United States Patent 7,745,391 (HUMAN THROMBOSPONDIN POLYPEPTIDE) - sequence listing, part 119

SEQ ID NO: 341802 - DNA, 1617 bp, Homo sapiens
agtcagtcactgcatcgggtccatctgtacaactctctccgtttctccgtctctctccctccctccctccctccacccccccaatctttttctccccatctctccatctctctcttatctcttcaggaagagcctaaaaggcggcaacaccaacacctcttgacatggaaatacactgatacaataggcaaaaggaaacactcgattgcatcttcccggttccaggtggccttatttgggagattctatactgaccttattcctgtgatggaggatactggcatccagcgaggcatctgggatggagatgccaaggctgtccaacaatgtctgacagatatttttaccagcgtttacaccacctgcgacatccctgagaatgctatatttggtccctgtgtcctgagccatacttccctatatgacagcatagctttcatagctctcaagtctactgacaagagaacagtaccgtatatctttcgggtagacacctcagcagcaaatggttcctcagaaggtctcatgtggctgcggttggtccaatcggccagagataaggaagagcagaaccttgaagcctacataaaaaacggacagctgttctaccgctctctccgcaggattgccaaagacgaggagttactagtttggtacgggaaagaactgactgagttactcttgctctgcccctctagatcccacaacaaaatgaatgggtcgtccccttacacatgcctggaatgcagccaacgtttccagtttgagttcccctatgtggcgcatctgcgtttccgctgccccaagagacttcacagcgctgatataagtccccaagacgaacaaggcggcggcgtgggcaccaaggaccacgggggcggcggcggcggtggcaaagaccagcagcagcagcagcaggaggcacctttaggcccgggtcccaagttttgcaaagccggccccctccaccactacccatccccctccccggaaagcagcaacccatccgctgccgccggcggcagcagcgcgaagccatccacagacttccacaacctggccagggagctggaaaactcccggggaggcagcagctgctccccagcccagagcctcagcagcggtagcggcagcggcggcggcggcggccaccaggaggcggagctgagtcccgacggcatcgccacgggcggcggcaaaggaaagaggaaattcccggaggaggcggcggagggcggcggtggcgctggtctggtagggggccggggccgcttcgtagagcggcccctcccggcctccaaggaggatctggtgtgcacaccgcagcagtaccgagcctcgggcagctacttcggcctggaagagaacggccgcctcttcgcgccgccaagtcccgagacgggcgaggcgaagcgcagcgccttcgtggaggtgaagaaggctgcccgcgcggccagcctgcaggaggaggggacagccgacggcgcgggagtcgcctccgaggaccaggacgctggcggcggcggcggctcctccacgcccgcggccgcgtcaccggtgggcgccgagaagctgctggccccgcggcctgggggcccgctgcccagccggctcgag

SEQ ID NO: 341803 - DNA, 2429 bp, Homo sapiens
aggctggtacggatcgcggatttaaggcatggcgtcccgcccccgccccggggaacgctgcctctgccgcaaagatgcccccttccgctggaaagcgatactatcaaatcagcctgggaagcatcttttcgctcagcaagttcaagagaacaaatatgttacaatccttgcctattcttgcctccacttcataatgtcataaaagccacctggggtgtcatttatcaacctctctccagcccactcttccaaaataacactacagtttcctacatgtgtatttttgccaggactccaaagagccttgctaaagtggaacaagcaaaatcctcccctggcctcctgggactgcagtcaccaggctgtcaaagcctcaataccccactgagttccagagaagggtctcaaagctgggagaggatcaaactaacatggagtagagaattgaactgtgaaaaagaagcccgagattccccagcgacgtggtgttgcagccccgttgaaggagtcaacttgcaggctgttaaagacctcaagtcattagcatcagctgctgcactaaaggggcaagtcagcgcctctaagtggcttagcgcacaaacgaggctcccgagacggcctcggcaactccatcccctcctccaccacccgctggatgtgaaaagctttccggagcccatcttgggggaagcttggtagtgttggcgctcctgaagagagacgacgcccgtttatcacccccaggcaactagctgcgcaaatcagcggtggctccagggctagagaatccctggagctaaccgcacccctctccctttcacggaacgcggactccggggaaatacgcacggggtccgcacgcgctgggtgtccagctctctgtcacagcttctccaagtgcctagtgaaacggggaaaggccctctccaatcattttggaagagcctaaaaggcggcaacaccaacacctcttgacatggaaatacactgatacaataggcaaaaggaaacactcgattgcatcttcccggttccaggtggccttatttgggagattctatactgaccttattcctgtgatggaggatactggcatccagcgaggcatctgggatggagatgccaaggctgtccaacaatgtctgacagatatttttaccagcgtttacaccacctgcgacatccctgagaatgctatatttggtccctgtgtcctgagccatacttccctatatgacagcatagctttcatagctctcaagtctactgacaagagaacagtaccgtatatctttcgggtagacacctcagcagcaaatggttcctcagaaggtctcatgtggctgcggttggtccaatcggccagagataaggaagagcagaaccttgaagcctacataaaaaacggacagctgttctaccgctctctccgcaggattgccaaagacgaggagttactagtttggtacgggaaagaactgactgagttactcttgctctgcccctctagatcccacaacaaaatgaatgggtcgtccccttacacatgcctggaatgcagccaacgtttccagtttgagttcccctatgtggcgcatctgcgtttccgctgccccaagagacttcacagcgctgatataagtccccaagacgaacaaggcggcggcgtgggcaccaaggaccacgggggcggcggcggcggtggcaaagaccagcagcagcagcagcaggaggcacctttaggcccgggtcccaagttttgcaaagccggccccctccaccactacccatccccctccccggaaagcagcaacccatccgctgccgccggcggcagcagcgcgaagccatccacagacttccacaacctggccagggagctggaaaactcccggggaggcagcagctgctccccagcccagagcctcagcagcggtagcggcagcggcggcggcggcggccaccaggaggcggagctgagtcccgacggcatcgccacgggcggcggcaaaggaaagaggaaattcccggaggaggcggcggagggcggcggtggcgctggtctggtagggggccggggccgcttcgtagagcggcccctcccggcctccaaggaggatctggtgtgcacaccgcagcagtaccgagcctcgggcagctacttcggcctggaagagaacggccgcctcttcgcgccgccaagtcccgagacgggcgaggcgaagcgcagcgccttcgtggaggtgaagaaggctgcccgcgcggccagcctgcaggaggaggggacagccgacggcgcgggagtcgcctccgaggaccaggacgctggcggcggcggcggctcctccacgcccgcggccgcgtcaccggtgggcgccgagaagctgctggccccgcggcctgggggcccgctgcccagccggctcgag

SEQ ID NO: 341804 - DNA, 2055 bp, Homo sapiens
gcggccgccgaggggcccgcagtagctgcgctcccggggaaggagccccacagtccccaggagtagagaattgaactgtgaaaaagaagcccgagattccccagcgacgtggtgttgcagccccgttgaaggagtcaacttgcaggctgttaaagacctcaagtcattagcatcagctgctgcactaaaggggcaagtcagcgcctctaagtggcttagcgcacaaacgaggctcccgagacggcctcggcaactccatcccctcctccaccacccgctggatgtgaaaagctttccggagcccatcttgggggaagcttggtagtgttggcgctcctgaagagagacgacgcccgtttatcacccccaggcaactagctgcgcaaatcagcggtggctccagggctagagaatccctggagctaaccgcacccctctccctttcacggaacgcggactccggggaaatacgcacggggtccgcacgcgctgggtgtccagctctctgtcacagcttctccaagtgcctagtgaaacggggaaaggccctctccaatcattttggaagagcctaaaaggcggcaacaccaacacctcttgacatggaaatacactgatacaataggcaaaaggaaacactcgattgcatcttcccggttccaggtggccttatttgggagattctatactgaccttattcctgtgatggaggatactggcatccagcgaggcatctgggatggagatgccaaggctgtccaacaatgtctgacagatatttttaccagcgtttacaccacctgcgacatccctgagaatgctatatttggtccctgtgtcctgagccatacttccctatatgacagcatagctttcatagctctcaagtctactgacaagagaacagtaccgtatatctttcgggtagacacctcagcagcaaatggttcctcagaaggtctcatgtggctgcggttggtccaatcggccagagataaggaagagcagaaccttgaagcctacataaaaaacggacagctgttctaccgctctctccgcaggattgccaaagacgaggagttactagtttggtacgggaaagaactgactgagttactcttgctctgcccctctagatcccacaacaaaatgaatgggtcgtccccttacacatgcctggaatgcagccaacgtttccagtttgagttcccctatgtggcgcatctgcgtttccgctgccccaagagacttcacagcgctgatataagtccccaagacgaacaaggcggcggcgtgggcaccaaggaccacgggggcggcggcggcggtggcaaagaccagcagcagcagcagcaggaggcacctttaggcccgggtcccaagttttgcaaagccggccccctccaccactacccatccccctccccggaaagcagcaacccatccgctgccgccggcggcagcagcgcgaagccatccacagacttccacaacctggccagggagctggaaaactcccggggaggcagcagctgctccccagcccagagcctcagcagcggtagcggcagcggcggcggcggcggccaccaggaggcggagctgagtcccgacggcatcgccacgggcggcggcaaaggaaagaggaaattcccggaggaggcggcggagggcggcggtggcgctggtctggtagggggccggggccgcttcgtagagcggcccctcccggcctccaaggaggatctggtgtgcacaccgcagcagtaccgagcctcgggcagctacttcggcctggaagagaacggccgcctcttcgcgccgccaagtcccgagacgggcgaggcgaagcgcagcgccttcgtggaggtgaagaaggctgcccgcgcggccagcctgcaggaggaggggacagccgacggcgcgggagtcgcctccgaggaccaggacgctggcggcggcggcggctcctccacgcccgcggccgcgtcaccggtgggcgccgagaagctgctggccccgcggcctgggggcccgctgcccagccggctcgag

SEQ ID NO: 341805 - DNA, 2011 bp, Homo sapiens
ggatttgtcaaggggatggtggcaaactggcttgggggcgatgctgagtaatcatgtggtgtgcgtgtgtgtgtgtgtgtgcgtgcgtgcgtgtgtgtggtgtttgctcactaagcagggtcgtccccttacacatgcctggaatgcagccaacgtttccagtttgagttccccgcgtcggacgagcgcaaaagcgccttctcgcagccagcacgctctttctcgcagctgtccccgctggtgctgggccagaagctgggcgcgctcgagccatgccaccccgccgacggcgtgggccccaccagactctatcccgccgccgcggaccctctagcggtgaagctccagggggccgcggacctgaacggaggttgcgggtccctgccgagcggcggcggcggcctgcctaagcagagccccttcctgtacgccaccgccttctggcccaagagctccgctgccgctgcagccgcggctgcggcggcggccgcggggcccttgcagctgcagctgccctcggcgctcacgctgctgccgccctccttcacctcgctgtgtctgcccgcgcagaactggtgcgccaagtgcaatgcctccttccgcatgacctccgacctggtgtaccatatgaggtcgcaccacaaaaaggagtatgcgatggagcccttggtgaagcggcggcgagaggagaaactcaagtgccccatctgcaatgagtccttcagggagcgccaccacctctccaggcacatgacctcgcataattgactcggaaaggaccccagctttccacgcgcgcgcaagcacagttaagccacctgcaggaataaacacgcgagaacatccaccgcttccttgcaccccgaaaccctgcacaaagacacatacattcaccgcccccccgcccccccaacgcgcacacacacgtcctctcctcccaggaacctcattcaaatatttacccgggacacacacccccccccacacacacacacagacacactcacacacaagagccaggatggtggagttttgattgggtgggttgtttgagggggttttcttttgaatgcacgcattttcactttccccaaaacaaaggtacattttttaaaatgtcatatattgcaacatattgatgcatttgtcatacgtttctacttaaattattaagcacttacgatttagatgtaataattatatgtaagggcaaaatttattttagatataaagtaaaggaggagggtgagatgctttctgcatttcttgatgacagtttgtgttcctacaaaaataaacaaaatgaataaaaagggatcaccattcaatttgagtttccagggggaagtgcatgtataatgaaatgataatggacttcaatgaagaatgtcatcaattatgtacatatgtattttcttttaatacaaagtgtaattttgtgccagtgaaatggagtctgaatagttatgtgtttcttttatccctggaaatatttattaaactttatagtttatccgagtatgttggatgctttgacaataaatgactattttcttcaaagcaaaaaaaaaaataaaaataaaaaaaaaaaaaaaaaaaaaaaaaaaaaaaaaaaaaaaaaaaaaaaaaaaaaaaaaaaaaaaaaaaaaaactttggggcccgtttggcccaatcgatttttaaattgggccagttttttcattgggcccgaattcggggttaattggccaaattccccttaaggggggccgtttacaatttaatggcccgtggtttaaaacggtcggattgggaaaaccctgggggtaaccaaattaaaacgcttggaagaaaatccccttttggcaggtgggggaaaaagcaaaaggccccgaccggatggcctttccaaaaatttgccaaccttgatggccaaaggaaatttgaaggcgtaaatttttggataaaattggggtaaatttttggttaacaagtttttttttaacccaaagggccgaaatgggctccttt

SEQ ID NO: 341806 - DNA, 1742 bp, Homo sapiens
aggctggtacggatcgcggatttaaggcatggcgtcccgcccccgccccggggaacgctgcctctgccgcaaagatgcccccttccgctggaaagcggtgcctccctgggtgctcgcgaaagcagccctgagaatggcagctctcagaggttgaagtcattcttttcgggggacggggcacggcgactgtttgattgggggacttgttttcctacaatttcacaaaaagcctcgctagaggaatgtgcaaggacagaagggaaactgaggagacccgcaactcattagcgaaataatagggtgcacttcaataaaaatgcggtcctgaagtggagcagactcaccggcaaggagcccggaaaatcgtcaggggcggcggcaaaatactatcaaatcagcctgggaagcatcttttcgctcagcaagttcaagagaacaaatatgttacaatccttgcctattcttgcctccacttcataatgtcataaaagccacctggggtgtcatttatcaacctctctccagcccactcttccaaaataacactacagtttcctacatgtgtatttttgccaggactccaaagagccttgctaaagtggaacaagcaaaatcctcccctggcctcctgggactgcagtcaccaggctgtcaaagcctcaataccccactgagttccagagaagggtctcaaagctgggagaggatcaaactaacatggagtagagaattgaactgtgaaaaagaagcccgagattccccagcgacgtggtgttgcagccccgttgaaggagtcaacttgcaggctgttaaagacctcaagtcattagcatcagctgctgcactaaaggggcaagtcagcgcctctaagtggcttagcgcacaaacgaggctcccgagacggcctcggcaactccatcccctcctccaccacccgctggatgtgaaaagctttccggagcccatcttgggggaagcttggtagtgttggcgctcctgaagagagacgacgcccgtttatcacccccaggcaactagctgcgcaaatcagcggtggctccagggctagagaatccctggagctaaccgcacccctctccctttcacggaacgcggactccggggaaatacgcacggggtccgcacgcgctgggtgtccagctctctgtcacagcttctccaagtgcctagtgaaacggggaaaggccctctccaatcattttggaagagcctaaaaggcggcaacaccaacacctcttgacatggaaatacactgatacaataggcaaaaggaaacactcgattgcatcttcccggttccaggtggccttatttgggagattctatactgaccttattcctgtgatggaggatactggcatccagcgaggcatctgggatggagatgccaaggctgtccaacaatgtctgacagatatttttaccagcgtttacaccacctcccacagccgaccaggctcaacgcacacaacagcattccctggcagtaccaccatgccaggcgtcagtcaggaatctacagcttcccacagcagcccaggctccacagacacaacattgtcccctggcagtaccacagcatcatcccttggtccagaatctactactttccacagcagcccaggctccactgaaacaacactcttacctgacaacaccacacctcaggcctccttgaagcatctacgcccgtccacaatgcacgtgatcaggatcctcaa

SEQ ID NO: 341807 - DNA, 2880 bp, Homo sapiens
acactgggctccggcggccagagtgggggactaggtgaagcggcgccgggccggggctggccgggaccaggcccgaggctgagcggcggcgacagcggtggccgggaggggggaggagaggcgcagccagaggagccgccgcagtagctcccccgcctcccgggctgagggcggaaagaaaacatgcatatatgattttcttctgatgaaacctaatgtattcaagaaaaagaatcttgctttttggaaggatggaaaaattgggaataattttttcccctttgataattagaccactcagtactgttgcttagtttttggttcagttactttgatgtggttacaagaggaattttggctgtaatggatttcatacatttttaatgtctaatttaatagggatatagacagttggtttaaaccaacatttttggacgaggagaggctatggaaatgaagaaagaagtgtttagaaatatcacacaaacagcattttaagaaagaaagatggatcaacctagtggaagaagtttcatgcaagtattatgtgaaaaatatagtcctgaaaattttccttatcgccgtggcccggggatgggagtccatgtcccagccacacctcagggctctcctatgaaagatcgcctcaacctcccaagtgtactagtgttgaacagctgtggaataacctgtgcaggagatgaaaaagaaattgctgctttctgcgctcatgtgtcggaactagatctttctgacaacaaactcgaagactggcatgaggtttgcagtcctgggaagacattgataaactaaattcatttcccaaactggaagaagtgagattgttaggaattcctcttctgcagccatataccaccgaggagcgaaggaaattggtaatagccagattgccatcagtttccaaacttaatggcagcgttgttactgatggtgaacgagaagattctgagagattttttattcgttactatgtggatgttccacaggaagaagtgccattcaggtatcatgaactgatcactaaatatgggaagttggagcctttggcagaagtggacctaagaccccagagcagtgcaaaagtagaagtccactttaacgatcaggtggaagaaatgagcattcgtctggaccaaacagtggcagaactaaagaaacagttaaaaactctagtacaattacccacaagcaacatgcttctctactattttgaccatgaagcaccctttggcccagaggaaatgaagtacagctctcgggcattgcattcctttggcattagggatggagataaaatttacgtggaatccaaaacaaaataacctctaccagccttgtgaaaaacatacacataaggacttgttgcagggcatttgtttttaatgtggttttctttaggagggagaggttgtttttgttttgttttgttctgtttaggtttgggaaggattttgtatatttttccccctggagtgagtaggggccatttttgggtgttttctaccacagattgatttggctcagccagcggaattggccacatttccagtgtatgtgccctctctaaggaaagatgacaaagaaatcaccgacttcttactgtgttcactgggatttgcctgccacttggttatcattactgttgggtgaacctgtgaagataacatgaacactgtagccccttagaagggtctcatagagaatttaaacagggtgacaaggaatcttcacaggaagggccagaacttctctctcccagttcttccttccgctaccctccctccttggcttttttggttcagttccatttttttttcattttgacatgtggtttacctaatagttttgttctgttcataattcttatttctcaacctgggtgatttttttgttctcatttctcccttttgaaataattgaaagtgttttaagcatttttaacctgattctaatctcaggtacgcagtaagaagctataactctgttagaacctcgaagagtagatgtagaatgaaaactccaggaaaacttgcagttattctggaagcaccggcagaacagtctgatctctttgtatgttactaactcacttttaatgtccctgtacattatgtcagccattactttcataacatgaaatatgtcagattccagagttcttttatttttgcttattgaatgtatttcctcatatctttctttttcattactttaaactattgggaattgaggcctgacttcataaataattcaatagagtcctggatacgtgcaccaggagagttgagaattagctcataaactatctgtggtgtgtgtggggaatgaagttgggggatgtgggggaagagcttatgactttcccacctgtgtcatccattggaagcccttgctcttgcactttgcattaaaagtgggaaacattaatcaaagggagattttattcccaggttttccctgggactttgtgatatcataattgaacagttcttttgttttacatttcaatttagttgcctcatagaagtataactgcccaatctatgagtaaagtgtaagtgtcaaaactttacaattgcctccaagtcatattttttgcagaagcacatttaaagcacttttctgtaaaagctagttccttacctgcttggaaatctttttgtttgttcttctattcctttgttaatcagatgtaatccctttctttaatgtgtatttttcttggtccaccatgtttacaggtgggagacttgagagatacttagcataactggggcagaaagtgtgtaagtgaagtatttttcaaagaatgcagttattatcctgattgccatttgaccttttgacctttgttacata

SEQ ID NO: 341808 - DNA, 5148 bp, Homo sapiens
acactgggctccggcggccagagtgggggactaggtgaagcggcgccgggccggggctggccgggaccaggcccgaggctgagcggcggcgacagcggtggccgggaggggggaggagaggcgcagccagaggagccgccgcagtagctcccccgcctcccgggctgagggcggaaagaaaacatgcatatatgattttcttctgatgaaacctaatgtattcaagaaaaagaatcttgctttttggaaggatggaaaaattgggaataattttttcccctttgataattagaccactcagtactgttgcttagtttttggttcagttactttgatgtggttacaagaggaattttggctgtaatggatttcatacatttttgtaagttatgtttccatgtctcgtgtgtgatgttgtgtactgttgacatgaaatactccttttttggtaaagatggattggcttaacagattagagctacagaaagtatgacttagcacgctggtaaggccacaaaaacccaagcaagttcccccagtttcgtatcctgtaaatagagataagttagtttttctgtttcagagagtggttatggaaaactactaggctttaaaatgattgttaatctcagtgtggggacatttggtttggggacatcagttcaggagtaaatgtatctgatcctgctttgaataaatgcaacttgaaagccttggaattttaccagatcgaatctgggccaaatagaaagaatgtctaatttaatagggatatagacagttggtttaaaccaacatttttggacgaggagaggctatggaaatgaagaaagaagtgtttagaaatatcacacaaacagcattttaagaaagaaagatggatcaacctagtggaagaagtttcatgcaagtattatgtgaaaaatatagtcctgaaaattttccttatcgccgtggcccggggatgggagtccatgtcccagccacacctcagggctctcctatgaaagatcgcctcaacctcccaagtgtactagtgttgaacagctgtggaataacctgtgcaggagatgaaaaagaaattgctgctttctgcgctcatgtgtcggaactagatctttctgacaacaaactcgaagactggcatgaggtcagtaaaattgtgtcaaatgttcctcagttggagtttctaaacctgagttccaaccctctgaatttgtcggttttagaaagaacatgtgctgggtccttctctggggttcgcaaacttgtcctcaacaacagcaaagcttcttgggagacggtccacatgatactacaggagttaccagatttggaggagctcttcctgtgccttaatgactatgaaacagtgtcttgtccttctatttgctgtcattctcttaagctactacatataacagacaataacctccaagactggactgaaatacgaaagttaggagttatgtttccttcactggataccctcgtcctggccaacaatcatttgaatgctattgaggagcctgatgattcattggccaggttgtttcctaatcttcgatccatcagcctccacaagtcaggtttgcagtcctgggaagacattgataaactaaattcatttcccaaactggaagaagtgagattgttaggaattcctcttctgcagccatataccaccgaggagcgaaggaaattggtaatagccagattgccatcagtttccaaacttaatggcagcgttgttactgatggtgaacgagaagattctgagagattttttattcgttactatgtggatgttccacaggaagaagtgccattcaggtatcatgaactgatcactaaatatgggaagttggagcctttggcagaagtggacctaagaccccagagcagtgcaaaagtagaagtccactttaacgatcaggtggaagaaatgagcattcgtctggaccaaacagtggcagaactaaagaaacagttaaaaactctagtacaattacccacaagcaacatgcttctctactattttgaccatgaagcaccctttggcccagaggaaatgaagtacagctctcgggcattgcattcctttggcattagggatggagataaaatttacgtggaatccaaaacaaaataacctctaccagccttgtgaaaaacatacacataaggacttgttgcagggcatttgtttttaatgtggttttctttaggagggagaggttgtttttgttttgttttgttctgtttaggtttgggaaggattttgtatatttttccccctggagtgagtaggggccatttttgggtgttttctaccacagattgatttggctcagccagcggaattggccacatttccagtgtatgtgccctctctaaggaaagatgacaaagaaatcaccgacttcttactgtgttcactgggatttgcctgccacttggttatcattactgttgggtgaacctgtgaagataacatgaacactgtagccccttagaagggtctcatagagaatttaaacagggtgacaaggaatcttcacaggaagggccagaacttctctctcccagttcttccttccgctaccctccctccttggcttttttggttcagttccatttttttttcattttgacatgtggtttacctaatagttttgttctgttcataattcttatttctcaacctgggtgatttttttgttctcatttctcccttttgaaataattgaaagtgttttaagcatttttaacctgattctaatctcaggtacgcagtaagaagctataactctgttagaacctcgaagagtagatgtagaatgaaaactccaggaaaacttgcagttattctggaagcaccggcagaacagtctgatctctttgtatgttactaactcacttttaatgtccctgtacattatgtcagccattactttcataacatgaaatatgtcagattccagagttcttttatttttgcttattgaatgtatttcctcatatctttctttttcattactttaaactattgggaattgaggcctgacttcataaataattcaatagagtcctggatacgtgcaccaggagagttgagaattagctcataaactatctgtggtgtgtgtggggaatgaagttgggggatgtgggggaagagcttatgactttcccacctgtgtcatccattggaagcccttgctcttgcactttgcattaaaagtgggaaacattaatcaaagggagattttatctttcaaaatcataaaaatgagcaatggagatccaggctgggtatagacaagaataattattttgcaaacacattttcctgacagatttttggaagtaggaaaaaagtatggcaacagtgtcatgaagattgaaactgtaggtgctttgtgtatgtatgcatgagtgcagatgagtttgagagagaaaaagtgtaattgagccctttgcttttgtcagcctgggaaacagatgcgttcttattttttgaagttgtgtgaccctggactgtcccacagcagaaggcagaacaaacacttatgttatgctttaatcataagtggaatggtcacaattaataagatattttatatatggcaaagttttatgaaatgcttttttactattagagacctgtttcttctgttattacagaacacagtgtttatcaactgcggacataattcttttattatacagttgcatgtaaagggagcttctcatttaattcagcggatgtgggtatttttagggcattgtaattgatggttttaataattgctgaataatttttgattaagagaaaaatgtaatacaattactggtctgagttacagaacagaagttaatgaaaaaggctatttgagcatgtgtacttatagattcatttgggtggctgagaaaagatgctgcttttgaaataaaattggtgctgtgtagacacttgtaaccaaaattatttttataacagaactaaaagaaggagagaagaggccatggacctttgagtttacatgttatacctaattgattgtctgcagcttatctgtattttaatattgactttgtccagattcagtgagaacatagtattgacattatgaggcaaaatgctgtcatagccagtattactgatatgttgctacagacacaatgtatagaacataccttttctaaaataggaattatttccagttatgaaaaaggaaaagagtaataaagaaaaccaaatcaaaaccaagggatcctttctacatgtgggtgaacggctgctaaagccacagtagaaaccaatttttgaatttgaattgttgaaatatcctagattgctttaatggaaaaaatccagagtcacatatcttttttattatcaagtttttgcagccttttgccagcattgccataaatacgtaagaaagcagcagatagtataagcccctagttattaagacttctcagttaatattaaggccaaaatataacttgagctaggtataacagggctgaatgctacagtgttgtttttaaagattttgcttatttttaaagacaggaaaattcagttctaaccagatgttccagctatgttactcaaccagcagtggtaggagcagagagcacttgcactaagagctgatcaccatttgagatacgcggcttaacgcacatgtgagtgtagcttgctacatgaaaatgctaggctctagggcatgtaaaacatgaatacagaatactagattgttctaagtaatgtcatttcggtttgtgaatttgatttttcccttcatttcatgtcatattgaaaatgcaaacaaactgctctcaagaacacccagaagctatctgtgttaccagatgtgttgtgaacactctactatttttcataggtgcttccttgaaatatatgtccattgtagtggtggagagggactggactctctcaggctctttacttgccagttgtctcccgcagttaatggaaatatatatacatatatatatatattttatttagaatataatttaaacatgaaggtctattctttgcactttttattaatatatatatagataatctttaaaaaaattaaaattcaagtccattttaaaaaaaaa

SEQ ID NO: 341809 - DNA, 4380 bp, Homo sapiens
acactgggctccggcggccagagtgggggactaggtgaagcggcgccgggccggggctggccgggaccaggcccgaggctgagcggcggcgacagcggtggccgggaggggggaggagaggcgcagccagaggagccgccgcagtagctcccccgcctcccgggctgagggcattttaagaaagaaagatggatcaacctagtggaagaagtttcatgcaagtattatgtgaaaaatatagtcctgaaaattttccttatcgccgtggcccggggatgggagtccatgtcccagccacacctcagggctctcctatgaaagatcgcctcaacctcccaagtgtactagtgttgaacagctgtggaataacctgtgcaggagatgaaaaagaaattgctgctttctgcgctcatgtgtcggaactagatctttctgacaacaaactcgaagactggcatgagaaagaacatgtgctgggtccttctctggggttcgcaaacttgtcctcaacaacagcaaagcttcttgggagacggtccacatgatactacaggagttaccagatttggaggagctcttcctgtgccttaatgactatgaaacagtgtcttgtccttctatttgctgtcattctcttaagctactacatataacagacaataacctccaagactggactgaaatacgaaagttaggagttatgtttccttcactggataccctcgtcctggccaacaatcatttgaatgctattgaggagcctgatgattcattggccaggttgtttcctaatcttcgatccatcagcctccacaagtcaggtttgcagtcctgggaagacattgataaactaaattcatttcccaaactggaagaagtgagattgttaggaattcctcttctgcagccatataccaccgaggagcgaaggaaattggtaatagccagattgccatcagtttccaaacttaatggcagcgttgttactgatggtgaacgagaagattctgagagattttttattcgttactatgtggatgttccacaggaagaagtgccattcaggtatcatgaactgatcactaaatatgggaagttggagcctttggcagaagtggacctaagaccccagagcagtgcaaaagtagaagtccactttaacgatcaggtggaagaaatgagcattcgtctggaccaaacagtggcagaactaaagaaacagttaaaaactctagtacaattacccacaagcaacatgcttctctactattttgaccatgaagcaccctttggcccagaggaaatgaagtacagctctcgggcattgcattcctttggcattagggatggagataaaatttacgtggaatccaaaacaaaataacctctaccagccttgtgaaaaacatacacataaggacttgttgcagggcatttgtttttaatgtggttttctttaggagggagaggttgtttttgttttgttttgttctgtttaggtttgggaaggattttgtatatttttccccctggagtgagtaggggccatttttgggtgttttctaccacagattgatttggctcagccagcggaattggccacatttccagtgtatgtgccctctctaaggaaagatgacaaagaaatcaccgacttcttactgtgttcactgggatttgcctgccacttggttatcattactgttgggtgaacctgtgaagataacatgaacactgtagccccttagaagggtctcatagagaatttaaacagggtgacaaggaatcttcacaggaagggccagaacttctctctcccagttcttccttccgctaccctccctccttggcttttttggttcagttccatttttttttcattttgacatgtggtttacctaatagttttgttctgttcataattcttatttctcaacctgggtgatttttttgttctcatttctcccttttgaaataattgaaagtgttttaagcatttttaacctgattctaatctcaggtacgcagtaagaagctataactctgttagaacctcgaagagtagatgtagaatgaaaactccaggaaaacttgcagttattctggaagcaccggcagaacagtctgatctctttgtatgttactaactcacttttaatgtccctgtacattatgtcagccattactttcataacatgaaatatgtcagattccagagttcttttatttttgcttattgaatgtatttcctcatatctttctttttcattactttaaactattgggaattgaggcctgacttcataaataattcaatagagtcctggatacgtgcaccaggagagttgagaattagctcataaactatctgtggtgtgtgtggggaatgaagttgggggatgtgggggaagagcttatgactttcccacctgtgtcatccattggaagcccttgctcttgcactttgcattaaaagtgggaaacattaatcaaagggagattttatctttcaaaatcataaaaatgagcaatggagatccaggctgggtatagacaagaataattattttgcaaacacattttcctgacagatttttggaagtaggaaaaaagtatggcaacagtgtcatgaagattgaaactgtaggtgctttgtgtatgtatgcatgagtgcagatgagtttgagagagaaaaagtgtaattgagccctttgcttttgtcagcctgggaaacagatgcgttcttattttttgaagttgtgtgaccctggactgtcccacagcagaaggcagaacaaacacttatgttatgctttaatcataagtggaatggtcacaattaataagatattttatatatggcaaagttttatgaaatgcttttttactattagagacctgtttcttctgttattacagaacacagtgtttatcaactgcggacataattcttttattatacagttgcatgtaaagggagcttctcatttaattcagcggatgtgggtatttttagggcattgtaattgatggttttaataattgctgaataatttttgattaagagaaaaatgtaatacaattactggtctgagttacagaacagaagttaatgaaaaaggctatttgagcatgtgtacttatagattcatttgggtggctgagaaaagatgctgcttttgaaataaaattggtgctgtgtagacacttgtaaccaaaattatttttataacagaactaaaagaaggagagaagaggccatggacctttgagtttacatgttatacctaattgattgtctgcagcttatctgtattttaatattgactttgtccagattcagtgagaacatagtattgacattatgaggcaaaatgctgtcatagccagtattactgatatgttgctacagacacaatgtatagaacataccttttctaaaataggaattatttccagttatgaaaaaggaaaagagtaataaagaaaaccaaatcaaaaccaagggatcctttctacatgtgggtgaacggctgctaaagccacagtagaaaccaatttttgaatttgaattgttgaaatatcctagattgctttaatggaaaaaatccagagtcacatatcttttttattatcaagtttttgcagccttttgccagcattgccataaatacgtaagaaagcagcagatagtataagcccctagttattaagacttctcagttaatattaaggccaaaatataacttgagctaggtataacagggctgaatgctacagtgttgtttttaaagattttgcttatttttaaagacaggaaaattcagttctaaccagatgttccagctatgttactcaaccagcagtggtaggagcagagagcacttgcactaagagctgatcaccatttgagatacgcggcttaacgcacatgtgagtgtagcttgctacatgaaaatgctaggctctagggcatgtaaaacatgaatacagaatactagattgttctaagtaatgtcatttcggtttgtgaatttgatttttcccttcatttcatgtcatattgaaaatgcaaacaaactgctctcaagaacacccagaagctatctgtgttaccagatgtgttgtgaacactctactatttttcataggtgcttccttgaaatatatgtccattgtagtggtggagagggactggactctctcaggctctttacttgccagttgtctcccgcagttaatggaaatatatatacatatatatatatattttatttagaatataatttaaacatgaaggtctattctttgcactttttattaatatatatatagataatctttaaaaaaattaaaattcaagtccattttaaaaaaaaa

SEQ ID NO: 341810 - DNA, 4778 bp, Homo sapiens
acactgggctccggcggccagagtgggggactaggtgaagcggcgccgggccggggctggccgggaccaggcccgaggctgagcggcggcgacagcggtggccgggaggggggaggagaggcgcagccagaggagccgccgcagtagctcccccgcctcccgggctgagggcggaaagaaaacatgcatatatgattttcttctgatgaaacctaatgtattcaagaaaaagaatcttgctttttggaaggatggaaaaattgggaataattttttcccctttgataattagaccactcagtactgttgcttagtttttggttcagttactttgatgtggttacaagaggaattttggctgtaatggatttcatacatttttaatgtctaatttaatagggatatagacagttggtttaaaccaacatttttggacgaggagaggctatggaaatgaagaaagaagtgtttagaaatatcacacaaacagcattttaagaaagaaagatggatcaacctagtggaagaagtttcatgcaagtattatgtgaaaaatatagtcctgaaaattttccttatcgccgtggcccggggatgggagtccatgtcccagccacacctcagggctctcctatgaaagatcgcctcaacctcccaagtgtactagtgttgaacagctgtggaataacctgtgcaggagatgaaaaagaaattgctgctttctgcgctcatgtgtcggaactagatctttctgacaacaaactcgaagactggcatgaggtcagtaaaattgtgtcaaatgttcctcagttggagtttctaaacctgagttccaaccctctgaatttgtcggttttagaaagaacatgtgctgggtccttctctggggttcgcaaacttgtcctcaacaacagcaaagcttcttgggagacggtccacatgatactacaggagttaccagatttggaggagctcttcctgtgccttaatgactatgaaacagtgtcttgtccttctatttgctgtcattctcttaagctactacatataacagacaataacctccaagactggactgaaatacgaaagttaggagttatgtttccttcactggataccctcgtcctggccaacaatcatttgaatgctattgaggagcctgatgattcattggccaggttgtttcctaatcttcgatccatcagcctccacaagtcaggtttgcagtcctgggaagacattgataaactaaattcatttcccaaactggaagaagtgagattgttaggaattcctcttctgcagccatataccaccgaggagcgaaggaaattggtaatagccagattgccatcagtttccaaacttaatggcagcgttgttactgatggtgaacgagaagattctgagagattttttattcgttactatgtggatgttccacaggaagaagtgccattcaggtatcatgaactgatcactaaatatgggaagttggagcctttggcagaagtggacctaagaccccagagcagtgcaaaagtagaagtccactttaacgatcaggtggaagaaatgagcattcgtctggaccaaacagtggcagaactaaagaaacagttaaaaactctagtacaattacccacaagcaacatgcttctctactattttgaccatgaagcaccctttggcccagaggaaatgaagtacagctctcgggcattgcattcctttggcattagggatggagataaaatttacgtggaatccaaaacaaaataacctctaccagccttgtgaaaaacatacacataaggacttgttgcagggcatttgtttttaatgtggttttctttaggagggagaggttgtttttgttttgttttgttctgtttaggtttgggaaggattttgtatatttttccccctggagtgagtaggggccatttttgggtgttttctaccacagattgatttggctcagccagcggaattggccacatttccagtgtatgtgccctctctaaggaaagatgacaaagaaatcaccgacttcttactgtgttcactgggatttgcctgccacttggttatcattactgttgggtgaacctgtgaagataacatgaacactgtagccccttagaagggtctcatagagaatttaaacagggtgacaaggaatcttcacaggaagggccagaacttctctctcccagttcttccttccgctaccctccctccttggcttttttggttcagttccatttttttttcattttgacatgtggtttacctaatagttttgttctgttcataattcttatttctcaacctgggtgatttttttgttctcatttctcccttttgaaataattgaaagtgttttaagcatttttaacctgattctaatctcaggtacgcagtaagaagctataactctgttagaacctcgaagagtagatgtagaatgaaaactccaggaaaacttgcagttattctggaagcaccggcagaacagtctgatctctttgtatgttactaactcacttttaatgtccctgtacattatgtcagccattactttcataacatgaaatatgtcagattccagagttcttttatttttgcttattgaatgtatttcctcatatctttctttttcattactttaaactattgggaattgaggcctgacttcataaataattcaatagagtcctggatacgtgcaccaggagagttgagaattagctcataaactatctgtggtgtgtgtggggaatgaagttgggggatgtgggggaagagcttatgactttcccacctgtgtcatccattggaagcccttgctcttgcactttgcattaaaagtgggaaacattaatcaaagggagattttatctttcaaaatcataaaaatgagcaatggagatccaggctgggtatagacaagaataattattttgcaaacacattttcctgacagatttttggaagtaggaaaaaagtatggcaacagtgtcatgaagattgaaactgtaggtgctttgtgtatgtatgcatgagtgcagatgagtttgagagagaaaaagtgtaattgagccctttgcttttgtcagcctgggaaacagatgcgttcttattttttgaagttgtgtgaccctggactgtcccacagcagaaggcagaacaaacacttatgttatgctttaatcataagtggaatggtcacaattaataagatattttatatatggcaaagttttatgaaatgcttttttactattagagacctgtttcttctgttattacagaacacagtgtttatcaactgcggacataattcttttattatacagttgcatgtaaagggagcttctcatttaattcagcggatgtgggtatttttagggcattgtaattgatggttttaataattgctgaataatttttgattaagagaaaaatgtaatacaattactggtctgagttacagaacagaagttaatgaaaaaggctatttgagcatgtgtacttatagattcatttgggtggctgagaaaagatgctgcttttgaaataaaattggtgctgtgtagacacttgtaaccaaaattatttttataacagaactaaaagaaggagagaagaggccatggacctttgagtttacatgttatacctaattgattgtctgcagcttatctgtattttaatattgactttgtccagattcagtgagaacatagtattgacattatgaggcaaaatgctgtcatagccagtattactgatatgttgctacagacacaatgtatagaacataccttttctaaaataggaattatttccagttatgaaaaaggaaaagagtaataaagaaaaccaaatcaaaaccaagggatcctttctacatgtgggtgaacggctgctaaagccacagtagaaaccaatttttgaatttgaattgttgaaatatcctagattgctttaatggaaaaaatccagagtcacatatcttttttattatcaagtttttgcagccttttgccagcattgccataaatacgtaagaaagcagcagatagtataagcccctagttattaagacttctcagttaatattaaggccaaaatataacttgagctaggtataacagggctgaatgctacagtgttgtttttaaagattttgcttatttttaaagacaggaaaattcagttctaaccagatgttccagctatgttactcaaccagcagtggtaggagcagagagcacttgcactaagagctgatcaccatttgagatacgcggcttaacgcacatgtgagtgtagcttgctacatgaaaatgctaggctctagggcatgtaaaacatgaatacagaatactagattgttctaagtaatgtcatttcggtttgtgaatttgatttttcccttcatttcatgtcatattgaaaatgcaaacaaactgctctcaagaacacccagaagctatctgtgttaccagatgtgttgtgaacactctactatttttcataggtgcttccttgaaatatatgtccattgtagtggtggagagggactggactctctcaggctctttacttgccagttgtctcccgcagttaatggaaatatatatacatatatatatatattttatttagaatataatttaaacatgaaggtctattctttgcactttttattaatatatatatagataatctttaaaaaaattaaaattcaagtccattttaaaaaaaaa

SEQ ID NO: 341811 - DNA, 4020 bp, Homo sapiens
acactgggctccggcggccagagtgggggactaggtgaagcggcgccgggccggggctggccgggaccaggcccgaggctgagcggcggcgacagcggtggccgggaggggggaggagaggcgcagccagaggagccgccgcagtagctcccccgcctcccgggctgagggcattttaagaaagaaagatggatcaacctagtggaagaagtttcatgcaagtattatgtgaaaaatatagtcctgaaaattttccttatcgccgtggcccggggatgggagtccatgtcccagccacacctcagggctctcctatgaaagatcgcctcaacctcccaagtgtactagtgttgaacagctgtggaataacctgtgcaggagatgaaaaagaaattgctgctttctgcgctcatgtgtcggaactagatctttctgacaacaaactcgaagactggcatgaggtttgcagtcctgggaagacattgataaactaaattcatttcccaaactggaagaagtgagattgttaggaattcctcttctgcagccatataccaccgaggagcgaaggaaattggtaatagccagattgccatcagtttccaaacttaatggcagcgttgttactgatggtgaacgagaagattctgagagattttttattcgttactatgtggatgttccacaggaagaagtgccattcaggtatcatgaactgatcactaaatatgggaagttggagcctttggcagaagtggacctaagaccccagagcagtgcaaaagtagaagtccactttaacgatcaggtggaagaaatgagcattcgtctggaccaaacagtggcagaactaaagaaacagttaaaaactctagtacaattacccacaagcaacatgcttctctactattttgaccatgaagcaccctttggcccagaggaaatgaagtacagctctcgggcattgcattcctttggcattagggatggagataaaatttacgtggaatccaaaacaaaataacctctaccagccttgtgaaaaacatacacataaggacttgttgcagggcatttgtttttaatgtggttttctttaggagggagaggttgtttttgttttgttttgttctgtttaggtttgggaaggattttgtatatttttccccctggagtgagtaggggccatttttgggtgttttctaccacagattgatttggctcagccagcggaattggccacatttccagtgtatgtgccctctctaaggaaagatgacaaagaaatcaccgacttcttactgtgttcactgggatttgcctgccacttggttatcattactgttgggtgaacctgtgaagataacatgaacactgtagccccttagaagggtctcatagagaatttaaacagggtgacaaggaatcttcacaggaagggccagaacttctctctcccagttcttccttccgctaccctccctccttggcttttttggttcagttccatttttttttcattttgacatgtggtttacctaatagttttgttctgttcataattcttatttctcaacctgggtgatttttttgttctcatttctcccttttgaaataattgaaagtgttttaagcatttttaacctgattctaatctcaggtacgcagtaagaagctataactctgttagaacctcgaagagtagatgtagaatgaaaactccaggaaaacttgcagttattctggaagcaccggcagaacagtctgatctctttgtatgttactaactcacttttaatgtccctgtacattatgtcagccattactttcataacatgaaatatgtcagattccagagttcttttatttttgcttattgaatgtatttcctcatatctttctttttcattactttaaactattgggaattgaggcctgacttcataaataattcaatagagtcctggatacgtgcaccaggagagttgagaattagctcataaactatctgtggtgtgtgtggggaatgaagttgggggatgtgggggaagagcttatgactttcccacctgtgtcatccattggaagcccttgctcttgcactttgcattaaaagtgggaaacattaatcaaagggagattttatctttcaaaatcataaaaatgagcaatggagatccaggctgggtatagacaagaataattattttgcaaacacattttcctgacagatttttggaagtaggaaaaaagtatggcaacagtgtcatgaagattgaaactgtaggtgctttgtgtatgtatgcatgagtgcagatgagtttgagagagaaaaagtgtaattgagccctttgcttttgtcagcctgggaaacagatgcgttcttattttttgaagttgtgtgaccctggactgtcccacagcagaaggcagaacaaacacttatgttatgctttaatcataagtggaatggtcacaattaataagatattttatatatggcaaagttttatgaaatgcttttttactattagagacctgtttcttctgttattacagaacacagtgtttatcaactgcggacataattcttttattatacagttgcatgtaaagggagcttctcatttaattcagcggatgtgggtatttttagggcattgtaattgatggttttaataattgctgaataatttttgattaagagaaaaatgtaatacaattactggtctgagttacagaacagaagttaatgaaaaaggctatttgagcatgtgtacttatagattcatttgggtggctgagaaaagatgctgcttttgaaataaaattggtgctgtgtagacacttgtaaccaaaattatttttataacagaactaaaagaaggagagaagaggccatggacctttgagtttacatgttatacctaattgattgtctgcagcttatctgtattttaatattgactttgtccagattcagtgagaacatagtattgacattatgaggcaaaatgctgtcatagccagtattactgatatgttgctacagacacaatgtatagaacataccttttctaaaataggaattatttccagttatgaaaaaggaaaagagtaataaagaaaaccaaatcaaaaccaagggatcctttctacatgtgggtgaacggctgctaaagccacagtagaaaccaatttttgaatttgaattgttgaaatatcctagattgctttaatggaaaaaatccagagtcacatatcttttttattatcaagtttttgcagccttttgccagcattgccataaatacgtaagaaagcagcagatagtataagcccctagttattaagacttctcagttaatattaaggccaaaatataacttgagctaggtataacagggctgaatgctacagtgttgtttttaaagattttgcttatttttaaagacaggaaaattcagttctaaccagatgttccagctatgttactcaaccagcagtggtaggagcagagagcacttgcactaagagctgatcaccatttgagatacgcggcttaacgcacatgtgagtgtagcttgctacatgaaaatgctaggctctagggcatgtaaaacatgaatacagaatactagattgttctaagtaatgtcatttcggtttgtgaatttgatttttcccttcatttcatgtcatattgaaaatgcaaacaaactgctctcaagaacacccagaagctatctgtgttaccagatgtgttgtgaacactctactatttttcataggtgcttccttgaaatatatgtccattgtagtggtggagagggactggactctctcaggctctttacttgccagttgtctcccgcagttaatggaaatatatatacatatatatatatattttatttagaatataatttaaacatgaaggtctattctttgcactttttattaatatatatatagataatctttaaaaaaattaaaattcaagtccattttaaaaaaaaa

SEQ ID NO: 341812 - DNA, 2097 bp, Homo sapiens
ttcttcatgtatgaggagttgtgtttattaatgctactttttaaattttcctgtgccatgtggcagatgtttattctcttaatgcacttcaggtttgctatctgtaaagcctttgacccaggcctactgagtcaaatctacattcagtgtaacattaaaggtggaaaccaaagggtttgagaaagacgaataaggcctattctccttctgctgcagactttatctttcaaaatcataaaaatgagcaatggagatccaggctgggtatagacaagaataattattttgcaaacacattttcctgacagatttttggaagtaggaaaaaagtatggcaacagtgtcatgaagattgaaactgtaggtgctttgtgtatgtatgcatgagtgcagatgagtttgagagagaaaaagtgtaattgagccctttgcttttgtcagcctgggaaacagatgcgttcttattttttgaagttgtgtgaccctggactgtcccacagcagaaggcagaacaaacacttatgttatgctttaatcataagtggaatggtcacaattaataagatattttatatatggcaaagttttatgaaatgcttttttactattagagacctgtttcttctgttattacagaacacagtgtttatcaactgcggacataattcttttattatacagttgcatgtaaagggagcttctcatttaattcagcggatgtgggtatttttagggcattgtaattgatggttttaataattgctgaataatttttgattaagagaaaaatgtaatacaattactggtctgagttacagaacagaagttaatgaaaaaggctatttgagcatgtgtacttatagattcatttgggtggctgagaaaagatgctgcttttgaaataaaattggtgctgtgtagacacttgtaaccaaaattatttttataacagaactaaaagaaggagagaagaggccatggacctttgagtttacatgttatacctaattgattgtctgcagcttatctgtattttaatattgactttgtccagattcagtgagaacatagtattgacattatgaggcaaaatgctgtcatagccagtattactgatatgttgctacagacacaatgtatagaacataccttttctaaaataggaattatttccagttatgaaaaaggaaaagagtaataaagaaaaccaaatcaaaaccaagggatcctttctacatgtgggtgaacggctgctaaagccacagtagaaaccaatttttgaatttgaattgttgaaatatcctagattgctttaatggaaaaaatccagagtcacatatcttttttattatcaagtttttgcagccttttgccagcattgccataaatacgtaagaaagcagcagatagtataagcccctagttattaagacttctcagttaatattaaggccaaaatataacttgagctaggtataacagggctgaatgctacagtgttgtttttaaagattttgcttatttttaaagacaggaaaattcagttctaaccagatgttccagctatgttactcaaccagcagtggtaggagcagagagcacttgcactaagagctgatcaccatttgagatacgcggcttaacgcacatgtgagtgtagcttgctacatgaaaatgctaggctctagggcatgtaaaacatgaatacagaatactagattgttctaagtaatgtcatttcggtttgtgaatttgatttttcccttcatttcatgtcatattgaaaatgcaaacaaactgctctcaagaacacccagaagctatctgtgttaccagatgtgttgtgaacactctactatttttcataggtgcttccttgaaatatatgtccattgtagtggtggagagggactggactctctcaggctctttacttgccagttgtctcccgcagttaatggaaatatatatacatatatatatatattttatttagaatataatttaaacatgaaggtctattctttgcactttttattaatatatatatagataatctttaaaaaaattaaaattcaagtccattttaaaaaaaaa

SEQ ID NO: 341813 - DNA, 822 bp, Homo sapiens
acactgggctccggcggccagagtgggggactaggtgaagcggcgccgggccggggctggccgggaccaggcccgaggctgagcggcggcgacagcggtggccgggaggggggaggagaggcgcagccagaggagccgccgcagtagctcccccgcctcccgggctgagggcggaaagaaaacatgcatatatgattttcttctgatgaaacctaatgtattcaagaaaaagaatcttgctttttggaaggatggaaaaattgggaataattttttcccctttgataattagaccactcagtactgttgcttagtttttggttcagttactttgatgtggttacaagaggaattttggctgtaatggatttcatacatttttgtaagttatgtttccatgtctcgtgtgtgatgttgtgtactgttgacatgaaatactccttttttggtaaagatggattggcttaacagattagagctacagaaagtatgacttagcacgctggtaaggccacaaaaacccaagcaagttcccccagtttcgtatcctgtaaatagagataagttagtttttctgtttcagagagtggttatggaaaactactaggctttaaaatgattgttaatctcagtgtggggacatttggtttggggacatcagttcaggagtaaatgtatctgatcctgctttgaataaatgcaacttgaaagccttggaattttaccagatcgaatctgggccaaatagaaaggtaggagtagatgtaaatttgtttgtaaaggagttggggatgtgtgtggtggggcagagtgagggtggag

SEQ ID NO: 341814 - DNA, 5040 bp, Homo sapiens
acactgggctccggcggccagagtgggggactaggtgaagcggcgccgggccggggctggccgggaccaggcccgaggctgagcggcggcgacagcggtggccgggaggggggaggagaggcgcagccagaggagccgccgcagtagctcccccgcctcccgggctgagggcggaaagaaaacatgcatatatgattttcttctgatgaaacctaatgtattcaagaaaaagaatcttgctttttggaaggatggaaaaattgggaataattttttcccctttgataattagaccactcagtactgttgcttagtttttggttcagttactttgatgtggttacaagaggaattttggctgtaatggatttcatacatttttgtaagttatgtttccatgtctcgtgtgtgatgttgtgtactgttgacatgaaatactccttttttggtaaagatggattggcttaacagattagagctacagaaagtatgacttagcacgctggtaaggccacaaaaacccaagcaagttcccccagtttcgtatcctgtaaatagagataagttagtttttctgtttcagagagtggttatggaaaactactaggctttaaaatgattgttaatctcagtgtggggacatttggtttggggacatcagttcaggagtaaatgtatctgatcctgctttgaataaatgcaacttgaaagccttggaattttaccagatcgaatctgggccaaatagaaagcattttaagaaagaaagatggatcaacctagtggaagaagtttcatgcaagtattatgtgaaaaatatagtcctgaaaattttccttatcgccgtggcccggggatgggagtccatgtcccagccacacctcagggctctcctatgaaagatcgcctcaacctcccaagtgtactagtgttgaacagctgtggaataacctgtgcaggagatgaaaaagaaattgctgctttctgcgctcatgtgtcggaactagatctttctgacaacaaactcgaagactggcatgaggtcagtaaaattgtgtcaaatgttcctcagttggagtttctaaacctgagttccaaccctctgaatttgtcggttttagaaagaacatgtgctgggtccttctctggggttcgcaaacttgtcctcaacaacagcaaagcttcttgggagacggtccacatgatactacaggagttaccagatttggaggagctcttcctgtgccttaatgactatgaaacagtgtcttgtccttctatttgctgtcattctcttaagctactacatataacagacaataacctccaagactggactgaaatacgaaagttaggagttatgtttccttcactggataccctcgtcctggccaacaatcatttgaatgctattgaggagcctgatgattcattggccaggttgtttcctaatcttcgatccatcagcctccacaagtcaggtttgcagtcctgggaagacattgataaactaaattcatttcccaaactggaagaagtgagattgttaggaattcctcttctgcagccatataccaccgaggagcgaaggaaattggtaatagccagattgccatcagtttccaaacttaatggcagcgttgttactgatggtgaacgagaagattctgagagattttttattcgttactatgtggatgttccacaggaagaagtgccattcaggtatcatgaactgatcactaaatatgggaagttggagcctttggcagaagtggacctaagaccccagagcagtgcaaaagtagaagtccactttaacgatcaggtggaagaaatgagcattcgtctggaccaaacagtggcagaactaaagaaacagttaaaaactctagtacaattacccacaagcaacatgcttctctactattttgaccatgaagcaccctttggcccagaggaaatgaagtacagctctcgggcattgcattcctttggcattagggatggagataaaatttacgtggaatccaaaacaaaataacctctaccagccttgtgaaaaacatacacataaggacttgttgcagggcatttgtttttaatgtggttttctttaggagggagaggttgtttttgttttgttttgttctgtttaggtttgggaaggattttgtatatttttccccctggagtgagtaggggccatttttgggtgttttctaccacagattgatttggctcagccagcggaattggccacatttccagtgtatgtgccctctctaaggaaagatgacaaagaaatcaccgacttcttactgtgttcactgggatttgcctgccacttggttatcattactgttgggtgaacctgtgaagataacatgaacactgtagccccttagaagggtctcatagagaatttaaacagggtgacaaggaatcttcacaggaagggccagaacttctctctcccagttcttccttccgctaccctccctccttggcttttttggttcagttccatttttttttcattttgacatgtggtttacctaatagttttgttctgttcataattcttatttctcaacctgggtgatttttttgttctcatttctcccttttgaaataattgaaagtgttttaagcatttttaacctgattctaatctcaggtacgcagtaagaagctataactctgttagaacctcgaagagtagatgtagaatgaaaactccaggaaaacttgcagttattctggaagcaccggcagaacagtctgatctctttgtatgttactaactcacttttaatgtccctgtacattatgtcagccattactttcataacatgaaatatgtcagattccagagttcttttatttttgcttattgaatgtatttcctcatatctttctttttcattactttaaactattgggaattgaggcctgacttcataaataattcaatagagtcctggatacgtgcaccaggagagttgagaattagctcataaactatctgtggtgtgtgtggggaatgaagttgggggatgtgggggaagagcttatgactttcccacctgtgtcatccattggaagcccttgctcttgcactttgcattaaaagtgggaaacattaatcaaagggagattttatctttcaaaatcataaaaatgagcaatggagatccaggctgggtatagacaagaataattattttgcaaacacattttcctgacagatttttggaagtaggaaaaaagtatggcaacagtgtcatgaagattgaaactgtaggtgctttgtgtatgtatgcatgagtgcagatgagtttgagagagaaaaagtgtaattgagccctttgcttttgtcagcctgggaaacagatgcgttcttattttttgaagttgtgtgaccctggactgtcccacagcagaaggcagaacaaacacttatgttatgctttaatcataagtggaatggtcacaattaataagatattttatatatggcaaagttttatgaaatgcttttttactattagagacctgtttcttctgttattacagaacacagtgtttatcaactgcggacataattcttttattatacagttgcatgtaaagggagcttctcatttaattcagcggatgtgggtatttttagggcattgtaattgatggttttaataattgctgaataatttttgattaagagaaaaatgtaatacaattactggtctgagttacagaacagaagttaatgaaaaaggctatttgagcatgtgtacttatagattcatttgggtggctgagaaaagatgctgcttttgaaataaaattggtgctgtgtagacacttgtaaccaaaattatttttataacagaactaaaagaaggagagaagaggccatggacctttgagtttacatgttatacctaattgattgtctgcagcttatctgtattttaatattgactttgtccagattcagtgagaacatagtattgacattatgaggcaaaatgctgtcatagccagtattactgatatgttgctacagacacaatgtatagaacataccttttctaaaataggaattatttccagttatgaaaaaggaaaagagtaataaagaaaaccaaatcaaaaccaagggatcctttctacatgtgggtgaacggctgctaaagccacagtagaaaccaatttttgaatttgaattgttgaaatatcctagattgctttaatggaaaaaatccagagtcacatatcttttttattatcaagtttttgcagccttttgccagcattgccataaatacgtaagaaagcagcagatagtataagcccctagttattaagacttctcagttaatattaaggccaaaatataacttgagctaggtataacagggctgaatgctacagtgttgtttttaaagattttgcttatttttaaagacaggaaaattcagttctaaccagatgttccagctatgttactcaaccagcagtggtaggagcagagagcacttgcactaagagctgatcaccatttgagatacgcggcttaacgcacatgtgagtgtagcttgctacatgaaaatgctaggctctagggcatgtaaaacatgaatacagaatactagattgttctaagtaatgtcatttcggtttgtgaatttgatttttcccttcatttcatgtcatattgaaaatgcaaacaaactgctctcaagaacacccagaagctatctgtgttaccagatgtgttgtgaacactctactatttttcataggtgcttccttgaaatatatgtccattgtagtggtggagagggactggactctctcaggctctttacttgccagttgtctcccgcagttaatggaaatatatatacatatatatatatattttatttagaatataatttaaacatgaaggtctattctttgcactttttattaatatatatatagataatctttaaaaaaattaaaattcaagtccattttaaaaaaaaa

SEQ ID NO: 341815 - DNA, 4123 bp, Homo sapiens
acactgggctccggcggccagagtgggggactaggtgaagcggcgccgggccggggctggccgggaccaggcccgaggctgagcggcggcgacagcggtggccgggaggggggaggagaggcgcagccagaggagccgccgcagtagctcccccgcctcccgggctgagggcattttaagaaagaaagatggatcaacctagtggaagaagtttcatgcaagtattatgtgaaaaatatagtcctgaaaattttccttatcgccgtggcccggggatgggagtccatgtcccagccacacctcagggctctcctatgaaagatcgcctcaacctcccaagtgtactagtgttgaacagctgtggaataacctgtgcaggagatgaaaaagaaattgctgctttctgcgctcatgtgtcggaactagatctttctgacaacaaactcgaagactggcatgagaaagaacatgtgctgggtccttctctggggttcgcaaacttgtcctcaacaacagcaaagcttcttgggagacggtccacatgatactacaggagttaccagagtttgcagtcctgggaagacattgataaactaaattcatttcccaaactggaagaagtgagattgttaggaattcctcttctgcagccatataccaccgaggagcgaaggaaattggtaatagccagattgccatcagtttccaaacttaatggcagcgttgttactgatggtgaacgagaagattctgagagattttttattcgttactatgtggatgttccacaggaagaagtgccattcaggtatcatgaactgatcactaaatatgggaagttggagcctttggcagaagtggacctaagaccccagagcagtgcaaaagtagaagtccactttaacgatcaggtggaagaaatgagcattcgtctggaccaaacagtggcagaactaaagaaacagttaaaaactctagtacaattacccacaagcaacatgcttctctactattttgaccatgaagcaccctttggcccagaggaaatgaagtacagctctcgggcattgcattcctttggcattagggatggagataaaatttacgtggaatccaaaacaaaataacctctaccagccttgtgaaaaacatacacataaggacttgttgcagggcatttgtttttaatgtggttttctttaggagggagaggttgtttttgttttgttttgttctgtttaggtttgggaaggattttgtatatttttccccctggagtgagtaggggccatttttgggtgttttctaccacagattgatttggctcagccagcggaattggccacatttccagtgtatgtgccctctctaaggaaagatgacaaagaaatcaccgacttcttactgtgttcactgggatttgcctgccacttggttatcattactgttgggtgaacctgtgaagataacatgaacactgtagccccttagaagggtctcatagagaatttaaacagggtgacaaggaatcttcacaggaagggccagaacttctctctcccagttcttccttccgctaccctccctccttggcttttttggttcagttccatttttttttcattttgacatgtggtttacctaatagttttgttctgttcataattcttatttctcaacctgggtgatttttttgttctcatttctcccttttgaaataattgaaagtgttttaagcatttttaacctgattctaatctcaggtacgcagtaagaagctataactctgttagaacctcgaagagtagatgtagaatgaaaactccaggaaaacttgcagttattctggaagcaccggcagaacagtctgatctctttgtatgttactaactcacttttaatgtccctgtacattatgtcagccattactttcataacatgaaatatgtcagattccagagttcttttatttttgcttattgaatgtatttcctcatatctttctttttcattactttaaactattgggaattgaggcctgacttcataaataattcaatagagtcctggatacgtgcaccaggagagttgagaattagctcataaactatctgtggtgtgtgtggggaatgaagttgggggatgtgggggaagagcttatgactttcccacctgtgtcatccattggaagcccttgctcttgcactttgcattaaaagtgggaaacattaatcaaagggagattttatctttcaaaatcataaaaatgagcaatggagatccaggctgggtatagacaagaataattattttgcaaacacattttcctgacagatttttggaagtaggaaaaaagtatggcaacagtgtcatgaagattgaaactgtaggtgctttgtgtatgtatgcatgagtgcagatgagtttgagagagaaaaagtgtaattgagccctttgcttttgtcagcctgggaaacagatgcgttcttattttttgaagttgtgtgaccctggactgtcccacagcagaaggcagaacaaacacttatgttatgctttaatcataagtggaatggtcacaattaataagatattttatatatggcaaagttttatgaaatgcttttttactattagagacctgtttcttctgttattacagaacacagtgtttatcaactgcggacataattcttttattatacagttgcatgtaaagggagcttctcatttaattcagcggatgtgggtatttttagggcattgtaattgatggttttaataattgctgaataatttttgattaagagaaaaatgtaatacaattactggtctgagttacagaacagaagttaatgaaaaaggctatttgagcatgtgtacttatagattcatttgggtggctgagaaaagatgctgcttttgaaataaaattggtgctgtgtagacacttgtaaccaaaattatttttataacagaactaaaagaaggagagaagaggccatggacctttgagtttacatgttatacctaattgattgtctgcagcttatctgtattttaatattgactttgtccagattcagtgagaacatagtattgacattatgaggcaaaatgctgtcatagccagtattactgatatgttgctacagacacaatgtatagaacataccttttctaaaataggaattatttccagttatgaaaaaggaaaagagtaataaagaaaaccaaatcaaaaccaagggatcctttctacatgtgggtgaacggctgctaaagccacagtagaaaccaatttttgaatttgaattgttgaaatatcctagattgctttaatggaaaaaatccagagtcacatatcttttttattatcaagtttttgcagccttttgccagcattgccataaatacgtaagaaagcagcagatagtataagcccctagttattaagacttctcagttaatattaaggccaaaatataacttgagctaggtataacagggctgaatgctacagtgttgtttttaaagattttgcttatttttaaagacaggaaaattcagttctaaccagatgttccagctatgttactcaaccagcagtggtaggagcagagagcacttgcactaagagctgatcaccatttgagatacgcggcttaacgcacatgtgagtgtagcttgctacatgaaaatgctaggctctagggcatgtaaaacatgaatacagaatactagattgttctaagtaatgtcatttcggtttgtgaatttgatttttcccttcatttcatgtcatattgaaaatgcaaacaaactgctctcaagaacacccagaagctatctgtgttaccagatgtgttgtgaacactctactatttttcataggtgcttccttgaaatatatgtccattgtagtggtggagagggactggactctctcaggctctttacttgccagttgtctcccgcagttaatggaaatatatatacatatatatatatattttatttagaatataatttaaacatgaaggtctattctttgcactttttattaatatatatatagataatctttaaaaaaattaaaattcaagtccattttaaaaaaaaa

SEQ ID NO: 341816 - DNA, 1014 bp, Homo sapiens
acactgggctccggcggccagagtgggggactaggtgaagcggcgccgggccggggctggccgggaccaggcccgaggctgagcggcggcgacagcggtggccgggaggggggaggagaggcgcagccagaggagccgccgcagtagctcccccgcctcccgggctgagggcggaaagaaaacatgcatatatgattttcttctgatgaaacctaatgtattcaagaaaaagaatcttgctttttggaaggatggaaaaattgggaataattttttcccctttgataattagaccactcagtactgttgcttagtttttggttcagttactttgatgtggttacaagaggaattttggctgtaatggatttcatacatttttaatgtctaatttaatagggatatagacagttggtttaaaccaacatttttggacgaggagaggctatggaaatgaagaaagaagtgtttagaaatatcacacaaacagcattttaagaaagaaagatggatcaacctagtggaagaagtttcatgcaagtattatgtgaaaaatatagtcctgaaaattttccttatcgccgtggcccggggatgggagtccatgtcccagccacacctcagggctctcctatgaaagatcgcctcaacctcccaagtgtactagtgttgaacagctgtggaataacctgtgcaggagatgaaaaagaaattgctgctttctgcgctcatgtgtcggaactagatctttctgacaacaaactcgaagactggcatgaggtgaagtttttatattgctacattttagtgaaaagcagcaataaccattgtgtcattgtttatgttattatatgttctgctaaattctgttctcacttgatgtctgtatgacttcttgttgtctgtatatcttattgtctgtatgtctttatatcaagataaataaggcctataatcccagtgctaaggaggctgaggcaggaggatcacttgagcccaggaattcaagaccag

SEQ ID NO: 341817 - DNA, 3991 bp, Homo sapiens
gcggccgcaccatcgactcgccaacgagagaaggtcctggggcacggacaccgacgggttgcgactgtgacgtgaggtgttctcgcgcgcgctagcgcgcgtctccgggtgccgctgacgggcgtgcgcgcttgtgcggagccggaggtgggggccgaaccagccaaggttgcgggggccgcagagccggacgaagacggagggcggagccggcttcgggactgcggagactacacaccgagcgagcgcctgggcccgaagggagcgatgctgtggttccagggcgccattccggccgccatcgcgacggccaaaaggagcggcgcggtcttcgtggtgttcgtggcaggtgatgatgaacagtctacacagatggctgcaagttgggaagatgataaagttacagaagcatcttcaaacagttttgttgctattaaaatcgataccaaaagtgaagcctgcctacagttttcacaaatctatcctgtagtgtgtgttccatccagtttctttattggagacagtggaattcccttggaagtaatagcaggaagtgtttctgcagatgaacttgttacaagaattcacaaggtccgacagatgcatttgctaaaaagtgaaacatcagtagcaaatggcagtcagtcagaaagttcagtgtctactccatctgcgtcatttgaacctaacaacacttgtgaaaactctcagtccagaaatgcagagctttgtgagataccacccacttctgatacaaagtcagatactgcaacaggaggagaaagtgcaggccatgccacttcctctcaggagcctagtggatgctcagatcagagacctgcagaggacctcaacatccgagtggaaagactaacaaaaaaacttgaagaaaggagagaagagaaaagaaaagaggaagaacagagagaaattaagaaggaaattgagaggagaaaaactggaaaagaaatgttggattataaaagaaaacaagaagaagaattaacaaaaagaatgctggaggaaagaaacagagagaaagcagaagatagggcagctcgagaacgtataaaacagcagattgcattggaccgtgcagagagagctgctcgttttgcaaagacaaaggaagaagtagaggctgccaaagctgctgccttgctagcaaaacaggcagaaatggaagtcaagagggaatcttatgcaagagaaagaagcactgttgcaagaattcaattccgtcttcctgatggttcttcctttacaaatcagttcccttctgatgctcctctagaagaggcaaggcagtttgctgcacagactgttggcaacacttacggtaatttttcgttagcaaccatgtttcccaggagggaatttaccaaagaagattataaaaagaagttactggatttggaacttgccccaagcgcttcggtggtactgttgccagtttgtttattaatttctaggcaggaagaccaactgcatccattgtacactcttccagcggagacatttggaccttgttgggaacagtgctttatccattccttgccatctggagattaattagcaatttcttgtttagtaatccgcctcccacacagacttcagtgagagtaacatcgtcagaacccccaaaccctgcatcatctagcaaatcagaaaaaagggaaccagtgagaaaaagagtgctggaaaaacgtggagacgactttaaaaaggaggggaaaatttatagattaaggactcaagatgatggtgaagatgaaaacaacacttggaatggaaattccactcaacagatgtagtgtgacaagtataatatgtgcaataatcattgtttctcttatgatttaattcaactaaaattctactggagaagtgggactgctttatattttccaactggtctataaaatgtctctttattcctgcttagtgggtgtgggttgaaggtgtttaactcagaaaagtaaagacaggaaataactctctgctaggtccttgcttatatggcaaccactgctagaaccctaaaagaaccaaaaatctgccacagcctgcctccatcagcttcttatttagtatttcatatgcccattagccctatgcttcagatgacacgttttgtttagagctactttgctccaagactcttaagcccaaagtaactggtatgtcactgagtaacttgactcggtgtcagagcattttaactagccactcagatgagaatttatgtttaacttctctttttactcatcagctgcaagcaaaatcttgtagtttttaatcttaaacactgaataaaaaaactttcccctaaattggaatgatcttagttttgctttgagttttgttatctagcatctttttgttgcacagggctctattgaggtcctatgtctctgatttttttttttccccagtattgccctggagctgtctctggaaagtagctggcgaggttaccttaactatcactgaagaaagaaattttctgacacactgatggcatgtgacttgtctcctaagtcagtgaggcatcactttgtttgcataaagtatacggtttgttaaggcctttgttcttgtgagatgcaaaacagctgctagtctgcaacctagttttccctctcacctttaactgacgttttgtcctcaataattacacaaggacctagagtacctataggacaaaaagtatagaataaaaatatgcctttagtcatttggtttttcttaaaaagttgagattcttaatctgacttacatgttactttatccgtatgtctttgttagtggagaccgctaaactaatgatgtttgaaaacagttcctctgttttagattggaagatagcactctagagtggacatacggaaagactgtgactttattttgtaatgggaggaagaaattttctcagagcaaactttctattttttacctgtgaaataacagtgactttttaaaatggtgacagtgttggcaaggaaacagcaacacaggctgcgctgttggtaggagtgaaaaccagtataattcttctgaaaaacatttatcagaaacttaaaatatttcataccgtttgatccagtagcttcttctaaatcataaatgcagacaatgtttaggtaaagacatactcattaagtgttatttattttactcaagaactggaaaccaactaaatgccttctatagaagtaatttttgatgaggagaaatggtacaatactaattaacaacttggtttaacatgtttactgagcatctgttaagtgttgggggaaaaagcagcaggatccagagctataggtacagtgtgatctcagctttgcaaacacattttctacatagatagtactaggtattaatagatatgtaaagaaagaaatcacaccattaataatggtaagattggtttatgtgattttagtggtatttttggcacccttatatatgttttccaaactttcagcagtgatattatttccataacttaaaaagtgagtttgaaaaagaaaatctccagcaagcatctcatttaaataaaggtttgtcatctttaaaaatacagcaatatgtgactttttaaaaaagctgtcaaataggtgtgaccctactaataattattagaaatacatttaaaaacatcgagtacctcaagtcagtttgccttgaaaaatatcaaatataactcttagagaaatgtacataaaagaatgcttcgtaattttggagtaggaggttccctcctcaattttgtatttttaaaaagtacatggtaaaaaaaaaaattcacaacagtatataaggctgtaaaatgagaattctgccccctcacctcttaccccagtactattctccagaggtaatctattaacaatttcttatgtaattttcagaaaatttgtatgcgtatataagcaaatatgtaatctttattttttaaataaatgggatcatattatatattcta

SEQ ID NO: 341818 - DNA, 4562 bp, Homo sapiens
gcggccgcaccatcgactcgccaacgagagaaggtcctggggcacggacaccgacgggttgcgactgtgacgtgaggtgttctcgcgcgcgctagcgcgcgtctccgggtgccgctgacgggcgtgcgcgcttgtgcggagccggaggtgggggccgaaccagccaaggttgcgggggccgcagagccggacgaagacggagggcggagccggcttcgggactgcggagactacacaccgagcgagcgcctgggcccgaagggagcgatgctgtggttccagggcgccattccggccgccatcgcgacggccaaaaggagcggcgcggtcttcgtggtgttcgtggcaggtgatgatgaacagtctacacagatggctgcaagttgggaagatgataaagttacagaagcatcttcaaacagttttgttgctattaaaatcgataccaaaagtgaagcctgcctacagttttcacaaatctgtatcctttcagtaaagaatggcttatatatatacatttatttaccttccttttggttaatttatgaaatttagaaattattcatttttatttaggaaatcatacattcttttttatggaaactttattactaagtgtcctcatttaaaaaaaatgttattataggaaatttcaaacatatataaaagtaactcaatggtgtagtgcaccccatacattgagataatatattgcagctaaagataggatagggagtttttaaaatgtgaatatctgaaaaacaatatagatcagttgggttggaatgttacaagtagcttgcaagaggcagctggcagcaagatggatagaaaaggaagttatgatagaggagaatgtagtagattcttcactagaatatacctcataaattaacatgtcacatgtattaatactacaggtataatgatgcagtacttgaaattatttaataaatgttagattatattgtgaaaatcacaaagatcatttgttttcctttgttaccaatagtgtttcgtaaaactatcctttcgtttcacatgaattgttagacttcattaaactgtacagatcctgtagtgtgtgttccatccagtttctttattggagacagtggaattcccttggaagtaatagcaggaagtgtttctgcagatgaacttgttacaagaattcacaaggtccgacagatgcatttgctaaaaagtgaaacatcagtagcaaatggcagtcagtcagaaagttcagtgtctactccatctgcgtcatttgaacctaacaacacttgtgaaaactctcagtccagaaatgcagagctttgtgagataccacccacttctgatacaaagtcagatactgcaacaggaggagaaagtgcaggccatgccacttcctctcaggagcctagtggatgctcagatcagagacctgcagaggacctcaacatccgagtggaaagactaacaaaaaaacttgaagaaaggagagaagagaaaagaaaagaggaagaacagagagaaattaagaaggaaattgagaggagaaaaactggaaaagaaatgttggattataaaagaaaacaagaagaagaattaacaaaaagaatgctggaggaaagaaacagagagaaagcagaagatagggcagctcgagaacgtataaaacagcagattgcattggaccgtgcagagagagctgctcgttttgcaaagacaaaggaagaagtagaggctgccaaagctgctgccttgctagcaaaacaggcagaaatggaagtcaagagggaatcttatgcaagagaaagaagcactgttgcaagaattcaattccgtcttcctgatggttcttcctttacaaatcagttcccttctgatgctcctctagaagaggcaaggcagtttgctgcacagactgttggcaacacttacggtaatttttcgttagcaaccatgtttcccaggagggaatttaccaaagaagattataaaaagaagttactggatttggaacttgccccaagcgcttcggtggtactgttgccagcaggaagaccaactgcatccattgtacactcttccagcggagacatttggaccttgttgggaacagtgctttatccattccttgccatctggagattaattagcaatttcttgtttagtaatccgcctcccacacagacttcagtgagagtaacatcgtcagaacccccaaaccctgcatcatctagcaaatcagaaaaaagggaaccagtgagaaaaagagtgctggaaaaacgtggagacgactttaaaaaggaggggaaaatttatagattaaggactcaagatgatggtgaagatgaaaacaacacttggaatggaaattccactcaacagatgtagtgtgacaagtataatatgtgcaataatcattgtttctcttatgatttaattcaactaaaattctactggagaagtgggactgctttatattttccaactggtctataaaatgtctctttattcctgcttagtgggtgtgggttgaaggtgtttaactcagaaaagtaaagacaggaaataactctctgctaggtccttgcttatatggcaaccactgctagaaccctaaaagaaccaaaaatctgccacagcctgcctccatcagcttcttatttagtatttcatatgcccattagccctatgcttcagatgacacgttttgtttagagctactttgctccaagactcttaagcccaaagtaactggtatgtcactgagtaacttgactcggtgtcagagcattttaactagccactcagatgagaatttatgtttaacttctctttttactcatcagctgcaagcaaaatcttgtagtttttaatcttaaacactgaataaaaaaactttcccctaaattggaatgatcttagttttgctttgagttttgttatctagcatctttttgttgcacagggctctattgaggtcctatgtctctgatttttttttttccccagtattgccctggagctgtctctggaaagtagctggcgaggttaccttaactatcactgaagaaagaaattttctgacacactgatggcatgtgacttgtctcctaagtcagtgaggcatcactttgtttgcataaagtatacggtttgttaaggcctttgttcttgtgagatgcaaaacagctgctagtctgcaacctagttttccctctcacctttaactgacgttttgtcctcaataattacacaaggacctagagtacctataggacaaaaagtatagaataaaaatatgcctttagtcatttggtttttcttaaaaagttgagattcttaatctgacttacatgttactttatccgtatgtctttgttagtggagaccgctaaactaatgatgtttgaaaacagttcctctgttttagattggaagatagcactctagagtggacatacggaaagactgtgactttattttgtaatgggaggaagaaattttctcagagcaaactttctattttttacctgtgaaataacagtgactttttaaaatggtgacagtgttggcaaggaaacagcaacacaggctgcgctgttggtaggagtgaaaaccagtataattcttctgaaaaacatttatcagaaacttaaaatatttcataccgtttgatccagtagcttcttctaaatcataaatgcagacaatgtttaggtaaagacatactcattaagtgttatttattttactcaagaactggaaaccaactaaatgccttctatagaagtaatttttgatgaggagaaatggtacaatactaattaacaacttggtttaacatgtttactgagcatctgttaagtgttgggggaaaaagcagcaggatccagagctataggtacagtgtgatctcagctttgcaaacacattttctacatagatagtactaggtattaatagatatgtaaagaaagaaatcacaccattaataatggtaagattggtttatgtgattttagtggtatttttggcacccttatatatgttttccaaactttcagcagtgatattatttccataacttaaaaagtgagtttgaaaaagaaaatctccagcaagcatctcatttaaataaaggtttgtcatctttaaaaatacagcaatatgtgactttttaaaaaagctgtcaaataggtgtgaccctactaataattattagaaatacatttaaaaacatcgagtacctcaagtcagtttgccttgaaaaatatcaaatataactcttagagaaatgtacataaaagaatgcttcgtaattttggagtaggaggttccctcctcaattttgtatttttaaaaagtacatggtaaaaaaaaaaattcacaacagtatataaggctgtaaaatgagaattctgccccctcacctcttaccccagtactattctccagaggtaatctattaacaatttcttatgtaattttcagaaaatttgtatgcgtatataagcaaatatgtaatctttattttttaaataaatgggatcatattatatattcta

SEQ ID NO: 341819 - DNA, 3005 bp, Homo sapiens
gcggccgcaccatcgactcgccaacgagagaaggtcctggggcacggacaccgacgggttgcgactgtgacgtgaggtgttctcgcgcgcgctagcgcgcgtctccgggtgccgctgacgggcgtgcgcgcttgtgcggagccggaggtgggggccgaaccagccaaggttgcgggggccgcagagccggacgaagacggagggcggagccggcttcgggactgcggagactacacaccgagcgagcgcctgggcccgaagggagcgatgctgtggttccagggcgccattccggccgccatcgcgacggccaaaaggagcggcgcggtcttcgtggtgttcgtggcaggtgatgatgaacagtctacacagatggctgcaagttgggaagatgataaagttacagaagcatcttcaaacagttttgttgctattaaaatcgataccaaaagtgaagcctgcctacagttttcacaaatctatcctgtagtgtgtgttccatccagtttctttattggagacagtggaattcccttggaagtaatagcaggaagtgtttctgcagatgaacttgttacaagaattcacaaggtccgacagatgcatttgctaaaaagtgaaacatcagtagcaaatggcagtcagtcagaaagttcagtgtctactccatctgcgtcatttgaacctaacaacacttgtgaaaactctcagtccagaaatgcagagctttgtgagataccacccacttctgatacaaagtcagatactgcaacaggaggagaaagtgcaggccatgccacttcctctcaggagcctagtggatgctcagatcagagacctgcagaggacctcaacatccgagtggaaagactaacaaaaaaacttgaagaaaggagagaagagaaaagaaaagaggaagaacagagagaaattaagaaggaaattgagaggagaaaaactggaaaagaaatgttggattataaaagaaaacaagaagaagaattaacaaaaagaatgtaggtccttgcttatatggcaaccactgctagaaccctaaaagaaccaaaaatctgccacagcctgcctccatcagcttcttatttagtatttcatatgcccattagccctatgcttcagatgacacgttttgtttagagctactttgctccaagactcttaagcccaaagtaactggtatgtcactgagtaacttgactcggtgtcagagcattttaactagccactcagatgagaatttatgtttaacttctctttttactcatcagctgcaagcaaaatcttgtagtttttaatcttaaacactgaataaaaaaactttcccctaaattggaatgatcttagttttgctttgagttttgttatctagcatctttttgttgcacagggctctattgaggtcctatgtctctgatttttttttttccccagtattgccctggagctgtctctggaaagtagctggcgaggttaccttaactatcactgaagaaagaaattttctgacacactgatggcatgtgacttgtctcctaagtcagtgaggcatcactttgtttgcataaagtatacggtttgttaaggcctttgttcttgtgagatgcaaaacagctgctagtctgcaacctagttttccctctcacctttaactgacgttttgtcctcaataattacacaaggacctagagtacctataggacaaaaagtatagaataaaaatatgcctttagtcatttggtttttcttaaaaagttgagattcttaatctgacttacatgttactttatccgtatgtctttgttagtggagaccgctaaactaatgatgtttgaaaacagttcctctgttttagattggaagatagcactctagagtggacatacggaaagactgtgactttattttgtaatgggaggaagaaattttctcagagcaaactttctattttttacctgtgaaataacagtgactttttaaaatggtgacagtgttggcaaggaaacagcaacacaggctgcgctgttggtaggagtgaaaaccagtataattcttctgaaaaacatttatcagaaacttaaaatatttcataccgtttgatccagtagcttcttctaaatcataaatgcagacaatgtttaggtaaagacatactcattaagtgttatttattttactcaagaactggaaaccaactaaatgccttctatagaagtaatttttgatgaggagaaatggtacaatactaattaacaacttggtttaacatgtttactgagcatctgttaagtgttgggggaaaaagcagcaggatccagagctataggtacagtgtgatctcagctttgcaaacacattttctacatagatagtactaggtattaatagatatgtaaagaaagaaatcacaccattaataatggtaagattggtttatgtgattttagtggtatttttggcacccttatatatgttttccaaactttcagcagtgatattatttccataacttaaaaagtgagtttgaaaaagaaaatctccagcaagcatctcatttaaataaaggtttgtcatctttaaaaatacagcaatatgtgactttttaaaaaagctgtcaaataggtgtgaccctactaataattattagaaatacatttaaaaacatcgagtacctcaagtcagtttgccttgaaaaatatcaaatataactcttagagaaatgtacataaaagaatgcttcgtaattttggagtaggaggttccctcctcaattttgtatttttaaaaagtacatggtaaaaaaaaaaattcacaacagtatataaggctgtaaaatgagaattctgccccctcacctcttaccccagtactattctccagaggtaatctattaacaatttcttatgtaattttcagaaaatttgtatgcgtatataagcaaatatgtaatctttattttttaaataaatgggatcatattatatattcta

SEQ ID NO: 341820 - DNA, 3917 bp, Homo sapiens
gcggccgcaccatcgactcgccaacgagagaaggtcctggggcacggacaccgacgggttgcgactgtgacgtgaggtgttctcgcgcgcgctagcgcgcgtctccgggtgccgctgacgggcgtgcgcgcttgtgcggagccggaggtgggggccgaaccagccaaggttgcgggggccgcagagccggacgaagacggagggcggagccggcttcgggactgcggagactacacaccgagcgagcgcctgggcccgaagggagcgatgctgtggttccagggcgccattccggccgccatcgcgacggccaaaaggagcggcgcggtcttcgtggtgttcgtggcaggtgatgatgaacagtctacacagatggctgcaagttgggaagatgataaagttacagaagcatcttcaaacagttttgttgctattaaaatcgataccaaaagtttctttattggagacagtggaattcccttggaagtaatagcaggaagtgtttctgcagatgaacttgttacaagaattcacaaggtccgacagatgcatttgctaaaaagtgaaacatcagtagcaaatggcagtcagtcagaaagttcagtgtctactccatctgcgtcatttgaacctaacaacacttgtgaaaactctcagtccagaaatgcagagctttgtgagataccacccacttctgatacaaagtcagatactgcaacaggaggagaaagtgcaggccatgccacttcctctcaggagcctagtggatgctcagatcagagacctgcagaggacctcaacatccgagtggaaagactaacaaaaaaacttgaagaaaggagagaagagaaaagaaaagaggaagaacagagagaaattaagaaggaaattgagaggagaaaaactggaaaagaaatgttggattataaaagaaaacaagaagaagaattaacaaaaagaatgctggaggaaagaaacagagagaaagcagaagatagggcagctcgagaacgtataaaacagcagattgcattggaccgtgcagagagagctgctcgttttgcaaagacaaaggaagaagtagaggctgccaaagctgctgccttgctagcaaaacaggcagaaatggaagtcaagagggaatcttatgcaagagaaagaagcactgttgcaagaattcaattccgtcttcctgatggttcttcctttacaaatcagttcccttctgatgctcctctagaagaggcaaggcagtttgctgcacagactgttggcaacacttacggtaatttttcgttagcaaccatgtttcccaggagggaatttaccaaagaagattataaaaagaagttactggatttggaacttgccccaagcgcttcggtggtactgttgccagcaggaagaccaactgcatccattgtacactcttccagcggagacatttggaccttgttgggaacagtgctttatccattccttgccatctggagattaattagcaatttcttgtttagtaatccgcctcccacacagacttcagtgagagtaacatcgtcagaacccccaaaccctgcatcatctagcaaatcagaaaaaagggaaccagtgagaaaaagagtgctggaaaaacgtggagacgactttaaaaaggaggggaaaatttatagattaaggactcaagatgatggtgaagatgaaaacaacacttggaatggaaattccactcaacagatgtagtgtgacaagtataatatgtgcaataatcattgtttctcttatgatttaattcaactaaaattctactggagaagtgggactgctttatattttccaactggtctataaaatgtctctttattcctgcttagtgggtgtgggttgaaggtgtttaactcagaaaagtaaagacaggaaataactctctgctaggtccttgcttatatggcaaccactgctagaaccctaaaagaaccaaaaatctgccacagcctgcctccatcagcttcttatttagtatttcatatgcccattagccctatgcttcagatgacacgttttgtttagagctactttgctccaagactcttaagcccaaagtaactggtatgtcactgagtaacttgactcggtgtcagagcattttaactagccactcagatgagaatttatgtttaacttctctttttactcatcagctgcaagcaaaatcttgtagtttttaatcttaaacactgaataaaaaaactttcccctaaattggaatgatcttagttttgctttgagttttgttatctagcatctttttgttgcacagggctctattgaggtcctatgtctctgatttttttttttccccagtattgccctggagctgtctctggaaagtagctggcgaggttaccttaactatcactgaagaaagaaattttctgacacactgatggcatgtgacttgtctcctaagtcagtgaggcatcactttgtttgcataaagtatacggtttgttaaggcctttgttcttgtgagatgcaaaacagctgctagtctgcaacctagttttccctctcacctttaactgacgttttgtcctcaataattacacaaggacctagagtacctataggacaaaaagtatagaataaaaatatgcctttagtcatttggtttttcttaaaaagttgagattcttaatctgacttacatgttactttatccgtatgtctttgttagtggagaccgctaaactaatgatgtttgaaaacagttcctctgttttagattggaagatagcactctagagtggacatacggaaagactgtgactttattttgtaatgggaggaagaaattttctcagagcaaactttctattttttacctgtgaaataacagtgactttttaaaatggtgacagtgttggcaaggaaacagcaacacaggctgcgctgttggtaggagtgaaaaccagtataattcttctgaaaaacatttatcagaaacttaaaatatttcataccgtttgatccagtagcttcttctaaatcataaatgcagacaatgtttaggtaaagacatactcattaagtgttatttattttactcaagaactggaaaccaactaaatgccttctatagaagtaatttttgatgaggagaaatggtacaatactaattaacaacttggtttaacatgtttactgagcatctgttaagtgttgggggaaaaagcagcaggatccagagctataggtacagtgtgatctcagctttgcaaacacattttctacatagatagtactaggtattaatagatatgtaaagaaagaaatcacaccattaataatggtaagattggtttatgtgattttagtggtatttttggcacccttatatatgttttccaaactttcagcagtgatattatttccataacttaaaaagtgagtttgaaaaagaaaatctccagcaagcatctcatttaaataaaggtttgtcatctttaaaaatacagcaatatgtgactttttaaaaaagctgtcaaataggtgtgaccctactaataattattagaaatacatttaaaaacatcgagtacctcaagtcagtttgccttgaaaaatatcaaatataactcttagagaaatgtacataaaagaatgcttcgtaattttggagtaggaggttccctcctcaattttgtatttttaaaaagtacatggtaaaaaaaaaaattcacaacagtatataaggctgtaaaatgagaattctgccccctcacctcttaccccagtactattctccagaggtaatctattaacaatttcttatgtaattttcagaaaatttgtatgcgtatataagcaaatatgtaatctttattttttaaataaatgggatcatattatatattcta

SEQ ID NO: 341821 - DNA, 3823 bp, Homo sapiens
gcggccgcaccatcgactcgccaacgagagaaggtcctggggcacggacaccgacgggttgcgactgtgacgtgaggtgttctcgcgcgcgctagcgcgcgtctccgggtgccgctgacgggcgtgcgcgcttgtgcggagccggaggtgggggccgaaccagccaaggttgcgggggccgcagagccggacgaagacggagggcggagccggcttcgggactgcggagactacacaccgagcgagcgcctgggcccgaagggagcgatgctgtggttccagggcgccattccggccgccatcgcgacggccaaaaggagcggcgcggtcttcgtggtgttcgtggcaggtgatgatgaacagtctacacagatggctgcaagttgggaagatgataaagttacagaagcatcttcaaacagttttgttgctattaaaatcgataccaaaagatgcatttgctaaaaagtgaaacatcagtagcaaatggcagtcagtcagaaagttcagtgtctactccatctgcgtcatttgaacctaacaacacttgtgaaaactctcagtccagaaatgcagagctttgtgagataccacccacttctgatacaaagtcagatactgcaacaggaggagaaagtgcaggccatgccacttcctctcaggagcctagtggatgctcagatcagagacctgcagaggacctcaacatccgagtggaaagactaacaaaaaaacttgaagaaaggagagaagagaaaagaaaagaggaagaacagagagaaattaagaaggaaattgagaggagaaaaactggaaaagaaatgttggattataaaagaaaacaagaagaagaattaacaaaaagaatgctggaggaaagaaacagagagaaagcagaagatagggcagctcgagaacgtataaaacagcagattgcattggaccgtgcagagagagctgctcgttttgcaaagacaaaggaagaagtagaggctgccaaagctgctgccttgctagcaaaacaggcagaaatggaagtcaagagggaatcttatgcaagagaaagaagcactgttgcaagaattcaattccgtcttcctgatggttcttcctttacaaatcagttcccttctgatgctcctctagaagaggcaaggcagtttgctgcacagactgttggcaacacttacggtaatttttcgttagcaaccatgtttcccaggagggaatttaccaaagaagattataaaaagaagttactggatttggaacttgccccaagcgcttcggtggtactgttgccagcaggaagaccaactgcatccattgtacactcttccagcggagacatttggaccttgttgggaacagtgctttatccattccttgccatctggagattaattagcaatttcttgtttagtaatccgcctcccacacagacttcagtgagagtaacatcgtcagaacccccaaaccctgcatcatctagcaaatcagaaaaaagggaaccagtgagaaaaagagtgctggaaaaacgtggagacgactttaaaaaggaggggaaaatttatagattaaggactcaagatgatggtgaagatgaaaacaacacttggaatggaaattccactcaacagatgtagtgtgacaagtataatatgtgcaataatcattgtttctcttatgatttaattcaactaaaattctactggagaagtgggactgctttatattttccaactggtctataaaatgtctctttattcctgcttagtgggtgtgggttgaaggtgtttaactcagaaaagtaaagacaggaaataactctctgctaggtccttgcttatatggcaaccactgctagaaccctaaaagaaccaaaaatctgccacagcctgcctccatcagcttcttatttagtatttcatatgcccattagccctatgcttcagatgacacgttttgtttagagctactttgctccaagactcttaagcccaaagtaactggtatgtcactgagtaacttgactcggtgtcagagcattttaactagccactcagatgagaatttatgtttaacttctctttttactcatcagctgcaagcaaaatcttgtagtttttaatcttaaacactgaataaaaaaactttcccctaaattggaatgatcttagttttgctttgagttttgttatctagcatctttttgttgcacagggctctattgaggtcctatgtctctgatttttttttttccccagtattgccctggagctgtctctggaaagtagctggcgaggttaccttaactatcactgaagaaagaaattttctgacacactgatggcatgtgacttgtctcctaagtcagtgaggcatcactttgtttgcataaagtatacggtttgttaaggcctttgttcttgtgagatgcaaaacagctgctagtctgcaacctagttttccctctcacctttaactgacgttttgtcctcaataattacacaaggacctagagtacctataggacaaaaagtatagaataaaaatatgcctttagtcatttggtttttcttaaaaagttgagattcttaatctgacttacatgttactttatccgtatgtctttgttagtggagaccgctaaactaatgatgtttgaaaacagttcctctgttttagattggaagatagcactctagagtggacatacggaaagactgtgactttattttgtaatgggaggaagaaattttctcagagcaaactttctattttttacctgtgaaataacagtgactttttaaaatggtgacagtgttggcaaggaaacagcaacacaggctgcgctgttggtaggagtgaaaaccagtataattcttctgaaaaacatttatcagaaacttaaaatatttcataccgtttgatccagtagcttcttctaaatcataaatgcagacaatgtttaggtaaagacatactcattaagtgttatttattttactcaagaactggaaaccaactaaatgccttctatagaagtaatttttgatgaggagaaatggtacaatactaattaacaacttggtttaacatgtttactgagcatctgttaagtgttgggggaaaaagcagcaggatccagagctataggtacagtgtgatctcagctttgcaaacacattttctacatagatagtactaggtattaatagatatgtaaagaaagaaatcacaccattaataatggtaagattggtttatgtgattttagtggtatttttggcacccttatatatgttttccaaactttcagcagtgatattatttccataacttaaaaagtgagtttgaaaaagaaaatctccagcaagcatctcatttaaataaaggtttgtcatctttaaaaatacagcaatatgtgactttttaaaaaagctgtcaaataggtgtgaccctactaataattattagaaatacatttaaaaacatcgagtacctcaagtcagtttgccttgaaaaatatcaaatataactcttagagaaatgtacataaaagaatgcttcgtaattttggagtaggaggttccctcctcaattttgtatttttaaaaagtacatggtaaaaaaaaaaattcacaacagtatataaggctgtaaaatgagaattctgccccctcacctcttaccccagtactattctccagaggtaatctattaacaatttcttatgtaattttcagaaaatttgtatgcgtatataagcaaatatgtaatctttattttttaaataaatgggatcatattatatattcta

SEQ ID NO: 341822 - DNA, 3487 bp, Homo sapiens
ctacccatagccaggcatgcctcctgccagattgttattcatgttttacatctgacctttaccttggtgattttaactcggtaactgctttatttctatttgtgaacaattttatccacgtctaaactttaggattagtaatagcatatttagctccttctccatttttagggaaaatatataatgcttaagatataaaattattaacagatgctataatctgaaagatttattcctttaaaaagttgcattaaatgcagtattcttatttctttttatttaataattaaggaggagaaagtgcaggccatgccacttcctctcaggagcctagtggatgctcagatcagagacctgcagaggacctcaacatccgagtggaaagactaacaaaaaaacttgaagaaaggagagaagagaaaagaaaagaggaagaacagagagaaattaagaaggaaattgagaggagaaaaactggaaaagaaatgttggattataaaagaaaacaagaagaagaattaacaaaaagaatgctggaggaaagaaacagagagaaagcagaagatagggcagctcgagaacgtataaaacagcagattgcattggaccgtgcagagagagctgctcgttttgcaaagacaaaggaagaagtagaggctgccaaagctgctgccttgctagcaaaacaggcagaaatggaagtcaagagggaatcttatgcaagagaaagaagcactgttgcaagaattcaattccgtcttcctgatggttcttcctttacaaatcagttcccttctgatgctcctctagaagaggcaaggcagtttgctgcacagactgttggcaacacttacggtaatttttcgttagcaaccatgtttcccaggagggaatttaccaaagaagattataaaaagaagttactggatttggaacttgccccaagcgcttcggtggtactgttgccagcaggaagaccaactgcatccattgtacactcttccagcggagacatttggaccttgttgggaacagtgctttatccattccttgccatctggagattaattagcaatttcttgtttagtaatccgcctcccacacagacttcagtgagagtaacatcgtcagaacccccaaaccctgcatcatctagcaaatcagaaaaaagggaaccagtgagaaaaagagtgctggaaaaacgtggagacgactttaaaaaggaggggaaaatttatagattaaggactcaagatgatggtgaagatgaaaacaacacttggaatggaaattccactcaacagatgtagtgtgacaagtataatatgtgcaataatcattgtttctcttatgatttaattcaactaaaattctactggagaagtgggactgctttatattttccaactggtctataaaatgtctctttattcctgcttagtgggtgtgggttgaaggtgtttaactcagaaaagtaaagacaggaaataactctctgctaggtccttgcttatatggcaaccactgctagaaccctaaaagaaccaaaaatctgccacagcctgcctccatcagcttcttatttagtatttcatatgcccattagccctatgcttcagatgacacgttttgtttagagctactttgctccaagactcttaagcccaaagtaactggtatgtcactgagtaacttgactcggtgtcagagcattttaactagccactcagatgagaatttatgtttaacttctctttttactcatcagctgcaagcaaaatcttgtagtttttaatcttaaacactgaataaaaaaactttcccctaaattggaatgatcttagttttgctttgagttttgttatctagcatctttttgttgcacagggctctattgaggtcctatgtctctgatttttttttttccccagtattgccctggagctgtctctggaaagtagctggcgaggttaccttaactatcactgaagaaagaaattttctgacacactgatggcatgtgacttgtctcctaagtcagtgaggcatcactttgtttgcataaagtatacggtttgttaaggcctttgttcttgtgagatgcaaaacagctgctagtctgcaacctagttttccctctcacctttaactgacgttttgtcctcaataattacacaaggacctagagtacctataggacaaaaagtatagaataaaaatatgcctttagtcatttggtttttcttaaaaagttgagattcttaatctgacttacatgttactttatccgtatgtctttgttagtggagaccgctaaactaatgatgtttgaaaacagttcctctgttttagattggaagatagcactctagagtggacatacggaaagactgtgactttattttgtaatgggaggaagaaattttctcagagcaaactttctattttttacctgtgaaataacagtgactttttaaaatggtgacagtgttggcaaggaaacagcaacacaggctgcgctgttggtaggagtgaaaaccagtataattcttctgaaaaacatttatcagaaacttaaaatatttcataccgtttgatccagtagcttcttctaaatcataaatgcagacaatgtttaggtaaagacatactcattaagtgttatttattttactcaagaactggaaaccaactaaatgccttctatagaagtaatttttgatgaggagaaatggtacaatactaattaacaacttggtttaacatgtttactgagcatctgttaagtgttgggggaaaaagcagcaggatccagagctataggtacagtgtgatctcagctttgcaaacacattttctacatagatagtactaggtattaatagatatgtaaagaaagaaatcacaccattaataatggtaagattggtttatgtgattttagtggtatttttggcacccttatatatgttttccaaactttcagcagtgatattatttccataacttaaaaagtgagtttgaaaaagaaaatctccagcaagcatctcatttaaataaaggtttgtcatctttaaaaatacagcaatatgtgactttttaaaaaagctgtcaaataggtgtgaccctactaataattattagaaatacatttaaaaacatcgagtacctcaagtcagtttgccttgaaaaatatcaaatataactcttagagaaatgtacataaaagaatgcttcgtaattttggagtaggaggttccctcctcaattttgtatttttaaaaagtacatggtaaaaaaaaaaattcacaacagtatataaggctgtaaaatgagaattctgccccctcacctcttaccccagtactattctccagaggtaatctattaacaatttcttatgtaattttcagaaaatttgtatgcgtatataagcaaatatgtaatctttattttttaaataaatgggatcatattatatattcta

SEQ ID NO: 341823 - DNA, 3154 bp, Homo sapiens
tgggactgctttatattttccaactggtctataaaatgtctctttattcctgcttagtgggtgtgggttgaaggtgtttaactcagaaaagaaaagaggaagaacagagagaaattaagaaggaaattgagaggagaaaaactggaaaagaaatgttggattataaaagaaaacaagaagaagaattaacaaaaagaatgctggaggaaagaaacagagagaaagcagaagatagggcagctcgagaacgtataaaacagcagattgcattggaccgtgcagagagagctgctcgttttgcaaagacaaaggaagaagtagaggctgccaaagctgctgccttgctagcaaaacaggcagaaatggaagtcaagagggaatcttatgcaagagaaagaagcactgttgcaagaattcaattccgtcttcctgatggttcttcctttacaaatcagttcccttctgatgctcctctagaagaggcaaggcagtttgctgcacagactgttggcaacacttacggtaatttttcgttagcaaccatgtttcccaggagggaatttaccaaagaagattataaaaagaagttactggatttggaacttgccccaagcgcttcggtggtactgttgccagcaggaagaccaactgcatccattgtacactcttccagcggagacatttggaccttgttgggaacagtgctttatccattccttgccatctggagattaattagcaatttcttgtttagtaatccgcctcccacacagacttcagtgagagtaacatcgtcagaacccccaaaccctgcatcatctagcaaatcagaaaaaagggaaccagtgagaaaaagagtgctggaaaaacgtggagacgactttaaaaaggaggggaaaatttatagattaaggactcaagatgatggtgaagatgaaaacaacacttggaatggaaattccactcaacagatgtagtgtgacaagtataatatgtgcaataatcattgtttctcttatgatttaattcaactaaaattctactggagaagtgggactgctttatattttccaactggtctataaaatgtctctttattcctgcttagtgggtgtgggttgaaggtgtttaactcagaaaagtaaagacaggaaataactctctgctaggtccttgcttatatggcaaccactgctagaaccctaaaagaaccaaaaatctgccacagcctgcctccatcagcttcttatttagtatttcatatgcccattagccctatgcttcagatgacacgttttgtttagagctactttgctccaagactcttaagcccaaagtaactggtatgtcactgagtaacttgactcggtgtcagagcattttaactagccactcagatgagaatttatgtttaacttctctttttactcatcagctgcaagcaaaatcttgtagtttttaatcttaaacactgaataaaaaaactttcccctaaattggaatgatcttagttttgctttgagttttgttatctagcatctttttgttgcacagggctctattgaggtcctatgtctctgatttttttttttccccagtattgccctggagctgtctctggaaagtagctggcgaggttaccttaactatcactgaagaaagaaattttctgacacactgatggcatgtgacttgtctcctaagtcagtgaggcatcactttgtttgcataaagtatacggtttgttaaggcctttgttcttgtgagatgcaaaacagctgctagtctgcaacctagttttccctctcacctttaactgacgttttgtcctcaataattacacaaggacctagagtacctataggacaaaaagtatagaataaaaatatgcctttagtcatttggtttttcttaaaaagttgagattcttaatctgacttacatgttactttatccgtatgtctttgttagtggagaccgctaaactaatgatgtttgaaaacagttcctctgttttagattggaagatagcactctagagtggacatacggaaagactgtgactttattttgtaatgggaggaagaaattttctcagagcaaactttctattttttacctgtgaaataacagtgactttttaaaatggtgacagtgttggcaaggaaacagcaacacaggctgcgctgttggtaggagtgaaaaccagtataattcttctgaaaaacatttatcagaaacttaaaatatttcataccgtttgatccagtagcttcttctaaatcataaatgcagacaatgtttaggtaaagacatactcattaagtgttatttattttactcaagaactggaaaccaactaaatgccttctatagaagtaatttttgatgaggagaaatggtacaatactaattaacaacttggtttaacatgtttactgagcatctgttaagtgttgggggaaaaagcagcaggatccagagctataggtacagtgtgatctcagctttgcaaacacattttctacatagatagtactaggtattaatagatatgtaaagaaagaaatcacaccattaataatggtaagattggtttatgtgattttagtggtatttttggcacccttatatatgttttccaaactttcagcagtgatattatttccataacttaaaaagtgagtttgaaaaagaaaatctccagcaagcatctcatttaaataaaggtttgtcatctttaaaaatacagcaatatgtgactttttaaaaaagctgtcaaataggtgtgaccctactaataattattagaaatacatttaaaaacatcgagtacctcaagtcagtttgccttgaaaaatatcaaatataactcttagagaaatgtacataaaagaatgcttcgtaattttggagtaggaggttccctcctcaattttgtatttttaaaaagtacatggtaaaaaaaaaaattcacaacagtatataaggctgtaaaatgagaattctgccccctcacctcttaccccagtactattctccagaggtaatctattaacaatttcttatgtaattttcagaaaatttgtatgcgtatataagcaaatatgtaatctttattttttaaataaatgggatcatattatatattcta

SEQ ID NO: 341824 - DNA, 2959 bp, Homo sapiens
caggcgtgagccaccacacccagcctaaaagagttaattttttatatgaatctcagtaaagcagttattaacaaacaaaaagatctgatatggtagaaaaaactattgtcattgcacatttccacttccattttctctaacttaatgatattgttagagaatatatagaggtgaagattgtgactttaattttcttttttcatagcactgttgcaagaattcaattccgtcttcctgatggttcttcctttacaaatcagttcccttctgatgctcctctagaagaggcaaggcagtttgctgcacagactgttggcaacacttacggtaatttttcgttagcaaccatgtttcccaggagggaatttaccaaagaagattataaaaagaagttactggatttggaacttgccccaagcgcttcggtggtactgttgccagcaggaagaccaactgcatccattgtacactcttccagcggagacatttggaccttgttgggaacagtgctttatccattccttgccatctggagattaattagcaatttcttgtttagtaatccgcctcccacacagacttcagtgagagtaacatcgtcagaacccccaaaccctgcatcatctagcaaatcagaaaaaagggaaccagtgagaaaaagagtgctggaaaaacgtggagacgactttaaaaaggaggggaaaatttatagattaaggactcaagatgatggtgaagatgaaaacaacacttggaatggaaattccactcaacagatgtagtgtgacaagtataatatgtgcaataatcattgtttctcttatgatttaattcaactaaaattctactggagaagtgggactgctttatattttccaactggtctataaaatgtctctttattcctgcttagtgggtgtgggttgaaggtgtttaactcagaaaagtaaagacaggaaataactctctgctaggtccttgcttatatggcaaccactgctagaaccctaaaagaaccaaaaatctgccacagcctgcctccatcagcttcttatttagtatttcatatgcccattagccctatgcttcagatgacacgttttgtttagagctactttgctccaagactcttaagcccaaagtaactggtatgtcactgagtaacttgactcggtgtcagagcattttaactagccactcagatgagaatttatgtttaacttctctttttactcatcagctgcaagcaaaatcttgtagtttttaatcttaaacactgaataaaaaaactttcccctaaattggaatgatcttagttttgctttgagttttgttatctagcatctttttgttgcacagggctctattgaggtcctatgtctctgatttttttttttccccagtattgccctggagctgtctctggaaagtagctggcgaggttaccttaactatcactgaagaaagaaattttctgacacactgatggcatgtgacttgtctcctaagtcagtgaggcatcactttgtttgcataaagtatacggtttgttaaggcctttgttcttgtgagatgcaaaacagctgctagtctgcaacctagttttccctctcacctttaactgacgttttgtcctcaataattacacaaggacctagagtacctataggacaaaaagtatagaataaaaatatgcctttagtcatttggtttttcttaaaaagttgagattcttaatctgacttacatgttactttatccgtatgtctttgttagtggagaccgctaaactaatgatgtttgaaaacagttcctctgttttagattggaagatagcactctagagtggacatacggaaagactgtgactttattttgtaatgggaggaagaaattttctcagagcaaactttctattttttacctgtgaaataacagtgactttttaaaatggtgacagtgttggcaaggaaacagcaacacaggctgcgctgttggtaggagtgaaaaccagtataattcttctgaaaaacatttatcagaaacttaaaatatttcataccgtttgatccagtagcttcttctaaatcataaatgcagacaatgtttaggtaaagacatactcattaagtgttatttattttactcaagaactggaaaccaactaaatgccttctatagaagtaatttttgatgaggagaaatggtacaatactaattaacaacttggtttaacatgtttactgagcatctgttaagtgttgggggaaaaagcagcaggatccagagctataggtacagtgtgatctcagctttgcaaacacattttctacatagatagtactaggtattaatagatatgtaaagaaagaaatcacaccattaataatggtaagattggtttatgtgattttagtggtatttttggcacccttatatatgttttccaaactttcagcagtgatattatttccataacttaaaaagtgagtttgaaaaagaaaatctccagcaagcatctcatttaaataaaggtttgtcatctttaaaaatacagcaatatgtgactttttaaaaaagctgtcaaataggtgtgaccctactaataattattagaaatacatttaaaaacatcgagtacctcaagtcagtttgccttgaaaaatatcaaatataactcttagagaaatgtacataaaagaatgcttcgtaattttggagtaggaggttccctcctcaattttgtatttttaaaaagtacatggtaaaaaaaaaaattcacaacagtatataaggctgtaaaatgagaattctgccccctcacctcttaccccagtactattctccagaggtaatctattaacaatttcttatgtaattttcagaaaatttgtatgcgtatataagcaaatatgtaatctttattttttaaataaatgggatcatattatatattcta

SEQ ID NO: 341825 - DNA, 3917 bp, Homo sapiens
gcggccgcaccatcgactcgccaacgagagaaggtcctggggcacggacaccgacgggttgcgactgtgacgtgaggtgttctcgcgcgcgctagcgcgcgtctccgggtgccgctgacgggcgtgcgcgcttgtgcggagccggaggtgggggccgaaccagccaaggttgcgggggccgcagagccggacgaagacggagggcggagccggcttcgggactgcggagactacacaccgagcgagcgcctgggcccgaagggagcgatgctgtggttccagggcgccattccggccgccatcgcgacggccaaaaggagcggcgcggtcttcgtggtgttcgtggcaggtgatgatgaacagtctacacagatggctgcaagttgggaagatgataaagttacagaagcatcttcaaacagttttgttgctattaaaatcgataccaaaagtgaagcctgcctacagttttcacaaatctatcctgtagtgtgtgttccatccagtttctttattggagacagtggaattcccttggaagtaatagcaggaagtgtttctgcagatgaacttgttacaagaattcacaaggtccgacagatgcatttgctaaaaagtgaaacatcagtagcaaatggcagtcagtcagaaagttcagtgtctactccatctgcgtcatttgaacctaacaacacttgtgaaaactctcagtccagaaatgcagagctttgtgagataccacccacttctgatacaaagtcagatactgcaacaggaggagaaagtgcaggccatgccacttcctctcaggagcctagtggatgctcagatcagagacctgcagaggacctcaacatccgagtggaaagactaacaaaaaaacttgaagaaaggagagaagagaaaagaaaagaggaagaacagagagaaattaagaaggaaattgagaggagaaaaactggaaaagaaatgttggattataaaagaaaacaagaagaagaattaacaaaaagaatgctggaggaaagaaacagagagaaagcagaagatagggcagctcgagaacgtataaaacagcagattgcattggaccgtgcagagagagctgctcgttttgcaaagacaaaggaagaagtagaggctgccaaagctgctgccttgctagcaaaacaggcagaaatggaagtcaagagggaatcttatgcaagagaaagaagcactgttgcaagaattcaattccgtcttcctgatggttcttcctttacaaatcagttcccttctgatgctcctctagaagaggcaaggcagtttgctgcacagactgttggcaacacttacggtaatttttcgttagcaaccatgtttcccaggagggaatttaccaaagaagattataaaaagaagttactggatttggaacttgccccaagcgcttcggtggtactgttgccagcaggaagaccaactgcatccattgtacactcttccagcggagacatttggaccttgttgggaacagtgctttatccattccttgccatctggagattaattagcaatttcttgtttagtaatccgcctcccacacagacttcagtgagagtaacatcgtcagaacccccaaaccctgcatcatctagcaaatcagaaaaaagggaaccagtgagaaaaagagtgctggaaaaacgtggagacgactttaaaaaggaggggaaaatttatagattaaggactcaagatgatggtgaagatgaaaacaacacttggaatggaaattccactcaacagatgtagtgtgacaagtataatatgtgcaataatcattgtttctcttatgatttaattcaactaaaattctactggagaagtgggactgctttatattttccaactggtctataaaatgtctctttattcctgcttagtgggtgtgggttgaaggtgtttaactcagaaaagtaaagacaggaaataactctctgctaggtccttgcttatatggcaaccactgctagaaccctaaaagaaccaaaaatctgccacagcctgcctccatcagcttcttatttagtatttcatatgcccattagccctatgcttcagatgacacgttttgtttagagctactttgctccaagactcttaagcccaaagtaactggtatgtcactgagtaacttgactcggtgtcagagcattttaactagccactcagatgagaatttatgtttaacttctctttttactcatcagctgcaagcaaaatcttgtagtttttaatcttaaacactgaataaaaaaactttcccctaaattggaatgatcttagttttgctttgagttttgttatctagcatctttttgttgcacagggctctattgaggtcctatgtctctgatttttttttttccccagtattgccctggagctgtctctggaaagtagctggcgaggttaccttaactatcactgaagaaagaaattttctgacacactgatggcatgtgacttgtctcctaagtcagtgaggcatcactttgtttgcataaagtatacggtttgttaaggcctttgttcttgtgagatgcaaaacagctgctagtctgcaacctagttttccctctcacctttaactgacgttttgtcctcaataattacacaaggacctagagtacctataggacaaaaagtatagaataaaaatatgcctttagtcatttggtttttcttaaaaagttgagattcttaatctgacttacatgttactttatccgtatgtctttgttagtggagaccgctaaactaatgatgtttgaaaacagttcctctgttttagattggaagatagcactctagagtggacatacggaaagactgtgactttattttgtaatgggaggaagaaattttctcagagcaaactttctattttttacctgtgaaataacagtgactttttaaaatggtgacagtgttggcaaggaaacagcaacacaggctgcgctgttggtaggagtgaaaaccagtataattcttctgaaaaacatttatcagaaacttaaaatatttcataccgtttgatccagtagcttcttctaaatcataaatgcagacaatgtttaggtaaagacatactcattaagtgttatttattttactcaagaactggaaaccaactaaatgccttctatagaagtaatttttgatgaggagaaatggtacaatactaattaacaacttggtttaacatgtttactgagcatctgttaagtgttgggggaaaaagcagcaggatccagagctataggtacagtgtgatctcagctttgcaaacacattttctacatagatagtactaggtattaatagatatgtaaagaaagaaatcacaccattaataatggtaagattggtttatgtgattttagtggtatttttggcacccttatatatgttttccaaactttcagcagtgatattatttccataacttaaaaagtgagtttgaaaaagaaaatctccagcaagcatctcatttaaataaaggtttgtcatctttaaaaatacagcaatatgtgactttttaaaaaagctgtcaaataggtgtgaccctactaataattattagaaatacatttaaaaacatcgagtacctcaagtcagtttgccttgaaaggagtaggaggttccctcctcaattttgtatttttaaaaagtacatggtaaaaaaaaaaattcacaacagtatataaggctgtaaaatgagaattctgccccctcacctcttaccccagtactattctccagaggtaatctattaacaatttcttatgtaattttcagaaaatttgtatgcgtatataagcaaatatgtaatctttattttttaaataaatgggatcatattatatattcta

SEQ ID NO: 341826 - DNA, 1508 bp, Homo sapiens
gcggccgcaccatcgactcgccaacgagagaaggtcctggggcacggacaccgacgggttgcgactgtgacgtgaggtgttctcgcgcgcgctagcgcgcgtctccgggtgccgctgacgggcgtgcgcgcttgtgcggagccggaggtgggggccgaaccagccaaggttgcgggggccgcagagccggacgaagacggagggcggagccggcttcgggactgcggagactacacaccgagcgagcgcctgggcccgaagggagcgatgctgtggttccagggcgccattccggccgccatcgcgacggccaaaaggagcggcgcggtcttcgtggtgttcgtggcaggtgatgatgaacagtctacacagatggctgcaagttgggaagatgataaagttacagaagcatcttcaaacagttttgttgctattaaaatcgataccaaaagtgaagcctgcctacagttttcacaaatctatcctgtagtgtgtgttccatccagtttctttattggagacagtggaattcccttggaagtaatagcaggaagtgtttctgcagatgaacttgttacaagaattcacaaggtccgacagatgcatttgctaaaaagtgaaacatcagtagcaaatggcagtcagtcagaaagttcagtgtctactccatctgcgtcatttgaacctaacaacacttgtgaaaactctcagtccagaaatgcagagctttgtgagataccacccacttctgatacaaagtcagatactgcaacaggaggagaaagtgcaggccatgccacttcctctcaggagcctagtggatgctcagatcagagacctgcagaggacctcaacatccgagtggaaagactaacaaaaaaacttgaagaaaggagagaagagaaaagaaaagaggaagaacagagagaaattaagaaggaaattgagaggagaaaaactggaaaagaaatgttggattataaaagaaaacaagaagaagaattaacaaaaagaatgctggaggaaagaaacagagagaaagcagaagatagggcagctcgagaacgtataaaacagcagattgcattggaccgtgcagagagagctgctcgttttgcaaagacaaaggaagaagtagaggctgccaaagctgctgccttgctagcaaaacaggcagaaatggaagtcaagagggaatcttatgcaagagaaagaagcactgttgcaagaattcaattccgtcttcctgatggttcttcctttacaaatcagttcccttctgatgctcctctagaagaggcaaggcagtttgctgcacagactgttggcaacacttacggtaatttttcgttagcaaccatgtttcccaggagggaatttaccaaagaagattataaaaagaagttactggatttggaacttgccccaagcgcttcggtggtactgttgccacaggaagaccaactgcatccattgacactctatcttctagtaacccggtgccggct

SEQ ID NO: 341827 - DNA, 1714 bp, Homo sapiens
gcggccgcaccatcgactcgccaacgagagaaggtcctggggcacggacaccgacgggttgcgactgtgacgtgaggtgttctcgcgcgcgctagcgcgcgtctccgggtgccgctgacgggcgtgcgcgcttgtgcggagccggaggtgggggccgaaccagccaaggttgcgggggccgcagagccggacgaagacggagggcggagccggcttcgggactgcggagactacacaccgagcgagcgcctgggcccgaagggagcgatgctgtggttccagggcgccattccggccgccatcgcgacggccaaaaggagcggcgcggtcttcgtggtgttcgtggcaggtgatgatgaacagtctacacagatggctgcaagttgggaagatgataaagttacagaagcatcttcaaacagttttgttgctattaaaatcgataccaaaagtgaagcctgcctacagttttcacaaatctatcctgtagtgtgtgttccatccagtttctttattggagacagtggaattcccttggaagtaatagcaggaagtgtttctgcagatgaacttgttacaagaattcacaaggtccgacagatgcatttgctaaaaagtgaaacatcagtagcaaatggcagtcagtcagaaagttcagtgtctactccatctgcgtcatttgaacctaacaacacttgtgaaaactctcagtccagaaatgcagagctttgtgagataccacccacttctgatacaaagtcagatactgcaacaggaggagaaagtgcaggccatgccacttcctctcaggagcctagtggatgctcagatcagagacctgcagaggacctcaacatccgagtggaaagactaacaaaaaaacttgaagaaaggagagaagagaaaagaaaagaggaagaacagagagaaattaagaaggaaattgagaggagaaaaactggaaaagaaatgttggattataaaagaaaacaagaagaagaattaacaaaaagaatgctggaggaaagaaacagagagaaagcagaagatagggcagctcgagaacgtataaaacagcagattgcattggaccgtgcagagagagctgctcgttttgcaaagacaaaggaagaagtagaggctgccaaagctgctgccttgctagcaaaacaggcagaaatggaagtcaagagggaatcttatgcaagagaaagaaggtactatatttcatgctgaaacatctctgtgcacataggggctgaggagaatgattataagctggtttttaacactgatgtatactgtggttataagcagtccattccagagggacatattaatttgacagctcccaatggtatctctcatttcgtgtgagtgtacactaaaaaagtactacataaataactttaaaagagggcccaatagccgggcgcggtggctcacgcctgtaatcccagcactttgggaggccgagacgggcggatcacgaggtcaggagatcgagaccatcctggctaacatggtgaaaccccgtctctactaaaaatacaaaaattagctgggcatggtggcgggcgcctgtagtcccagctacgcgggaggctgaggcaggagaatggcgtgaacccgggaggcggagcttgcagtgagccgagattgcgccactgcactccagcctgggcgacagagcgagactccgtccccaaaaaaa

SEQ ID NO: 341828 - DNA, 852 bp, Homo sapiens
  misc_feature (738)..(738): n is a, c, g, or t
tgggactgctttatattttccaactggtctataaaatgtctctttattcctgcttagtgggtgtgggttgaaggtgtttaactcagaaaagaaaagaggaagaacagagagaaattaagaaggaaattgagaggagaaaaactggaaaagaaatgttggattataaaagaaaacaagaagaagaattaacaaaaagaatgctggaggaaagaaacagagagaaagcagaagatagggcagctcgagaacgtataaaacagcagattgcattgactaacaaaaaaacttgaagaaaggagagaagagaaaagaaaagaggaagaacagagagaaattaagaaggaaattgagaggagaaaaactggaaaagaaatgttggattataaaagaaaacaagaagaagaattaacaaaaagaatgctggaggaaagaaacagagagaaagcagaagatagggcagctcgagaacgtataaaacagcagattgcattgactaacaaaaaaacttgaagaacaggagagaagacgaaaagaaaagaggaagaacagagagaacattaagaaggaaattgagaggagaaaaactggcaaaagaaatgtcggattataaaagagaacaagaagaagaattaacaaaaagaatgctggaggaaagaaacagagagaaagcagaagatagggcaggtcgagaacgtataaaacagcagattgcattgactaacaaaaaaacttgaaganaggagagaaagaagtcaccgaagaggagaaaaccaaggaggagaagccagaagccaaaggggtcaaggaggaggtcaagttggcctgaatggacctctccagctctggcttcct

SEQ ID NO: 341829 - DNA, 3971 bp, Homo sapiens
gcggccgcaccatcgactcgccaacgagagaaggtcctggggcacggacaccgacgggttgcgactgtgacgtgaggtgttctcgcgcgcgctagcgcgcgtctccgggtgccgctgacgggcgtgcgcgcttgtgcggagccggaggtgggggccgaaccagccaaggttgcgggggccgcagagccggacgaagacggagggcggagccggcttcgggactgcggagactacacaccgagcgagcgcctgggcccgaagggagcgatgctgtggttccagggcgccattccggccgccatcgcgacggccaaaaggagcggcgcggtcttcgtggtgttcgtggcaggtgatgatgaacagtctacacagatggctgcaagttgggaagatgataaagttacagaagcatcttcaaacagttttgttgctattaaaatcgataccaaaagtgaagcctgcctacagttttcacaaatctatcctgtagtgtgtgttccatccagtttctttattggagacagtggaattcccttggaagtaatagcaggaagtgtttctgcagatgaacttgttacaagaattcacaaggtccgacagatgcatttgctaaaaagtgaaacatcagtagcaaatggcagtcagtcagaaagttcagtgtctactccatctgcgtcatttgaacctaacaacacttgtgaaaactctcagtccagaaatgcagagctttgtgagataccacccacttctgatacaaagtcagatactgcaacaggaggagaaagtgcaggccatgccacttcctctcaggagcctagtggatgctcagatcagagacctgcagaggacctcaacatccgagtggaaagactaacaaaaaaacttgaagaaaggagagaagagaaaagaaaagaggaagaacagagagaaattaagaaggaaattgagaggagaaaaactggaaaagaaatgttggattataaaagaaaacaagaagaagaattaacaaaaagaatgctggaggaaagaaacagagagaaagcagaagatagggcagctcgagaacgtataaaacagcagattgcattggaccgtgcagagagagctgctcgttttgcaaagacaaaggaagaagtagaggctgccaaagctgctgccttgctagcaaaacaggcagaaatggaagtcaagagggaatcttatgcaagagaaagaagcactgttgcaagaattcaattccgtcttcctgatggttcttcctttacaaatcagttcccttctgatgctcctctagaagaggcaaggcagtttgctgcacagactgttggcaacacttacggtaatttttcgttagcaaccatgtttcccaggagggaatttaccaaagaagattataaaaagaagttactggatttggaacttgccccaagcgcttcggtggtactgttgccagcaggaagaccaactgcatccattgtacactcttccagcggagacatttggaccttgttgggaacagtgctttatccattccttgccatctggagattaattagcaatttcttgtttagtaatccgcctcccacacagacttcagtgagagtaacatcgtcagaacccccaaaccctgcatcatctagcaaatcagaaaaaagggaaccagtgagaaaaagagtgctggaaaaacgtggagacgactttaaaaaggaggggaaaatttatagattaaggactcaagatgatggtgaagatgaaaacaacacttggaatggaaattccactcaacagatgtagtgtgacaagtataatatgtgcaataatcattgtttctcttatgatttaattcaactaaaattctactggagaagtgggactgctttatattttccaactggtctataaaatgtctctttattcctgcttagtgggtgtgggttgaaggtgtttaactcagaaaagtaaagacaggaaataactctctgctaggtccttgcttatatggcaaccactgctagaaccctaaaagaaccaaaaatctgccacagcctgcctccatcagcttcttatttagtatttcatatgcccattagccctatgcttcagatgacacgttttgtttagagctactttgctccaagactcttaagcccaaagtaactggtatgtcactgagtaacttgactcggtgtcagagcattttaactagccactcagatgagaatttatgtttaacttctctttttactcatcagctgcaagcaaaatcttgtagtttttaatcttaaacactgaataaaaaaactttcccctaaattggaatgatcttagttttgctttgagttttgttatctagcatctttttgttgcacagggctctattgaggtcctatgtctctgatttttttttttccccagtattgccctggagctgtctctggaaagtagctggcgaggttaccttaactatcactgaagaaagaaattttctgacacactgatggcatgtgacttgtctcctaagtcagtgaggcatcactttgtttgcataaagtatacggtttgttaaggcctttgttcttgtgagatgcaaaacagctgctagtctgcaacctagttttccctctcacctttaactgacgttttgtcctcaataattacacaaggacctagagtacctataggacaaaaagtatagaataaaaatatgcctttagtcatttggtttttcttaaaaagttgagattcttaatctgacttacatgttactttatccgtatgtctttgttagtggagaccgctaaactaatgatgtttgaaaacagttcctctgttttagattggaagatagcactctagagtggacatacggaaagactgtgactttattttgtaatgggaggaagaaattttctcagagcaaactttctattttttacctgtgaaataacagtgactttttaaaatggtgacagtgttggcaaggaaacagcaacacaggctgcgctgttggtaggagtgaaaaccagtataattcttctgaaaaacatttatcagaaacttaaaatatttcataccgtttgatccagtagcttcttctaaatcataaatgcagacaatgtttaggtaaagacatactcattaagtgttatttattttactcaagaactggaaaccaactaaatgccttctatagaagtaatttttgatgaggagaaatggtacaatactaattaacaacttggtttaacatgtttactgagcatctgttaagtgttgggggaaaaagcagcaggatccagagctataggtacagtgtgatctcagctttgcaaacacattttctacatagatagtactaggtattaatagatatgtaaagaaagaaatcacaccattaataatggtaagattggtttatgtgattttagtggtatttttggcacccttatatatgttttccaaactttcagcagtgatattatttccataacttaaaaagtgagtttgaaaaagaaaatctccagcaagcatctcatttaaataaaggtttgtcatctttaaaaatacagcaatatgtgactttttaaaaaagctgtcaaataggtgtgaccctactaataattattagaaatacatttaaaaacatcgagtacctcaagtcagtttgccttgaaaaatatcaaatataactcttagagaaatgtacataaaagaatgcttcgtaattttggagtaggaggttccctcctcaattttgtatttttaaaaagtacatggtaaaaaaaaaaattcacaacagtatataaggctgtaaaatgagaattctgccccctcacctcttaccccagtactattctccagaggtaatctattaacaatttcttatgtaattttcagaaaatttgtatgcgtatataagcaaatatgtaatctttattttttaaataaatgggatcatattatatattcta

SEQ ID NO: 341830 - DNA, 1005 bp, Homo sapiens
  misc_feature (891)..(891): n is a, c, g, or t
gcggccgcaccatcgactcgccaacgagagaaggtcctggggcacggacaccgacgggttgcgactgtgacgtgaggtgttctcgcgcgcgctagcgcgcgtctccgggtgccgctgacgggcgtgcgcgcttgtgcggagccggaggtgggggccgaaccagccaaggttgcgggggccgcagagccggacgaagacggagggcggagccggcttcgggactgcggagactacacaccgagcgagcgcctgggcccgaagggagcgatgctgtggttccagggcgccattccggccgccatcgcgacggccaaaaggagcggcgcggtcttcgtggtgttcgtggcaggtgatgatgaacagtctacacagatggctgcaagttgggaagatgataaagttacagaagcatcttcaaacagttttgttgctattaaaatcgataccaaaagtgaagcctgcctacagttttcacaaatctatcctgtagtgtgtgttccatccagtttctttattggagacagtggaattcccttggaagtaatagcaggaagtgtttctgcagatgaacttgttacaagaattcacaaggtccgacagatgcatttgctaaaaagtgaaacatcagtagcaaatggcagtcagtcagaaagttcagtgtctactccatctgcgtcatttgaacctaacaacacttgtgaaaactctcagtccagaaatgcagagctttgtgagataccacccacttctgatacaaagtcagatactgcaacaggaggagaaagtgcaggccatgccacttcctctcaggagcctagtggatgctcagatcagagacctgcagaggacctcaacatccgagtggaaagactaacaaaaaaacttgaaganaggagagaaagaagtcaccgaagaggagaaaaccaaggaggagaagccagaagccaaaggggtcaaggaggaggtcaagttggcctgaatggacctctccagctctggcttcct

SEQ ID NO: 341831 - DNA, 3916 bp, Homo sapiens
gcggccgcaccatcgactcgccaacgagagaaggtcctggggcacggacaccgacgggttgcgactgtgacgtgaggtgttctcgcgcgcgctagcgcgcgtctccgggtgccgctgacgggcgtgcgcgcttgtgcggagccggaggtgggggccgaaccagccaaggttgcgggggccgcagagccggacgaagacggagggcggagccggcttcgggactgcggagactacacaccgagcgagcgcctgggcccgaagggagcgatgctgtggttccagggcgccattccggccgccatcgcgacggccaaaaggagcggcgcggtcttcgtggtgttcgtggcaggtgatgatgaacagtctacacagatggctgcaagttgggaagatgataaagttacagaagcatcttcaaacagttttgttgctattaaaatcgataccaaaagtgaagcctgcctacagttttcacaaatctatcctgtagtgtgtgttccatccagtttctttattggagacagtggaattcccttggaagtaatagcaggaagtgtttctgcagatgaacttgttacaagaattcacaaggtccgacagatgcatttgctaaaaagtgaaacatcagtagcaaatggcagtcagtcagaaagttcagtgtctactccatctgcgtcatttgaacctaacaacacttgtgaaaactctcagtccagaaatgcagagctttgtgagataccacccacttctgatacaaagtcagatactgcaacaggaggagaaagtgcaggccatgccacttcctctcaggagcctagtggatgctcagatcagagacctgcagaggacctcaacatccgagtggaaagactaacaaaaaaacttgaagaaaggagagaagagaaaagaaaagaggaagaacagagagaaattaagaaggaaattgagaggagaaaaactggaaaagaaatgttggattataaaagaaaacaagaagaagaattaacaaaaagaatgctggaggaaagaaacagagagaaagcagaagatagggcagctcgagaacgtataaaacagcagattgcattggaccgtgcagagagagctgctcgttttgcaaagacaaaggaagaagtagaggctgccaaagctgctgccttgctagcaaaacaggcagaaatggaagtcaagagggaatcttatgcaagagaaagaagcactgttgcaagaattcaattccgtcttcctgatggttcttcctttacaaatcagttcccttctgatgctcctctagaagaggcaaggcagtttgctgcacagactgttggcaacacttacggtaatttttcgttagcaaccatgtttcccaggagggaatttaccaaagaagattataaaaagaagttactggatttggaacttgccccaagcgcttcggtggtactgttgccagcaggaagaccaactgcatccattgtacactcttccagcggagacatttggaccttgttgggaacagtgctttatccattccttgccatctggagattaattagcaatttcttgtttagtaatccgcctcccacacagacttcagtgagagtaacatcgtcagaacccccaaaccctgcatcatctagcaaatcagaaaaaagggaaccagtgagaaaaagagtgctggaaaaacgtggagacgactttaaaaaggaggggaaaatttatagattaaggactcaagatgatggtgaagatgaaaacaacacttggaatggaaattccactcaacagatgtagtgtgacaagtataatatgtgcaataatcattgtttctcttatgatttaattcaactaaaattctactggagaagtgggactgctttatattttccaactggtctataaaatgtctctttattcctgcttagtgggtgtgggttgaaggtgtttaactcagaaaagtaaagacaggaaataactctctgctaggtccttgcttatatggcaaccactgctagaaccctaaaagaaccaaaaatcctatgcttcagatgacacgttttgtttagagctactttgctccaagactcttaagcccaaagtaactggtatgtcactgagtaacttgactcggtgtcagagcattttaactagccactcagatgagaatttatgtttaacttctctttttactcatcagctgcaagcaaaatcttgtagtttttaatcttaaacactgaataaaaaaactttcccctaaattggaatgatcttagttttgctttgagttttgttatctagcatctttttgttgcacagggctctattgaggtcctatgtctctgatttttttttttccccagtattgccctggagctgtctctggaaagtagctggcgaggttaccttaactatcactgaagaaagaaattttctgacacactgatggcatgtgacttgtctcctaagtcagtgaggcatcactttgtttgcataaagtatacggtttgttaaggcctttgttcttgtgagatgcaaaacagctgctagtctgcaacctagttttccctctcacctttaactgacgttttgtcctcaataattacacaaggacctagagtacctataggacaaaaagtatagaataaaaatatgcctttagtcatttggtttttcttaaaaagttgagattcttaatctgacttacatgttactttatccgtatgtctttgttagtggagaccgctaaactaatgatgtttgaaaacagttcctctgttttagattggaagatagcactctagagtggacatacggaaagactgtgactttattttgtaatgggaggaagaaattttctcagagcaaactttctattttttacctgtgaaataacagtgactttttaaaatggtgacagtgttggcaaggaaacagcaacacaggctgcgctgttggtaggagtgaaaaccagtataattcttctgaaaaacatttatcagaaacttaaaatatttcataccgtttgatccagtagcttcttctaaatcataaatgcagacaatgtttaggtaaagacatactcattaagtgttatttattttactcaagaactggaaaccaactaaatgccttctatagaagtaatttttgatgaggagaaatggtacaatactaattaacaacttggtttaacatgtttactgagcatctgttaagtgttgggggaaaaagcagcaggatccagagctataggtacagtgtgatctcagctttgcaaacacattttctacatagatagtactaggtattaatagatatgtaaagaaagaaatcacaccattaataatggtaagattggtttatgtgattttagtggtatttttggcacccttatatatgttttccaaactttcagcagtgatattatttccataacttaaaaagtgagtttgaaaaagaaaatctccagcaagcatctcatttaaataaaggtttgtcatctttaaaaatacagcaatatgtgactttttaaaaaagctgtcaaataggtgtgaccctactaataattattagaaatacatttaaaaacatcgagtacctcaagtcagtttgccttgaaaaatatcaaatataactcttagagaaatgtacataaaagaatgcttcgtaattttggagtaggaggttccctcctcaattttgtatttttaaaaagtacatggtaaaaaaaaaaattcacaacagtatataaggctgtaaaatgagaattctgccccctcacctcttaccccagtactattctccagaggtaatctattaacaatttcttatgtaattttcagaaaatttgtatgcgtatataagcaaatatgtaatctttattttttaaataaatgggatcatattatatattcta

SEQ ID NO: 341832 - DNA, 3917 bp, Homo sapiens
gcggccgcaccatcgactcgccaacgagagaaggtcctggggcacggacaccgacgggttgcgactgtgacgtgaggtgttctcgcgcgcgctagcgcgcgtctccgggtgccgctgacgggcgtgcgcgcttgtgcggagccggaggtgggggccgaaccagccaaggttgcgggggccgcagagccggacgaagacggagggcggagccggcttcgggactgcggagactacacaccgagcgagcgcctgggcccgaagggagcgatgctgtggttccagggcgccattccggccgccatcgcgacggccaaaaggagcggcgcggtcttcgtggtgttcgtggcaggtgatgatgaacagtctacacagatggctgcaagttgggaagatgataaagttacagaagcatcttcaaacagttttgttgctattaaaatcgataccaaaagtgaagcctgcctacagttttcacaaatctatcctgtagtgtgtgttccatccagtttctttattggagacagtggaattcccttggaagtaatagcaggaagtgtttctgcagatgaacttgttacaagaattcacaaggtccgacagatgcatttgctaaaaagtgaaacatcagtagcaaatggcagtcagtcagaaagttcagtgtctactccatctgcgtcatttgaacctaacaacacttgtgaaaactctcagtccagaaatgcagagctttgtgagataccacccacttctgatacaaagtcagatactgcaacaggaggagaaagtgcaggccatgccacttcctctcaggagcctagtggatgctcagatcagagacctgcagaggacctcaacatccgagtggaaagactaacaaaaaaacttgaagaaaggagagaagagaaaagaaaagaggaagaacagagagaaattaagaaggaaattgagaggagaaaaactggaaaagaaatgttggattataaaagaaaacaagaagaagaattaacaaaaagaatgctggaggaaagaaacagagagaaagcagaagatagggcagctcgagaacgtataaaacagcagattgcattggaccgtgcagagagagctgctcgttttgcaaagacaaaggaagaagtagaggctgccaaagctgctgccttgctagcaaaacaggcagaaatggaagtcaagagggaatcttatgcaagagaaagaagcactgttgcaagaattcaattccgtcttcctgatggttcttcctttacaaatcagttcccttctgatgctcctctagaagaggcaaggcagtttgctgcacagactgttggcaacacttacggtaatttttcgttagcaaccatgtttcccaggagggaatttaccaaagaagattataaaaagaagttactggatttggaacttgccccaagcgcttcggtggtactgttgccagcaggaagaccaactgcatccattgtacactcttccagcggagacatttggaccttgttgggaacagtgctttatccattccttgccatctggagattaattagcaatttcttgtttagtaatccgcctcccacacagacttcagtgagagtaacatcgtcagaacccccaaaccctgcatcatctagcaaatcagaaaaaagggaaccagtgagaaaaagagtgctggaaaaacgtggagacgactttaaaaaggaggggaaaatttatagattaaggactcaagatgatggtgaagatgaaaacaacacttggaatggaaattccactcaacagatgtagtgtgacaagtataatatgtgcaataatcattgtttctcttatgatttaattcaactaaaattctactggagaagtgggactgctttatattttccaactggtctataaaatgtctctttattcctgcttagtgggtgtgggttgaaggtgtttaactcagaaaagtaaagacaggaaataactctctgctaggtccttgcttatatggcaaccactgctagaaccctaaaagaaccaaaaatctgccacagcctgcctccatcagcttcttatttagtatttcatatgcccattagccctatgcttcagatgacacgttttgtttagagctactttgctccaagactcttaagcccaaagtaactggtatgtcactgagtaacttgactcggtgtcagagcattttaactagccactcagatgagaatttatgtttaacttctctttttactcatcagctgcaagcaaaatcttgtagtttttaatcttaaacactgaataaaaaaactttcccctaaattggaatgatcttagttttgctttgagttttgttatctagcatctttttgttgcacagggctctattgaggtcctatgtctctgatttttttttttccccagtattgccctggagctgtctctggaaagtagctggcgaggttaccttaactatcactgaagaaagaaattttctgacacactgatggcatgtgacttgtctcctaagtcagtgaggcatcactttgtttgcataaagtatacggtttgttaaggcctttgttcttgtgagatgcaaaacagctgctagtctgcaacctagttttccctctcacctttaactgacgttttgtcctcaataattacacaaggacctagagtacctataggacaaaaagtatagaataaaaatatgcctttagtcatttggtttttcttaaaaagttgagattcttaatctgacttacatgttactttatccgtatgtctttgttagtggagaccgctaaactaatgatgtttgaaaacagttcctctgttttagattggaagatagcactctagagtggacatacggaaagactgtgactttattttgtaatgggaggaagaaattttctcagagcaaactttctattttttacctgtgaaataacagtgactttttaaaatggtgacagtgttggcaaggaaacagcaacacaggctgcgctgttggtaggagtgaaaaccagtataattcttctgaaaaacatttatcagaaacttaatgtttaggtaaagacatactcattaagtgttatttattttactcaagaactggaaaccaactaaatgccttctatagaagtaatttttgatgaggagaaatggtacaatactaattaacaacttggtttaacatgtttactgagcatctgttaagtgttgggggaaaaagcagcaggatccagagctataggtacagtgtgatctcagctttgcaaacacattttctacatagatagtactaggtattaatagatatgtaaagaaagaaatcacaccattaataatggtaagattggtttatgtgattttagtggtatttttggcacccttatatatgttttccaaactttcagcagtgatattatttccataacttaaaaagtgagtttgaaaaagaaaatctccagcaagcatctcatttaaataaaggtttgtcatctttaaaaatacagcaatatgtgactttttaaaaaagctgtcaaataggtgtgaccctactaataattattagaaatacatttaaaaacatcgagtacctcaagtcagtttgccttgaaaaatatcaaatataactcttagagaaatgtacataaaagaatgcttcgtaattttggagtaggaggttccctcctcaattttgtatttttaaaaagtacatggtaaaaaaaaaaattcacaacagtatataaggctgtaaaatgagaattctgccccctcacctcttaccccagtactattctccagaggtaatctattaacaatttcttatgtaattttcagaaaatttgtatgcgtatataagcaaatatgtaatctttattttttaaataaatgggatcatattatatattcta

SEQ ID NO: 341833 - DNA, 3234 bp, Homo sapiens
  misc_feature (28)..(28): n is a, c, g, or t
ataatccaacatttcttttccagttttnctcctctcaatttccttcttaatttctctctgttcttcctctcaggagcctagtggatgctcagatcagagacctgcagaggacctcaacatccgagtggaaagactaacaaaaaaacttgaagaaaggagagaagagaaaagaaaagaggaagaacagagagaaattaagaaggaaattgagaggagaaaaactggaaaagaaatgttggattataaaagaaaacaagaagaagaattaacaaaaagaatgctggaggaaagaaacagagagaaagcagaagatagggcagctcgagaacgtataaaacagcagattgcattggaccgtgcagagagagctgctcgttttgcaaagacaaaggaagaagtagaggctgccaaagctgctgccttgctagcaaaacaggcagaaatggaagtcaagagggaatcttatgcaagagaaagaagcactgttgcaagaattcaattccgtcttcctgatggttcttcctttacaaatcagttcccttctgatgctcctctagaagaggcaaggcagtttgctgcacagactgttggcaacacttacggtaatttttcgttagcaaccatgtttcccaggagggaatttaccaaagaagattataaaaagaagttactggatttggaacttgccccaagcgcttcggtggtactgttgccagcaggaagaccaactgcatccattgtacactcttccagcggagacatttggaccttgttgggaacagtgctttatccattccttgccatctggagattaattagcaatttcttgtttagtaatccgcctcccacacagacttcagtgagagtaacatcgtcagaacccccaaaccctgcatcatctagcaaatcagaaaaaagggaaccagtgagaaaaagagtgctggaaaaacgtggagacgactttaaaaaggaggggaaaatttatagattaaggactcaagatgatggtgaagatgaaaacaacacttggaatggaaattccactcaacagatgtagtgtgacaagtataatatgtgcaataatcattgtttctcttatgatttaattcaactaaaattctactggagaagtgggactgctttatattttccaactggtctataaaatgtctctttattcctgcttagtgggtgtgggttgaaggtgtttaactcagaaaagtaaagacaggaaataactctctgctaggtccttgcttatatggcaaccactgctagaaccctaaaagaaccaaaaatctgccacagcctgcctccatcagcttcttatttagtatttcatatgcccattagccctatgcttcagatgacacgttttgtttagagctactttgctccaagactcttaagcccaaagtaactggtatgtcactgagtaacttgactcggtgtcagagcattttaactagccactcagatgagaatttatgtttaacttctctttttactcatcagctgcaagcaaaatcttgtagtttttaatcttaaacactgaataaaaaaactttcccctaaattggaatgatcttagttttgctttgagttttgttatctagcatctttttgttgcacagggctctattgaggtcctatgtctctgatttttttttttccccagtattgccctggagctgtctctggaaagtagctggcgaggttaccttaactatcactgaagaaagaaattttctgacacactgatggcatgtgacttgtctcctaagtcagtgaggcatcactttgtttgcataaagtatacggtttgttaaggcctttgttcttgtgagatgcaaaacagctgctagtctgcaacctagttttccctctcacctttaactgacgttttgtcctcaataattacacaaggacctagagtacctataggacaaaaagtatagaataaaaatatgcctttagtcatttggtttttcttaaaaagttgagattcttaatctgacttacatgttactttatccgtatgtctttgttagtggagaccgctaaactaatgatgtttgaaaacagttcctctgttttagattggaagatagcactctagagtggacatacggaaagactgtgactttattttgtaatgggaggaagaaattttctcagagcaaactttctattttttacctgtgaaataacagtgactttttaaaatggtgacagtgttggcaaggaaacagcaacacaggctgcgctgttggtaggagtgaaaaccagtataattcttctgaaaaacatttatcagaaacttaaaatatttcataccgtttgatccagtagcttcttctaaatcataaatgcagacaatgtttaggtaaagacatactcattaagtgttatttattttactcaagaactggaaaccaactaaatgccttctatagaagtaatttttgatgaggagaaatggtacaatactaattaacaacttggtttaacatgtttactgagcatctgttaagtgttgggggaaaaagcagcaggatccagagctataggtacagtgtgatctcagctttgcaaacacattttctacatagatagtactaggtattaatagatatgtaaagaaagaaatcacaccattaataatggtaagattggtttatgtgattttagtggtatttttggcacccttatatatgttttccaaactttcagcagtgatattatttccataacttaaaaagtgagtttgaaaaagaaaatctccagcaagcatctcatttaaataaaggtttgtcatctttaaaaatacagcaatatgtgactttttaaaaaagctgtcaaataggtgtgaccctactaataattattagaaatacatttaaaaacatcgagtacctcaagtcagtttgccttgaaaaatatcaaatataactcttagagaaatgtacataaaagaatgcttcgtaattttggagtaggaggttccctcctcaattttgtatttttaaaaagtacatggtaaaaaaaaaaattcacaacagtatataaggctgtaaaatgagaattctgccccctcacctcttaccccagtactattctccagaggtaatctattaacaatttcttatgtaattttcagaaaatttgtatgcgtatataagcaaatatgtaatctttattttttaaataaatgggatcatattatatattcta

SEQ ID NO: 341834 - DNA, 3103 bp, Homo sapiens
tgggactgctttatattttccaactggtctataaaatgtctctttattcctgcttagtgggtgtgggttgaaggtgtttaactcagaaaagaaaagaggaagaacagagagaaattaagaaggaaattgagaggagaaaaactggaaaagaaatgttggattataaaagaaaacaagaagaagaattaacaaaaagaatgctggaggaaagaaacagagagaaagcagaagatagggcagctcgagaacgtataaaacagcagattgcattggaccgtgcagagagagctgctcgttttgcaaagacaaaggaagaagtagaggctgccaaagctgctgccttgctagccactgttgcaagaattcaattccgtcttcctgatggttcttcctttacaaatcagttcccttctgatgctcctctagaagaggcaaggcagtttgctgcacagactgttggcaacacttacggtaatttttcgttagcaaccatgtttcccaggagggaatttaccaaagaagattataaaaagaagttactggatttggaacttgccccaagcgcttcggtggtactgttgccagcaggaagaccaactgcatccattgtacactcttccagcggagacatttggaccttgttgggaacagtgctttatccattccttgccatctggagattaattagcaatttcttgtttagtaatccgcctcccacacagacttcagtgagagtaacatcgtcagaacccccaaaccctgcatcatctagcaaatcagaaaaaagggaaccagtgagaaaaagagtgctggaaaaacgtggagacgactttaaaaaggaggggaaaatttatagattaaggactcaagatgatggtgaagatgaaaacaacacttggaatggaaattccactcaacagatgtagtgtgacaagtataatatgtgcaataatcattgtttctcttatgatttaattcaactaaaattctactggagaagtgggactgctttatattttccaactggtctataaaatgtctctttattcctgcttagtgggtgtgggttgaaggtgtttaactcagaaaagtaaagacaggaaataactctctgctaggtccttgcttatatggcaaccactgctagaaccctaaaagaaccaaaaatctgccacagcctgcctccatcagcttcttatttagtatttcatatgcccattagccctatgcttcagatgacacgttttgtttagagctactttgctccaagactcttaagcccaaagtaactggtatgtcactgagtaacttgactcggtgtcagagcattttaactagccactcagatgagaatttatgtttaacttctctttttactcatcagctgcaagcaaaatcttgtagtttttaatcttaaacactgaataaaaaaactttcccctaaattggaatgatcttagttttgctttgagttttgttatctagcatctttttgttgcacagggctctattgaggtcctatgtctctgatttttttttttccccagtattgccctggagctgtctctggaaagtagctggcgaggttaccttaactatcactgaagaaagaaattttctgacacactgatggcatgtgacttgtctcctaagtcagtgaggcatcactttgtttgcataaagtatacggtttgttaaggcctttgttcttgtgagatgcaaaacagctgctagtctgcaacctagttttccctctcacctttaactgacgttttgtcctcaataattacacaaggacctagagtacctataggacaaaaagtatagaataaaaatatgcctttagtcatttggtttttcttaaaaagttgagattcttaatctgacttacatgttactttatccgtatgtctttgttagtggagaccgctaaactaatgatgtttgaaaacagttcctctgttttagattggaagatagcactctagagtggacatacggaaagactgtgactttattttgtaatgggaggaagaaattttctcagagcaaactttctattttttacctgtgaaataacagtgactttttaaaatggtgacagtgttggcaaggaaacagcaacacaggctgcgctgttggtaggagtgaaaaccagtataattcttctgaaaaacatttatcagaaacttaaaatatttcataccgtttgatccagtagcttcttctaaatcataaatgcagacaatgtttaggtaaagacatactcattaagtgttatttattttactcaagaactggaaaccaactaaatgccttctatagaagtaatttttgatgaggagaaatggtacaatactaattaacaacttggtttaacatgtttactgagcatctgttaagtgttgggggaaaaagcagcaggatccagagctataggtacagtgtgatctcagctttgcaaacacattttctacatagatagtactaggtattaatagatatgtaaagaaagaaatcacaccattaataatggtaagattggtttatgtgattttagtggtatttttggcacccttatatatgttttccaaactttcagcagtgatattatttccataacttaaaaagtgagtttgaaaaagaaaatctccagcaagcatctcatttaaataaaggtttgtcatctttaaaaatacagcaatatgtgactttttaaaaaagctgtcaaataggtgtgaccctactaataattattagaaatacatttaaaaacatcgagtacctcaagtcagtttgccttgaaaaatatcaaatataactcttagagaaatgtacataaaagaatgcttcgtaattttggagtaggaggttccctcctcaattttgtatttttaaaaagtacatggtaaaaaaaaaaattcacaacagtatataaggctgtaaaatgagaattctgccccctcacctcttaccccagtactattctccagaggtaatctattaacaatttcttatgtaattttcagaaaatttgtatgcgtatataagcaaatatgtaatctttattttttaaataaatgggatcatattatatattcta

SEQ ID NO: 341835 - DNA, 3973 bp, Homo sapiens
gcggccgcaccatcgactcgccaacgagagaaggtcctggggcacggacaccgacgggttgcgactgtgacgtgaggtgttctcgcgcgcgctagcgcgcgtctccgggtgccgctgacgggcgtgcgcgcttgtgcggagccggaggtgggggccgaaccagccaaggttgcgggggccgcagagccggacgaagacggagggcggagccggcttcgggactgcggagactacacaccgagcgagcgcctgggcccgaagggagcgatgctgtggttccagggcgccattccggccgccatcgcgacggccaaaaggagcggcgcggtcttcgtggtgttcgtggcaggtgatgatgaacagtctacacagatggctgcaagttgggaagatgataaagttacagaagcatcttcaaacagttttgttgctattaaaatcgataccaaaagtgaagcctgcctacagttttcacaaatctatcctgtagtgtgtgttccatccagtttctttattggagacagtggaattcccttggaagtaatagcaggaagtgtttctgcagatgaacttgttacaagaattcacaaggtccgacagatgcatttgctaaaaagtgaaacatcagtagcaaatggcagtcagtcagaaagttcagtgtctactccatctgcgtcatttgaacctaacaacacttgtgaaaactctcagtccagaaatgcagagctttgtgagataccacccacttctgatacaaagtcagatactgcaacaggaggagaaagtgcaggccatgccacttcctctcaggagcctagtggatgctcagatcagagacctgcagaggacctcaacatccgagtggaaagactaacaaaaaaacttgaagaaaggagagaagagaaaagaaaagaggaagaacagagagaaattaagaaggaaattgagaggagaaaaactggaaaagaaatgttggattataaaagaaaacaagaagaagaattaacaaaaagaatgctggaggaaagaaacagagagaaagcagaagatagggcagctcgagaacgtataaaacagcagattgcattggaccgtgcagagagagctgctcgttttgcaaagacaaaggaagaagtagaggctgccaaagctgctgccttgctagcaaaacaggcagaaatggaagtcaagagggaatcttatgcaagagaaagaagcactgttgcaagaattcaattccgtcttcctgatggttcttcctttacaaatcagttcccttctgatgctcctctagaagaggcaaggcagtttgctgcacagactgttggcaacacttacggtaatttttcgttagcaaccatgtttcccaggagggaatttaccaaagaagattataaaaagaagttactggatttggaacttgccccaagcgcttcggtggtactgttgccagcaggaagaccaactgcatccattgtacactcttccagcggagacatttggaccttgttgggaacagtgctttatccattccttgccatctggagattaattagcaatttcttgtttagtaatccgcctcccacacagacttcagtgagagtaacatcgtcagaacccccaaaccctgcatcatctagcaaatcagaaaaaagggaaccagtgagaaaaagagtgctggaaaaacgtggagacgactttaaaaaggaggggaaaatttatagattaaggactcaagatgatggtgaagatgaaaacaacacttggaatggaaattccactcaacagatgtagtgtgacaagtataatatgtgcaataatcattgtttctcttatgatttaattcaactaaaattctactggagaagtgggactgctttatattttccaactggtctataaaatgtctctttattcctgcttagtgggtgtgggttgaaggtgtttaactcagaaaagtaaagacaggaaataactctctgctaggtccttgcttatatggcaaccactgctagaaccctaaaagaaccaaaaatctgccacagcctgcctccatcagcttcttatttagtatttcatatgcccattagccctatgcttcagatgacacgttttgtttagagctactttgctccaagactcttaagcccaaagtaactggtatgtcactgagtaacttgactcggtgtcagagcattttaactagccactcagatgagaatttatgtttaacttctctttttactcatcagctgcaagcaaaatcttgtagtttttaatcttaaacactgaataaaaaaactttcccctaaattggaatgatcttagttttgctttgagttttgttatctagcatctttttgttgcacagggctctattgaggtcctatgtctctgatttttttttttccccagtattgccctggagctgtctctggaaagtagctggcgaggttaccttaactatcactgaagaaagaaattttctgacacactgatggcatgtgacttgtctcctaagtcagtgaggcatcactttgtttgcataaagtatacggtttgttaaggcctttgttcttgtgagatgcaaaacagctgctagtctgcaacctagttttccctctcacctttaactgacgttttgtcctcaataattacacaaggacctagagtacctataggacaaaaagtatagaataaaaatatgcctttagtcatttggtttttcttaaaaagttgagattcttaatctgacttacatgttactttatccgtatgtctttgttagtggagaccgctaaactaatgatgtttgaaaacagttcctctgttttagattggaagatagcactctagagtggacatacggaaagactgtgactttattttgtaatgggaggaagaaattttctcagagcaaactttctattttttacctgtgaaataacagtgactttttaaaatggtgacagtgttggcaaggaaacagcaacacaggctgcgctgttggtaggagtgaaaaccagtataattcttctgaaaaacatttatcagaaacttaaaatatttcataccgtttgatccagtagcttcttctaaatcataaatgcagacaatgtttaggtaaagacatactcattaagtgttatttattttactcaagaactggaaaccaactaaatgccttctatagaagtaatttttgatgaggagaaatggtacaatactaattaacaacttggtttaacatgtttactgagcatctgttaagtgttgggggaaaaagcagcaggatccagagctataggtacagtgtgatctcagctttgcaaacacattttctacatagatagtactaggtattaatagatatgtaaagaaagaaatcacaccattaataatggtaagattggtttatgtgattttagtggtatttttggcacccttatatatgttttccaaactttcagcagtgatattatttccataacttaaaaagtgagtttgaaaaagaaaatctccagcaagcatctcatttaaataaaggtttgtcatctttaaaaatacagcaatatgtgactttttaaaaaagctgtcaaataggtgtgaccctactaataattattagaaatacatttaaaaacatcgagtacctcaagtcagtttgccttgaaaaatatcaaatataactcttagagaaatgtacataaaagaatgcttcgtaattttggagtaggaggttccctcctcaattttgtatttttaaaaagtacatggtaaaaaaaatttttcaccgcggtttttggccctataatgtgtttttgcccccctccctcttttacctcccttcttttctcgccgggtgttttcttttctccaatttcttatgtaattttcagaaaatttgtatgcgtatataagcaaatatgtaatctttattttttaaataaatgggatcatattatatattcta

SEQ ID NO: 341836 - DNA, 2310 bp, Homo sapiens
gcggccgcaccatcgactcgccaacgagagaaggtcctggggcacggacaccgacgggttgcgactgtgacgtgaggtgttctcgcgcgcgctagcgcgcgtctccgggtgccgctgacgggcgtgcgcgcttgtgcggagccggaggtgggggccgaaccagccaaggttgcgggggccgcagagccggacgaagacggagggcggagccggcttcgggactgcggagactacacaccgagcgagcgcctgggcccgaagggagcgatgctgtggttccagggcgccattccggccgccatcgcgacggccaaaaggagcggcgcggtcttcgtggtgttcgtggcaggtgatgatgaacagtctacacagatggctgcaagttgggaagatgataaagttacagaagcatcttcaaacagttttgttgctattaaaatcgataccaaaagtgaagcctgcctacagttttcacaaatctatcctgtagtgtgtgttccatccagtttctttattggagacagtggaattcccttggaagtaatagcaggaagtgtttctgcagatgaacttgttacaagaattcacaaggtccgacagatgcatttgctaaaaagtgaaacatcagtagcaaatggcagtcagtcagaaagttcagtgtctactccatctgcgtcatttgaacctaacaacacttgtgaaaactctcagtccagaaatgcagagctttgtgagataccacccacttctgatacaaagtcagatactgcaacaggaggagaaagtgcaggccatgccacttcctctcaggagcctagtggatgctcagatcagagacctgcagaggacctcaacatccgagtggaaagactaacaaaaaaacttgaagaaaggagagaagagaaaagaaaagaggaagaacagagagaaattaagaaggaaattgagaggagaaaaactggaaaagaaatgttggattataaaagaaaacaagaagaagaattaacaaaaagaatgctggaggaaagaaacagagagaaagcagaagatagggcagctcgagaacgtataaaacagcagattgcattggaccgtgcagagagagctgctcgttttgcaaagacaaaggaagaagtagaggctgccaaagctgctgccttgctagcaaaacaggcagaaatggaagtcaagagggaatcttatgcaagagaaagaagcactgttgcaagaattcaattccgtcttcctgatggttcttcctttacaaatcagttcccttctgatgctcctctagaagaggcaaggcagtttgctgcacagactgttggcaacacttacggtaatttttcgttagcaaccatgtttcccaggagggaatttaccaaagaagattataaaaagaagttactggatttggaacttgccccaagcgcttcggtggtactgttgccagcaggaagaccaactgcatccattgtacactcttccagcggagacatttggaccttgttgggaacagtgctttatccattccttgccatctggagattaattagcaatttcttgtttagtaatccgcctcccacacagacttcagtgagagtaacatcgtcagaacccccaaaccctgcatcatctagcaaatcagaaaaaagggaaccagtgagaaaaagagtgctggaaaaacgtggagacgactttaaaaaggaggggaaaatttatagattaaggactcaagatgatggtgaagatgaaaacaacacttggaatggaaattccactcaacagatgtagtgtgacaagtataatatgtgcaataatcattgtttctcttatgatttaattcaactaaaattctactggagaagtgggactgctttatattttccaactggtctataaaatgtctctttattcctgcttagtgggtgtgggttgaaggtgtttaactcagaaaagtaaagacaggaaataactctctgctaggtccttgcttatatggcaaccactgctagaaccctaaaagaaccaaaaatctgccacagcctgcctccatcagcttcttatttagtatttcatatgcccattagccctatgcttcagatgacacgttttgtttagagctactttgctccaagactcttaagcccaaagtaactggtatgtcactgagtaacttgactcggtgtcagagcattttaactagccactcagatgagaatttatgtttaacttctctttttactcatcagctgcaagcaaaatcttgtagtttttaatcttaaacactgaataaaaaaactttcccct

SEQ ID NO: 341837 - DNA, 1663 bp, Homo sapiens
gcggccgcaccatcgactcgccaacgagagaaggtcctggggcacggacaccgacgggttgcgactgtgacgtgaggtgttctcgcgcgcgctagcgcgcgtctccgggtgccgctgacgggcgtgcgcgcttgtgcggagccggaggtgggggccgaaccagccaaggttgcgggggccgcagagccggacgaagacggagggcggagccggcttcgggactgcggagactacacaccgagcgagcgcctgggcccgaagggagcgatgctgtggttccagggcgccattccggccgccatcgcgacggccaaaaggagcggcgcggtcttcgtggtgttcgtggcaggtgatgatgaacagtctacacagatggctgcaagttgggaagatgataaagttacagaagcatcttcaaacagttttgttgctattaaaatcgataccaaaagtgaagcctgcctacagttttcacaaatctatcctgtagtgtgtgttccatccagtttctttattggagacagtggaattcccttggaagtaatagcaggaagtgtttctgcagatgaacttgttacaagaattcacaaggtccgacagatgcatttgctaaaaagtgaaacatcagtagcaaatggcagtcagtcagaaagttcagtgtctactccatctgcgtcatttgaacctaacaacacttgtgaaaactctcagtccagaaatgcagagctttgtgagataccacccacttctgatacaaagtcagatactgcaacaggaggagaaagtgcaggccatgccacttcctctcaggagcctagtggatgctcagatcagagacctgcagaggacctcaacatccgagtggaaagactaacaaaaaaacttgaagaaaggagagaagagaaaagaaaagaggaagaacagagagaaattaagaaggaaattgagaggagaaaaactggaaaagaaatgttggattataaaagaaaacaagaagaagaattaacaaaaagaatgctggaggaaagaaacagagagaaagcagaagatagggcagctcgagaacgtataaaacagcagattgcattggaccgtgcagagagagctgctcgttttgcaaagacaaaggaagaagtagaggctgccaaagctgctgccttgctagcgtactatatttcatgctgaaacatctctgtgcacataggggctgaggagaatgattataagctggtttttaacactgatgtatactgtggttataagcagtccattccagagggacatattaatttgacagctcccaatggtatctctcatttcgtgtgagtgtacactaaaaaagtactacataaataactttaaaagagggcccaatagccgggcgcggtggctcacgcctgtaatcccagcactttgggaggccgagacgggcggatcacgaggtcaggagatcgagaccatcctggctaacatggtgaaaccccgtctctactaaaaatacaaaaattagctgggcatggtggcgggcgcctgtagtcccagctacgcgggaggctgaggcaggagaatggcgtgaacccgggaggcggagcttgcagtgagccgagattgcgccactgcactccagcctgggcgacagagcgagactccgtccccaaaaaaa

SEQ ID NO: 341838 - DNA, 953 bp, Homo sapiens
gcggccgcaccatcgactcgccaacgagagaaggtcctggggcacggacaccgacgggttgcgactgtgacgtgaggtgttctcgcgcgcgctagcgcgcgtctccgggtgccgctgacgggcgtgcgcgcttgtgcggagccggaggtgggggccgaaccagccaaggttgcgggggccgcagagccggacgaagacggagggcggagccggcttcgggactgcggagactacacaccgagcgagcgcctgggcccgaagggagcgatgctgtggttccagggcgccattccggccgccatcgcgacggccaaaaggagcggcgcggtcttcgtggtgttcgtggcaggtgatgatgaacagtctacacagatggctgcaagttgggaagatgataaagttacagaagcatcttcaaacagttttgttgctattaaaatcgataccaaaagtgaagcctgcctacagttttcacaaatctacttcattaaactgtacagatcctgtagtgtgtgttccatccagtttctttattggagacagtggaattcccttggaagtaatagcaggaagtgtttctgcagatgaacttgttacaagaattcacaaggtccgacagatgcatttgctaaaaagtgaaacatcagtagcaaatggcagtcagtcagaaagttcagtgtctactccatctgcgtcatttgaacctaacaacacttgtgaaaactctcagtccagaaatgcagagctttgtgagataccacccacttctgatacaaagtcagatactgcaacaggaggagaaagtgcaggccatgccacttcctctcaggagcctagtggatgctcagatcagagacctgcagaggacctcaacatccgagtggaaagactatacccaagataacttgaagtaacggagatgaagagctgtagcctagtgatagtgtttcctg

SEQ ID NO: 341839 - DNA, 412 bp, Homo sapiens
ttttgctttgatttggcttggagccaaattgtatgttttaatcagaatatccatggcctgattcactttgttcaagtctctgcctctccttcagtttctagtttctatattctaattaagatgttttgtagttctgatattacttatcaccttgtatggtttaatgcaagctacctcaagtcctttgtgaatggggcagagcgtgtacacatgcacacaggtgtatgcacacacacttatactttcccagtagttgtgacttttttcaagtatgttaacaacaatcacgttttttaaatattccattctttggaaatattttcagcacctctctgctaacattaatctaatacctggaaatatgacaagaggtgttacttgtcctcatgaaagagcctattacatagtgtaa

SEQ ID NO: 341840 - DNA, 1452 bp, Homo sapiens
cgcccccaggacgcgttgttcgctgccggagtttggggtggcaaggaccgggcgcacggctgagatgcgctgccctccagaatgcgagcctgtgcacgcgcctgcggaggggccacactccctgcagcgtccgcgatgcgctgttcccgctggcgctcggcgggcgctcccctgggcacatcgaggctctagtgaccgcattatgaattagtcctttccttttctcctcatgtgattgcagcgagcgctcgtcttgtttgtaaatcgtgctggcaagccccgttttaaccaactacgaatttcatttcggaatgaaaaaggagacgcactttcggacagggcagcggttgccgccggtccttcctctgagctaccggtccctagaaggaagacctgccttcgaccgatctggaaatgagtcccagctgcaagcccagggcggcggaagccccacgggccgagccgaagaaagacgaggcgggggacggggagcgtagtgccgcgtgccgggacccacaacccctttcccctgggcgctcttccccgagcggacaggaaaaagctctcctttgccgctgcccatcccccagggcccaagcgatgcttcctaaccgcgtggacgcagcttgatgggggagaaagagctctgggagcagggcttagagcctcgtctcgcctcctgccaactcggtccggcaaggttccgaacctccctgagcctcagcttcctaatctggcaaacatgacgacaaaagtccttctcttttaaggttggtgcaaaaattaaatggccctttactgtatatttagagcacctggctcacggattagtcacctcgctcctgggctcaacagtgttcactgggtccttacagcatcacactgggatccttaagggcaaagaccaaaattagacctagcttaattcctggtgtgcaagtgctaagtgttatgaaatgagtgagtgacaggatgatccagctatgagaaataggagagagtttgcggtgggatagagactgtaccttctttttgtataagatgtttggcagttggggataacttaccggaagcaagcttaagatgcacacgaaatcctgaccaagaggatgtagaaattagatatatggccaagaatcagagaagcaaataaacagatctcaaataaaatgtttagttttgaggttagaggtgggatatcagggtaaccaggcaaaataactgatacaataaataactacatgacaaatcacttctctcaacaacacatttcaaaaaaaatcactttattttataactgcaagattttcttcaaaccagtttcttgctattacaagctcaaaaacttatcctgctctggtggcaaacattttgtgactcatgctgtgtaacaaagacctgtgtagacattgagttgtatattgctgatgcttctgaacataaaggaaaagt

SEQ ID NO: 341841 - DNA, 225 bp, Homo sapiens
gctggtgttgttatgttgctgttgttatgctggtcgtgctgctccatgttctccaggtgttcttcccttttatcgtcacagttaccccgtacacctgacaactggacatctgcgcctgggggtcttcagcctaaacacacctaaaccctccaccaaacccctctgcttccgcctccccgtgtctgtgagcgcctccactgcccatccctctgctcaggccccact

SEQ ID NO: 341842 - DNA, 685 bp, Homo sapiens
tgggtaggagagagttgatgtggggttgttgagagacatgagggttctttgtggcttggcttaaaaggcttataatcacatagtggtctgtgttgggcagcatggaaatgaagccccaagctttattggctataaacgtggagttctaatttccgaggaagatctcccatctgtttccctatccataagccaagatagactaggggtgaacaacacactgctagtgagagtataaattatttgtgcccaggggtttagattctctgtgtccatcgctactaattcttactcattcctgacaccctagtatccctttcagcatattttgacaaccccatctctgttttaaaattcttccctgcaggattcatatgtcagggaattgcgttctggtttaattggaacaagccatttggaagtcctcctggtctggagaacattctgtgaggtagagaggctgcaaccccaggataatgtcctcagtgggagggacaggaggtcttatgtcaagaagaggtgatggtccctctcctcaccagtgatggctagtccgaggacatcctttaattccacatctgttcaagttttgtctttggatctcagaatgtgcctgcctgcagggaaaatcaaaggagttgaaatgacagtaaatattaaccttgaaagagactttaaaaaaaataaa

SEQ ID NO: 341843 - DNA, 787 bp, Homo sapiens
ctttggatgctacacccatcactgtgttgacacagctcttaaaggtgctcgcttaatcaatggatccagtgacttttccatcctgacaaggccagtcattaccatggatgaggtccaggctttctgaagttgcttctaccagctgtcttctctagcagccaaatgccatattctatcatcagcctggctgcataaccttgcataaactacttaaaaaccttctgcctcagcttctacttctataaaatggaaataatattagtacctacttaacagggttttgtgaggatgaggtgagccaatacctgtaaagtgctttaaataatcctggcacatgaggttgagaagcaagctggggtctccaacgaaggcttttttttttaacattaataaaatatttaataaagagtagctcattaaatgcacatggctcattaaatgccactctttattaatttttttatgatgattttctaagtgatgtttcactctgcagtttgcctcacatctcttcttcccacatttcagagatcttggctgaggttcaaccattattcttgtatctttcttcctgtgtcctctcttccccagaaatcgtatctgcccctgaagtttcagtgattgtttacatgggttcagtatcccttatttaaaattcatgagaccagaagtgtttcagatttcaaataattttggattttgggatatttgcattatacttactgattcagcattccttatccaaagatctgaaatctaaaatcctccaataaacatttccttggag

SEQ ID NO: 341844 - DNA, 544 bp, Homo sapiens
atcaagctgctgcagctgccagaaaagatgcctgctactaccagcagaaagggagtggagcccagagcatcacgaggagtgccttctagtgtactgtcaccttgccaccccctcctgtcccttcacccagacacatggaagggatggaaaaggattcttcacagagcactccggtacactgtatcagacaaaaattgatagattagctaatggtttttcttgaatttgagaagcaaagccctgttctccatattgatatgttctccctcaaccaagatcttctaaaaagaaataatattttagtcttctgcttgaggatttgactgtgaagctatgcctagtgaaaaacatattcttgcagcagctctggtggcagttatccttgaggaaccttcagtgtgtggtgggaagctatcagaacaagaaatgtaggcatttaatcttataacacttgtgctggtttcatgccttctgagaaattagaaaccctttctgttgctattatattaataaaattggtgtttgttttctggtaaaaaaaaat

SEQ ID NO: 341845 - DNA, 282 bp, Homo sapiens
gcattctgggagatgttaacagaggcccatatgactggtgattctcatgttcattcactgattcagggaaaacactctctgaatgggcgcctgaatgtggcataaaggctattttttgtggggtggcttttctttctacggttaagtggtaaagcaaggagcttatcttgcctctaggacttgagcatcaaggacaagaatatttgggacgcaaatatttcaaaggcagttttttgggggttttttgtttgtttgtgatggagtctcactctttcacccggg

SEQ ID NO: 341846 - DNA, 518 bp, Homo sapiens
gaatttaaactgccccctaaagccctctccccaacccctccactgaatgacacagatccaggtaaaaccacttctccagtggagaaactgtgcaataaaaaaaggaaagttgcagcaagacctacatccaggaatggccatgtgactcaagacagacatcagtttatgctaccaacagcgctatgcattgggagaggctgacctagaactgtatggatgcccaatccctagagaacctacgttcgccccaaccaagggcaggtcatggaggctgtggggtctacaccgactcatgaattggctgggctgatgagcacacctggccacccatctgctttggagtccacgcgcttccactggaccttggattatctcttctccagcagggcaggatgggtggtgggaggtggaagggcagtgaccactactgtcaatcctggagaggcactggcttcacagtgaaagttaataaggccctgaggctccccaagattctaaaataaaaagattaaccactg

SEQ ID NO: 341847 - DNA, 206 bp, Homo sapiens
gagaggaggaagagaggaaggagaaagaggagagagagaataaaagctaaggaaagaaggatggaaagaaaaagaaaaggacagccattccatgcttttgtatactttactcaaaccaaaaataatttgtgggaaatgtgattttttgacacatgagaggggcatgtgtgtgtttctctgttccctctttagacttagcctacatg

SEQ ID NO: 341848 - DNA, 413 bp, Homo sapiens
atgccatccaggagccaggaccaggagttggaaaccttagaaatctacctggtgttttattctactgtggctgagctggcacctataccacaagacaaaatccttaccactcttccttttccccaggcaaaagagcctctctccgtgtcaactaccaccataagcccatgggagtgctgctagactctatcaatctaactactactgtcaatgtttacttaagcccaaggcctccttagtcagcttgtggtgaatggtgccaggcctgcaactcacctttcagggcaatgcactcccctttggcccagggtaggtctagaaatggcatctaagagccaaggcctggaattggggaccccaaaagccctcttggtcctctaccccactggccaagccggtacctgagctgtaag

SEQ ID NO: 341849 - DNA, 618 bp, Homo sapiens
gaataagattgaaaactagcattggagtaggctgtggagtaatagagctttgaaatcctttttgaggctttatgtgctttcaaagaggatggcttctggcagtggagagtagttttttccataaaacatttactttgcaaatatataacaaaagactgtttccacctatatgactgaaaaatggagcattgactataaaacacatcctgttatattttcctgatttgaacacaaaagacatgtattgctcatctaacactgtgtatttaatatttcctgcgtatgagtgaaacctgttaaacaaggtgaagaaaatctataaaaggttaagatgtttttaaaaacaatttttggggcagcgttttgaagaccagtgtgtttactccttgaggatttattaatgtttaattggctctttcgtgtttatagtgctctgctgcaaacaccttttttgattttaccagtagctgcactgccatttctttatactagaagagctagaagatttgctgccagggccagcattgtgcatgtcgtactttcatgcatgtattattattttaaaaaatcatgtgtctgtgggagcaggtcagctacatttctgatacacgtatgttt

SEQ ID NO: 341850 - DNA, 852 bp, Homo sapiens
tttttacagcacaatactgcctctctacttattttttctaaaagcagagcggaggagaaaaagtgcacgcgtgcatgtgtgtgtgtgtgtataagcttactgcagctgtattacaggtgtgagggctccagatccttaccagcaagccagatactggtgttgggggtttgaggtgggaatatggaattagttatcaggagttggaactctttaagtctgactctatccctgatttgtgacctaggtttagtcacttaattactcagagcctcattgttctacctggcaagtaatatccatctgatattattacttcgtttttatgtaacagttatagaattcactagctactacattagaccatatggaaaaaatcaaggtactactgtgatacattcagacaatgcaatattattgagagctaaaaagaaatgaactatcaaaccatgaaaaacatagaagaaccttacatgcttattactgagtgaaagaaaccaatttggaaaggctgcatactgtatgactccaactctatgacattctggaaagggtagaactatggaggcagtaaaaagaggagtggttgccagagggtgagggaaggttgtgctgaatagacaggcatagaggaatttcaggacagtgaaactactctgtgtgatagtataatggtggctgtatgtcattatatgtttgtctaaatccatggaatgtacagcatcaggagtgaacactagtttaaactgtggacttcgacagtattgaggtgtcagtgtaggttcgattgtaacaaatgttctgctatgtgtagcttgttgatagtggggagatgtggggtggggaggccaggag

SEQ ID NO: 341851 - DNA, 467 bp, Homo sapiens
gggctcaaccccagatttgagcagggagaaaaaaaaaatcagcaaacttcaatataggtcagttgagatgatctagtctgggcaacagattgaaaagagaaagaagaaacatcaacaggcctcaaagtcctgtgggacacaatcaagcacaccaacgtgcgcgtaatgggagtttcagaaggagaggagaaaaagaaaagggcaggcataatacttgaataaaagaatggccaaaaacttcctaaatttaatgagaaatatttatcgacacatccaagaagcttaacaaatgccaagtgacataaacaaatccacacctcaacacattgtaattaaccgattaaaagtcaagggcaaagagagactcttgaaagtggccactttcaagaagaaaagccacaaagagagaagccactcatcacataatcctccataagatttacagttgatgccatgaaagccaaaag

SEQ ID NO: 341852 - DNA, 431 bp, Homo sapiens
ccatgttacttttaattagtgtaattaccatggagacaataggcatcatctgtcactgtttatctttcattctaatcaaaagagacattttaaacaagctttttaggatctctgaaatattgtctactcataatcatgtattataaagttcagctgttttaaaagttaactataccaggagtgtactcattaggtatgataacaagttaactggttaatctcatacagatggaaagttcttataagttagacatttttgagttgtgcacctatatttggaaagaacaacttttagtcatatccctcatatatctgttttgacgttttatgtcagccttatgtttaaatgtgatacctcattataacgtcctaaaggcaagaaacaatatacccaaataaaaatatgtctatgcttctgtgttataatttat

SEQ ID NO: 341853 - DNA, 1652 bp, Homo sapiens
gctcagcaaggggtccgtccttctctgtcactgtctcttttgcctgttgtaattctgtctgcctctctgggactctgcctgtctcactctttctgtctgtgcctctcctcactcttgttctttctgcctgaatcacagccctcagtttttctgtcctcatgcatttgtctttgtggctctttccgtctttctgcccttgacaccatcccctctcccagtgcttcccctctgcttccagatcgcttcatgacttaggcagggaaacagaggtcagggcctccttccaggcttccctctgcatcttactgagtatgcaggtcggaagagcctcgggtcctgcctccgcgggtggcctagagccaaaggaaggcggagcccgtcggggcgggattggcccttagggccacctcataaagcctggggcgaggggcacaacggccttgggaaggagccctgctggggccgtccagtcccccagacctcacaggctcagtcgcggatctgcagtgtcatgcctgggagccctcggcccgcgccaagctgggtgctgttgctgcggctgctggcgttgctgcggcccccggggctgggtgaggcatgcagctgcgccccggcgcaccctcagcagcacatctgccactcggcacttgtgattcgggccaaaatctccagtgagaaggtagttccggccagtgcagaccctgctgacactgaaaaaatgctccggtatgaaatcaaacagataaagatgttcaaagggtttgagaaagtcaaggatgttcagtatatctatacgccttttgactcttccctctgtggtgtgaaactagaagccaacagccagaagcagtatctcttgactggtcaggtcctcagtgatggaaaagtcttcatccatctgtgcaactacatcgagccctgggaggacctgtccttggtgcagagggaaagtctgaatcatcactaccatctgaactgtggctgccaaatcaccacctgctacacagtaccctgtaccatctcggcccctaacgagtgcctctggacagactggctgttggaacgaaagctctatggttaccaggctcagcattatgtctgtatgaagcatgttgacggcacctgcagctggtaccggggccacctgcctctcaggaaggagtttgttgacatcgttcagccctagtagggaccagtgaccatcacatcccttcaagagtcctgaagatcaagccagttctccttccctgcagagctttggccattaccacctgacctcttgctgccagctaataagaagtgccaagtggacagtctggccactgtcaaggcagggaaggggccatgacttttctgccctgccctcagcctgttgcccctgcctcccaaaccccattagtctagccttgtagctgttactgcaagtgtttcttctggcttagtctgttttctaaagccaggactattccctttcctccccaggaatatgtgttttcctttgtcttaatcgatctggtaggggagaaatggcgaatgtcatacacatgagatggtatatccttgcgatgtacagtatcagaaggtggtttgacagcatcataaacaggctgactggcaggaatgaaaacaagaacatactgtggctgtgtatc

SEQ ID NO: 341854 - DNA, 1986 bp, Homo sapiens
gctcagcaaggggtccgtccttctctgtcactgtctcttttgcctgttgtaattctgtctgcctctctgggactctgcctgtctcactctttctgtctgtgcctctcctcactcttgttctttctgcctgaatcacagccctcagtttttctgtcctcatgcatttgtctttgtggctctttccgtctttctgcccttgacaccatcccctctcccagtgcttcccctctgcttccagatcgcttcatgacttaggcagggaaacagaggtcagggcctccttccaggcttccctctgcatcttactgagtatgcaggtcggaagagcctcgggtcctgcctccgcgggtggcctagagccaaaggaaggcggagcccgtcggggcgggattggcccttagggccacctcataaagcctggggcgaggggcacaacggccttgggaaggagccctgctggggccgtccagtcccccagacctcacaggctcagtcgcggatctgcagtgtcatgcctgggagccctcggcccgcgccaagctgggtgctgttgctgcggctgctggcgttgctgcggcccccggggctgggtgaggcatgcagctgcgccccggcgcaccctcagcagcacatctgccactcggcacttgtgattcgggccaaaatctccagtgagaaggtagttccggccagtgcagaccctgctgacactgaaaaaatgctccggtatgaaatcaaacagataaagatgttcaaagggtttgagaaagtcaaggatgttcagtatatctatacgccttttgactcttccctctgtggtgtgaaactagaagccaacagccagaagcagtatctcttgactggtcaggtcctcagtgatggaaaagtcttcatccatctgtgcaactacatcgagccctgggaggacctgtccttggtgcagagggaaagtctgaatcatcactaccatctgaactgtggctgccaaatcaccacctgctacacagtaccctgtaccatctcggcccctaacgagtgcctctggacagactggctgttggaacgaaagctctatggttaccaggctcagcattatgtctgtatgaagcatgttgacggcacctgcagctggtaccggggccacctgcctctcaggaaggagtttgttgacatcgttcagccctagtagggaccagtgaccatcacatcccttcaagagtcctgaagatcaagccagttctccttccctgcagagctttggccattaccacctgacctcttgctgccagctaataagaagtgccaagtggacagtctggccactgtcaaggcagggaaggggccatgacttttctgccctgccctcagcctgttgcccctgcctcccaaaccccattagtctagccttgtagctgttactgcaagtgtttcttctggcttagtctgttttctaaagccaggactattccctttcctccccaggaatatgtgttttcctttgtcttaatcgatctggtaggggagaaatggcgaatgtcatacacatgagatggtatatccttgcgatgtacagtatcagaaggtggtttgacagcatcataaacaggctgactggcaggaatgaaaacaaaaaaaaaaaaaaaaaaaaaaaaaaaaaaaaaaaaaaaaaaaaaaaaaaacacagacagaaaggagaacaaaccaccgaacaaaccacaacacaaaaccaaagaaccaaacacaaagaaaacaaccaaaacagacgcgacatgcagacataacaacacaaacagaacgagaagcgacgcaaccaatagacgcaacacacaaacaaatgggacacacaaggaagcacgaaataaaactcaaagagacaaagacgaacacacgacaccaccggggcaacaccacaaagcccctagcagcccgcatgacaaaaccatccagccaaaaacccgaaagagagaccgagcacacgggaagcca

SEQ ID NO: 341855 - DNA, 392 bp, Homo sapiens
tgaaagatgattcacacagatcgaagagcctccttgcatgtggtttggtagttgccattacacatgtctatctcagctgcacacagtccccctggagccagaggagctcatgttaaaagtgttgctatgggctgaattgcattacccaccccccaaaatgcctatgtcgaagtcctaccccctagtacttcggaatgtggctgtatttggagatagggcctttagaggagtgattaaattaaaatgaggtcattccggcagggcctaatctgatattactggtgtccttctatgaacaggaaatttggacacagacagctacagagggaagaccacgtgaggacacagggagaaggtggccgtctacaagccaaggagagagactgcaggag

SEQ ID NO: 341856 - DNA, 1630 bp, Homo sapiens
gctcagcaaggggtccgtccttctctgtcactgtctcttttgcctgttgtaattctgtctgcctctctgggactctgcctgtctcactctttctgtctgtgcctctcctcactcttgttctttctgcctgaatcacagccctcagtttttctgtcctcatgcatttgtctttgtggctctttccgtctttctgcccttgacaccatcccctctcccagtgcttcccctctgcttccagatcgcttcatgacttaggcagggaaacagaggtcagggcctccttccaggcttccctctgcatcttactgagtatgcaggtcggaagagcctcgggtcctgcctccgcgggtggcctagagccaaaggaaggcggagcccgtcggggcgggattggcccttagggccacctcataaagcctggggcgaggggcacaacggccttgggaaggagccctgctggggccgtccagtcccccagacctcacaggctcagtcgcggatctgcagtgtcatgcctgggagccctcggcccgcgccaagctgggtgctgttgctgcggctgctggcgttgctgcggcccccggggctgggtgaggcatgcagctgcgccccggcgcaccctcagcagcacatctgccactcggcacttgtgattcgggccaaaatctccagtgagaaggtagttccggccagtgcagaccctgctgacactgaaaaaatgctccggtatgaaatcaaacagataaagatgttcaaagggtttgagaaagtcaaggatgttcagtatatctatacgccttttgactcttccctctgtggtgtgaaactagaagccaacagccagaagcagtatctcttgactggtcaggtcctcagtgatggaaaagtcttcatccatctgtgcaactacatcgagccctgggaggacctgtccttggtgcagagggaaagtctgaatcatcactaccatctgaactgtggctgccaaatcaccacctgctacacagtaccctgtaccatctcggcccctaacgagtgcctctggacagactggctgttggaacgaaagctctatggttaccaggctcagcattatgtctgtatgaagcatgttgacggcacctgcagctggtaccggggccacctgcctctcaggaaggagtttgttgacatcgttcagccctagtagggaccagtgaccatcacatcccttcaagagtcctgaagatcaagccagttctccttccctgcagagctttggccattaccacctgacctcttgctgccagctaataagaagtgccaagtggacagtctggccactgtcaaggcagggaaggggccatgacttttctgccctgccctcagcctgttgcccctgcctcccaaaccccattagtctagccttgtagctgttactgcaagtgtttcttctggcttagtctgttttctaaagccaggactattccctttcctccccaggaatatgtgttttcctttgtcttaatcgatctggtaggggagaaatggcgaatgtcatacacatgagatggtatatccttgcgatgtacagtatcagaaggtggtttgacagcatcataaacaggctgactggcaggaatgaaaacaa

SEQ ID NO: 341857 - DNA, 1431 bp, Homo sapiens
ttctgtcaaccctatgatgtgaaacagcttgagaagctcgtgtgtagaggaagcttgacagaggctgaccgaggaatgaacttctcctgaaatcaagcccagagcattccaggaagaaaaaacaacatctgtagagatgctgagacaagaacaaacatggcgtgtgcggggagcttgcaagtcgttcagcatgacttaagtgaaatggaaagttctgagaagagtaagctgtcgaactagaaaggaaatttggacacagacagctacagagggaagaccacgtgaggacacagggagaaggtggccgtctacaagccaaggagagagactgcaggagaaaccaaccctgccaacaccctgatctcgaacttccagcctcgagaactgcccagccacagaacgttaagaggacatctgcctcccctacagctggaaacagaaggaactctaaaggtcaattgccttgcgcccagtgattcgggccaaaatctccagtgagaaggtagttccggccagtgcagaccctgctgacactgaaaaaatgctccgatgttcaaagggtttgagaaagtcaaggatgttcagtatatctatacgccttttgactcttccctctgtggtgtgaaactagaagccaacagccagaagcagtatctcttgactggtcaggtcctcagtgatggaaaagtcttcatccatctgtgcaactacatcgagccctgggaggacctgtccttggtgcagagggaaagtctgaatcatcactaccatctgaactgtggctgccaaatcaccacctgctacacagtaccctgtaccatctcggcccctaacgagtgcctctggacagactggctgttggaacgaaagctctatggttaccaggctcagcattatgtctgtatgaagcatgttgacggcacctgcagctggtaccggggccacctgcctctcaggaaggagtttgttgacatcgttcagccctagtagggaccagtgaccatcacatcccttcaagagtcctgaagatcaagccagttctccttccctgcagagctttggccattaccacctgacctcttgctgccagctaataagaagtgccaagtggacagtctggccactgtcaaggcagggaaggggccatgacttttctgccctgccctcagcctgttgcccctgcctcccaaaccccattagtctagccttgtagctgttactgcaagtgtttcttctggcttagtctgttttctaaagccaggactattccctttcctccccaggaatatgtgttttcctttgtcttaatcgatctggtaggggagaaatggcgaatgtcatacacatgagatggtatatccttgcgatgtacagtatcagaaggtggtttgacagcatcataaacaggctgactggcaggaatgaaaacaa

SEQ ID NO: 341858 - DNA, 407 bp, Homo sapiens
agaaggtccaagaaagtcgacatgttttctgccctcaagaaatgaacctctggcttaaaacaaaaaccttgcaagcaactaatgatgggctaacttggtaccggtatagaaggactcgttcaatttaccttaaatcattaagagtcccttgtcagggggcctgacaggatcccagaaaaagccaaatcctcgagcttcaagaagagctggagctaactctctatgatagttaatttacgtgtcagcttggctgggctgtggggcccagttgttccatcaaacacgagttcagatgttgctgggaaggtattttgttgatggaattaatgtcccaaatcatctggctttaagtcaaggtgaggaccgttgttcttatgggtgggcctcctccaaccagtgggcagcct

SEQ ID NO: 341859 - DNA, 402 bp, Homo sapiens
ccgggtgatctagaggatcccgtcgacggtaccaacactgacaacggcttagcacaaacccaaaaggctctgctagagctcagaggcagccacgagattgggagagctggatgacggtttgctaagagaattcaagctgtcagtcctcctgtgtatcctttggattctgttatgctgttgcttgtagagggaaaaagttcatgtgtcatttatatacaagtgcccatttgacattgagtgagtcacatttattttaccctatatgaacacaaaatctctgttttaaaatcagattctagaactttaaaagggttcttatgtattgttctgaagtaactcagtggctcttggtgagcccgccccacctggcctgttggtaccctcttcctgccccctcaccgg

SEQ ID NO: 341860 - DNA, 586 bp, Homo sapiens
cggagaaagaatcagttgcagtctggaggaatatacgtgtgttacatggtttccctgcctttaaattctctgttaatctgtattccttgtaaagtagatgacagcatgtatcttggcctacatgtttctaaagacaaacctctaagctcttgaagttctgccatggtgtatcatagtacattgaagtcagaaagcccattagaggaggaggatgcctggctagaatagtgttcttgagtttttccatgtgtattgtctcaggtaggaagatgacaagtcctactttgttcttgtgtgattccccatcattcagtctgtggaggctgagcttgttaatggtggtgaacacgagtttcgttctttgccaggagtgcccaccagtgcccataacgccctcccggagccgggcagtatgtttagggtaagactgactaacgacccaacactgacaacggcttagcacaaacccaaaaggctctgctagagctcagaggcagccacgagattgggagagctggatgacggtttgctaagagaattcaagctgtcagtcctcctgtgtatcctttggattctgttatgctgt

SEQ ID NO: 341861 - DNA, 370 bp, Homo sapiens
gtgaaaatttcttaatctacctacagtgaactagctggttacagaatcaactcttccacccatgaataatagccagaaaagctagacgatgtataaccacatttgtgtgaaggcaccagaaagctaccaaggcagagatggcttaatgggacaagcttccaaatagatggaaatccagagaggtgagtccagtgctttgcacaactgttcaccttgaggcgtttcctgtttccaaagtaatggctgagagactgaccagctgcacagagcttccatcaatctcaaaaggctgaggagacaaaaaaaaaaggaacttcagggccagccaaggaaaagagctctagaaaacaccatgttttcactttgggct

SEQ ID NO: 341862 - DNA, 655 bp, Homo sapiens
cttgatgtatcatagtgggattaagaataaagaattactctagtaactgccaacacagtacacgtttctctatttattttaagttagtttctccttgttgatttaaaggaattattgaaagttgcttacatggagattccttggagctctatcaacatggacaattatcaccagaggtgggaggttgagggtctcccttttgtgctatgtcacatggtccatactgctgtttaaatactttttccaaattactttctgtttgtgataaccgtaagtgtctttatcaaaagagttataaaagtcttttaaagttagggcaggactcctgcaattgtaattgcaaggtcattaatttgcataaccccgtggtttctttcctgttccgatgttccctgaagatgttcggctaaatgttgtaactccaccaaaggagtaacttcctattctagtgtatgattcttcaataaatcacttatctctgtatgcaatctattaacaaaatgggattacaagactaattcatcatctcagccattaaagccagtagtgggtcagccagtagtgggtcagccagtagtgggtcagccagtagtgggtcagccagtagtgggtcagccagtagtgggtcagccagtagtgggtcagccagtagtgg

SEQ ID NO: 341863 - DNA, 664 bp, Homo sapiens
aatatgtatccccatcttagtgaatggacttcaggcttatgcttatagctccactgatagctgacatgctgattgatgacagtttataaaagtatctttctgtagagacttttgtggtaaatatttcctgtgcaactgacctaattttgtttgcagtggaaatttctgaactttgaacatcaaaaactttcatacaatatcttttttcatcacaattttgacaatgttctgaatactagtataatgtattattgaacaggttatagaaagtacatttattattggaaagagtttgtatttcaagtcttgatcagtaggttcagttggtactttaaaatcatatattttgctgtatgattttcttgcattagtaacggtaaattcagttataatgcccaaccacacacacacaaaattatcttttgaggacaaatattaccaatctcctagattaaatgtggaaaatttgttaggaggtgttatgggctgaattgtgttcctactcttctccccagaattcatatattgacatcttaacccttagaagatggagtccttaaagaggtaaataagttaaaggtgagccctaatcaaatatggctggactcctcttaagaagatattaagacatagatacatacagaggtaagaccaggtgaagaca

SEQ ID NO: 341864 - DNA, 484 bp, Homo sapiens
agcatcagattcaccagctgcctaggaccccagtcggttcatcaaaatgcaagtcttaaattgtcactgagattgttaaacagagagacattctttttatgctggattttatgttgagattgttaaacaagagagatattctttttatgctggattttatgttgtgataatagaagctgagaaatgcttggagacaccatatagagataatttgcctacatagggagccacaaaatgcaaacagagataagtgattaaaaagccagaaaggccgagtcctgatgaaaagatttaagcccttggatctagccaggcctgaaatccatcagatcccctctggacatttcaatcatggatccaaagaatttgtgggagtttttttttgttttgttttgttttcattttctttaaagtccagcaattttacttgaacttggtgttggtcatgatgggtcactattcacaggatgcagcctgctctttt

SEQ ID NO: 341865 - DNA, 383 bp, Homo sapiens
acaaagatttatatgttaacaagctgaattcctgcttcatctggaggactgcacagtgtatctgagagaggattttcaggaggccagaaaatcaagctggagggattttcagccaattacaaaatttttggaatgcaattgggaagtacagctgaaaaacttcagcaacgtgggctgtttgattgtacaatcgcacttcttggaatttatcctacagaaatcagtagtcaagttcacaaaaactgacaatagccattacagagaagcagaagaaagggaaataaaaacattcaaacctaccaacaggagattggacaaataaatcatgttataactatacaatgggctattatgtaaccattaaaatgatcatctattctaga

SEQ ID NO: 341866 - DNA, 410 bp, Homo sapiens
tctgtagcaaggttctgtctaaaaataatgtctagttgtctaaaattagagcactctctctcccagagagcaggacagagattaaaattttcactcttcactcctccttatttccaatattcttttgttttttaagacagagttttgctcttgttgcccaggctggagaaactttttaaattgttaggagaatacctacagagcattttgaagagtagggattgaagtcagcccggaaaagcttcccggatcttgaagaaaagtaatagacatgagtgtagggtgtttccaggaaggttgagttgtttgaataaagatctaaaagtagttagataatggtgaaggtattatttgccattcatggagcaatgaggacgtgctatctggattcagataggagggggtaccgg

SEQ ID NO: 341867 - DNA, 690 bp, Homo sapiens
actcacccccatccagtcacccagtcctatgtgcctaccttccaagtagctctcaagtccattttctgctccccatccctatcaccaccacctacaggtcctcactacctctctctcagactaaagaaacaggttcctaattggtttccctgtttcaaatcttttttcctcctttcctgaagtagaagtatttagttataaaaatcacatgttaatcataaaaatattcaaatgatgcataaatgtaggaagtgaaatcatccataattccaccttcaagagaacctctgttaaacaatttctaattttgcctccttcttcctccccctcaaaatctttatactgcctccagaacaatcttccaaaacatcagtgcagtacttaaaaaaccctttactggacaatcaatgacagcttcttgattaagtcaatggtgaggaaaaaagggggagaggcgctggcctacattaaggaagacttcagaacatcatcggcaaatcaaaggtgtgggccttgatttaatcctgatacaaaccaatcaactgtaaaacagattggacaatgaggaaatttgattatggactggatagtaaattatgctaaagaatttttgtagttttcttaggtataataatggcatagttatcatctaagaaagtgaccatattttcctttttttttttttttttt

SEQ ID NO: 341868 - DNA, 110 bp, Homo sapiens
agcagattgccctccccaatgtaggtgagcatcatccaacctgctgagggcctgaataaaacaaaaaggccaaggtgggagagtcacttgaaggctgaagtctctgcctg

SEQ ID NO: 341869 - DNA, 205 bp, Homo sapiens
ctgcctcttcagagcccagcagaaagacagagaaagaagcctccttggggttccattacccacactccaaggtggaaatctttcagatggttagatgatgaaggtagtagaaggcaaggatgattgggagtagaaggaagagtgacaggctagcatgagctgtgcagcagcaagattccatatgagcaaagtgcagaaagtgaga

SEQ ID NO: 341870 - DNA, 428 bp, Homo sapiens
ctccaagttacaggcctctccacccaaacagcccaaggttcaaatccttgctccacagtttcccaaagactctccaaagcttcagtttccccatctgtaaaatggagccaagagcctcttttgcatagcccagtgagatgtcaccgagtatgtatgtcactcagtaagtgcccagcaccagggcaagatacaggattttcaggacccggtgcaaaatgaacacgtggtcctctagttcgaaaactaagaatttcaggccaagcatggcggctcacgcctgtaatcccagcactttgggaggccgaggcaggagagtcacctgaggccaggaggtggaggtagcagtgagccgaacgaaattgaggcacttcactccagcctgggtgacagagcgagactccgtctcaaaaaaaaaaggaaatccctaa

SEQ ID NO: 341871 - DNA, 407 bp, Homo sapiens
ccagagcacaggatccaagctccaagttacaggcctctccacccaaacagcccaaggttcaaatccttgctccacagtttcccaaagactctccaaagcttcagtttccccatctgtaaaatggagccaagagcctcttttgcatagcccagtgagatgtcaccgagtatgtatgtcactcagtaagtgcccagcaccagggcaagatacaggattttcaggacccggtgcaaaatgaacacgtggtcctctagttcgaaaactaagaatttcaggccaagcatggcggctcacgcctgtaatcccagcactttgggaggccgaggcaggagagtcacctgaggccaggagttcaagaccagcctgcgcaatacgacaataccccatctctacaaaaaaaaaaaata

SEQ ID NO: 341872 - DNA, 86 bp, Homo sapiens
ggccatcactcatgacgggtattacagatgcataatggtaacacctgatgggaatttccatcgtggatatcacctccaagtgttag

SEQ ID NO: 341873 - DNA, 450 bp, Homo sapiens
tgggccagtttctgaaagagccactttctgagcatattaaagaaaaatctcttgtaaaaacaaagagggcttagtgttaatgctcctttatgaattgtgttagtaggaactgattgttcaatcatggggcagtgcaaaacgttagctgtgttaactctgagcaaacaggggagatccttcaaggacctggaacactgtttcctagaaaagcttttaatcatgtgtccaaatcactgccacactcttctttaatgataagaattggatttagatttaaggctttagataaatgattctcaaccttcaagatgctatgaaatgacctaattaaggaattattttttcctaggcctatccagagattccagttcagtttgtggtatgaggctgaagtatggatatttttttcaaagctccttaagtatataaattgataaaattactttggaa

SEQ ID NO: 341874 - DNA, 348 bp, Homo sapiens
aagagaaaagaaggtagaacatgatgaagctaggtatgtatacaggatccagatcatggagtcatgtagccaaaaataagtttggattttactctaatgacaatgagaaaactttggaggtttttaagctgggtagtgacatgttccaatttaagagagcagaggaaaaggagatgctaagttcttgtcatgttaacttagattagtcactaagacattcaggaagatatgcttaatagacagtggggattatgagcctgggacaagggagattggcctggactatggtatcaaatttgtgagtgatcacatagatgccaaagaaccatgggtagaatgagaacagag

SEQ ID NO: 341875 - DNA, 300 bp, Homo sapiens
gtaaatttgagtctgctattccttcataattgagactgactgtggagtattctaccccttacatgaaatgattaatggactattcgtacccctagcttttgtaatgattttttaagttaaaaaatcttttaataattaagtttaattttaaacagttaaagattgggaatgaatctttacagccctctcattctatctttacaccaaaataatgaccaatactgtctgttaaattttttaacctatgcttctgtcatctatttaaaaatgtagagtattaaggctagttcttgtgcttta

SEQ ID NO: 341876 - DNA, 399 bp, Homo sapiens
aaaaaaaaaaaaagaccttgcagttttccagttggcaaatgggagaaaattgttaatgaattcccagtttgaagtaatgacttcaaagtcatatcctgtgttttcggtgaagcttgaagaaagagagcagatttgcctttattaatgtttcctttctgaaaaactattttccttcctgggttacagatttatactctatggtcacatctctaatatattagcccaaatgagatttaaaataaaataaaaaatgatgatagatgatttgtacccaaactgccatttagtggttagtaccctgccagcattcaatatttagttaggtcaaatgtgtttattcaactttgtataagtcataatgggaaagttcaaccaatttgtgacagatgaaaaaaagaa

SEQ ID NO: 341877 - DNA, 5451 bp, Homo sapiens
agaaatgtaaaaacagaaggggtccaatttttacacgtttttttctcaagtagcctttctggggatttttattttcttaatgaagtgccaatcagcttttcaaaatgttttctatttctcagcatttccaggaagtgataacgtttagctaaatgagtagaagtggacttccttcaacatattgttaccttgtctagccttaggaagaaaacaagagccacctgaaaataaatacaggctcttttcgagcatctgctgaaatactgttacagcaatttgaagttgatgtggtaggaaaggaaggtgacttttcttgcaaaagtctttctaaacattcacactgtcctaagagatgagctttcttgttttattccggtatattccacaaggtggcacttttagagaaaaacaaatctgatgaagactaaagaggtacttctaaaagagatttcattctaactttatttttctgcgcatatttaactctttcctagcacttgttttttgggatgattaatagtctctataatgttctgtaacttcaatattttacttgttacctaggttctgaacaattgtctgcaaataaattgttcttaaggatggataatacacccattttgatcatttaagtaaagaaagcctagtcattcattcagtcaagaaaaaatttttgaagtacccagttaccttacttttctagattaaaacaggcttagttactaaaaaggcagtcctcatctgtgaacaggatagtttcgttagaagtataaaactcctttagtggccccagttaaaacacacataccctctctgctgctttcaaattccctagcatggtggcctttcaacattgattaaattttaaaatcctaatttaaagatcaggtgagcaaaatgagtagcacatcagtaattcagtagacaaaacttttgtctgaaaaattgctgtattgaaacagagccctaaaataccaaaagaccaggtaattttaacatttgtggaatcacaaatgtaaattcataagaagctctaattaaaaaaaaaaagtctgaagtatatgagcataacaacttaggagtgtgtctacatacttaacttttgaagtttttgggcaactttatatactttttttaaatttacaagtctacttaaagacttcttataccccaaatgattaagttaattttagaggtcacctttctcacagcagtgtcacttgaaatttagtagggaaggatattgcagtatttttcagtttccttagcacagcaccacagaaagcagcttattccttttgagtggcagacactcgacggtgcctgcccaactttcctcctgagtggcaagcagatgagtctcagtaattcatactggaaccaaaatgccacatacactaggggcagtcagaaactggctgagaaatcccccgcctcattcgcccctctgctcccaggaactagagtccagttaaagcccctatgcgaaaggccgaattccaccccagggtttgttataacagtggccagtctgaaccccatttgctcgtgctcaaaacttgattcccacttgaaagccttccgggcgcgctgcctcgttgccccgcccctttggcaggagagaggcagtgggcgaggccgggctggggccccgcctcccactcacctgccggtgcctgaaattatgtgcggccccgcgggctgctttccgaggtcagagtgccctgctgctgtctcagaggcatctgttctgcaaatcttaggaagaaaaatgtccctagtagcaaacgggtgtcttctgtgcataaataagtacaacacaattctccgaaagttcgggtaaaaagagatgcggtagcagctgccctgtgtgaagctgtctaccccgcatctctcaggcgctaagctcagtttttgtttttgtttttgtttttttaaagaaaagatgtataattgcaggaatttttttttatttttttattttccatcattctatatatgtgatggtgaaagatatgcctggaaaagttttgttttgaaaagtttattttctgcttcgtcttcagttggcaaaagctctcaattctttagcttccagtttcttttctctctttttctttgttaggtaattaaaggtatgtaaacaaattatctcatgtagcaggggattttcatgttgagaggaatcttccgtgtgagttgtttggtcacacaaataaccctttctcaattttaggagtttggattgtcaaatgtaggtttttctcaaagggggcatataactacatattgactgccaagaactatgactgtagcactaatcagcacacatagagccacacaattatttaatttctaactctctgtggtccctagaaaaattccgttgatgtgcttaggttaaagttctgaagatacccgttgtacccttacttgaaagtttctaatcttaagttttatgaaatgcaataatatgtatcagctagcaatatttctgtgatcaccaacaactctcagtttgatcttaaagtctgaataataaaacaaatcccagcagtaatacatttcttaaacctcacagtgcatgatatatcttttcattctgatcctgtgtttgcaaaaatatacacatgtatatcatagttcctcactttttattcatttgttttcctattacctgtagtaaatatattagttagtacatggaatttatagcatcagctacccccaggaacagcacctgacaggcgggggattttttttcaagttgttctacatttgcataaattatttctattattattcatgtatgttatttatttctgaatcacactagtcctgtgaaagtacaactgaaggcagaaagtgttaggattttgcatctaatgttcattatcatggtattgatggacctaagaaaataaaaattagactaagcccccaaataagctgcatgcatttgtaacacgattagtagatttgaatatatagatgtagtattttgggtatctaggtgttttatcattatgtaaaggaattaaagtaaaggactttgtagttgtttttattaaatatgcatatagtagagtgcaaaaatatagcaaaaataaaaactaaaggtagaaaagcattttagatatgccttaatttagaaactgtgccaggtggccctcggaatagatgccaggcagagaccagtgcctgggtggtgcctcctcttgtctgccctcatgaagaagcttccctcacgtgatgtagtgccctcgtaggtgtcatgtggagtagtgggaacaggcagtactgttgagaggagagcagtgtgagagtttttctgtagaagcagaactgtcagcttgtgccttgaggcttccagaacgtgtcagatggagaagtccaagtttccatgcttcaggcaacttagctgtgtacagaagcaatccagtgtggtaataaaaagcaaggattgcctgtataatttattataaaataaaagggattttaacaaccaacaattcccaacacctcaaaagcttgttgcattttttggtatttgaggtttttatctgaaggttaaagggcaagtgtttggtatagaagagcagtatgtgttaagaaaagaaaaatattggttcgcgtagagtgcaaattagaactagaaagttttatacgattatcattttgagatgtgttaaagtaggttttcactgtaaaatgtattagtgtttctgcattgccatagggcctggttaaaactttctcttaggtttcaggaagactgtcacatacagtaagcttttttccttctgacttataatagaaaatgttttgaaagtaaaaaaaaaaaaatctaatttggaaatttgacttgttagtttctgtgtttgaaatcatggttctagaaatgtagaaattgtgtatatcagatactcatctaggctgtgtgaaccagcccaagatgaccaacatccccacacctctacatctctgtcccctgtatctcttcctttctaccactaaagtgttccctgctaccatcctggcttgtccacatggtgctctccatcttcctccacatcatggaccacaggtgtgcctgtctaggcctggccaccactcccaacttgacctagccacattcatctagagatggttcctgatgctgggcacagactgtgctcatggcacccattagaaatgcctctagcatctttgtatgcatcttgatttttaaaccaagtcattgtacagagcattcagttttggctgtggtaccaagagaaaaactaatcaagaatataaaccacattccaggctgctgttttctctccatctacaggccacacttttactgtatttcttcatacttgaaattcattctgctattttcatatcagggtacagacttataagggtgcatgttccttaaaggtgcataattattcttattccgtttgcttatattgctacagaatgctctgttttggtgctttgagttctgcagacccaagaagcagtgtggaaattcactgcctgggacacagtcttataagaatgttggcaggtgactttgtatcagatgttgcttctcttttctctgtacacagattgagagttaccacagtggcctgtcgggtccaccctgtgggtgcagcacagctctctgaaagcaagaaccttcctacctattctaacgtttttgccctctaagaaaaatggcctcaggtatggtatagacatagcaagaggggaagggctgtctcactctagcaaccatccctccattacacacagaaagccctcttgaagcaaaagaagaagaaagaaagaaagcttatctctaaggctactgtcttcagaatgctctgagctgaatgctcttgctcctttcccaagaggcagatgaaaatatagccagtttatctatacccttcctatctgaggaggagaatagaaaagtagggtaaatatgtaacgtaaaatatgtcattcaaggaccaccaaaactttaagtaccctatcattaaaaatctggttttaaaagtagctcaagtaagggatgctttgtgacccagggtttctgaagtcagatagccattcttacctgccccttactctgacttattgggaaagggagaactgcagtggtgtttctgttgcagtggcaaaggtaacatgtcagaaaattcagagggttgcataccaataatcctttggaaactggatgtcttactgggtgctagaatgaaaatgtaggtatttattgtcagatgatgaagttcattgtttttttcaaaattggtgttgaaatatcactgtccaatgtgttcacttatgtgaaagctaaattgaatgaggcaaaaagagcaaatagtttgtatatttgtaataccttttgtatttcttacaataaaaatattggtagcaaataaaaataataaaaacaataacttt

SEQ ID NO: 341878 - DNA, 5569 bp, Homo sapiens
agaaatgtaaaaacagaaggggtccaatttttacacgtttttttctcaagtagcctttctggggatttttattttcttaatgaagtgccaatcagcttttcaaaatgttttctatttctcagcatttccaggaagtgataacgtttagctaaatgagtagaagtggacttccttcaacatattgttaccttgtctagccttaggaagaaaacaagagccacctgaaaataaatacaggctcttttcgagcatctgctgaaatactgttacagcaatttgaagttgatgtggtaggaaaggaaggtgacttttcttgcaaaagtctttctaaacattcacactgtcctaagagatgagctttcttgttttattccggtatattccacaaggtggcacttttagagaaaaacaaatctgatgaagactaaagaggtacttctaaaagagatttcattctaactttatttttctgcgcatatttaactctttcctagcacttgttttttgggatgattaatagtctctataatgttctgtaacttcaatattttacttgttacctaggttctgaacaattgtctgcaaataaattgttcttaaggatggataatacacccattttgatcatttaagtaaagaaagcctagtcattcattcagtcaagaaaaaatttttgaagtacccagttaccttacttttctagattaaaacaggcttagttactaaaaaggcagtcctcatctgtgaacaggatagtttcgttagaagtataaaactcctttagtggccccagttaaaacacacataccctctctgctgctttcaaattccctagcatggtggcctttcaacattgattaaattttaaaatcctaatttaaagatcaggtgagcaaaatgagtagcacatcagtaattcagtagacaaaacttttgtctgaaaaattgctgtattgaaacagagccctaaaataccaaaagaccaggtaattttaacatttgtggaatcacaaatgtaaattcataagaagctctaattaaaaaaaaaaagtctgaagtatatgagcataacaacttaggagtgtgtctacatacttaacttttgaagtttttgggcaactttatatactttttttaaatttacaagtctacttaaagacttcttataccccaaatgattaagttaattttagaggtcacctttctcacagcagtgtcacttgaaatttagtagggaaggatattgcagtatttttcagtttccttagcacagcaccacagaaagcagcttattccttttgagtggcagacactcgacggtgcctgcccaactttcctcctgagtggcaagcagatgagtctcagtaattcatactggaaccaaaatgccacatacactaggggcagtcagaaactggctgagaaatcccccgcctcattcgcccctctgctcccaggaactagagtccagttaaagcccctatgcgaaaggccgaattccaccccagggtttgttataacagtggccagtctgaaccccatttgctcgtgctcaaaacttgattcccacttgaaagccttccgggcgcgctgcctcgttgccccgcccctttggcaggagagaggcagtgggcgaggccgggctggggccccgcctcccactcacctgccggtgcctgaaattatgtgcggccccgcgggctgctttccgaggtcagagtgccctgctgctgtctcagaggcatctgttctgcaaatcttaggaagaaaaatgtccctagtagcaaacgggtgtcttctgtgcataaataagtacaacacaattctccgaaagttcgggtaaaaagagatgcggtagcagctgccctgtgtgaagctgtctaccccgcatctctcaggcgctaagctcagtttttgtttttgtttttgtttttttaaagaaaagatgtataattgcaggaatttttttttatttttttattttccatcattctatatatgtgatggtgaaagatatgcctggaaaagttttgttttgaaaagtttattttctgcttcgtcttcagttggcaaaagctctcaattctttagcttccagtttcttttctctctttttctttgttaggtaattaaaggtatgtaaacaaattatctcatgtagcaggggattttcatgttgagaggaatcttccgtgtgagttgtttggtcacacaaataaccctttctcaattttaggagtttggattgtcaaatgtaggtttttctcaaagggggcatataactacatattgactgccaagaactatgactgtagcactaatcagcacacatagagccacacaattatttaatttctaactctctgtggtccctagaaaaattccgttgatgtgcttaggttaaagttctgaagatacccgttgtacccttacttgaaagtttctaatcttaagttttatgaaatgcaataatatgtatcagctagcaatatttctgtgatcaccaacaactctcagtttgatcttaaagtctgaataataaaacaaatcccagcagtaatacatttcttaaacctcacagtgcatgatatatcttttcattctgatcctgtgtttgcaaaaatatacacatgtatatcatagttcctcactttttattcatttgttttcctattacctgtagtaaatatattagttagtacatggaatttatagcatcagctacccccaggaacagcacctgacaggcgggggattttttttcaagttgttctacatttgcataaattatttctattattattcatgtatgttatttatttctgaatcacactagtcctgtgaaagtacaactgaaggcagaaagtgttaggattttgcatctaatgttcattatcatggtattgatggacctaagaaaataaaaattagactaagcccccaaataagctgcatgcatttgtaacacgattagtagatttgaatatatagatgtagtattttgggtatctaggtgttttatcattatgtaaaggaattaaagtaaaggactttgtagttgtttttattaaatatgcatatagtagagtgcaaaaatatagcaaaaataaaaactaaaggtagaaaagcattttagatatgccttaatttagaaactgtgccaggtggccctcggaatagatgccaggcagagaccagtgcctgggtggtgcctcctcttgtctgccctcatgaagaagcttccctcacgtgatgtagtgccctcgtaggtgtcatgtggagtagtgggaacaggcagtactgttgagaggagagcagtgtgagagtttttctgtagaagcagaactgtcagcttgtgccttgaggcttccagaacgtgtcagatggagaagtccaagtttccatgcttcaggcaacttagctgtgtacagaagcaatccagtgtggtaataaaaagcaaggattgcctgtataatttattataaaataaaagggattttaacaaccaacaattcccaacacctcaaaagcttgttgcattttttggtatttgaggtttttatctgaaggttaaagggcaagtgtttggtatagaagagcagtatgtgttaagaaaagaaaaatattggttcgcgtagagtgcaaattagaactagaaagttttatacgattatcattttgagatgtgttaaagtaggttttcactgtaaaatgtattagtgtttctgcattgccatagggcctggttaaaactttctcttaggtttcaggaagactgtcacatacagtaagcttttttccttctgacttataatagaaaatgttttgaaagtaaaaaaaaaaaaatctaatttggaaatttgacttgttagtttctgtgtttgaaatcatggttctagaaatgtagaaattgtgtatatcagatactcatctaggctgtgtgaaccagcccaagatgaccaacatccccacacctctacatctctgtcccctgtatctcttcctttctaccactaaagtgttccctgctaccatcctggcttgtccacatggtgctctccatcttcctccacatcatggaccacaggtgtgcctgtctaggcctggccaccactcccaacttgacctagccacattcatctagagatggttcctgatgctgggcacagactgtgctcatggcacccattagaaatgcctctagcatctttgtatgcatcttgatttttaaaccaagtcattgtacagagcattcagttttggctgtggtaccaagagaaaaactaatcaagaatataaaccacattccaggctgctgttttctctccatctacaggccacacttttactgtatttcttcatacttgaaattcattctgctattttcatatcagggtacagacttataagggtgcatgttccttaaaggtgcataattattcttattccgtttgcttatattgctacagaatgctctgttttggtgctttgagttctgcagacccaagaagcagtgtggaaattcactgcctgggacacagtcttataagaatgttggcaggtgactttgtatcagatgttgcttctcttttctctgtacacagattgagagttaccacagtggcctgtcgggtccaccctgtgggtgcagcacagctctctgaaagcaagaaccttcctacctattctaacgtttttgccctctaagaaaaatggcctcaggtatggtatagacatagcaagaggggaagggctgtctcactctagcaaccatccctccattacacacagaaagccctcttgaagcaaaagaagaagaaagaaagaaagcttatctctaaggctactgtcttcagaatgctctgagctgaatgctcttgctcctttcccaagaggcagatgaaaatatagccagtttatctatacccttcctatctgaggaggagaatagaaaagtagggtaaatatgtaacgtaaaatatgtcattcaaggaccaccaaaactttaagtaccctatcattaaaaatctggttttaaaagtagctcaagtaagggatgctttgtgacccagggtttctgaagtcagatagccattcttacctgccccttactctgacttattgggaaagggagaactgcagtggtgtttctgttgcagtggcaaaggtaacatgtcagaaaattcagagggttgcataccaataatcctttggaaactggatgtcttactgggtgctagaatgaaaatgtaggtatttattgtcagatgatgaagttcattgtttttttcaaaattggtgttgaaatatcactgtccaatgtgttcacttatgtgaaagctaaattgaatgaggcaaaaagagcaaatagtttgtatatttgtaataccttttgtatttcttacaataaaaatattggtagcaaataaaaataataaaaacaataactttaaactgctttctggagatgaattactctcctggctattttcttttttactttaatgtaaaatgagtataactgtagtgagtaaaattcattaaattccaagttttagcaaaaaaaaaa

SEQ ID NO: 341879 - DNA, 5374 bp, Homo sapiens
agaaatgtaaaaacagaaggggtccaatttttacacgtttttttctcaagtagcctttctggggatttttattttcttaatgaagtgccaatcagcttttcaaaatgttttctatttctcagcatttccaggaagtgataacgtttagctaaatgagtagaagtggacttccttcaacatattgttaccttgtctagccttaggaagaaaacaagagccacctgaaaataaatacaggctcttttcgagcatctgctgaaatactgttacagcaatttgaagttgatgtggtaggaaaggaaggtgacttttcttgcaaaagtctttctaaacattcacactgtcctaagagatgagctttcttgttttattccggtatattccacaaggtggcacttttagagaaaaacaaatctgatgaagactaaagaggtacttctaaaagagatttcattctaactttatttttctgcgcatatttaactctttcctagcacttgttttttgggatgattaatagtctctataatgttctgtaacttcaatattttacttgttacctaggttctgaacaattgtctgcaaataaattgttcttaaggatggataatacacccattttgatcatttaagtaaagaaagcctagtcattcattcagtcaagaaaaaatttttgaagtacccagttaccttacttttctagattaaaacaggcttagttactaaaaaggcagtcctcatctgtgaacaggatagtttcgttagaagtataaaactcctttagtggccccagttaaaacacacataccctctctgctgctttcaaattccctagcatggtggcctttcaacattgattaaattttaaaatcctaatttaaagatcaggtgagcaaaatgagtagcacatcagtaattcagtagacaaaacttttgtctgaaaaattgctgtattgaaacagagccctaaaataccaaaagaccaggtaattttaacatttgtggaatcacaaatgtaaattcataagaagctctaattaaaaaaaaaaagtctgaagtatatgagcataacaacttaggagtgtgtctacatacttaacttttgaagtttttgggcaactttatatactttttttaaatttacaagtctacttaaagacttcttataccccaaatgattaagttaattttagaggtcacctttctcacagcagtgtcacttgaaatttagtagggaaggatattgcagtatttttcagtttccttagcacagcaccacagaaagcagcttattccttttgagtggcagacactcgacggtgcctgcccaactttcctcctgagtggcaagcagatgagtctcagtaattcatactggaaccaaaatgccacatacactaggggcagtcagaaactggctgagaaatcccccgcctcattcgcccctctgctcccaggaactagagtccagttaaagcccctatgcgaaaggccgaattccaccccagggtttgttataacagtggccagtctgaaccccatttgctcgtgctcaaaacttgattcccacttgaaagccttccgggcgcgctgcctcgttgccccgcccctttggcaggagagaggcagtgggcgaggccgggctggggccccgcctcccactcacctgccggtgcctgaaattatgtgcggccccgcgggctgctttccgaggtcagagtgccctgctgctgtctcagaggcatctgttctgcaaatcttaggaagaaaaatgtccctagtagcaaacgggtgtcttctgtgcataaataagtacaacacaattctccgaaagttcgggtaaaaagagatgcggtagcagctgccctgtgtgaagctgtctaccccgcatctctcaggcgctaagctcagtttttgtttttgtttttgtttttttaaagaaaagatgtataattgcaggaatttttttttatttttttattttccatcattctatatatgtgatggtgaaagatatgcctggaaaagttttgttttgaaaagtttattttctgcttcgtcttcagttggcaaaagctctcaattctttagcttccagtttcttttctctctttttctttgttaggtaattaaaggtatgtaaacaaattatctcatgtagcaggggattttcatgttgagaggaatcttccgtgtgagttgtttggtcacacaaataaccctttctcaattttaggagtttggattgtcaaatgtaggtttttctcaaagggggcatataactacatattgactgccaagaactatgactgtagcactaatcagcacacatagagccacacaattatttaatttctaactctctgtggtccctagaaaaattccgttgatgtgcttaggttaaagttctgaagatacccgttgtacccttacttgaaagtttctaatcttaagttttatgaaatgcaataatatgtatcagctagcaatatttctgtgatcaccaacaactctcagtttgatcttaaagtctgaataataaaacaaatcccagcagtaatacatttcttaaacctcacagtgcatgatatatcttttcattctgatcctgtgtttgcaaaaatatacacatgtatatcatagttcctcactttttattcatttgttttcctattacctgtagtaaatatattagttagtacatggaatttatagcatcagctacccccaggaacagcacctgacaggcgggggattttttttcaagttgttctacatttgcataaattatttctattattattcatgtatgttatttatttctgaatcacactagtcctgtgaaagtacaactgaaggcagaaagtgttaggattttgcatctaatgttcattatcatggtattgatggacctaagaaaataaaaattagactaagcccccaaataagctgcatgcatttgtaacacgattagtagatttgaatatatagatgtagtattttgggtatctaggtgttttatcattatgtaaaggaattaaagtaaaggactttgtagttgtttttattaaatatgcatatagtagagtgcaaaaatatagcaaaaataaaaactaaaggtagaaaagcattttagatatgccttaatttagaaactgtgccaggtggccctcggaatagatgccaggcagagaccagtgcctgggtggtgcctcctcttgtctgccctcatgaagaagcttccctcacgtgatgtagtgccctcgtaggtgtcatgtggagtagtgggaacaggcagtactgttgagaggagagcagtgtgagagtttttctgtagaagcagaactgtcagcttgtgccttgaggcttccagaacgtgtcagatggagaagtccaagtttccatgcttcaggcaacttagctgtgtacagaagcaatccagtgtggtaataaaaagcaaggattgcctgtataatttattataaaataaaagggattttaacaaccaacaattcccaacacctcaaaagcttgttgcattttttggtatttgaggtttttatctgaaggttaaagggcaagtgtttggtatagaagagcagtatgtgttaagaaaagaaaaatattggttcgcgtagagtgcaaattagaactagaaagttttatacgattatcattttgagatgtgttaaagtaggttttcactgtaaaatgtattagtgtttctgcattgccatagggcctggttaaaactttctcttaggtttcaggaagactgtcacatacagtaagcttttttccttctgacttataatagaaaatgttttgaaagtaaaaaaaaaaaaatctaatttggaaatttgacttgttagtttctgtgtttgaaatcatggttctagaaatgtagaaattgtgtatatcagatactcatctaggctgtgtgaaccagcccaagatgaccaacatccccacatggtgctctccatcttcctccacatcatggaccacaggtgtgcctgtctaggcctggccaccactcccaacttgacctagccacattcatctagagatggttcctgatgctgggcacagactgtgctcatggcacccattagaaatgcctctagcatctttgtatgcatcttgatttttaaaccaagtcattgtacagagcattcagttttggctgtggtaccaagagaaaaactaatcaagaatataaaccacattccaggctgctgttttctctccatctacaggccacacttttactgtatttcttcatacttgaaattcattctgctattttcatatcagggtacagacttataagggtgcatgttccttaaaggtgcataattattcttattccgtttgcttatattgctacagaatgctctgttttggtgctttgagttctgcagacccaagaagcagtgtggaaattcactgcctgggacacagtcttataagaatgttggcaggtgactttgtatcagatgttgcttctcttttctctgtacacagattgagagttaccacagtggcctgtcgggtccaccctgtgggtgcagcacagctctctgaaagcaagaaccttcctacctattctaacgtttttgccctctaagaaaaatggcctcaggtatggtatagacatagcaagaggggaagggctgtctcactctagcaaccatccctccattacacacagaaagccctcttgaagcaaaagaagaagaaagaaagaaagcttatctctaaggctactgtcttcagaatgctctgagctgaatgctcttgctcctttcccaagaggcagatgaaaatatagccagtttatctatacccttcctatctgaggaggagaatagaaaagtagggtaaatatgtaacgtaaaatatgtcattcaaggaccaccaaaactttaagtaccctatcattaaaaatctggttttaaaagtagctcaagtaagggatgctttgtgacccagggtttctgaagtcagatagccattcttacctgccccttactctgacttattgggaaagggagaactgcagtggtgtttctgttgcagtggcaaaggtaacatgtcagaaaattcagagggttgcataccaataatcctttggaaactggatgtcttactgggtgctagaatgaaaatgtaggtatttattgtcagatgatgaagttcattgtttttttcaaaattggtgttgaaatatcactgtccaatgtgttcacttatgtgaaagctaaattgaatgaggcaaaaagagcaaatagtttgtatatttgtaataccttttgtatttcttacaataaaaatattggtagcaaataaaaataataaaaacaataacttt

SEQ ID NO: 341880 - DNA, 5515 bp, Homo sapiens
agaaatgtaaaaacagaaggggtccaatttttacacgtttttttctcaagtagcctttctggggatttttattttcttaatgaagtgccaatcagcttttcaaaatgttttctatttctcagcatttccaggaagtgataacgtttagctaaatgagtagaagtggacttccttcaacatattgttaccttgtctagccttaggaagaaaacaagagccacctgaaaataaatacaggctcttttcgagcatctgctgaaatactgttacagcaatttgaagttgatgtggtaggaaaggaaggtgacttttcttgcaaaagtctttctaaacattcacactgtcctaagagatgagctttcttgttttattccggtatattccacaaggtggcacttttagagaaaaacaaatctgatgaagactaaagaggtacttctaaaagagatttcattctaactttatttttctgcgcatatttaactctttcctagcacttgttttttgggatgattaatagtctctataatgttctgtaacttcaatattttacttgttacctaggttctgaacaattgtctgcaaataaattgttcttaaggatggataatacacccattttgatcatttaagtaaagaaagcctagtcattcattcagtcaagaaaaaatttttgaagtacccagttaccttacttttctagattaaaacaggcttagttactaaaaaggcagtcctcatctgtgaacaggatagtttcgttagaagtataaaactcctttagtggccccagttaaaacacacataccctctctgctgctttcaaattccctagcatggtggcctttcaacattgattaaattttaaaatcctaatttaaagatcaggtgagcaaaatgagtagcacatcagtaattcagtagacaaaacttttgtctgaaaaattgctgtattgaaacagagccctaaaataccaaaagaccaggtaattttaacatttgtggaatcacaaatgtaaattcataagaagctctaattaaaaaaaaaaagtctgaagtatatgagcataacaacttaggagtgtgtctacatacttaacttttgaagtttttgggcaactttatatactttttttaaatttacaagtctacttaaagacttcttataccccaaatgattaagttaattttagaggtcacctttctcacagcagtgtcacttgaaatttagtagggaaggatattgcagtatttttcagtttccttagcacagcaccacagaaagcagcttattccttttgagtggcagacactcgacggtgcctgcccaactttcctcctgagtggcaagcagatgagtctcagtaattcatactggaaccaaaatgccacatacactaggggcagtcagaaactggctgagaaatcccccgcctcattcgcccctctgctcccaggaactagagtccagttaaagcccctatgcgaaaggccgaattccaccccagggtttgttataacagtggccagtctgaaccccatttgctcgtgctcaaaacttgattcccacttgaaagccttccgggcgcgctgcctcgttgccccgcccctttggcaggagagaggcagtgggcgaggccgggctggggccccgcctcccactcacctgccggtgcctgaaattatgtgcggccccgcgggctgctttccgaggtcagagtgccctgctgctgtctcagaggcatctgttctgcaaatcttaggaagaaaaatgtccctagtagcaaacgggtgtcttctgtgcataaataagtacaacacaattctccgaaagttcgggtaaaaagagatgcggtagcagctgccctgtgtgaagctgtctaccccgcatctctcaggcgctaagctcagtttttgtttttgtttttgtttttttaaagaaaagatgtataattgcaggaatttttttttatttttttattttccatcattctatatatgtgatggtgaaagatatgcctggaaaagttttgttttgaaaagtttattttctgcttcgtcttcagttggcaaaagctctcaattctttagcttccagtttcttttctctctttttctttgttaggtaattaaaggtatgtaaacaaattatctcatgtagcaggggattttcatgttgagaggaatcttccgtgtgagttgtttggtcacacaaataaccctttctcaattttaggagtttggattgtcaaatgtaggtttttctcaaagggggcatataactacatattgactgccaagaactatgactgtagcactaatcagcacacatagagccacacaattatttaatttctaactctctgtggtccctagaaaaattccgttgatgtgcttaggttaaagttctgaagatacccgttgtacccttacttgaaagtttctaatcttaagttttatgaaatgcaataatatgtatcagctagcaatatttctgtgatcaccaacaactctcagtttgatcttaaagtctgaataataaaacaaatcccagcagtaatacatttcttaaacctcacagtgcatgatatatcttttcattctgatcctgtgtttgcaaaaatatacacatgtatatcatagttcctcactttttattcatttgttttcctattacctgtagtaaatatattagttagtacatggaatttatagcatcagctacccccaggaacagcacctgacaggcgggggattttttttcaagttgttctacatttgcataaattatttctattattattcatgtatgttatttatttctgaatcacactagtcctgtgaaagtacaactgaaggcagaaagtgttaggattttgcatctaatgttcattatcatggtattgatggacctaagaaaataaaaattagactaagcccccaaataagctgcatgcatttgtaacacgattagtagatttgaatatatagatgtagtattttgggtatctaggtgttttatcattatgtaaaggaattaaagtaaaggactttgtagttgtttttattaaatatgcatatagtagagtgcaaaaatatagcaaaaataaaaactaaaggtagaaaagcattttagatatgccttaatttagaaactgtgccaggtggccctcggaatagatgccaggcagagaccagtgcctgggtggtgcctcctcttgtctgccctcatgaagaagcttccctcacgtgatgtagtgccctcgtaggtgtcatgtggagtagtgggaacaggcagtactgttgagaggagagcagtgtgagagtttttctgtagaagcagaactgtcagcttgtgccttgaggcttccagaacgtgtcagatggagaagtccaagtttccatgcttcaggcaacttagctgtgtacagaagcaatccagtgtggtaataaaaagcaaggattgcctgtataatttattataaaataaaagggattttaacaaccaacaattcccaacacctcaaaagcttgttgcattttttggtatttgaggtttttatctgaaggttaaagggcaagtgtttggtatagaagagcagtatgtgttaagaaaagaaaaatattggttcgcgtagagtgcaaattagaactagaaagttttatacgattatcattttgagatgtgttaaagtaggttttcactgtaaaatgtattagtgtttctgcattgccatagggcctggttaaaactttctcttaggtttcaggaagactgtcacatacagtaagcttttttccttctgacttataatagaaaatgttttgaaagtaaaaaaaaaaaaatctaatttggaaatttgacttgttagtttctgtgtttgaaatcatggttctagaaatgtagaaattgtgtatatcagatactcatctaggctgtgtgaaccagcccaagatgaccaacatccccacacctctacatctctgtcccctgtatctcttcctttctaccactaaagtgttccctgctaccatcctggcttgtccacatggtgctctccatcttcctccacatcatggaccacaggtgtgcctgtctaggcctggccaccactcccaacttgacctagccacattcatctagagatggttcctgatgctgggcacagactgtgctcatggcacccattagaaatgcctctagcatctttgtatgcatcttgatttttaaaccaagtcattgtacagagcattcagttttggctgtggtaccaagagaaaggccacacttttactgtatttcttcatacttgaaattcattctgctattttcatatcagggtacagacttataagggtgcatgttccttaaaggtgcataattattcttattccgtttgcttatattgctacagaatgctctgttttggtgctttgagttctgcagacccaagaagcagtgtggaaattcactgcctgggacacagtcttataagaatgttggcaggtgactttgtatcagatgttgcttctcttttctctgtacacagattgagagttaccacagtggcctgtcgggtccaccctgtgggtgcagcacagctctctgaaagcaagaaccttcctacctattctaacgtttttgccctctaagaaaaatggcctcaggtatggtatagacatagcaagaggggaagggctgtctcactctagcaaccatccctccattacacacagaaagccctcttgaagcaaaagaagaagaaagaaagaaagcttatctctaaggctactgtcttcagaatgctctgagctgaatgctcttgctcctttcccaagaggcagatgaaaatatagccagtttatctatacccttcctatctgaggaggagaatagaaaagtagggtaaatatgtaacgtaaaatatgtcattcaaggaccaccaaaactttaagtaccctatcattaaaaatctggttttaaaagtagctcaagtaagggatgctttgtgacccagggtttctgaagtcagatagccattcttacctgccccttactctgacttattgggaaagggagaactgcagtggtgtttctgttgcagtggcaaaggtaacatgtcagaaaattcagagggttgcataccaataatcctttggaaactggatgtcttactgggtgctagaatgaaaatgtaggtatttattgtcagatgatgaagttcattgtttttttcaaaattggtgttgaaatatcactgtccaatgtgttcacttatgtgaaagctaaattgaatgaggcaaaaagagcaaatagtttgtatatttgtaataccttttgtatttcttacaataaaaatattggtagcaaataaaaataataaaaacaataactttaaactgctttctggagatgaattactctcctggctattttcttttttactttaatgtaaaatgagtataactgtagtgagtaaaattcattaaattccaagttttagcaaaaaaaaaa

SEQ ID NO: 341881 - DNA, 5341 bp, Homo sapiens
agaaatgtaaaaacagaaggggtccaatttttacacgtttttttctcaagtagcctttctggggatttttattttcttaatgaagtgccaatcagcttttcaaaatgttttctatttctcagcatttccaggaagtgataacgtttagctaaatgagtagaagtggacttccttcaacatattgttaccttgtctagccttaggaagaaaacaagagccacctgaaaataaatacaggctcttttcgagcatctgctgaaatactgttacagcaatttgaagttgatgtggtaggaaaggaaggtgacttttcttgcaaaagtctttctaaacattcacactgtcctaagagatgagctttcttgttttattccggtatattccacaaggtggcacttttagagaaaaacaaatctgatgaagactaaagaggtacttctaaaagagatttcattctaactttatttttctgcgcatatttaactctttcctagcacttgttttttgggatgattaatagtctctataatgttctgtaacttcaatattttacttgttacctaggttctgaacaattgtctgcaaataaattgttcttaaggatggataatacacccattttgatcatttaagtaaagaaagcctagtcattcattcagtcaagaaaaaatttttgaagtacccagttaccttacttttctagattaaaacaggcttagttactaaaaaggcagtcctcatctgtgaacaggatagtttcgttagaagtataaaactcctttagtggccccagttaaaacacacataccctctctgctgctttcaaattccctagcatggtggcctttcaacattgattaaattttaaaatcctaatttaaagatcaggtgagcaaaatgagtagcacatcagtaattcagtagacaaaacttttgtctgaaaaattgctgtattgaaacagagccctaaaataccaaaagaccaggtaattttaacatttgtggaatcacaaatgtaaattcataagaagctctaattaaaaaaaaaaagtctgaagtatatgagcataacaacttaggagtgtgtctacatacttaacttttgaagtttttgggcaactttatatactttttttaaatttacaagtctacttaaagacttcttataccccaaatgattaagttaattttagaggtcacctttctcacagcagtgtcacttgaaatttagtagggaaggatattgcagtatttttcagtttccttagcacagcaccacagaaagcagcttattccttttgagtggcagacactcgacggtgcctgcccaactttcctcctgagtggcaagcagatgagtctcagtaattcatactggaaccaaaatgccacatacactaggggcagtcagaaactggctgagaaatcccccgcctcattcgcccctctgctcccaggaactagagtccagttaaagcccctatgcgaaaggccgaattccaccccagggtttgttataacagtggccagtctgaaccccatttgctcgtgctcaaaacttgattcccacttgaaagccttccgggcgcgctgcctcgttgccccgcccctttggcaggagagaggcagtgggcgaggccgggctggggccccgcctcccactcacctgccggtgcctgaaattatgtgcggccccgcgggctgctttccgaggtcagagtgccctgctgctgtctcagaggcatctgttctgcaaatcttaggaagaaaaatgtccctagtagcaaacgggtgtcttctgtgcataaataagtacaacacaattctccgaaagttcgggtaaaaagagatgcggtagcagctgccctgtgtgaagctgtctaccccgcatctctcaggcgctaagctcagtttttgtttttgtttttgtttttttaaagaaaagatgtataattgcaggaatttttttttatttttttattttccatcattctatatatgtgatggtgaaagatatgcctggaaaagttttgttttgaaaagtttattttctgcttcgtcttcagttggcaaaagctctcaattctttagcttccagtttcttttctctctttttctttgttaggtaattaaaggtatgtaaacaaattatctcatgtagcaggggattttcatgttgagaggaatcttccgtgtgagttgtttggtcacacaaataaccctttctcaattttaggagtttggattgtcaaatgtaggtttttctcaaagggggcatataactacatattgactgccaagaactatgactgtagcactaatcagcacacatagagccacacaattatttaatttctaactctctgtggtccctagaaaaattccgttgatgtgcttaggttaaagttctgaagatacccgttgtacccttacttgaaagtttctaatcttaagttttatgaaatgcaataatatgtatcagctagcaatatttctgtgatcaccaacaactctcagtttgatcttaaagtctgaataataaaacaaatcccagcagtaatacatttcttaaacctcacagtgcatgatatatcttttcattctgatcctgtgtttgcaaaaatatacacatgtatatcatagttcctcactttttattcatttgttttcctattacctgtagtaaatatattagttagtacatggaatttatagcatcagctacccccaggaacagcacctgacaggcgggggattttttttcaagttgttctacatttgcataaattatttctattattattcatgtatgttatttatttctgaatcacactagtcctgtgaaagtacaactgaaggcagaaagtgttaggattttgcatctaatgttcattatcatggtattgatggacctaagaaaataaaaattagactaagcccccaaataagctgcatgcatttgtaacacgattagtagatttgaatatatagatgtagtattttgggtatctaggtgttttatcattatgtaaaggaattaaagtaaaggactttgtagttgtttttattaaatatgcatatagtagagtgcaaaaatatagcaaaaataaaaactaaaggtagaaaagcattttagatatgccttaatttagaaactgtgccaggtggccctcggaatagatgccaggcagagaccagtgcctgggtggtgcctcctcttgtctgccctcatgaagaagcttccctcacgtgatgtagtgccctcgtaggtgtcatgtggagtagtgggaacaggcagtactgttgagaggagagcagtgtgagagtttttctgtagaagcagaactgtcagcttgtgccttgaggcttccagaacgtgtcagatggagaagtccaagtttccatgcttcaggcaacttagctgtgtacagaagcaatccagtgtggtaataaaaagcaaggattgcctgtataatttattataaaataaaagggattttaacaaccaacaattcccaacacctcaaaagcttgttgcattttttggtatttgaggtttttatctgaaggttaaagggcaagtgtttggtatagaagagcagtatgtgttaagaaaagaaaaatattggttcgcgtagagtgcaaattagaactagaaagttttatacgattatcattttgagatgtgttaaagtaggttttcactgtaaaatgtattagtgtttctgcattgccatagggcctggttaaaactttctcttaggtttcaggaagactgtcacatacagtaagcttttttccttctgacttataatagaaaatgttttgaaagtaaaaaaaaaaaaatctaatttggaaatttgacttgttagtttctgtgtttgaaatcatggttctagaaatgtagaaattgtgtatatcagatactcatctaggctgtgtgaaccagcccaagatgaccaacatccccacacctctacatctctgtcccctgtatctcttcctttctaccactaaagtgttccctgctaccatcctggcttgtccacatggtgctctccatcttcctccacatcatggaccacaggtgtgcctgtctaggcctggccaccactcccaacttgacctagccacattcatctagagatggttcctgatgctgggcacagactgtgctcatggcacccattagaaatgcctctagcatctttgtatgcatcttgatttttaaaccaagtcattgtacagagcattcagttttggctgtggtaccaagagaaaaactaatcaagaatataaaccacattccaggctgctgttttctctccatctacaggccacacttttactgtatttcttcatacttgaaattcattctgctattttcatatcagggtacagacttataagggtgcatgttccttaaaggtgcataattattcttattccgtttgcttatattgctacagaatgctctgttttggtgctttgagttctgcagacccaagaagcagtgtggaaattcactgcctgggacacagtcttataagaatgttggcaggtgactttgtatcagatgttgcttctcttttctctgtacacagattgagagttaccacagtggcctgtcgggtccaccctgtgggtgcagcacagctctctgaaagcaagaaccttcctacctattctaacgtttttgccctctaagaaaaatggcctcaggtatggtatagacatagcaagaggggaagggctgtctcactctagcaaccatccctccattacacacagaaagccctcttgaagcaaaagaagaagaaagaaagaaagcttatctctaaggctactgtcttcagaatgctctgagctgaatgctcttgctcctttcccaagaggcagatgaaaatatagccagtttatctatacccttcctatctgaggaggagaatagaaaagtagggtaaatatgtaacgtaaaatatgtcattcaaggaccaccaaaactttaagtaccctatcattaaaaatctggttttaaaagtagctcaagtaagggatgctttgtgacccagggtttctgaagtcagatagccattcttacctgccccttactctgacttattgggaaagggagaactgcagtggtgtttctgttgcagtggcaaaggtaacatgtcagaaaattcagagggttgcataccaataatcctttggaaactggatgtcttactgggtgctagaatgaaaatgtaggtatttattgtcagatgatgaccctctttatccgtttccccattgatgcctgttatctcgctgtccactgtctgcccgtatatccggc

SEQ ID NO: 341882 - DNA, 3834 bp, Homo sapiens
agaaatgtaaaaacagaaggggtccaatttttacacgtttttttctcaagtagcctttctggggatttttattttcttaatgaagtgccaatcagcttttcaaaatgttttctatttctcagcatttccaggaagtgataacgtttagctaaatgagtagaagtggacttccttcaacatattgttaccttgtctagccttaggaagaaaacaagagccacctgaaaataaatacaggctcttttcgagcatctgctgaaatactgttacagcaatttgaagttgatgtggtaggaaaggaaggtgacttttcttgcaaaagtctttctaaacattcacactgtcctaagagatgagctttcttgttttattccggtatattccacaaggtggcacttttagagaaaaacaaatctgatgaagactaaagaggtacttctaaaagagatttcattctaactttatttttctgcgcatatttaactctttcctagcacttgttttttgggatgattaatagtctctataatgttctgtaacttcaatattttacttgttacctaggttctgaacaattgtctgcaaataaattgttcttaaggatggataatacacccattttgatcatttaagtaaagaaagcctagtcattcattcagtcaagaaaaaatttttgaagtacccagttaccttacttttctagattaaaacaggcttagttactaaaaaggcagtcctcatctgtgaacaggatagtttcgttagaagtataaaactcctttagtggccccagttaaaacacacataccctctctgctgctttcaaattccctagcatggtggcctttcaacattgattaaattttaaaatcctaatttaaagatcaggtgagcaaaatgagtagcacatcagtaattcagtagacaaaacttttgtctgaaaaattgctgtattgaaacagagccctaaaataccaaaagaccaggtaattttaacatttgtggaatcacaaatgtaaattcataagaagctctaattaaaaaaaaaaagtctgaagtatatgagcataacaacttaggagtgtgtctacatacttaacttttgaagtttttgggcaactttatatactttttttaaatttacaagtctacttaaagacttcttataccccaaatgattaagttaattttagaggtcacctttctcacagcagtgtcacttgaaatttagtagggaaggatattgcagtatttttcagtttccttagcacagcaccacagaaagcagcttattccttttgagtggcagacactcgacggtgcctgcccaactttcctcctgagtggcaagcagatgagtctcagtaattcatactggaaccaaaatgccacatacactaggggcagtcagaaactggctgagaaatcccccgcctcattcgcccctctgctcccaggaactagagtccagttaaagcccctatgcgaaaggccgaattccaccccagggtttgttataacagtggccagtctgaaccccatttgctcgtgctcaaaacttgattcccacttgaaagccttccgggcgcgctgcctcgttgccccgcccctttggcaggagagaggcagtgggcgaggccgggctggggccccgcctcccactcacctgccggtgcctgaaattatgtgcggccccgcgggctgctttccgaggtcagagtgccctgctgctgtctcagaggcatctgttctgcaaatcttaggaagaaaaatgtccctagtagcaaacgggtgtcttctgtgcataaataagtacaacacaattctccgaaagttcgggtaaaaagagatgcggtagcagctgccctgtgtgaagctgtctaccccgcatctctcaggcgctaagctcagtttttgtttttgtttttgtttttttaaagaaaagatgtataattgcaggaatttttttttatttttttattttccatcattctatatatgtgatggtgaaagatatgcctggaaaagttttgttttgaaaagtttattttctgcttcgtcttcagttggcaaaagctctcaattctttagcttccagtttcttttctctctttttctttgttaggtaattaaaggtatgtaaacaaattatctcatgtagcaggggattttcatgttgagaggaatcttccgtgtgagttgtttggtcacacaaataaccctttctcaattttaggagtttggattgtcaaatgtaggtttttctcaaagggggcatataactacatattgactgccaagaactatgactgtagcactaatcagcacacatagagccacacaattatttaatttctaactctctgtggtccctagaaaaattccgttgatgtgcttaggttaaagttctgaagatacccgttgtacccttacttgaaagtttctaatcttaagttttatgaaatgcaataatatgtatcagctagcaatatttctgtgatcaccaacaactctcagtttgatcttaaagtctgaataataaaacaaatcccagcagtaatacatttcttaaacctcacagtgcatgatatatcttttcattctgatcctgtgtttgcaaaaatatacacatgtatatcatagttcctcactttttattcatttgttttcctattacctgtagtaaatatattagttagtacatggaatttatagcatcagctacccccaggaacagcacctgacaggcgggggattttttttcaagttgttctacatttgcataaattatttctattattattcatgtatgttatttatttctgaatcacactagtcctgtgaaagtacaactgaaggcagaaagtgttaggattttgcatctaatgttcattatcatggtattgatggacctaagaaaataaaaattagactaagcccccaaataagctgcatgcatttgtaacacgattagtagatttgaatatatagatgtagtattttgggtatctaggtgttttatcattatgtaaaggaattaaagtaaaggactttgtagttgtttttattaaatatgcatatagtagagtgcaaaaatatagcaaaaataaaaactaaaggtagaaaagcattttagatatgccttaatttagaaactgtgccaggtggccctcggaatagatgccaggcagagaccagtgcctgggtggtgcctcctcttgtctgccctcatgaagaagcttccctcacgtgatgtagtgccctcgtaggtgtcatgtggagtagtgggaacaggcagtactgttgagaggagagcagtgtgagagtttttctgtagaagcagaactgtcagcttgtgccttgaggcttccagaacgtgtcagatggagaagtccaagtttccatgcttcaggcaacttagctgtgtacagaagcaatccagtgtggtaataaaaagcaaggattgcctgtataatttattataaaataaaagggattttaacaaccaacaattcccaacacctcaaaagcttgttgcattttttggtatttgaggtttttatctgaaggttaaagggcaagtgtttggtatagaagagcagtatgtgttaagaaaagaaaaatattggttcgcgtagagtgcaaattagaactagaaagttttatacgattatcattttgagatgtgttaaagtaggttttcactgtaaaatgtattagtgtttctgcattgccatagggcctggttaaaactttctcttaggtttcaggaagactgtcacatacagtaagcttttttccttctgacttataatagaaaatgttttgaaagta

SEQ ID NO: 341883 - DNA, 3797 bp, Homo sapiens
agaaatgtaaaaacagaaggggtccaatttttacacgtttttttctcaagtagcctttctggggatttttattttcttaatgaagtgccaatcagcttttcaaaatgttttctatttctcagcatttccaggaagtgataacgtttagctaaatgagtagaagtggacttccttcaacatattgttaccttgtctagccttaggaagaaaacaagagccacctgaaaataaatacaggctcttttcgagcatctgctgaaatactgttacagcaatttgaagttgatgtggtaggaaaggaaggtgacttttcttgcaaaagtctttctaaacattcacactgtcctaagagatgagctttcttgttttattccggtatattccacaaggtggcacttttagagaaaaacaaatctgatgaagactaaagaggtacttctaaaagagatttcattctaactttatttttctgcgcatatttaactctttcctagcacttgttttttgggatgattaatagtctctataatgttctgtaacttcaatattttacttgttacctaggttctgaacaattgtctgcaaataaattgttcttaaggatggataatacacccattttgatcatttaagtaaagaaagcctagtcattcattcagtcaagaaaaaatttttgaagtacccagttaccttacttttctagattaaaacaggcttagttactaaaaaggcagtcctcatctgtgaacaggatagtttcgttagaagtataaaactcctttagtggccccagttaaaacacacataccctctctgctgctttcaaattccctagcatggtggcctttcaacattgattaaattttaaaatcctaatttaaagatcaggtgagcaaaatgagtagcacatcagtaattcagtagacaaaacttttgtctgaaaaattgctgtattgaaacagagccctaaaataccaaaagaccaggtaattttaacatttgtggaatcacaaatgtaaattcataagaagctctaattaaaaaaaaaaagtctgaagtatatgagcataacaacttaggagtgtgtctacatacttaacttttgaagtttttgggcaactttatatactttttttaaatttacaagtctacttaaagacttcttataccccaaatgattaagttaattttagaggtcacctttctcacagcagtgtcacttgaaatttagtagggaaggatattgcagtatttttcagtttccttagcacagcaccacagaaagcagcttattccttttgagtggcagacactcgacggtgcctgcccaactttcctcctgagtggcaagcagatgagtctcagtaattcatactggaaccaaaatgccacatacactaggggcagtcagaaactggctgagaaatcccccgcctcattcgcccctctgctcccaggaactagagtccagttaaagcccctatgcgaaaggccgaattccaccccagggtttgttataacagtggccagtctgaaccccatttgctcgtgctcaaaacttgattcccacttgaaagccttccgggcgcgctgcctcgttgccccgcccctttggcaggagagaggcagtgggcgaggccgggctggggccccgcctcccactcacctgccggtgcctgaaattatgtgcggccccgcgggctgctttccgaggtcagagtgccctgctgctgtctcagaggcatctgttctgcaaatcttaggaagaaaaatgtccctagtagcaaacgggtgtcttctgtgcataaataagtacaacacaattctccgaaagttcgggtaaaaagagatgcggtagcagctgccctgtgtgaagctgtctaccccgcatctctcaggcgctaagctcagtttttgtttttgtttttgtttttttaaagaaaagatgtataattgcaggaatttttttttatttttttattttccatcattctatatatgtgatggtgaaagatatgcctggaaaagttttgttttgaaaagtttattttctgcttcgtcttcagttggcaaaagctctcaattctttagcttccagtttcttttctctctttttctttgttaggtaattaaaggtatgtaaacaaattatctcatgtagcaggggattttcatgttgagaggaatcttccgtgtgagttgtttggtcacacaaataaccctttctcaattttaggagtttggattgtcaaatgtaggtttttctcaaagggggcatataactacatattgactgccaagaactatgactgtagcactaatcagcacacatagagccacacaattatttaatttctaactctctgtggtccctagaaaaattccgttgatgtgcttaggttaaagttctgaagatacccgttgtacccttacttgaaagtttctaatcttaagttttatgaaatgcaataatatgtatcagctagcaatatttctgtgatcaccaacaactctcagtttgatcttaaagtctgaataataaaacaaatcccagcagtaatacatttcttaaacctcacagtgcatgatatatcttttcattctgatcctgtgtttgcaaaaatatacacatgtatatcatagttcctcactttttattcatttgttttcctattacctgtagtaaatatattagttagtacatggaatttatagcatcagctacccccaggaacagcacctgacaggcgggggattttttttcaagttgttctacatttgcataaattatttctattattattcatgtatgttatttatttctgaatcacactagtcctgtgaaagtacaactgaaggcagaaagtgttaggattttgcatctaatgttcattatcatggtattgatggacctaagaaaataaaaattagactaagcccccaaataagctgcatgcatttgtaacacgattagtagatttgaatatatagatgtagtattttgggtatctaggtgttttatcattatgtaaaggaattaaagtaaaggactttgtagttgtttttattaaatatgcatatagtagagtgcaaaaatatagcaaaaataaaaactaaaggtagaaaagcattttagatatgccttaatttagaaactgtgccaggtggccctcggaatagatgccaggcagagaccagtgcctgggtggtgcctcctcttgtctgccctcatgaagaagcttccctcacgtgatgtagtgccctcgtaggtgtcatgtggagtagtgggaacaggcagtactgttgagaggagagcagtgtgagagtttttctgtagaagcagaactgtcagcttgtgccttgaggcttccagaacgtgtcagatggagaagtccaagtttccatgcttcaggcaacttagctgtgtacagaagcaatccagtgtggtaataaaaagcaaggattgcctgtataatttattataaaataaaagggattttaacaaccaacaattcccaacacctcaaaagcttgttgcattttttggtatttgaggtttttatctgaaggttaaagggcaagtgtttggtatagaagagcagtatgtgttaagaaaagaaaaatattggttcgcgtagagtgcaaattagaactagaaagttttatacgattatcattttgagatgtgttaaagtaggttttcactgtaaaatgtattagtgtttctgcattgccatagggccagggtattacaatctcagtagacttcaagaatatgcgcgggttactctaggaat

SEQ ID NO: 341884 - DNA, 3482 bp, Homo sapiens
agaaatgtaaaaacagaaggggtccaatttttacacgtttttttctcaagtagcctttctggggatttttattttcttaatgaagtgccaatcagcttttcaaaatgttttctatttctcagcatttccaggaagtgataacgtttagctaaatgagtagaagtggacttccttcaacatattgttaccttgtctagccttaggaagaaaacaagagccacctgaaaataaatacaggctcttttcgagcatctgctgaaatactgttacagcaatttgaagttgatgtggtaggaaaggaaggtgacttttcttgcaaaagtctttctaaacattcacactgtcctaagagatgagctttcttgttttattccggtatattccacaaggtggcacttttagagaaaaacaaatctgatgaagactaaagaggtacttctaaaagagatttcattctaactttatttttctgcgcatatttaactctttcctagcacttgttttttgggatgattaatagtctctataatgttctgtaacttcaatattttacttgttacctaggttctgaacaattgtctgcaaataaattgttcttaaggatggataatacacccattttgatcatttaagtaaagaaagcctagtcattcattcagtcaagaaaaaatttttgaagtacccagttaccttacttttctagattaaaacaggcttagttactaaaaaggcagtcctcatctgtgaacaggatagtttcgttagaagtataaaactcctttagtggccccagttaaaacacacataccctctctgctgctttcaaattccctagcatggtggcctttcaacattgattaaattttaaaatcctaatttaaagatcaggtgagcaaaatgagtagcacatcagtaattcagtagacaaaacttttgtctgaaaaattgctgtattgaaacagagccctaaaataccaaaagaccaggtaattttaacatttgtggaatcacaaatgtaaattcataagaagctctaattaaaaaaaaaaagtctgaagtatatgagcataacaacttaggagtgtgtctacatacttaacttttgaagtttttgggcaactttatatactttttttaaatttacaagtctacttaaagacttcttataccccaaatgattaagttaattttagaggtcacctttctcacagcagtgtcacttgaaatttagtagggaaggatattgcagtatttttcagtttccttagcacagcaccacagaaagcagcttattccttttgagtggcagacactcgacggtgcctgcccaactttcctcctgagtggcaagcagatgagtctcagtaattcatactggaaccaaaatgccacatacactaggggcagtcagaaactggctgagaaatcccccgcctcattcgcccctctgctcccaggaactagagtccagttaaagcccctatgcgaaaggccgaattccaccccagggtttgttataacagtggccagtctgaaccccatttgctcgtgctcaaaacttgattcccacttgaaagccttccgggcgcgctgcctcgttgccccgcccctttggcaggagagaggcagtgggcgaggccgggctggggccccgcctcccactcacctgccggtgcctgaaattatgtgcggccccgcgggctgctttccgaggtcagagtgccctgctgctgtctcagaggcatctgttctgcaaatcttaggaagaaaaatgtccctagtagcaaacgggtgtcttctgtgcataaataagtacaacacaattctccgaaagttcgggtaaaaagagatgcggtagcagctgccctgtgtgaagctgtctaccccgcatctctcaggcgctaagctcagtttttgtttttgtttttgtttttttaaagaaaagatgtataattgcaggaatttttttttatttttttattttccatcattctatatatgtgatggtgaaagatatgcctggaaaagttttgttttgaaaagtttattttctgcttcgtcttcagttggcaaaagctctcaattctttagcttccagtttcttttctctctttttctttgttaggtaattaaaggtatgtaaacaaattatctcatgtagcaggggattttcatgttgagaggaatcttccgtgtgagttgtttggtcacacaaataaccctttctcaattttaggagtttggattgtcaaatgtaggtttttctcaaagggggcatataactacatattgactgccaagaactatgactgtagcactaatcagcacacatagagccacacaattatttaatttctaactctctgtggtccctagaaaaattccgttgatgtgcttaggttaaagttctgaagatacccgttgtacccttacttgaaagtttctaatcttaagttttatgaaatgcaataatatgtatcagctagcaatatttctgtgatcaccaacaactctcagtttgatcttaaagtctgaataataaaacaaatcccagcagtaatacatttcttaaacctcacagtgcatgatatatcttttcattctgatcctgtgtttgcaaaaatatacacatgtatatcatagttcctcactttttattcatttgttttcctattacctgtagtaaatatattagttagtacatggaatttatagcatcagctacccccaggaacagcacctgacaggcgggggattttttttcaagttgttctacatttgcataaattatttctattattattcatgtatgttatttatttctgaatcacactagtcctgtgaaagtacaactgaaggcagaaagtgttaggattttgcatctaatgttcattatcatggtattgatggacctaagaaaataaaaattagactaagcccccaaataagctgcatgcatttgtaacacgattagtagatttgaatatatagatgtagtattttgggtatctaggtgttttatcattatgtaaaggaattaaagtaaaggactttgtagttgtttttattaaatatgcatatagtagagtgcaaaaatatagcaaaaataaaaactaaaggtagaaaagcattttagatatgccttaatttagaaactgtgccaggtggccctcggaatagatgccaggcagagaccagtgcctgggtggtgcctcctcttgtctgccctcatgaagaagcttccctcacgtgatgtagtgccctcgtaggtgtcatgtggagtagtgggaacaggcagtactgttgagaggagagcagtgtgagagtttttctgtagaagcagaactgtcagcttgtgccttgaggcttccagaacgtgtcagatggagaagtccaagtttccatgcttcaggcaacttagctgtgtacagaagcaatccagtgtggtaataaaaagcaaggattgcctgtataatttatta

SEQ ID NO: 341885 - DNA, 626 bp, Homo sapiens
tgtcagcttctacagaaaaactctcacactgctctcctctcaacagtactgcctgttcccactactccacatgacacctacgagggcactacatcacgtgagggaagcagtgtgagagtttttctgtagaagcagaactgtcagcttgtgccttgaggcttccagaacgtgtcagatggagaagtccaagtttccatgcttcaggcaacttagctgtgtacagaagcaatccagtgtggtaataaaaagcaaggattgcctgtataatttattataaaataaaagggattttaacaaccaacaattcccaacacctcaaaagcttgttgcattttttggtatttgaggtttttatctgaaggttaaagggcaagtgtttggtatagaagagcagtatgtgttaagaaaagaaaaatattggttcgcgtagagtgcaaattagaactagaaagttttatacgattatcattttgagatgtgttaaagtaggttttcactgtaaaatgtattagtgtttctgcattgccatagggcctggttaaaactttctcttaggtttcaggaagactgtcacatacagtaagcttttttccttctgacttataatagaaaatgttttgaaagta

SEQ ID NO: 341886 - DNA, 460 bp, Homo sapiens
gtgactgtatcctgattgggaagtcatcccccttcagttcatttttttcgtctataaagaacttcagtgccagcgaattaaaagtccattagactatggtttgtagggatctgaacttgccattagatgtcagtgttaacttttagagtcttggtaatagggtggtcagtactgagggaggtgctgtaggatgtaataagcaggatggagtagtggagaaagagctagattagccatccagagacttgccactgactcctgtgtgatcttgagcagttcactccattgttattctgacactgactcctgtatgatctttggcagttcatgccactgttctgtcactgattagctatgtgatcttggacagttcactctactcttctgacactgactagctgtgtgatcttgggcagttcaccccactgttctcctgccactgactcctgtgtgatattgg

SEQ ID NO: 341887 - DNA, 417 bp, Homo sapiens
agaatccatgtcttgggaacctgagctcaagtgggagggaggcgtttcgcgcagagcggcagccagttccaggctctgcaattgccctgtctgtggggagagcccaccatggggcgtcctctggcctcatcagcctgtccacgcctttcctctacttctgcctgccccgctcctgttctgagaacgtgctccacgtgggccgtttcataccattcacttcctcttccttcatctgagcaagctctgtcccctgactcggacccttcgtaagaacatcgtggaggtgttttcagcctccacccaaggaaatggtgtgttctccagacagggagggcttcattcctttagatttgttcgttcatgaaaatgcaggctgctgtgtggacgaggcgttactctaggctcccaagtctgagg

SEQ ID NO: 341888 - DNA, 1821 bp, Homo sapiens
  misc_feature (1295)..(1295): n is a, c, g, or t
ctcccgcctgccttcctttcggcgaggctttcctctgcgcgcttactgtgcgcgcatgccgggctcgctgcacgcagggggcgctctaggggccccgcccgggcagctgggaccctgcctgcccaaccctccggcccattttccttgaggccgccgcccggggtgggaccaggctgtgtgcttgctaactgtgcttcaggaatccgctctgggatgccttcctgtctggcaaaaggggttacccccagttctacccagtccctgtcctcggtcacatgctgccgccgcctcttcccccgcggtgccgggagcccgcgttttgtttgtcagcagttaggcggtgagtatttatagacgccacggcagtcctgcggtgcgcaaggtttcaattactgcgatgcgccccacaagacgaaaggttcacgcgctgcgtctgagctgcacgtctgccccggagacccgcgtggaaaaagctctgggctggaatctccgggcttccctgcttgggcagaattctggacctgttgcccagacgacacgtgcacattcagatgacccatgctaaggaccaaagggatgccaccggcccaatgtactgccttcatcccccaccatcctcaagggacccttgctgatcaagcccgggagactaccctttttgacctctctttggtgatcctgaccaccgtagaaatttgcagtcatgacatttcattgccctacatactgcaaaatgtcaaagtgctgagctgtggtaaattgctctggggtggaaggcgctgttactgacaacacgaagcagctagcgggtcaggaggggaaatggagcttgcagaaactaatttagccacatttaaaatttagcccctggtaaggttcccagtatgactgacgaaggtgcagggctcctgtctgtggaacctggctggttagtcttctctggttgcagccctagaatcaggatcaagggtgctgtttagagcggtttctgtagcatgtagcctttcagataagggaagtgatgcttggtcaatccacaaagttgtcttcagtttttccaactgcaaccattgttctttgagtatgttactgatgcttctaacaactggaaccactaatatgtaaaagaagaaaggcactagaaataagaaagtctaactagcttatttctcaaaggcttagtttagactactttgtttctcaagggtgggacctcatttctttcaggtccagagggccatggatatatatttatttctgtgggtgaaatttcaataatgttctgtcttagaacnttacaaatatgtgccacttgttttaaaaaggggaaaggtgcaaatgcctcttgaggtcttaatgatgtcttaaactttgcactgagagactttgataatattatatactcctcatgcaaacaatgatataggtactattatatccctatcatatagatgagcccactgaggcttggagaatttaagtaatttgtctaaagccatacacacagggatggagctgagaatggattacagatttgttactccagactcatagtctggacatgtctttcccttcaattctccattgttgattagctcacgttatagttgattagatggatggctttttatttattttcaaaatttcacagaatgttacaaattggctcagttattggggaaaaaagccctaatcttgtctttagaaaactgttatattggttatctgaaaatctcttgctgatagtccagacctaaatcataatcctcactttgctccttgacttaatgtatcttcagcattaaagccatttatctgtag

SEQ ID NO: 341889 - DNA, 2190 bp, Homo sapiens
  misc_feature (1242)..(1242): n is a, c, g, or t
ctcccgcctgccttcctttcggcgaggctttcctctgcgcgcttactgtgcgcgcatgccgggctcgctgcacgcagggggcgctctaggggccccgcccgggcagctgggaccctgcctgcccaaccctccggcccattttccttgaggccgccgcccggggtgggaccaggctgtgtgcttgctaactgtgcttcaggaatccgctctgggatgccttcctgtctggcaaaaggggttacccccagttctacccagtccctgtcctcggtcacatgctgccgccgcctcttcccccgcggtgccgggagcccgcgttttgtttgtcagcagttaggcggtgagtatttatagacgccacggcagtcctgcggtgcgcaaggtttcaattactgcgatgcgccccacaagacgaaaggttcacgcgctgcgtctgagctgcacgtctgccccggagacccgcgtggactgttgcccagacgacacgtgcacattcagatgacccatgctaaggaccaaagggatgccaccggcccaatgtactgccttcatcccccaccatcctcaagggacccttgctgatcaagcccgggagactaccctttttgacctctctttggtgatcctgaccaccgtagaaatttgcagtcatgacatttcattgccctacatactgcaaaatgtcaaagtgctgagctgtggtaaattgctctggggtggaaggcgctgttactgacaacacgaagcagctagcgggtcaggaggggaaatggagcttgcagaaactaatttagccacatttaaaatttagcccctggtaaggttcccagtatgactgacgaaggtgcagggctcctgtctgtggaacctggctggttagtcttctctggttgcagccctagaatcaggatcaagggtgctgtttagagcggtttctgtagcatgtagcctttcagataagggaagtgatgcttggtcaatccacaaagttgtcttcagtttttccaactgcaaccattgttctttgagtatgttactgatgcttctaacaactggaaccactaatatgtaaaagaagaaaggcactagaaataagaaagtctaactagcttatttctcaaaggcttagtttagactactttgtttctcaagggtgggacctcatttctttcaggtccagagggccatggatatatatttatttctgtgggtgaaatttcaataatgttctgtcttagaacnttacaaatatgtgccacttgttttaaaaaggggaaaggtgcaaatgcctcttgaggtcttaatgatgtcttaaactttgcactgagagactttgataatattatatactcctcatgcaaacaatgatataggtactattatatccctatcatatagatgagcccactgaggcttggagaatttaagtaatttgtctaaagccatacacacagggatggagctgagaatggattacagatttgttactccagactcatagtctggacatgtctttcccttcaattctccattgttgattagctcacgttatagttgattagatggatggctttttatttattttcaaaatttcacagaatgttacaaattggctcagttattggggaaaaaagccctaatcttgtctttagaaaactgttatattggttatctgaaaatctcttgctgatagtccagacctaaatcataatcctcactttgctccttgacttaatgtatcttcagcattaaagccatttatctgtagaaaattgaattcagtaaggactttgtggattacttaattttttcagatttctccatactaatgatttgtaggtatgcatgtgtctgttttcctgtggctgttccttttgtacaaggtaaaatatgctgaaatctctcttaaattgcagcctttttccttttcattctttttgcagagctagacccaatacagaattgatttgaaaaacagtgtgtgagttcctctgaaagatccttacaatgtctaatgttcatcattaaaggtttgttctcaagagttgcctctctgtatgtaaaatgtaaatacatgttaaaggcaatgcttgtagaaatgaccctttgttaacaagtcagtgtgaattaatattttagttgctgaaatataggaataaaatattttgtggattttgtacagaatattat

SEQ ID NO: 341890 - DNA, 699 bp, Homo sapiens
gaatccccctccattgagagttgccatcactgggagcctttcttacccaggagagaggatatggaggcagaatttagggtgagaactgttacactcgtaattgaggccctgaatggaaatgtgctgagaaagaaaaacataacgagaaagacatagaaagaaatgaagatagccagacaggtatagaaggaacatgactccctttaaatagagaaacagccacacgatactctcaagtaatgctgctttgttatgtccatattttgacccattgtggtacctgtccaaatagccctgatttcaggccaagccctgccttgataaatggaactcacatagtaacaacaggtttcctaccacatcgatcttgttgatgttggagcaaattaaagcagatgtttcctgtcaactgtgaatctcttcccaaagaacacatcagcatcctcaacctcttcaagccacaccaaagacaaaggacctccatgcaactggatttctccttaaccgcaccattctatttgttaggtccattatctctgaacaattaacatgctctggaatactgtgttccagaatgtgtatataaatggaatatagcacgtggccctataaaagaaagaaactattaagaaaatggtccctttagccaattagaggaaatataatttctgacacgggccgctatggccagctggatac

SEQ ID NO: 341891 - DNA, 688 bp, Homo sapiens
tttaacaggcaaataagtttccttgggagactgaggtcccttaaaggggggacagcaatatgtgacaagtgtgtccctattctaaagaggactgttaaatcatctggaggccaggcggggtggctcatgcctgtaatttcagcactttgggaggccgaggtgggtggatcacttgaggtcaggagtttgagaccagcctggccaacatggtgaaaccctgtctttactaaaaatacaaaaattagctgggcgtggtgacaggtgtctgtgatctcagctactcaggagtctggggcaggacaattgcttgggcctagaaggcagaggttgcagtgagctgagattttgccactgtactccatcatgggtgacagagtgagactgtgtctttaaaaaataatgaaaagctgggcgcggtggctcactcgtgtaatcccagcactttgggaggccgaggtgggcatgtcaagaggtcaggagtttaagaccagcctggccaacatggcaaaaccccgtttctactaaaaatacttaaattagctgagcatggtggcgggcacctgtaatcccagctactccggaggctgaggcaggggaattgcttgaacctgggaggcagatgttgcagtgagccgagataacgccattgcaccccagcctgggtagcaaaagcaaaactccatctcaa

SEQ ID NO: 341892 - DNA, 451 bp, Homo sapiens
taacgacttcttgaaactcagtcctgtccctacgagattttgccataaatgtagggttcatttaaagatgacttttcccaaaactatacatgtgaaattcagttttcaaatcttaaattctgacatgagaatgagaaacaaaaaagacccagatgaactcccaggtaatccaatctcacaatcatggtttaaaaaaaaaaaggacttgaatacattcactcaagtatgtttgagcagctacaatattctaggcacaatggacagagataaagacagtgacctgaaactcagtctactgagaagagaacagtatggggtggtgtcagagaaagaaaaacacaggatgcaaacctcaattcagattgcagtcaactgacagaacacttcctaggggaagtgacagctcaagaggtctttgaaggatgagtaaaagtgaccacacaaaagaggc

SEQ ID NO: 341893 - DNA, 2315 bp, Homo sapiens
  misc_feature (2315)..(2315): n is a, c, g, or t
gggcttacagtttgatagatgcaaaataataaagcagtatgtattaagtgaggtaatagaagtacaaatgctctaggattttagaggaaggaagcccatatttgcagggaaggtttccttacgatatttatactaggccttgaaagatgcctgggatttctttagacagaagaggcagagaaatgtatttctggaaaaagttacaggagtgagaaaggacatatttaggaaatgacaagtgcttcagtttggctgcaatataaggtgtgtgcgaggtatgtagggaatgttaggaaataaggttgatatataggttggggtcagaatagaactttgaatatgccatgcaacaagggttgaatttacatgatagttgatcttgaagactgaaaactaggaaattacccagtcagaactgtgctttagaaggatgtgctgggggactgggcatggtggtttacacctgtaatctcagcacttcgggaagccaaggtgggaaaattgaggccaagagtttaagaaaaatgtactggaaagccatgagtaaaatagattagaatgaaggatagagggtacagagaaattggaattcagaaattctattggaattacctataaaaaacaaaggtagagccactttaaacatgtgcagtttatatatgccagtaatacctaagtaaggccgtttaaagaaaaaaaagtaagctatgataacgaggcactgaacttggaaagatgaaagaaagttcagatttgaatgacattttggaaatagaatctacagaggaggatggaaagagtgaagaagtaggagtggagtcaaacatgatgaaatttttaagcttgggtaatttaggaaaattgtggagccagaatagaaatagagaagtcaagaggaaggaggaaaaagcattttgaacgtgactattgatgaatctcttggacacattgtaactgaagtgtccacaaggtatcagtgattttgtcccagaggcaggtgaaaatgtggaatggtggtgcatggcgtagatcaccttctcagttgatgctgtacaagctgaagcaatggatatgaatggaacaaattgctcagcagtttcttataactctaactttctgtgacctgagttcaactatctctagtatacctgaataatatataagttggtattgtggcctaatatggggggaggtaatttctgatttttacattggttttatttctaaggtatttgtatacatagactctaacagaacacaaattcagaaacagatagttttgtatttgttcaggcgaaaatgacagacatcctctcttagctgtaggggaagaaactttgaggaaaagaagcgtctgacggtttctgaaaaccaagctaaaagggacaaaaatagaatgagatccttttctatggcattctttctctgtggttttaggaaatggtcttaataatttcttttaattctgtaattcttttttgtttgtttgttttaattcaggaccacaaataggaaaatctgccatttgtatttttgtttaatcagctctctcattagcacattctaatgtaaatgttccctgatttattgactgaagtttagtggattctccatgtatgtttggttatgcatagactggttgctgttaattgcacttgaattttgggatttttattttatcaataatagagcttctctaggcatgagtgatgttccagatatatagttgtcttaaaaatgtgattgaggaagggtacggtggctcacgcctgtaatcccagcacttcgggaggctgagacaggtggatcacttgaggtcaggacttcgataccagcctggccaacattacagaaccctttctccactaaaaatacaaaaatcagctgggcatggtggtgggcacgtgtaaccccagctactcgggaggctgagacacgaaaataacttgaacctgggaagttttagttcaagaccacaaaccaacaaaaactcacaaaaaacctgctttgccttctttaagaaggaaaaagggccgggtgcggtagcccatgcctgtagtccctagcaatttgggaggccgaggagggcagatcacctgaggtcaggagtttgagaccagcctggccggcagggtgaaaccccgtctctactaaaaaaatgcaaaattagtcaggcgtggtgatacatgcctgtagtctcagctactcgggaagctgacgcaggagaattgcttgaatccgggaggcagagctgcagtgagccaagatagctccattgcactccagcctgggcaacaagagtgaaactccatctn

SEQ ID NO: 341894 - DNA, 304 bp, Homo sapiens
gctcctccacccactgtctgcacctcagcaaatgcctcctatgctctgtggatcccccagacctctgtgtttaaaaaaaataaaataaaggaaaaagaaattaaatgcagttccaaccaaaatcctaaataagtttgagaaactgattttgaagtttttgaaacagtttttaaaaagaacgaggttttgtagggaaaaggggacttccctattagatataaaaattactataaagactatttatatcttattataaagtaacagtaattaagacaatgtgctttgagcacagtgataaacgcat

SEQ ID NO: 341895 - DNA, 295 bp, Homo sapiens
caccacgcccggccagttcttgtatttttagaagagacggggtttcaccctgttggccaggctcgtctgggactcctgacctcaggtaatccgcccacctcagcctcccaaagtgctgggattgcaggcatgagccaccgtgcccagtcaactccttctcaaaaaaaaaaaaatagtgctgctttctctttcaagtgtcctgatttgggtgatagtaaatgccactctacttataagggatctacctcagaatgctaattgggacatttttgtagcactctactgttggcagcag

SEQ ID NO: 341896 - DNA, 108 bp, Homo sapiens
gtgctcaataaatacttattgtatgaatgtggatgattcctattctgatcattgcccaataaaacatagctattattttatgagctatttattagttggaaaaattca

SEQ ID NO: 341897 - DNA, 603 bp, Homo sapiens
caagagtaaaactccatctcaaaaaaaaagctctttggaaccctcagtaatattttagaatataaagagtcctaaaagctaagaactgtttacataatttactactcttctctattgaaggctctttggattgcccaaatattcaattattacaattattatgctgcagtaatgtccttttactcatttaagcagaatgtttcaacccaggagcagttggaccatgaatgcgccaaatgctcttctctaagaagtcagtatgaactattagtcttttatccaaacaatttgctttagacataaactgattagtgaatcagaactttgttttaaattttgcatagaaaagaatcttgaaataatttcaggaaaataaaaatagaaaaaatttggtacagaaggaacaggattggaattttggaaaattagaaacaaacggactttgccattttaaaattgaatcaaggaatttaattggcttaatgatgtttaatctgggatatatttgctgaataacagaaactctcaatgctgaaatagttctgtgtattcatgaacttgttcctcccccccagatggcagatggcagttctgtcctcccaa

SEQ ID NO: 341898 - DNA, 244 bp, Homo sapiens
tcgtctatatactttctataagacttacttaataagggatatattttcattacaaagaccccaggctcttctctgattctactatatggattttaggatcaattatattcatcaaggtaagcataacttgcaaagttggcatttgatactgtagaatcagagatcagacaggtctcaagatgcccagttattaatctgtgtccagaaattactactctgctactctgatggagtcactgtgtag

SEQ ID NO: 341899 - DNA, 502 bp, Homo sapiens
ttatgacttctggggtaaaattctctgttgagagacacaaaggtgcaaatgatgggtgttgcttaaaatgctaagaagggtcatggacgccctaagctgagcatcttgtttagtaccaggtactttcatcccttcttgactccatctgccttctgtcctggggggccttggttccagaaaccagctcccttctgatcaggtattgtcattaataaactgtgtggtaccagtccagtttaatagaggactacagaagaaattaaaacacaaataaatgagttaggactatagaggtattttagatatggtgggagatggtagaagaaatatgtatttaatgtagagcctgccagtgctttcatatcttgcttcctgctctgtcttcataagaactgtgtcattcttcttataaatgagggtctgtgtgaccctgagtgtccatcttcatagcagttaagtagataggacattacaataatatatttaaaatttaaaatgataa

SEQ ID NO: 341900 - DNA, 480 bp, Homo sapiens
atgaggatcccccgtgaagccttaaccctccatctccctgtctgcactgctctcctgctccatctccccatctgcaccgtctctccctgccccgtctccatctccctgtctgcactgtctctcccagaggtgtttgctggtgccttctttgcagttccctgtgctgtgtcatgcccgtttgctgacccagcccctgctgtgtcttccccatcccagtgtgactgtcgctcttggtagttcctccgtgtttcctttgtttccttaggtgacttgtctttgccccactccctgcagtccgcagcacctgttgtctccttccctctcctcccgcttctcctcagacgtcatctgttctttctagagttgttccccttgccccagggtccagggttcctaacagcctgttttttttctttctttttttttttttagtgagacagagtctcgctctgttgcccaggctggagtgcagtggtgcgg

SEQ ID NO: 341901 - DNA, 244 bp, Homo sapiens
  misc_feature (152)..(152): n is a, c, g, or t
  misc_feature (190)..(190): n is a, c, g, or t
ggcatctagagcaaagaggtagtctccctgccccgtctccatctccctgtctgcactgtctctcccagaggtgtttgctggtgccttctttgcagttccctgtgctgtgtcatgcccgtttgctgacccagcccctgctgtgtcttccccangcctggctaattaaaattttttttttgtagagacgggntcttgctatgttgcccaggctggtctcaaactcttggcgatcctatagaggtcc

SEQ ID NO: 341902 - DNA, 679 bp, Homo sapiens
gagtacagtggcatgatcacggctcactgcatccctgacctcctaggctcaagccatcctcccacctcagccttctggagtagctgggaatataagcgtgtaccatcctacctggctaatttgtttgaatttttgtggaaacaggggtctcatttatgttttagatataccttctacacatagcctgcgggtaactttatataatactttaaataattttcttcatgaaacaaagtttttttcttttttttttgagacggagtctcactctgtcacccaggctggaatgcagtggcatgatctcctgacttcgtgatctgcctgccttggcctcccaaagtgctgggattacaggcatgagccaccatgcacagccactaatttttgtatttttttgtagagatggggtttcaccatgttgcccagggtggttttgaactccttagctcaagtgattcacccaccttggcctcccaaagtgctagaattacaggcatgagccactgtgccgggccagttttaggtttttgttttgttttgtttttcagagacagggtcttgctgtgctaaggctggagagtagtggtgtgatcatatcttgctacagccttgaactcctgggttcacatgtttctttcaccttagccttcccagtagtggactgtaggtatgtgccact

SEQ ID NO: 341903 - DNA, 471 bp, Homo sapiens
cctttgccttttcataccaccttgtttgtattccttttatggcaaatattagaattattatttacaaacatgtcttatcttcaaaatatatccagaatccaactgcttctaactaatcattttcaccgctaccgctttggtccaaaccactgtcatcttttccttgcattacggtgatatccttctaactggttctgctgttttcactctggccctcccacttccacaccagactattcttaacagcagttagcatgatcccatagaaacttaggccatactgtgtcactcctctcctaaatccacctcacccagagtaaaggccaaagttctttttatttttttaagatagagtctcactctgttgcccaggctggagtgcagtggcacaatctcggctcactgcaacctccgcctctcgggttcaagcaattctcctgcctcagcctcccaagtagctgggattacagg

SEQ ID NO: 341904 - DNA, 762 bp, Homo sapiens
ggctttggattttattcaaagaataatggaaaccatgtaagagttttaaaaaggggaatgacatgatttctattatatatgagaacaacttcaactgctgtatctccagtacctaccaagtaagtccctgacatttattaggtctataataaatcatttgttcaagttgttggggccggacatggtggctcacacctgtaatcccagaactttgggaggccgaggcaggcaaatggcttgagttcaggagttcgagaccagcctggacgatgtggcaaaaacccatttctaccaaaataaaaatacaaaaagtagccaggcatggtggcacatgcctgtactgtagtcccagctacctgagaggctgaggcaggagggtcgtttgagcctgagattcggaggttgctgtaagccaagatagcgccattgcactccatcctcggtgacagagcaagaccctgtctaaataaataaataaggttgttggaattgcttcccttagagaatctatgttactcctgagtaaggaggcagaataatgagagctaggggtgctcagggagaggctagtcaagtaaggccttgcgagatgggaaaccaatggagcattctaaacagaaaagtatcaccatttgatatatatgatctgatataaatttaggagcaaaatcctcaattaggaatttttgaaccatgtttcttggcaatgctatcagcctgttgaattatgatggtagctaaaactttctaaaacttagctca

SEQ ID NO: 341905 - DNA, 358 bp, Homo sapiens
cccaccagctgttagggactcctcccctctttacgcagatcaccagttatcttacactgtctggctttagtctcagatgaagacattctaataagcaccaagttgttcagctcagtgctaactctgccaggaatgtgtgcatttcctaagagctgccgaaaatggaaattaaatagtttgaaagaattaaatgataatggtggcatttcatacaccagaagggcagattggcatcagtgtaagcaccttttcagtccttctttgagaacaccaggaaagtggctacctgttttgctcatgcgaaatttggatctctatacaaaagcaaaaagacagtttgtgaagcgttacaatattg

SEQ ID NO: 341906 - DNA, 228 bp, Homo sapiens
catacattatggctgattccggttcaagggctcattgctgtttgtaatgcagcatcttcaacatccatggagccaccccacttactatcttcataaaccaacatagatgaccaccattgtttcctagcaatcaacttactatgatttatgcttcagactattttgtctttcctgtattttttgttctctccttgcgtttatttaacccctcatcatttgcaataagga

SEQ ID NO: 341907 - DNA, 544 bp, Homo sapiens
ccctaagtaacatatgtagaaccaaaaacggcaaacataaaagtattattcttgtgttaggaaaaagtccccagtacttccagcttaattagctggtactggtagtttagtatcctagagatcataaactagtagatcagaatttgcctttaagtttcattaggaagaaataaagacactattactaattcatgtttctggtttgcagttaactcatttaagctatatttagttactcattttggtcaatctactgaaaagaaatactgtaagggatttgcaatgccccctaatttctccttctctgtcaacttctcacatttgctttctaaaaaattcttaatatttaccttccaaatagtaaatgcaatcttctacaaatatctttgatatgaaaatgctcagtttaagaaaaatgtttcagtcacataaatctttgctatatagtattgagggcatttaaatactaagaacataaattattatgttaaatgttgtcagccaagtgtggtggctcatgcatgtaatcctagcactttgggag

SEQ ID NO: 341908 - DNA, 718 bp, Homo sapiens
agaaatgaagagattacagctgcatagagatgcctgtcaaatgacaagtgcctggagaaagcattttgatgaatgaacaacagaatgatcacaaaacagcctttggggccagcagtgtgatctgggttgagactccactgctcttgtgggatcctggagtgtctgatgggatgggaattacagtggatccttcacgacaggggtttgaagggcatggtccactttggtccacctctgccactctgagacagaagcaccaacccctcttcttcctcctcctcctcagtctactcagtgtgaagataacaagaatgaagaactttatgatgatgcatttccacttaacgaacaataaatatattttcttttccttgtgactttcttaataatattttcttttctctatcttactttatggtaagaatcagtatataatacatataacatacaaaatatgtgttaatcagctgtttatgttattgataaggctctggttgacagtaggctattagtagtagttctgtttggggggactcaaagttatacatggattttcagttgcatgggagctggcaccccaatccttgcgttattcaagggtcaactgtgcatagtttcagtggtaaatttgaaatgcataatgcggggattctcaaatttgaaggaagtgatatggggcaaatgaagcaatcgtagtgtgaatggggttatctgggac

SEQ ID NO: 341909 - DNA, 856 bp, Homo sapiens
attccagggtctgagagagagccaagatgaatatggccttccaagaagacatgctgacaagaaaagactcagagtgcccaggagcttccccttcctaccaaccctgcagcctggaaccctagccatacctctccctgactgtggacagtacagcctttgagctgagccaagctgctcccctggcgatttccataagagtaccacttatcagcaccttggacagcatacaaatgattctgcatctccaggaagaactggtccttcagccaagggcagcactgagccccaagtggccccagatgagtgcaaaggactaccagttttgatcagcgactggttgaattcgtggatgcaaaacctgtggatacagagggacagaggcctactgtacatggcacatgctcgcttccccaccccagcctgggcactgctgttcgactgagaccaggattattcccaccgcccaagagcagagagggctcagatgcacagcctctgccttcgtggagtgggcattttcaggaagtgcttagcctccaagtatgggctacttattttttaacaattactttcactccaagacgtacataattttttaaacatgggaatccctgatgtttcatttttgttttggaaatgatttttagagaagatgaattatcctgtctgatgccatgagatctatttttatcatttgggatgttgagactaaaactgacaacatatttagtattgcttatagtactcagtgacactgcctccctttgaagcccgccagagagccaccatgcaggaacatgagttactaattaattcaacctgctcactgggacaaaatgggaaggaagaacccaca

SEQ ID NO: 341910 - DNA, 737 bp, Homo sapiens
attccagggtctgagagagagccaagatgaatatggccttccaagaagacatgctgacaagaaaagactcagagtgcccaggagcttccccttcctaccaaccctgcagcctggaaccctagccatacctctccctgactgtggacagtacagcctttgagctgagccaagctgctcccctggcgatttccataagagtaccacttatcagcaccttggacagcatacaaatgattctgcatctccagaaattgtcacagccaccccaaccttcagctaccactaccctgattcatcagcatcaataccaaggcaacatcctccaccagaaaaagattacaactcaagcacattcacctggggatctggcaagatggctgaatagcaacagctccagtctgcagctcccagtgagaccaacacagaagggtctccctatcacccaggctggatggagtgcagtggcgtactcacagctcaccgcagcctcgacctcccaggctcagttgatcctcccacctcagcctcctgagtagctaggaatataggtgtgcacgaccacacacacctagtttttgtattttttgtagagacagggttttgccatgtttccccggctggtcttgaattcctaagctcaagcaatccacctacctcagcctcccaaagtgctattacaggcatgagccactgtgcccggccaacttcttttcctgttaaagaatctgaacatttat

SEQ ID NO: 341911 - DNA, 560 bp, Homo sapiens
attccagggtctgagagagagccaagatgaatatggccttccaagaagacatgctgacaagaaaagactcagagtgcccaggagcttccccttcctaccaaccctgcagcctggaaccctagccatacctctccctgactgtggacagtacagcctttgagctgagccaagctgctcccctggcgatttccataagagtaccacttatcagcaccttggacagcatacaaatgattctgcatctccaggaagaactggtccttcagccaagggcagcactgagccccaagtggccccagatgagtgcaaaggactaccagggctccatttaaatcttcctttgggcaaaacgggatcttgctgctcaaaaataatttgaaaaaactttgacattttgggtttgtgtcagaaagtcatggatttttttttttttttcgcctaagaagctatcaccaggaagcgtcaaatgagccctgtggaccatggctggcctcttatctttgggtttcaggagggacctcctgctaggttcatctccccccacagctcctgaaatggag

SEQ ID NO: 341912 - DNA, 283 bp, Homo sapiens
gtaaggacagatttattgaaaccaaagtacactccacagagtggaagtgggcttgagcaagcagcccaagagccgtttaccactcatacatttgattccgctgttttgactttgttaatcttttctttgtagattttaaaatgcagagggcagaatattattttgttcttctgtaagtttttaacaagtgatgaaatgataacttcatagatatcaagattcatttttgggttagtgtttttgaaaagctgggtctacttttgattcaatgggattcttaagt

SEQ ID NO: 341913 - DNA, 94 bp, Homo sapiens
aggtggcattctggagagaagcacaaaaaggagaaatcgcatatgagtggcaaaacccagcagagctctctgttgctgaagcctgaagttttaa

SEQ ID NO: 341914 - DNA, 667 bp, Homo sapiens
aaaagtccattctcatagaaattatgtttaaatttccagaggaattaaataaaacccagagagtttaagtaacttatccagcatcatagagcaaagatgacactggaattcaagtcttgagacttccaaacattatctttcaaagggaactgtcacatctttagaatgctagtccatgtatgaattgtaacagctaatacgttttgaagttggggaatcgggggggtaaagaactttaaagtttttgaacttttaatataattcaaagcaaattggcagtccacgttggcataaaaatagctagaatttatgaatttgtattcttggatttgtaaataatatttagcccttagggtcagttcataatatagtaaagcattaagagaatgctcatataaatagccagaatcttctgtttagctgttggaaaactagtcaactgctgcagctctcaagctaaactgttgatgattagtataggcacgggtaagattgaatatgaaggaagcattggggacacaaaattcaagtgaatattagtcacaaagtagtccatattcagataaatttctgtaataaccattttaccattatgtaatcagaaccagaccacctgggtctgagttgtagttcccctatctgatgaccaaagggtaagccagtaaat

SEQ ID NO: 341915 - DNA, 494 bp, Homo sapiens
tggaccaggagcaccatttccaagacaaatatttattctatcgatttctggatgatgagcacgaggatgcccctttgcctactgaggaggagaagaaggagtgtgatgaggagctccaggacaccatgctgctgctgtcacagatgggccccgacgcccacatgaggatgatccttcgcaaaccacctggccagaggactgtggatgacctagagattatctatgaggagcttcttcatattaaagccttatcccatctttctaccacagtgaaacgagagttagcaggtgttctcatttttgagtctcacgccaaaggagggactgtgttgtttaaccagggggaagaaggtacctcctggtacattattctaaaaggatcagtgaatgtagtcatttacggcaagggtgtggtctgcaccctgcatgaaggagatgacttcggcaagttagcactagtgaatgatgccccacgagctgcctctatcgtctta

SEQ ID NO: 341916 - DNA, 452 bp, Homo sapiens
ttagacagagtttcgctcttgtcacccaggctggagtgcaatggcgcaatcttggctcactgcaacctccacctcccaggttcagtgattctcctacctcagcctcccgagtagctgggactacaggcacatgccaccatgcccagctattttatcctttaatataacaataattctaatactctgttggaaggcaattcatcgatgtcccttgtttcttcatgtcctgtgagaagatgcactgacttattgttctgaactattttgtttacaccgtaaacacttggaagataagctctgcttcagcaacagatttgggggcagctttggaaataataatgtctccttctaggtcaaagggcagtaaagcatacttactacatgctataaaagatttgacgccctagcctcagagctcctctcctataattcagctcactgcatgtgtaggt

SEQ ID NO: 341917 - DNA, 305 bp, Homo sapiens
ccactgcacactgtccctggatgaggacacagctctgtgaaggtggggacccaggctgaccaattcacatccggccttcagcagccaacacagagcttggcatgtgggtggtgcttaacagactggctgatgagacaacgtgcatcaacaaaggacaccggacggggtttcaccatgttagccaggatggtcttgatctcctgacctcgtgattcacccacctcggcctcccaaagtgctgggattataggcgtgagccaccgcgcccggccctgaccctgtcttaaaaaataaataaaaaacaa

SEQ ID NO: 341918 - DNA, 1773 bp, Homo sapiens
  misc_feature (860)..(860): n is a, c, g, or t
  misc_feature (1117)..(1117): n is a, c, g, or t
gggatagactggaggggaaggtggacaggtctggagtacagtaggtggagggagggaagcacaggtttggggcactgaattttgtgctgtagggagaagggaggtagggagaaagaaggaaggtagacaggctattttggggtagaggatgtagaagaatgcttaatacctatagtggagtaagagaagggcaaggcagaggtgtatgtggacatgtctgtaactagaaaggcataggtgatggattggagtggtggtggtggtggtgggggaaataggatgcccaggtttagggcaggaaatgactgcttaagttggagagagctaggaacacaggttgcttaagagagtatggaagatccaaggagtggaagtatggggagagattggaacactttgagtttgagagatgaaaggggccaagatttttaggtcactgagagtctaaggaagatcaggcagagtgcagaagttggaaaaataactaaatggagaggattaaattccatactgagagaaactggagattgaggggtggggggacctggatcctggaatgatgttaatggaaagtggaggacattaaactcagtgtcatatctgaaagttcatactcctagggtcagagagatcgttgagcctgcttttaattccagaacccagtaaatgaggaagggggaaggggtaagggagagctgagtgcacatccccaaatttgggagaggtgtgtagtgggtatcatcctagcatattggtttgacgagtggacagaagggccacacagggtcacgaggagcgcaccaagagtgaatggaaatgggattgcagcaggtgcagggcagatgtctttgtgaaactgnaagagaccaggcccagtggccagtagcattcaagggctatgcataagagaggaagaaagggataccttggtgcagtgtctcagataccctggtgctttctgggtaatgggtcagtattcaggcagcatggggtgatgtaatatctgagtcccatgctataggcagacagaagtaatgtacacctagctcctaaaagtggcagaattggagctttctgactcttaacactctttcaaggcgtgaataactgatctggnttgttgactttttctcccaaatggttcaggtaaaatttagttggaggcttttggattctctggtattttgatttgagttgggaagtgtaatgttagctttattgaggaaagacacttatgggttgggcggacatatggccttcagcttgccaaacacatgggaagtaacctttaggggtttgaacacagacatttatttcagtgcaagtctcattcactgttctgtggcttgtgttagattcttaggggtttgaaaggattaagcaaactactttgagactgcttcagtaagcaaggtttcctagaatcttggaaaacgatttcccttttgacagttgaaaattaagtcttgtcagattttgctaagaaataaatttcatcatgttgcagaaataacttcaattatcactctgtgggcttcacgtaatgtgtagtgtggtacctagtatgatttcaaataaaaggttcgctttggtagcttgggagctttctgggttgattagttttcttcttttgtcgatttaggaagtatcttaatgcagccattgtatgttcgaataataagtttgagtggaagtgggaatcttgcctaaacataatgagggcggagcagaacaccaaattttaagtaatcggaatccgttaatataaatatt

SEQ ID NO: 341919 - DNA, 177 bp, Homo sapiens
tatccctaaaattctatgaaatgtaatagctgtagtcatgggccagacaaataattgttttacatcaaattctaattgctgatgttatctctcagtttcagtaaggctattgtatctgtactctagaaagacaaaatacttattaaacaataagatagaaaaacataggtagaccag

SEQ ID NO: 341920 - DNA, 513 bp, Homo sapiens
ttttttttttttggtgctatattaagttggattgctgccactaaaaatacaagtgaaggacatgaatcaaaatagctttaccaaatggcttaaacaaacacaaaaaccttctgctaggttgtgtgtgaggaaaattcatctcttatttttaaagtccacatattatatccatacataacagtatttactatcaaagtgaaaaaaatccatgagattaatatcatgggatgtttccctatgaatccacagtcaacgttttttattccttttaatacataaatactatctttaattgtactttcaagcacattttatgcccctcttactaaaaacacacaaaacgtatgagataaaatagaactagagtgctttattcttaaagcttgggctacaatttcccaaaatgtctctgatttataatattaaagattatgattttagatttcagcctaaaggcaagcattcaatctagtggataaatttagatcccactattcattgatattttgaaga

SEQ ID NO: 341921 - DNA, 661 bp, Homo sapiens
ggaagggtgactcactagacaggagttgaaaatgcctgggtttttgtgacactaacatctgtgtcctccatagatggagctcacatcacggagctcatgagaagctgagtgccagctaccacacacacattcagacatttgctgtcgggccacgggccatgctgatggagaaaaggtagcctaaattctctggtaacgggggtgagagagagagagagagatgtggcgatgaaaataaagaataaggaaaggaatagcgacttcaggggactttgcctgggttggggctcaggccggggcctgggaagtatgagagacagagggtgataaaagggcatcaggtgttagagagcagctggaccagaagacccaccatccggcagcaacacccaaagacctttggtcacataatgtggggacggggagggaggagctctggcactggagatagccttgggcacctggcaatgccctcccgccccttccccgctgactagttcacagaggccttgccccatgccactgcactgccttgacactgacacacagcactgccggcccagggacttctcagggtccaaacctcctacattcccagggctcccagaaatcagagctgaacccacaaggcacacagagctgggcctctgagctggctccc

SEQ ID NO: 341922 - DNA, 737 bp, Homo sapiens
ggttgatttgggaagcagagcacagcagcccaaatttgcttgtaatgtcggcggctacagaggaaaggccaagaatggacagattaataaagggccatctacaagccacgaataaggccatcaccagaagccaaccccgccagtccttgatctaggacttccagacttcaaaacttttctagcctgctggcctgccttcactgtcctgggggaggcttggagagaccaggtggactggagtagactgttgagagacgctggtctggtgaagatgtccaggaaaccacgagcctccagcccattgtccaacaaccacccaccaacaccaaagaggcgaggaagtggaaggttcccaagacaacccggaagggaaaagggacccatcaaggaagttccaggaacaaaaggctctccctaaaagaccgccgcttcaaaaaaacctgaggaatggagtgggccaacactatccagccactctgaccagccgaacgaggaactcaatcaaaatgagccatagcgggaccacaagggcaaggagaccaccaccttctccagtctctcttcggacagccagtaattcccgggcaaggccagagacttcaagtctatctgaaaagtctccagaggtctaaccccagataaatagccaacagggtgtagagtacattttacaccccaaagagtgtgccccatggtgatgaaaataaagtgaacatgttgcaaaatgaaaaatgtgt

SEQ ID NO: 341923 - DNA, 343 bp, Homo sapiens
gttgctgtgaaggtattttgtagatgtgatcaacatttacaatcagttgattttaagtaaagcagtttaacttccataatgtggatgggcctcatccaattagttgaaggtgttaagagaaaagaccaaggtttcctggaaaaggaattctaccacaagactaacataaaaatgcgctgtgagtttctagcctgctggcctgccttcactgtcctgggggaggcttggagagaccaggtggactggagtagactgttgagagacgctggtctggtgaagatgtccaggaaaccacgagcctccagcccattgtccaacaaccacccaccaacaccaaagaggc

SEQ ID NO: 341924 - DNA, 381 bp, Homo sapiens
cccgaggtgacaaaaaaacactcacattcccaagcacgtatgcatgtacaccatgggcattgggttgtttttagttaaatagcatcctgttacgcacgccctgaaattgtttctaaacttgcctataggtctgtagattaatttcaaatgtatcattacatacataggtgtcattttacataaatgggattataacatttttggtttttagtgcagtatttttttccatctaatctgccttccccttcccttacttcccatttcaccgctatgacttcccaggtaactcctataatttaccaggacttttctctgtgcttatgttgttattctaaacaacacatacacatttatatgtttgtttctttttttttttttttt

SEQ ID NO: 341925 - DNA, 754 bp, Homo sapiens
cttgtgactacccacttcaactccagtctgcatttcccagtggctcctggcatgggaggagtcaatgggagtcaagatgaaaaaggacccaggcaggaaaagttaacatgagtgaacactaccggctagctaaggaacagcaaatgtggctgccccgtgcaccaagggccatgtgtgatccccaggctgctgtgggtcactagacgtggttatagagagtgagaactggacagtgtcttttttcagggagaagacaagattaaggcaggaatgtcaatttctctgtgcaagacttccagatagcagctggccagaaaatgttttcatgccatacttccaaagaggggcccaaatctcatgcttgtcctttatatccaaggttaaatgagttaatacttataaagcactcagaatggtgactggcctagggtaggaaccctgcaactgattcaaaagtttcttctctgagatttcaaaacaacaggtaagaatagcaagactccattttgtgttttacgtctccttttatctgacccagtcacaggcttctttgcttcagtcaacacaaattatgacctagccatgagaaatttcccctcttctcctccttaattcattttgaatccaggcagcctggctgccaaaagtatttttctttttctttgtcttttttggttctttcttttttagaaaaacatccaactgatttactataaagccattgtattcatatagcattaattaaatactacat

SEQ ID NO: 341926 - DNA, 312 bp, Homo sapiens
tgagcgaggtgatctgaggaccctcctcagctggaaagatatagttcttcacagataaatattttgtttccatgatctgtaataacatctgataatatatgagtaattattttcaataaactaaaataaaagtaatctttctttttctttctatcttgaagtagtgggaggaaaaatactatttggaagcgtcatgccctaaaatagtggaaagctttagagggatgggtttcacatcaggaaatctagggaggaaaaatctcttcctctgggatggtgttagtttctttttccagagagggcaaaagttcc

SEQ ID NO: 341927 - DNA, 551 bp, Homo sapiens
agagtttattagtctctacagtgtgtgttcatcagaagttcatccagtttgacctagtgttggcctgtgacagtctaaagctttaatccctgccaaattagagtggaaatcatgataaggaaccatctagagatttttaattgcagataaaacatacaaaatgttttttgaaatctcatgtaacaatctgtttggataatattattggagatgttgacatttaagtgagaaaattattgtgcataaagtgaagcagaatgaagatggtaagaatctctgagcagatagcaaaaataaaaagctacataaaccagttgatttttaaaattagcacagctttaatctgagatgcaagatatcagttttgtaagcattattcagggctggcacttggtgaggtcctacgtctctggaggagtaaacagttcacgggattattttgttaatcaactctgaggagagagatttggacaaaaacactttacttagtaaatgaaacatatttaatttgctgtctcattctttgtcagtttgtcattagaggaacccgt

SEQ ID NO: 341928 - DNA, 289 bp, Homo sapiens
ggatgactgactacaaacggcacaaggcaacttttggggatgatgggaatattccacatctcaattgcggtggttgttacatgacagtttatgtttgttaaaactcagaggcccacacaactaaaaagtgtgaattttattctgtgtaaattattcttcaataaacctgattttaaaaattatcaagtgacaagatgaaaaggtgtaatttgtttgcagggtcctagacttcctgagacctaaaaatgtgaccttaggctgaacgctgtggctcacgcctgtaatccca

SEQ ID NO: 341929 - DNA, 791 bp, Homo sapiens
ttccacttctgggcataaacccccaaactgaaagctggaactcaacaggtgcttgtacacccatgtacagagtaacattattctaacagccaaaaggtgaaaacagcaccatgtccatctacagatcaatggacaaacacagtgccatgtgctaacacgaactaaatgtggcctgagaagaatgccaggacgtctatgtttgagtccttgtggacgaactataacctaccttaatagcagacaggactgaaaacctaattcaggagtctgcgcctgtaatagtggccgagtcttgaccaatcccagcagccatacgtcaaccatgcatagactgccgagtgttcaaactgttccaataaggcaaatgccaacctggaaccaatccagctgttctgtacctcactgccgagttttatatatcacttccccttttttttgtctatatatttgttctgaccacgaggaatccctggagtctctctgaatctgctgtgattctggcgctgcccgattcatgaatcattcattgctcaattaaactcctttaaatttaattcagttgaagtgtttcttttaacaaatggaatatgatccagccttaaaaaagaagtgagtctggacacaggctataacacgaggaaccctgaggatgttatgctgggtgaaatgagccggtcacagaaggacgaatcccgcagggtggcactgaggagaggtctccggaggggttggagccacagagacagaaagtaggatggttggtggctgccacatgcgcgcaggggaatctg

SEQ ID NO: 341930 - DNA, 312 bp, Homo sapiens
tatagtcaacactgggctacaacagttaagtttttggggagtcagttatatgtggattttctactgcatagtgggagtgtgagggtcgttgcctcttacccacatgttctggggactcaactgtaggattattagaaatagtaactatcctgatggaaggtttgtaccctttgaccaacatttccccatttcgttcaacccccctggctctagtaaccaccattctactctctgcttctatgagtttgatttttttagattccatgtacaagttagattatgcagtatttgctatgtcttgcttatttcgcc

SEQ ID NO: 341931 - DNA, 459 bp, Homo sapiens
gaatcagctccctccttcccagcagttggctttctccctctctttcctggtctggtctgtctaccaccagttgccatcctgtcctgagtgattgcttcatttcccaccctgattgacatcctcagggattccccttcagcataagctgcccccaccccgggcgtggtcccttgcacctccctccacaggctggcccctgcctgcctcctcacctcacgtatccccagtcacctcctctgctccaaggcacggcaggtccctgcccttctctgagcaggccactttgtttgaacacgtctctgtgtctttgaatagccctcctctccccactgaagccttctgcctcccaccacgaataaagatgatctttgtcttctttaaaacttgccctaagtttgcaaaacacaggatgtagagcagcatctaatagactatcatttgtgtttgaaaaaaaaaaaa

SEQ ID NO: 341932 - DNA, 199 bp, Homo sapiens
tcctcctcattctacttgcctgatcttggacaagttgatgaacctcttggcttccacacctgtaaactcaggataataagacagtagcgatatttggttgtctattgtctattcagcaccgacttcattcttcctaacaagactttggtgttgttcagggatcttctctatcctcacacaactgtgggaaacaggggaa

SEQ ID NO: 341933 - DNA, 282 bp, Homo sapiens
catacatttacaaattctatatcccaggaatggaaagtactcatgttaagctctgattctgacagaatgcattcctgttacgttgcaaataccactagtcaagcattgcttaaagtacaggtcataattgttttccacctgtgaatacaggcaatcatatcagtgtgaataggcttttttttttcctttaccacatagtatttacatttatagtttaatagtgctgagcaattcactttacaccatttttaaaagcttatttgtttttgttttgtttttttt

SEQ ID NO: 341934 - DNA, 340 bp, Homo sapiens
gagctcgtgatccgcccgcctcggcctcccaaagtgctgggatgacaggcgggagccaccgcgcccggccggtactagtatcgtggataacagcaatcactacatcataaagctgacagagtggactgtgaaaccaattcatcgtgtggcctgtccaatgaattacatttactcccaattctgaaaggtgctttaaaacaaacacaagaggagccagcacttctctcattagattaccagtaggcggaaaccttgggctttatgtgaaaaagtcccactttaccaacctgaagagcatcttacctcgaaagcattcatcaggacagtggctcccaattgt

SEQ ID NO: 341935 - DNA, 169 bp, Homo sapiens
ccaccttcattctttccaggatacacacagcaactcctccctgctctcctcttccctgtcctcccacctgcctattcccaaaggcagcccactgtgaccctataaaaatgttaggtcccatcacatcgcttccctactcagaactccccagtgtcaccctctcattcag

SEQ ID NO: 341936 - DNA, 460 bp, Homo sapiens
gcaggagaatcacttcaacccaggagcagagggtgcattgagctgagatcgccccactgcactccctcctgggcgacagagagagacgctgtccacccccgcctccaccaaaacaaacaaacaaacaaacaaacaaaaaaacccctgagactgggtaatttatagagaaaagagtttgattggctcacgctttgtagcacaggtgtttctgcttctggagaggccccaggaagcttccaaccgtggtggaaggcgaagcgggagcaggtgtctcacatggcgtgagcgggaacgagaaagacagagcagggaaacgtgcagaggaaatggttggagagcgaagtccaggcacaggggccatgagagccggaccccacgcagctgcagaccccgacccgaactgcatgcggctgaggacccccaagccaggcagaccccgacccagaccccacgcggccgc

SEQ ID NO: 341937 - DNA, 554 bp, Homo sapiens
ggcgggcaggtggccccgggagcccagacggacggctgctgtcgatatggcgacagctgccctgtggccgcccctgcacccagatggcgcctggcctggccgcagcatcctggagtctgaggccagcacctgcgtctccctgaagcccctcagagcctgccctgcagtgctgctgccctcgtctaccagtggctcaagcctgtcatcccagcactgtgggaggccgaggcgggtggatcacctgaggacaggagttcaagaccagcctgggcaacatggctatatggaaagcacaggtgtttctgcttctggagaggccccaggaagcttccaaccgtggtggaaggcgaagcgggagcaggtgtctcacatggcgtgagcgggaacgagaaagacagagcagggaaacgtgcagaggaaatggttggagagcgaagtccaggcacaggggccatgagagccggaccccacgcagctgcagaccccgacccgaactgcatgcggctgaggacccccaagccaggcagaccccgacccagaccccacgcggccgc

SEQ ID NO: 341938 - DNA, 1213 bp, Homo sapiens
ccacccaccacccacccacccacccacccacccacccaccacccacccacccacccacccacccacccaccacccacccacccacccacccacccacccaccacccacccacccacccacccacccacccaccacccacccacccacccacccacccacccaccacccacccacccacccacccacccacccaccacccacccacccacccacccacccacccaccacccacccacccacccacccacccacccaccacccacccacccacccacccacccacccaccacccacccacccacccacccacccacccaccacccacccacccacccacccacccacccaccacccacccacccacccacccacccacccaccacccacccacccacccacccacccacccaccacccacccacccacccacccacccacccaccacccacccacccacccacccacccacccaccacccacccacccacccacccacccacccaccacccacccacccacccacccacccacccaccacccacccacccacccacccacccacccaccacccacccacccacccacccacccacccaccacccacccacccacccacccacccacccaccacccacccacccacccacccacccacccaccacccacccacccacccacccacccacccaccacccacccacccacccacccacccacccaccacccacccacccacccacccacccacccaccagccagccagccagccagccccaatttttataaagtgtttttgagtgtcctatgggccggggcagggtccaagatcttttcccttccccaggcccctcggctccctcccagatcccacccccagccccactggttgccaaacactaaatctgccgacacccatctgccccacctcctgccatggccatgaaccgcgacccccactaaatttctagattggggatagggagaaagggaggcccaggaaggtctcccctgattttttttcatagtaatttttttccccagagtttgaattttttggtcttctcctggttttttggcaaattaggggggcccggggctcaagtgcgggaagggggctggcccgaggatcccatggctctcacaccatgtttttgtacagaactgatggttgaatctttgttctcttgaaataaacagaagaaaatgaaacctt

SEQ ID NO: 341939 - DNA, 519 bp, Homo sapiens
gagacaaagtctcgctctgttgcccagactggagtgcagtggcatgatctcggctcactgcaacccccgcctcccaggttcaagcaattatcctacctcagcctcccgagtagttgggaagacaggtgcacatcaccatgctctgctaatttttgtatttttagtccagacagggtttcacatgttgaccaggctggtcttgaactcctgggctcaaataatctgccccacctcctgccatggccatgaaccgcgacccccactaaatttctagattggggatagggagaaagggaggcccaggaaggtctcccctgattttttttcatagtaatttttttccccagagtttgaattttttggtcttctcctggttttttggcaaattaggggggcccggggctcaagtgcgggaagggggctggcccgaggatcccatggctctcacaccatgtttttgtacagaactgatggttgaatctttgttctcttgaaataaacagaagaaaatgaaacctt

SEQ ID NO: 341940 - DNA, 333 bp, Homo sapiens
gacagcgaggatgctcagatgcgcacgcgtcacatctgggctcacagttgcgcgctgatatgacagtggcgtcgtctcaaggacatggtttttctggacgatggccccaatttttataaagtgtttttgagtgtcctatgggccggggcagggtccaagatcttttcccttccccaggcccctcggctccctcccagatcccacccccagccccactggttgccaaacactaaatctgccgacacccatctgcgggtttcagggggacagtggaggatccaggtcttggggagctcaggacttgggctgtttgtagttttttgccttttagac

SEQ ID NO: 341941 - DNA, 1568 bp, Homo sapiens
tcgctctcctccctcttcccggctccagctccgccgccagctccagcctttgctccccctcccaaagtcccctccccggagcggagcgcacctagggtccctcttccgtccccccagcccagctacccgttcagaccagcagcctcggggggcacccccccgccagcctgcctccctcccgctcagccctgccagggttccccagccatgaatctcttccgattcctgggagacctctcccacctcctcgccatcatcttgctactgctcaaaatctggaagtcccgctcgtgcgccggaatttcagggaagagccaggtcctgtttgctgtggtgttcactgcccgatatctggacctcttcaccaactacatctcactctacaacacgtgtatgaaggtggtctacatagcctgctccttcaccacggtctggttgatttatagcaagttcaaagctacttacgatgggaaccatgacacgttcagagtggagttcctggtcgttcccacagccattctggcgttcctggtcaatcatgacttcacccctctggagatcctctggaccttctccatctacctggagtcagtggccatcttgccgcagctgttcatggtgagcaagaccggcgaggcggagaccatcaccagccactacttgtttgcgctaggcgtttaccgcacgctctatctcttcaactggatctggcgctaccatttcgagggcttcttcgacctcatcgccattgtggcaggcctggtccagacagtcctctactgcgatttcttctacctctatatcaccaaagtcctaaaggggaagaagttgagtttgccggcatagccccggtcctctccatctctctcctcggcagcagcgggaggcagaggaaggcggcagaagatgaagagctttcccatccaggggtgacttttttaagaacccacctcttgtgctccccatcccgcctcctgccgggtttcagggggacagtggaggatccaggtcttggggagctcaggacttgggctgtttgtagttttttgccttttagacaagaaaaaaaaatctttccactctttagtttttgattctgatgactcgtttttcttctactctgtggccccaatttttataaagtgtttttgagtgtcctatgggccggggcagggtccaagatcttttcccttccccaggcccctcggctccctcccagatcccacccccagccccactggttgccaaacactaaatctgccgacacccatctgccccacctcctgccatggccatgaaccgcgacccccactaaatttctagattggggatagggagaaagggaggcccaggaaggtctcccctgattttttttcatagtaatttttttccccagagtttgaattttttggtcttctcctggttttttggcaaattaggggggcccggggctcaagtgcgggaagggggctggcccgaggatcccatggctctcacaccatgtttttgtacagaactgatggttgaatctttgttctcttgaaataaacagaagaaaatgaaacctt

SEQ ID NO: 341942 - DNA, 2035 bp, Homo sapiens
tcgctctcctccctcttcccggctccagctccgccgccagctccagcctttgctccccctcccaaagtcccctccccggagcggagcgcacctagggtccctcttccgtccccccagcccagctacccgttcagaccagcagcctcggggggcacccccccgccagcctgcctccctcccgctcagccctgccagggttccccagccatgaatctcttccgattcctgggagacctctcccacctcctcgccatcatcttgctactgctcaaaatctggaagtcccgctcgtgcgccggaatttcagggaagagccaggtcctgtttgctgtggtgttcactgcccgatatctggacctcttcaccaactacatctcactctacaacacgtgtatgaaggtggtctacatagcctgctccttcaccacggtctggttgatttatagcaagttcaaagctacttacgatgggaaccatgacacgttcagagtggagttcctggtcgttcccacagccattctggcgttcctggtcaatcatgacttcacccctctggagatcctctggaccttctccatctacctggagtcagtggccatcttgccgcagctgttcatggtgagcaagaccggcgaggcggagaccatcaccagccactacttgtttgcgctaggcgtttaccgcacgctctatctcttcaactggatctggcgctaccatttcgagggcttcttcgacctcatcgccattgtggcaggcctggtccagacagtcctctactgcgatttcttctacctctatatcaccaaagtcctaaaggggaagaagttgagtttgccggcatagccccggtcctctccatctctctcctcggcagcagcgggaggcagaggaaggcggcagaagatgaagagctttcccatccaggggtgacttttttaagaacccacctcttgtgctccccatcccgcctcctgccgggtttcagggggacagtggaggatccaggtcttggggagctcaggacttgggctgtttgtagttttttgccttttagacaagaaaaaaaaatctttccactctttagtttttgattctgatgactcgtttttcttctactctgtggccccaatttttataaagtgtttttgagtgtcctatgggccggggcagggtccaagatcttttcccttccccaggcccctcggctccctcccagatcccacccccagccccactggttgccaaacactaaatctgccgacacccatctgccccacctcctgccatggccatgaaccgcgacccccactaaatttctagattggggatagggagaaagggaggcccaggaaggtctcccctgattttttttcatagtaatttttttccccagagtttgaattttttggtcttctcctggttttttggcaaattaggggggcccggggctcaagtgcgggaagggggctggcccgaggatcccatggctctcacaccatgtttttgtacagaactgatggttgaatctttgttctcttgaaataaacagaagaaaatgaaaccttaaaaaacaaaaaaacaaaaaaaaaaacacatttttggggcgcggccttgggccccgaaaaactttcttaaacccatccgcaggtgggacgcgcgcggcgaccacaaagagagcgtaggtgacaccgtgtggcaacaaacgggtggtaccccaggagaaaaccacggtggacaagagaaaaaaagcgccgactgggagaaattcctcccccgcacggatagaaaaaaagaagcgcccgcgcgggggggcgcaacaacaccgcagaagatgctgtctcgtgagacgacacaacagaactcgcccacagaatggggagcgcgaccgcccgagagagggcgccaactagaaggggggggagactcagaagatgacacagaggggaggagagtaccacaccagaagggagaagatgcgccgaacaagactagaatagaagacgaccccgcccgtcgtcgggtggatagcgca

SEQ ID NO: 341943 - DNA, 1624 bp, Homo sapiens
tcgctctcctccctcttcccggctccagctccgccgccagctccagcctttgctccccctcccaaagtcccctccccggagcggagcgcacctagggtccctctactcagcctcaggcgtacctctgttcagtagcatgctagtcgtctgggcgggcagctcccacctaacaggccgtggtgctccactcgctcgcgtgcagaccgcctgtccgagtggatttacccacagacctactgcataatttgcgtgtaccgaacttccgtggcgaggaccatgctcgcgcgatactccgtcgaccatcgagtcttgctacatgcgtacaaaatctgagaagtccgcgctcgtgcgccggaatttcagggaagagccaggtcctgtttgctgtggtgttcactgcccgatatctggacctcttcaccaactacatctcactctacaacacgtgtatgaaggtggtctacatagcctgctccttcaccacggtctggttgatttatagcaagttcaaagctacttacgatgggaaccatgacacgttcagagtggagttcctggtcgttcccacagccattctggcgttcctggtcaatcatgacttcacccctctggagatcctctggaccttctccatctacctggagtcagtggccatcttgccgcagctgttcatggtgagcaagaccggcgaggcggagaccatcaccagccactacttgtttgcgctaggcgtttaccgcacgctctatctcttcaactggatctggcgctaccatttcgagggcttcttcgacctcatcgccattgtggcaggcctggtccagacagtcctctactgcgatttcttctacctctatatcaccaaagtcctaaaggggaagaagttgagtttgccggcatagccccggtcctctccatctctctcctcggcagcagcgggaggcagaggaaggcggcagaagatgaagagctttcccatccaggggtgacttttttaagaacccacctcttgtgctccccatcccgcctcctgccgggtttcagggggacagtggaggatccaggtcttggggagctcaggacttgggctgtttgtagttttttgccttttagacaagaaaaaaaaatctttccactctttagtttttgattctgatgactcgtttttcttctactctgtggccccaatttttataaagtgtttttgagtgtcctatgggccggggcagggtccaagatcttttcccttccccaggcccctcggctccctcccagatcccacccccagccccactggttgccaaacactaaatctgccgacacccatctgccccacctcctgccatggccatgaaccgcgacccccactaaatttctagattggggatagggagaaagggaggcccaggaaggtctcccctgattttttttcatagtaatttttttccccagagtttgaattttttggtcttctcctggttttttggcaaattaggggggcccggggctcaagtgcgggaagggggctggcccgaggatcccatggctctcacaccatgtttttgtacagaactgatggttgaatctttgttctcttgaaataaacagaagaaaatgaaacctt

SEQ ID NO: 341944 - DNA, 1189 bp, Homo sapiens
ccaaatccggggtcagtgatcctcgagctggcagaaccaatggccattcgctactagtgaaacagtaaggtatcctgcatatgcaagatgggaaccatgacacgttcagagtggagttcctggtcgttcccacagccattctggcgttcctggtcaatcatgacttcacccctctggagatcctctggaccttctccatctacctggagtcagtggccatcttgccgcagctgttcatggtgagcaagaccggcgaggcggagaccatcaccagccactacttgtttgcgctaggcgtttaccgcacgctctatctcttcaactggatctggcgctaccatttcgagggcttcttcgacctcatcgccattgtggcaggcctggtccagacagtcctctactgcgatttcttctacctctatatcaccaaagtcctaaaggggaagaagttgagtttgccggcatagccccggtcctctccatctctctcctcggcagcagcgggaggcagaggaaggcggcagaagatgaagagctttcccatccaggggtgacttttttaagaacccacctcttgtgctccccatcccgcctcctgccgggtttcagggggacagtggaggatccaggtcttggggagctcaggacttgggctgtttgtagttttttgccttttagacaagaaaaaaaaatctttccactctttagtttttgattctgatgactcgtttttcttctactctgtggccccaatttttataaagtgtttttgagtgtcctatgggccggggcagggtccaagatcttttcccttccccaggcccctcggctccctcccagatcccacccccagccccactggttgccaaacactaaatctgccgacacccatctgccccacctcctgccatggccatgaaccgcgacccccactaaatttctagattggggatagggagaaagggaggcccaggaaggtctcccctgattttttttcatagtaatttttttccccagagtttgaattttttggtcttctcctggttttttggcaaattaggggggcccggggctcaagtgcgggaagggggctggcccgaggatcccatggctctcacaccatgtttttgtacagaactgatggttgaatctttgttctcttgaaataaacagaagaaaatgaaacctt

SEQ ID NO: 341945 - DNA, 1188 bp, Homo sapiens
cctgtgtatctgctgtgatgtagtgtccccgttacacattggtagttgaaatctgtgggagtgtgtcagtgaccaaacgtgattccgaaggaacactagtggtgcctaccaagaagtctcagatcttttctcccgccctgtcccctcccacctcatcatgtccccggcctctctgcagatcctctggaccttctccatctacctggagtcagtggccatcttgccgcagctgttcatggtgagcaagaccggcgaggcggagaccatcaccagccactacttgtttgcgctaggcgtttaccgcacgctctatctcttcaactggatctggcgctaccatttcgagggcttcttcgacctcatcgccattgtggcaggcctggtccagacagtcctctactgcgatttcttctacctctatatcaccaaagtcctaaaggggaagaagttgagtttgccggcatagccccggtcctctccatctctctcctcggcagcagcgggaggcagaggaaggcggcagaagatgaagagctttcccatccaggggtgacttttttaagaacccacctcttgtgctccccatcccgcctcctgccgggtttcagggggacagtggaggatccaggtcttggggagctcaggacttgggctgtttgtagttttttgccttttagacaagaaaaaaaaatctttccactctttagtttttgattctgatgactcgtttttcttctactctgtggccccaatttttataaagtgtttttgagtgtcctatgggccggggcagggtccaagatcttttcccttccccaggcccctcggctccctcccagatcccacccccagccccactggttgccaaacactaaatctgccgacacccatctgccccacctcctgccatggccatgaaccgcgacccccactaaatttctagattggggatagggagaaagggaggcccaggaaggtctcccctgattttttttcatagtaatttttttccccagagtttgaattttttggtcttctcctggttttttggcaaattaggggggcccggggctcaagtgcgggaagggggctggcccgaggatcccatggctctcacaccatgtttttgtacagaactgatggttgaatctttgttctcttgaaataaacagaagaaaatgaaacctt

SEQ ID NO: 341946 - DNA, 1176 bp, Homo sapiens
cgctatcgctctccaaccacccaacatgcggcgtatttgcctcaagtacctgctgcttactacacattgctgcttctggctggctgttctggctgtcatggcagtgggcatctggacgctggccctcaagagtgactacatcagcctgttgcctcaggcacctacctggccacagcctacaatcctgggggtgggtggagaacggccgctctccactcaaccaatggtgagcaagaccggcgaggcggagaccatcaccagccactacttgtttgcgctaggcgtttaccgcacgctctatctcttcaactggatctggcgctaccatttcgagggcttcttcgacctcatcgccattgtggcaggcctggtccagacagtcctctactgcgatttcttctacctctatatcaccaaagtcctaaaggggaagaagttgagtttgccggcatagccccggtcctctccatctctctcctcggcagcagcgggaggcagaggaaggcggcagaagatgaagagctttcccatccaggggtgacttttttaagaacccacctcttgtgctccccatcccgcctcctgccgggtttcagggggacagtggaggatccaggtcttggggagctcaggacttgggctgtttgtagttttttgccttttagacaagaaaaaaaaatctttccactctttagtttttgattctgatgactcgtttttcttctactctgtggccccaatttttataaagtgtttttgagtgtcctatgggccggggcagggtccaagatcttttcccttccccaggcccctcggctccctcccagatcccacccccagccccactggttgccaaacactaaatctgccgacacccatctgccccacctcctgccatggccatgaaccgcgacccccactaaatttctagattggggatagggagaaagggaggcccaggaaggtctcccctgattttttttcatagtaatttttttccccagagtttgaattttttggtcttctcctggttttttggcaaattaggggggcccggggctcaagtgcgggaagggggctggcccgaggatcccatggctctcacaccatgtttttgtacagaactgatggttgaatctttgttctcttgaaataaacagaagaaaatgaaacctt

SEQ ID NO: 341947 - DNA, 1259 bp, Homo sapiens
tcgctctcctccctcttcccggctccagctccgccgccagctccagcctttgctccccctcccaaagtcccctccccggagcggagcgcacctagggtccctcttccgtccccccagcccagctacccgttcagaccagcagcctcggggggcacccccccgccagcctgcctccctcccgctcagccctgccagggttccccagccatgaatctcttccgattcctgggagacctctcccacctcctcgccatcatcttgctactgctcaaaatctggaagtcccgctcgtgcgccggaatttcagggaagagccaggtcctgtttgctgtggtgttcactgcccgatatctggacctcttcaccaactacatctcactctacaacacgtgtatgaaggtggtctacatagcctgctccttcaccacggtctggttgatttatagcaagttcaaagctacttacgatgggaaccatgacacgttcagagtggagttcctggtcgttcccacagccattctggcgttcctggtcaatcatgacttcacccctctggagatcctctggaccttctccatctacctggagtcagtggccatcttgccgcagctgttcatggtgagcaagaccggcgaggcggagaccatcaccagccactacttgtttgcgctaggcgtttaccgcacgctctatctcttcaactggatctggcgctaccatttcgagggcttcttcgacctcatcgccattgtggcaggcctggtccagacagtcctctactgcgatttcttctacctctatatcaccaaagtcctaaaggggaagaagttgagtttgccggcatagccccggtcctctccatctctctcctcggcagcagcgggaggcagaggaaggcggcagaagatgaagagctttcccatccccactggttgccaaacactaaatctgccgacacccatctgccccacctcctgccatggccatgaaccgcgacccccactaaatttctagattggggatagggagaaagggaggcccaggaaggtctcccctgattttttttcatagtaatttttttccccagagtttgaattttttggtcttctcctggttttttggcaaattaggggggcccggggctcaagtgcgggaagggggctggcccgaggatcccatggctctcacaccatgtttttgtacagaactgatggttgaatctttgttctcttgaaataaacagaagaaaatgaaacctt

SEQ ID NO: 341948 - DNA, 546 bp, Homo sapiens
gacagcgaggatgctcagatgcgcacgcgtcacatctgggctcacagttgcgcgctgatatgacagtggcgtcgtctcaaggacatggtttttctggacgatggccccaatttttataaagtgtttttgagtgtcctatgggccggggcagggtccaagatcttttcccttccccaggcccctcggctccctcccagatcccacccccagccccactggttgccaaacactaaatctgccgacacccatctgccccacctcctgccatggccatgaaccgcgacccccactaaatttctagattggggatagggagaaagggaggcccaggaaggtctcccctgattttttttcatagtaatttttttccccagagtttgaattttttggtcttctcctggttttttggcaaattaggggggcccggggctcaagtgcgggaagggggctggcccgaggatcccatggctctcacaccatgtttttgtacagaactgatggttgaatctttgttctcttgaaataaacagaagaaaatgaaacctt

SEQ ID NO: 341949 - DNA, 337 bp, Homo sapiens
tcgctctcctccctcttcccggctccagctccgccgccagctccagcctttgctccccctcccaaagtcccctccccggagcggagcgcacctagggtccctcggagaaagggaggcccaggaaggtctcccctgattttttttcatagtaatttttttccccagagtttgaattttttggtcttctcctggttttttggcaaattaggggggcccggggctcaagtgcgggaagggggctggcccgaggatcccatggctctcacaccatgtttttgtacagaactgatggttgaatctttgttctcttgaaataaacagaagaaaatgaaacctt

SEQ ID NO: 341950 - DNA, 191 bp, Homo sapiens
atcataggatctcctcgccgggccatggtgatgattaaatcagaggtaccagtaactcgggcagaactgtgtctggcacttggcagcacctggatcaccttccttctctccaccttcgcggcacctgtaactgcaatgttgtcctctgccttttctcccgccctgtcccctcccacctcatcatgtccccg

SEQ ID NO: 341951 - DNA, 1594 bp, Homo sapiens
tcgctctcctccctcttcccggctccagctccgccgccagctccagcctttgctccccctcccaaagtcccctccccggagcggagcgcacctagggtccctcttccgtccccccagcccagctacccgttcagaccagcagcctcggggggcacccccccgccagcctgcctccctcccgctcagccctgccagggttccccagccatgaatctcttccgattcctgggagacctctcccacctcctcgccatcatcttgctactgctcaaaatctggaagtcccgctcgtgcgccggaatttcagggaagagccaggtcctgtttgctgtggtgttcactgcccgatatctggacctcttcaccaactacatctcactctacaacacgtgtatgaaggtggtctacatagcctgctccttcaccacggtctggttgatttatagcaagttcaaagctacttacgatgggaaccatgacacgttcagagtggagttcctggtcgttcccacagccattctggcgttcctggtcaatcatgacttcacccctctggagatcctctggaccttctccatctacctggagtcagtggccatcttgccgcagctgttcatggtgagcaagaccggcgaggcggagaccatcaccagccactacttgtttgcgctaggcgtttaccgcacgctctatctcttcaactggatctggcgctaccatttcgagggcttcttcgacctcatcgccattgtggcaggcctggtccagacagtcctctactgcgatttcttctacctctatatcaccaaagtcctaaaggggaagaagttgagtttgccggcatagccccggtcctctccatctctctcctcggcagcagcgggaggcagaggaaggcggcagaagatgaagagctttcccatccaggggtgacttttttaagaacccacctcttgtgctccccatcccgcctcctgccgggtttcagggggacagtggaggatccaggtcttggggagctcaggacttgggctgtttgtagttttttgccttttagacaagaaaaaaaaatctttccactctttagtttttgattctgatgactcgtttttcttctactctgtggccccaatttttataaagtgtttttgagtgtcctatgggccggggcagggtccaagatcttttcccttccccaggcccctcggctccctcccagatcccacccccagccccactggttgccaaacactaaatctgccgacacccatctgccccacctcctgccatggccatgaaccgcgacccccactaaatttctagattggggatagggagaaagggaggcccaggaaggtctcccctgattttttttcatagtaatttttttccccagagtttgaattttttggtcttctcctggttttttggcaaattaggggggcccggggctcaagtgcgggaagggggctggcccgaggatcccatggctctcacaccatgtttttgtacagaactgatggttgaatctttgttctcttgaaataaacagaagaaaatgaaaccttaaaaaaaaaaaacaagggcggccgct

SEQ ID NO: 341952 - DNA, 1937 bp, Homo sapiens
ctaggggcacaggttccacccccactgcttgctggggatctctcttctaggttctgggtctccaggggatcagctcccttccccagactggcgggggtgcatacagtttcatgtgaatggctttaggcccccaattcagccacccccagccccaatctgggcagcccgagggttcatggaccgggaacagggaaccatggcaggcggggaggtggctgtgagttggtgacgtggaccgtggcggccaggaagggaacgggagggaggtgaccggatccggggcctgaggtcagggaaggtcctccctaggcctcacctcaggtccagactgcgggaggaccctgaggggccagggtagccatgaggcctagtctgggacggagcctcgggctggagtagcttcgggggcctgggctgccccctggctgtggtccgtgggaaagggccctgctcaggcggggcgggctggggaggcctccggggacagctgcactccagagctgcctccaggctggtcccgggcgccctgccttagtttattgcccatgcagcccacccccagcttcctctctccttctgtctgtctgtctgtctgtctgtctctctctctctctctctctctctctctgtctctctctctctctctttctctgtctctggaccacaggaatttcagggaagagccaggtcctgtttgctgtggtgttcactgcccgatatctggacctcttcaccaactacatctcactctacaacacgtgtatgaaggtggtctacatagcctgctccttcaccacggtctggttgatttatagcaagttcaaagctacttacgatgggaaccatgacacgttcagagtggagttcctggtcgttcccacagccattctggcgttcctggtcaatcatgacttcacccctctggagatcctctggaccttctccatctacctggagtcagtggccatcttgccgcagctgttcatggtgagcaagaccggcgaggcggagaccatcaccagccactacttgtttgcgctaggcgtttaccgcacgctctatctcttcaactggatctggcgctaccatttcgagggcttcttcgacctcatcgccattgtggcaggcctggtccagacagtcctctactgcgatttcttctacctctatatcaccaaagtcctaaaggggaagaagttgagtttgccggcatagccccggtcctctccatctctctcctcggcagcagcgggaggcagaggaaggcggcagaagatgaagagctttcccatccaggggtgacttttttaagaacccacctcttgtgctccccatcccgcctcctgccgggtttcagggggacagtggaggatccaggtcttggggagctcaggacttgggctgtttgtagttttttgccttttagacaagaaaaaaaaatctttccactctttagtttttgattctgatgactcgtttttcttctactctgtggccccaatttttataaagtgtttttgagtgtcctatgggccggggcagggtccaagatcttttcccttccccaggcccctcggctccctcccagatcccacccccagccccactggttgccaaacactaaatctgccgacacccatctgccccacctcctgccatggccatgaaccgcgacccccactaaatttctagattggggatagggagaaagggaggcccaggaaggtctcccctgattttttttcatagtaatttttttccccagagtttgaattttttggtcttctcctggttttttggcaaattaggggggcccggggctcaagtgcgggaagggggctggcccgaggatcccatggctctcacaccatgtttttgtacagaactgatggttgaatctttgttctcttgaaataaacagaagaaaatgaaacctt

SEQ ID NO: 341953 - DNA, 1635 bp, Homo sapiens
tcgctctcctccctcttcccggctccagctccgccgccagctccagcctttgctccccctcccaaagtcccctccccggagcggagcgcacctagggtccctcttccgtccccccagcccagctacccgttcagaccagcagcctcggggggcacccccccgccagcctgcctccctcccgctcagccctgccagggttccccagccatgaatctcttccgattcctgggagacctctcccacctcctcgccatcatcttgctactgctcaaaatctggaagtcccgctcgtgcgccggaatttcagggaagagccaggtcctgtttgctgtggtgttcactgcccgatatctggacctcttcaccaactacatctcactctacaacacgtgtatgaaggtggtctacatagcctgctccttcaccacggtctggttgatttatagcaagttcaaagctacttacgatgggaaccatgacacgttcagagtggagttcctggtcgttcccacagccattctggcgttcctggtcaatcatgacttcacccctctggaggaagataggcctgggtggccagatgtgctgatcttttcaacagaagccataattcaggagttttcagatcctctggaccttctccatctacctggagtcagtggccatcttgccgcagctgttcatggtgagcaagaccggcgaggcggagaccatcaccagccactacttgtttgcgctaggcgtttaccgcacgctctatctcttcaactggatctggcgctaccatttcgagggcttcttcgacctcatcgccattgtggcaggcctggtccagacagtcctctactgcgatttcttctacctctatatcaccaaagtcctaaaggggaagaagttgagtttgccggcatagccccggtcctctccatctctctcctcggcagcagcgggaggcagaggaaggcggcagaagatgaagagctttcccatccaggggtgacttttttaagaacccacctcttgtgctccccatcccgcctcctgccgggtttcagggggacagtggaggatccaggtcttggggagctcaggacttgggctgtttgtagttttttgccttttagacaagaaaaaaaaatctttccactctttagtttttgattctgatgactcgtttttcttctactctgtggccccaatttttataaagtgtttttgagtgtcctatgggccggggcagggtccaagatcttttcccttccccaggcccctcggctccctcccagatcccacccccagccccactggttgccaaacactaaatctgccgacacccatctgccccacctcctgccatggccatgaaccgcgacccccactaaatttctagattggggatagggagaaagggaggcccaggaaggtctcccctgattttttttcatagtaatttttttccccagagtttgaattttttggtcttctcctggttttttggcaaattaggggggcccggggctcaagtgcgggaagggggctggcccgaggatcccatggctctcacaccatgtttttgtacagaactgatggttgaatctttgttctcttgaaataaacagaagaaaatgaaacctt

SEQ ID NO: 341954 - DNA, 1224 bp, Homo sapiens
tcgctctcctccctcttcccggctccagctccgccgccagctccagcctttgctccccctcccaaagtcccctccccggagcggagcgcacctagggtccctcttccgtccccccagcccagctacccgttcagaccagcagcctcggggggcacccccccgccagcctgcctccctcccgctcagccctgccagggttccccagccatgaatctcttccgattcctgggagacctctcccacctcctcgccatcatcttgctactgctcaaaatctggaagtcccgctcgtgcgccggaatttcagggaagagccaggtcctgtttgctgtggtgttcactgcccgatatctggacctcttcaccaactacatctcactctacaacacgtgtatgaaggtggtctacatagcctgctccttcaccacggtctggttgatttatagcaagttcaaagctacttacgatgggaaccatgacacgttcagagtggagttcctggtcgttcccacagccattctggcgttcctggtcaatcatgacttcacccctctggagatcctctggaccttctccatctacctggagtcagtggccatcttgccgcagctgttcatggtgagcaagaccggcgaggcggagaccatcaccagccactacttgtttgcgctaggcgtttaccgcacgctctatctcttcaactggatctggcgctaccatttcgagggcttcttcgacctcatcgccattgtggcaggcctggtccagacagtcctctactgcgatttcttctacctctatatcaccaaagtcctaaaggggaagaagttgagtttgccggcatagccccggtcctctccatctctctcctcggcagcagcgggaggcagaggaaggcggcagaagatgaagagctttcccatccaggggtgacttttttaagaacccacctcttgtgctccccatcccgcctcctgccgggtttcagggggacagtggaggatccaggtcttggggagctcaggacttgggctgtttgtagttttttgccttttagacaagaaaaaaaaatctttccactctttagtttttgattctgatgactcgtttttcttctactctgtggctggcccgaggatcccatggctctcacaccatgtttttgtacagaactgatggttgaatctttgttctcttgaaataaacagaagaaaatgaaacctt

SEQ ID NO: 341955 - DNA, 1085 bp, Homo sapiens
  misc_feature (989)..(989): n is a, c, g, or t
  misc_feature (999)..(999): n is a, c, g, or t
  misc_feature (1044)..(1044): n is a, c, g, or t
  misc_feature (1061)..(1061): n is a, c, g, or t
  misc_feature (1077)..(1077): n is a, c, g, or t
tcgctctcctccctcttcccggctccagctccgccgccagctccagcctttgctccccctcccaaagtcccctccccggagcggagcgcacctagggtccctcttccgtccccccagcccagctacccgttcagaccagcagcctcggggggcacccccccgccagcctgcctccctcccgctcagccctgccagggttccccagccatgaatctcttccgattcctgggagacctctcccacctcctcgccatcatcttgctactgctcaaaatctggaagtcccgctcgtgcgccggaatttcagggaagagccaggtcctgtttgctgtggtgttcactgcccgatatctggacctcttcaccaactacatctcactctacaacacgtgtatgaaggtggtctacatagcctgctccttcaccacggtctggttgatttatagcaagttcaaagctacttacgatgggaaccatgacacgttcagagtggagttcctggtcgttcccacagccattctggcgttcctggtcaatcatgacttcacccctctggagatcctctggaccttctccatctacctggagtcagtggccatcttgccgcagctgttcatggtgagcaagaccggcgaggcggagaccatcaccagccactacttgtttgcgctaggcgtttaccgcacgctctatctcttcaactggatctggcgctaccatttcgagggcttcttcgacctcatcgccattgtggcaggcctggtccagacagtcctctactgcgatttcttctacctctatatcaccaaagtcctaaaggggaagaagttgagtttgccggcatagccccggtcctctccatctctctcctcggcagcagcgggaggcagaggaaggcggcagaagatgaagagctttcccattccaggggggtggatttttttttaaaggaaaccccaccttttttgttggtttcccccattccccgnctttccttgnccgggttttcagggggggaacagtgggaaggattccagggttttngggggagttcagggatnttggggttgttttgtnagtttttt

SEQ ID NO: 341956 - DNA, 587 bp, Homo sapiens
agagtggttagctttcttttcaagaatgtatttccatacttcttttgggtttctagaaaagaaggtacatttcctggatttgagctttagccacagagagtatctgggaccagaaacacaggatctctattaaaagaacacgaaacgtcacttccacacgacctgcaatttctagaatggagagaaagcttcagtaaacattcagtaatagcatgcaacaaaggtgggagatatgaagttatgaagagatagttactggatcaaaatagaagaaatgatgcctggcagctagaaaaaaatattcatgtgcattgattacacaataaacaagtaaatacgtgggaaaactgaggctgagataaagtaatgacttaatggcacagtaagagaccaagttacgatttcaacccagaaatacttgattccaaagccccaactctactgcatgatatactaagcactattatatctctacttctgagtagaatgctccaagattttgctgggacaggaagggtataaatagtacatacatacatacacttccatattattttggtgacaataaaattacgtcataaaaatgt

SEQ ID NO: 341957 - DNA, 472 bp, Homo sapiens
agagtggttagctttcttttcaagaatgtatttccatacttcttttgggtttctagaaaagaaggtacatttcctggatttgagctttagccacagagagtatctgggaccagaaacacaggatctctattaaaagaacacgaaacgtcacttccacacgacctgcaatttctagaatggagagaaagcttcagtaaacattcagtaatagcatgcaacaaaggtgggaaaactgaggctgagataaagtaatgacttaatggcacagtaagagaccaagttacgatttcaacccagaaatacttgattccaaagccccaactctactgcatgatatactaagcactattatatctctacttctgagtagaatgctccaagattttgctgggacaggaagggtataaatagtacatacatacatacacttccatattattttggtgacaataaaattacgtcataaaaatgt

SEQ ID NO: 341958 - DNA, 412 bp, Homo sapiens
agagtggttagctttcttttcaagaatgtatttccatacttcttttgggtttctagaaaagaaggtacatttcctggatttgagttgctagacagagcctgggacttgactagcgcctttcccgtgaattgactcatctggtgaattgtggcatcttcatcctcaggaaggtgccaggacatggagtgaactttagccacagagagtatctgggaccagaaacacaggatctctattaaaagaacacgaaacgtcacttccacacgacctgcaatttctagaatggagagaaagcttcagtaaacattcagtaatagcatgcaacaaaggcaagtaaaggctgtgatagaacactggcatggtgttcttaaaagaataatattatttgtcctgtatttagccaacataagga

SEQ ID NO: 341959 - DNA, 1007 bp, Homo sapiens
cagagggccttcgctgctgcggcccctggggactccttcgcgacggcttcccggggagggggctgaggcctggcagcgaggaccctgacaccccttcgggagaggagtggctgctaggccgctcgcttgctcctggaaagatttggggtttgagagctcttggccaggaggctcgcgctggccgaggcccgagagctgtccccgcgggacgggactagcgagggccggggagatggagcgcaggcggcgtctgggttcgaagcactttccggctgaaccacctgctgctgaggctgagccctgagaggcggttcgtggcccccaaaccggggaaggggcgaagctttgggcatctgtcccatgcaagggtcccaacatctgaatctcacctcactcgtctcccacctgtcacgaatggccagcgccaaagtgataaatatgtaataggaatgtcttcccgaggctgtgctggagacttccctggccgcacagtgaccgttcagagcccacgataagcaagccgaaacccggtttggcgcagaggcgcgcaaggagagaggtctgtcctttgactctgtgagttgggcagcctaacatggttattgttaattgacggtaaagtatctcgaggtccgttagtctatgtttttgttcttatttatcactgtgtatgtctttgggcttctcttcactttgtatggcagattattttgaaaaagtttacccttgtgtttgtctcagctgttttaaaggggatctgccgtctagggagttccccttgaaaatcggacctttgagcagtgacttctgttttgccacctgggagcaacgtgtaaggaagtggacttaagcttctctctccccaggggaagaagcacagtggaaaaatcacaagtgacttctggcctgaaaagcccttaatttacctgcttctacaattactgccctttctgacccagttctttccctgcagatataggtgaggttcaaagaagcagatggtggag

SEQ ID NO: 341960 - DNA, 967 bp, Homo sapiens
atttattaagcagacattatttgctgtaatacaatgctaggagctgcaaataccagtgcaaaaaagatcagctctccataccagtgtatataagacaattacagatgtttgtaaaagctatgacagaattaaagcaagattataagaaagttagacttttggggatagcagtctcaatgaaggctctctaaagggggaatatttgaattgagaggtattggacttgagatttaaggaacaaaatgagttggccgtggaggagctgggggaaaattccaagcatagggaggagcaggtgttgagggcaaaagaagaaaagggcattttgtcacagaaaagaggccagtgtggctggaatatggtatgtatcaatggtatttttaatagtgaattttgtaacttttatttctaaatgccagaatggataaaaataataattgacatttatttagtgctctctaggcttggtacagccagtgcagtctctcgacaactctcttaggagcttggtcatctgcattctgtagatgacggaagtgagggctggggaagttgggaaactcacccaaggcaacctggctaacaatggtatagtcaggaattgggaagtgcatttttgaggattataacttttgaatgcagattaactagtgtgtatttgggaaaggttgtaataaatggagagggtgaagtggggatggttgatgagtacaaaaaataggtagaatgaataagatctagtatttgatagtacagcagtgattatagtcaataataatttaattgtacatttaaaaataacgaaaacagtataattggattgttcgtaacacaaagaataaatggttgaggtgacagataccccatttaccctgatgtaatgattataaattatatacctctatcaagatatcccatgtgccccatatgtatgtatatttactatgtacccacaaaaattaaaagt

SEQ ID NO: 341961 - DNA, 339 bp, Homo sapiens
atttattaagcagacattatttgctgtaatacaatgctaggagctgcaaataccagtgcaaaaaagatcagctctccataccagtgtatataagacaattacagatgtttgtaaaagctatgacagaattaaagcaagattataagaaagttagacttttggggatagcagtctcaatgaaggctctctaaagggggaatatttgaattgagaggtattggacttgagatttaaggaacaaaatgagttggccgtggaggagctgggggaaaattccaagcatagggaggagcaggtgctttctgggctggagcgtcgacgcggccgcgaatttagtag

SEQ ID NO: 341962 - DNA, 340 bp, Homo sapiens
gggtttttcctttgaggccctaacacattgggtagtcagagggtatgaagcccttctgtgtcctctgtatgtcctcaagctgggatgagactccggttctccaattctgatctgtagatgagatggaggaatgagatgaccaggcacgtcacggaggcagtgcagggtcagagctgaaactcaggcctctgacctgaaatctcgaccagtttctaacagacctattacatctctgcagcagcctcattctttttaaggtctctccctctcagcacatcactgtggtcaagcctgttcccccacccagcctggtgcctcttccctccacaatctgaccaca

SEQ ID NO: 341963 - DNA, 371 bp, Homo sapiens
ctcggtaagatattgcttcatgcttactccactgaggaggaagctaaggcacggggaggccacacagctaggaagagacggcagagaggattcccaggctttgaactgctgaggtatactatgtgacggtgatgaatgaacacgtggaaagtcgacggcagtgtagcttagtggttgggagcacagacccatttcagaccacctggattcaaattccagctttgccatttgggcaacctactaacctctgcgtctcagttcccttctctgtagaatggagagaacagcagcacttaccttatgggactgccgtgcagatgaaacaagggagaatgtttaaagcccttagcacacaatgggcactgcgtaaa

SEQ ID NO: 341964 - DNA, 778 bp, Homo sapiens
gagtcttgttaagggagatttcatttcttttcctgttcttttaattagtcttacattaagattcttagaagttgtacatcttcttattgctagcagcaagctcggtaagtccaggttacttctaggcggacaggtctgacccaaagggtgctcatcagtgcctccgttgccgccagtagggaggtgataggagcagttctggggtgtggcttaatatctgtactagaaattgggacttacggataacctcgatgagttcacagatgaggcgggcttaacataggattgccagtaaatttggcaatcgaaatgatcctgttataccaagcactgtttagattcatgtgccaaagtgaccagctctgggtttgaaagagggttattgtgggccttctggatggacagaagtcaaatggaacacatgtgagcatgtgttcaatgtctttaaatattgaatagcataatggtggagttaacatgggatcggcccatgctgttggagtctgcatcttgagcaagatggagcaattgagaatggtccaaagaaaagtagtattgtgggcatgagaaaaataagacctatgggaaaattttttaaaaactgaaattgttggccaggtgcggtggctcatgcctgtattcccagcactttgggaggctgaggcgggcagatcacttgagcccagcaatttgagacaagcctgggcaacatggtgaaatcccatctctacaaaaaaaaatactaaaaaatgatgcaagtgtgatggtgcacacctgt

SEQ ID NO: 341965 - DNA, 371 bp, Homo sapiens
tgctccctcctctgcactctgccagcttggaacaggtgccaaggtcaaggaaagcagcatatgccaccgggacctattcctctcattctgctccctcagggagaaccaggtttctggcctttattgtactccacccttttatctcctgggaagtcaccagatgttctgccattggaagaaggggagatattgtctccaaacagaagacaccaatctatctgtttacaatgattcacatccagagaatcaatgaactctaaaatccttggcagactccaactcatggctggaggagctgatggtggaaacaggccgcagacttcagttaaatattaataataatattaaacatttactgtgtgtttattcaa

SEQ ID NO: 341966 - DNA, 271 bp, Homo sapiens
gtaatgatgtataatgtacattattcaggtgatggttacagtaaaagcccagactttatcactatgcagtatatgcatgtaacaaaaccgtacttgtactccttaaaattacgcagtttttttttttaaagaaagcctggaattggttcatggtactctgactattagatcaagtttttttcctatgatgtctcaaatatttatattttcatagtatgatattattctatgatgtgataatataaatatttgatacatcattacgaaaatg

SEQ ID NO: 341967 - DNA, 581 bp, Homo sapiens
gtattttggcaacaatatgttttattgtaaaatagaggggggattgaggaggaaccacaacaggaggatagctacttaaaacagtgaaggacaattatttcaaatatttatgaaattcacttagtggttattcagggccagattctcaccctttatcactctatggggacattatgacatttatccaggatcctgagactaatttaggaaaaggaattcatgttttgtatgagcttttaaaaaattcaaaaactgacattttcttctaaagtgtttctcttttgaaactttcaataatgactttaggtaaaagggttattttttaaattagctattttctttttatgttggtcagaatatgctgtcctctggtccaaacaatatttataggctttgcttttatacctatatatagatatataattgttttttatatatgtataaaacaataaatatatacatataattgttttatatatgcataaaacaatatatatatacacacacatatgtgtaacaatatatgtatgttatacatattattgcatatattatgtatatacacacacacacacatatat

SEQ ID NO: 341968 - DNA, 524 bp, Homo sapiens
gtattttggcaacaatatgttttattgtaaaatagaggggggattgaggaggaaccacaacaggaggatagctacttaaaacagtgaaggacaattatttcaaatatttatgaaattcacttagtggttattcagggccagattctcaccctttatcactctatggggacattatgacatttatccaggatcctgagactaatttaggaaaaggaattcatgttttgtatgagcttttaaaaaattcaaaaactgacattttcttctaaagtgtttctcttttgaaactttcaataatgactttaggtaaaagggttattttttaaattagctattttctttttatgttggtcagaatatgctgtcctctggtccaaacaatatttataggctttgcttttatacctatttgattatatgttttattatgataacataatttcattatgttatttctaacatttttcccacattggtacattagagtactatgctatatgttcccccctttttttaggcgttgg

SEQ ID NO: 341969 - DNA, 334 bp, Homo sapiens
ttaaagcaacaaactcaaaatcaatattgtatttgtcagaattagagggcccacactaaattcatgaatttcctagaaagttttataagaaacagggatttttttccccctgtggtggcaaaagtacaatcaataaataaaagagactgtctttctaagggaaggaaaggaaggtacacaacatttttagcacctactataaattctgtgatagggtactttcaccattattccagtgaatcttctcaagatcacattgaagaaggtattactggtcccatttttatagtgagagtaactgagattcaatcaagttaagtgatttgcctaagaa

SEQ ID NO: 341970 - DNA, 374 bp, Homo sapiens
tggaattgacctacatatggttgcttaggacaaataaaattaaaaattgtaattaaggggtaaagaaaagcaatgagaagtagtcagaatatagtttgttaaaaaatgtattaaataaaatacatatggaacttaaggagcctttaaagcttcacattttgataacttcgtctttggtacgttttctcccatatacatcatgccttacttttcataccatgaatttctacaatatagaacttaactaattctgtccaatattataaaaacatcccacagtttccacctaagaaagagacaaagagtgagcaaaaagtaaaagaaataagaaaaccaatacctctcagggtagattttgtatttcattgtatggg

SEQ ID NO: 341971 - DNA, 232 bp, Homo sapiens
gaagacacgtttttcagtggttgagctgattgttgaacactagtcaagtccacacgcaagtacacagaagcctagtcaggaaaaggtgtgtaatgcaaattttggtgtggaacttggagtctgccttccctccccagaaaaaccccgtagcgggttgtagccccgtaagcgggttgttgccaccgtacgcggggtgttgccaccgtagcgggatgtagccaccgtagcggga

SEQ ID NO: 341972 - DNA, 184 bp, Homo sapiens
ctcggagctagctcttcggtgtgcttcaagcctttagcatcagaatcgctgggcacttggtaaaaatgcagatttctgggatctctctcgaaccttgtgaaggagaatctccgaggctgaacccaggaatctgcattttaacacttcactacaggcaatctttggcccccttggaggtgtgaaa

SEQ ID NO: 341973 - DNA, 227 bp, Homo sapiens
tggtgtgactacagctcactgtagccttgaccttcctggctcaggtggtttctcccctcagcctccccagtagttgggactacaggcacatgccaccacttttttttttttttttttttttttttaattttttgtagagatgggattttgtcatgttgcccaagctggtcttgatttgctgggctcaagtgatcctcctgccttggcctcccaaagtgttgggatta

SEQ ID NO: 341974 - DNA, 126 bp, Homo sapiens
ccccaaatacaggaatggttaaatgctgatgacctactttatgtactatgatgcaaatgcaaatgataatggttactgtgcagcaacatggaagaacttggtgaaagcaggatgtaccacatgact

SEQ ID NO: 341975 - DNA, 138 bp, Homo sapiens
ttttcactaaactagggacttcagggtgttcaccatgcctcagttttctcactagaaaatgggtaatttaatagttcctaccccacagggttatgaagataagtgggttaatacgcataatacatttagaacaatgac

SEQ ID NO: 341976 - DNA, 1243 bp, Homo sapiens
gccggacctgggactgggctggggccctggcggatggagacatgctgcccctgctgctgctgcccctgctgtggggggggtccctgcaggagaagccagtgtacgagctgcaagtgcagaagtcggtgacggtgcaggagggcctgtgcgtccttgtgccctgctccttctcttacccctggagatcctggtattcctctcccccactctacgtctactggttccgggacggggagatcccatactacgctgaggttgtggccacaaacaacccagacagaagagtgaagccagagacccagggccgattccgcctccttggggatgtccagaagaagaactgctccctgagcatcggagatgccagaatggaggacacgggaagctatttcttccgcgtggagagaggaagggatgtaaaatatagctaccaacagaataagctgaacttggaggtgacagccctgatagagaaacccgacatccactttctggagcctctggagtccggccgccccacaaggctgagctgcagccttccaggatcctgtgaagcgggaccacctctcacattctcctggacggggaatgccctcagccccctggaccccgagaccacccgctcctcggagctcaccctcacccccaggcccgaggaccatggcaccaacctcacctgtcagatgaaacgccaaggagctcaggtgaccacggagagaactgtccagctcaatgtctcctatgctccacagaccatcaccatcttcaggaacggcatagccctagagatcctgcaaaacacctcataccttccggtcctggagggccaggctctgcggctgctctgtgatgctcccagcaacccccctgcacacctgagctggttccagggctcccctgccctgaacgccacccccatctccaataccgggatcttggagcttcgtcgagtaaggtctgcagaagaaggaggcttcacctgccgcgctcagcacccgctgggcttcctgcaaatttttctgaatctctcagtttactccctcccacagttgctgggcccctcctgctcctgggaggctgagggtctgcactgcagatgctcctttcgagcccggccggccccctccctgtgctggcggcttgaggagaagccgctggaggggaacagcagccagggctcattcaaggtcaactccagctcagctgggccctgggccaacagctccctgatcctccacggggg

SEQ ID NO: 341977 - DNA, 891 bp, Homo sapiens
gggatgtccagaagaagaactgctccctgagcatcggagatgccagaatggaggacacgggaagctatttcttccgcgtggagagaggaagggatgtaaaatatagctaccaacagaataagctgaacttggaggtgacaggtatggcagggaccccaggagaggaccctgggacgtggagacccccgtatgagaacagggacaggagttgggcaggggcggctggaggaggtgtaggacttggggcaggtcggggcctgaggcctggccactctcggggtcacaccttacgtcctcaagcccctggggcccaggtatctccctgtctcctcctcagccctgatagagaaacccgacatccactttctggagcctctggagtccggccgccccacaaggctgagctgcagccttccaggatcctgtgaagcgggaccacctctcacattctcctggacggggaatgccctcagccccctggaccccgagaccacccgctcctcggagctcaccctcacccccaggcccgaggaccatggcaccaacctcacctgtcagatgaaacgccaaggagctcaggtgaccacggagagaactgtccagctcaatgtctcctgtgagtggtgctggggacacagctgagtcctcaagggcagtgggagtgaggggtgtgtgtgtgtgtgtgtgtgtgtgtgtgtgtgtaaggaagacagagagaaacaaaacaataacttgagaaaccttgtgtgtggatctaagccttgggatctgcggggagtgagacaggacagccttccccgcttggtgggtttctgtggctcctctttgggtacctcctgggcccatgcccatctcactcctcactgctgaagccaagtttatatcttttta

SEQ ID NO: 341978 - DNA, 794 bp, Homo sapiens
gggagggggatggggtgcgcgtagaggctccgcggcccgggttggacggaggagcccaggagccaccgcagccgccgcacgcccagagctccgagcttcgctgccagcccaggacaccggggccctgccgtgggccgaggggagccgggcggcgggagaggagccccggagccccggagccccggagccccgccgggcgccagccgagagggcgttttccccgcccccggagactcgcccgcccggcccgccccgccccgagcgcggggagttcacctccgcccgtcacctcctccccttgtcgcctaggtccacccgagccccctcccccgggccgcccccgagcacgaagttggcgggagcctataaaagctggtgccggcgcgacccgcggacacacagtgcaggcgcccaagccgccgccgccagatcggtgccgattcctgccctgccccgaccgccagcgcgaccatgtcccatcactgggggtacggcaaacacaacggacctgagcactggcataaggacttccccattgccaagggagagcgccagtcccctctgagacatccgacgacgtcgagggcaagacgcacgctactgagcctggcgcccgagcgcggctccggggctccaggggctacacggggctcctctgaccgccgcccaggctacccctcaggcccatcggacagggcacccggtagtgcctgggcatggacagacagaagctgcggagcatctgggcgtgcggcggctgacggtggatcctgggctcacgtccctccccgctc

SEQ ID NO: 341979 - DNA, 1904 bp, Homo sapiens
gggagggggatggggtgcgcgtagaggctccgcggcccgggttggacggaggagcccaggagccaccgcagccgccgcacgcccagagctccgagcttcgctgccagcccaggacaccggggccctgccgtgggccgaggggagccgggcggcgggagaggagccccggagccccggagccccggagccccgccgggcgccagccgagagggcgttttccccgcccccggagactcgcccgcccggcccgccccgccccgagcgcggggagttcacctccgcccgtcacctcctccccttgtcgcctaggtccacccgagccccctcccccgggccgcccccgagcacgaagttggcgggagcctataaaagctggtgccggcgcgacccgcggacacacagtgcaggcgcccaagccgccgccgccagatcggtgccgattcctgccctgccccgaccgccagcgcgaccatgtcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaataagatggtcccatagtctgtatccaaataatgaatcttcgggtgtttccctttagctaagcacagatctaccttggtgatttggaccctggttgctttgtgtctagttttctagacccttcatctcttacttgatagacttactaataaaatgtgaagactagaccaattgtcatgcttgacacaactgctgtggctggttggtgctttgtttatggtagtagtttttctgtaacacagaatataggataagaaataagaataaagtaccttgactttgttcacagcatgtagggtgatgagcactcacaattgttgactaaaatgctgcttttaaaacataggaaagtagaatggttgagtgcaaatccatagcacaagataaattgagctagttaaggcaaatcaggtaaaatagtcatgattctatgtaatgtaaaccagaaaaaataaatgttcatgatttcaagatgttatattaaagaaaaactttaaaaattattatatatttatagcaaagttatcttaaatatgaattctgttgtaatttaatgacttttgaattacagagatataaatgaagtattatctgtaaaaattgttataattagagttgtgatacagagtatatttccattcagacaatatatcataacttaataaatattgtattttagatatattctctaataaaattcagaattcta

SEQ ID NO: 341980 - DNA, 1916 bp, Homo sapiens
gggagggggatggggtgcgcgtagaggctccgcggcccgggttggacggaggagcccaggagccaccgcagccgccgcacgcccagagctccgagcttcgctgccagcccaggacaccggggccctgccgtgggccgaggggagccgggcggcgggagaggagccccggagccccggagccccggagccccgccgggcgccagccgagagggcgttttccccgcccccggagactcgcccgcccggcccgccccgccccgagcgcggggagttcacctccgcccgtcacctcctccccttgtcgcctaggtccacccgagccccctcccccgggccgcccccgagcacgaagttggcgggagcctataaaagctggtgccggcgcgacccgcggacacacagtgcaggcgcccaagccgccgccgccagatcggtgccgattcctgccctgccccgaccgccagcgcgaccatgtcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagcttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaataagatggtcccatagtctgtatccaaataatgaatcttcgggtgtttccctttagctaagcacagatctaccttggtgatttggaccctggttgctttgtgtctagttttctagacccttcatctcttacttgatagacttactaataaaatgtgaagactagaccaattgtcatgcttgacacaactgctgtggctggttggtgctttgtttatggtagtagtttttctgtaacacagaatataggataagaaataagaataaagtaccttgactttgttcacagcatgtagggtgatgagcactcacaattgttgactaaaatgctgcttttaaaacataggaaagtagaatggttgagtgcaaatccatagcacaagataaattgagctagttaaggcaaatcaggtaaaatagtcatgattctatgtaatgtaaaccagaaaaaataaatgttcatgatttcaagatgttatattaaagaaaaactttaaaaattattatatatttatagcaaagttatcttaaatatgaattctgttgtaatttaatgacttttgaattacagagatataaatgaagtattatctgtaaaaattgttataattagagttgtgatacagagtatatttccattcagacaatatatcataacttaataaatattgtattttagatatattctctaataaaattcagaattcta

SEQ ID NO: 341981 - DNA, 1118 bp, Homo sapiens
  misc_feature (42)..(43): n is a, c, g, or t
  misc_feature (54)..(54): n is a, c, g, or t
gggattgtcggcgaaagctgtgcaacagcctgtagtgttacnntggccgtcgcntatgatcattgtcctgtgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaataagatggtcccatagtctgtatccaaataatgaatcttcgggtgtttccctttagctaagcacagatctaccttggtgatttggaccctggttgctttgtgtctagttttctagacccttcatctcttacttgatagacttactaataaaatgtgaagactagaccaattgtcatgcttgacacaactgctgtggctggttggtgctttgtttatggtagtagtttttctgtaacacagaatataggataagaaataagaataaagtaccttgactttgttcacagcatgtagggtgatgagcactcacaattgttgactaaaatgctgcttttaaaacataggaaagtagaatggttgagtgcaaatccatagcacaagataaattgagctagttaaggcaaatcaggtaaaatagtcatgattctatgtaatgtaaaccagaaaaaataaatgttcatgatttcaagatgttatattaaagaaaaactttaaaaattattatatatttatagcaaagttatcttaaatatgaattctgttgtaatttaatgacttttgaattacagagatataaatgaagtattatctgtaaaaattgttataattagagttgtgatacagagtatatttccattcagacaatatatcataacttaataaatattgtattttagatatattctctaataaaattcagaattcta

SEQ ID NO: 341982 - DNA, 1057 bp, Homo sapiens
  misc_feature (4)..(4): n is a, c, g, or t
  misc_feature (6)..(6): n is a, c, g, or t
gctngnatcatgattgactggccgtctcttttaaaagtgaggtgtcgtaccggcttcagaattatgtcgatctaacaggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaataagatggtcccatagtctgtatccaaataatgaatcttcgggtgtttccctttagctaagcacagatctaccttggtgatttggaccctggttgctttgtgtctagttttctagacccttcatctcttacttgatagacttactaataaaatgtgaagactagaccaattgtcatgcttgacacaactgctgtggctggttggtgctttgtttatggtagtagtttttctgtaacacagaatataggataagaaataagaataaagtaccttgactttgttcacagcatgtagggtgatgagcactcacaattgttgactaaaatgctgcttttaaaacataggaaagtagaatggttgagtgcaaatccatagcacaagataaattgagctagttaaggcaaatcaggtaaaatagtcatgattctatgtaatgtaaaccagaaaaaataaatgttcatgatttcaagatgttatattaaagaaaaactttaaaaattattatatatttatagcaaagttatcttaaatatgaattctgttgtaatttaatgacttttgaattacagagatataaatgaagtattatctgtaaaaattgttataattagagttgtgatacagagtatatttccattcagacaatatatcataacttaataaatattgtattttagatatattctctaataaaattcagaattcta

SEQ ID NO: 341983 - DNA, 1129 bp, Homo sapiens
actacgacttgccacatattttcaagttgaatgtcttctgttaatttctctttattttgtttgccagtgaatatagaacctcttttttaaaaacttcctcctactctgtcaatgtgatagtttgaagctgcgtatttgccttgttctagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaataagatggtcccatagtctgtatccaaataatgaatcttcgggtgtttccctttagctaagcacagatctaccttggtgatttggaccctggttgctttgtgtctagttttctagacccttcatctcttacttgatagacttactaataaaatgtgaagactagaccaattgtcatgcttgacacaactgctgtggctggttggtgctttgtttatggtagtagtttttctgtaacacagaatataggataagaaataagaataaagtaccttgactttgttcacagcatgtagggtgatgagcactcacaattgttgactaaaatgctgcttttaaaacataggaaagtagaatggttgagtgcaaatccatagcacaagataaattgagctagttaaggcaaatcaggtaaaatagtcatgattctatgtaatgtaaaccagaaaaaataaatgttcatgatttcaagatgttatattaaagaaaaactttaaaaattattatatatttatagcaaagttatcttaaatatgaattctgttgtaatttaatgacttttgaattacagagatataaatgaagtattatctgtaaaaattgttataattagagttgtgatacagagtatatttccattcagacaatatatcataacttaataaatattgtattttagatatattctctaataaaattcagaattcta

SEQ ID NO: 341984 - DNA, 1413 bp, Homo sapiens
gttcagttatatgtttgggattttttaggtagtgggtgttgagcttgaacgctttcttaattggtggctgcttttaggcctactatgggtgttaaattttttactctctctacaaggttttttcctagtgtccaaagagctgttcctctttggactaacagttaaatttacaaggggatttagagggttctgtgggcaaatttaaagttgaactaagattctatcttggacaaccagctatcaccaggctcggtaggtttgtcgcctctacctataaatcttcccactattttgctacatagacgggtgtgctcttttagctgttcttaggtagctcgtctggtttcgggggtcttagctttggctctccttgcaaagttatttctagttaattcattatgcagaaggtataggggttagtccttgctatattatgcttggttataatttttcacggcacgagattcggcacgagcttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaataagatggtcccatagtctgtatccaaataatgaatcttcgggtgtttccctttagctaagcacagatctaccttggtgatttggaccctggttgctttgtgtctagttttctagacccttcatctcttacttgatagacttactaataaaatgtgaagactagaccaattgtcatgcttgacacaactgctgtggctggttggtgctttgtttatggtagtagtttttctgtaacacagaatataggataagaaataagaataaagtaccttgactttgttcacagcatgtagggtgatgagcactcacaattgttgactaaaatgctgcttttaaaacataggaaagtagaatggttgagtgcaaatccatagcacaagataaattgagctagttaaggcaaatcaggtaaaatagtcatgattctatgtaatgtaaaccagaaaaaataaatgttcatgatttcaagatgttatattaaagaaaaactttaaaaattattatatatttatagcaaagttatcttaaatatgaattctgttgtaatttaatgacttttgaattacagagatataaatgaagtattatctgtaaaaattgttataattagagttgtgatacagagtatatttccattcagacaatatatcataacttaataaatattgtattttagatatattctctaataaaattcagaattcta

SEQ ID NO: 341985 - DNA, 1362 bp, Homo sapiens
gggagggggatggggtgcgcgtagaggctccgcggcccgggttggacggaggagcccaggagccaccgcagccgccgcacgcccagagctccgagcttcgctgccagcccaggacaccggggccctgccgtgggccgaggggagccgggcggcgggagaggagccccggagccccggagccccggagccccgccgggcgccagccgagagggcgttttccccgcccccggagactcgcccgcccggcccgccccgccccgagcgcggggagttcacctccgcccgtcacctcctccccttgtcgcctaggtccacccgagccccctcccccgggccgcccccgagcacgaagttggcgggagcctataaaagctggtgccggcgcgacccgcggacacacagtgcaggcgcccaagccgccgccgccagatcggtgccgattcctgccctgccccgaccgccagcgcgaccatgtcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcaggtcagtgtttagaaaataacttgtgtcttttagccagtagctgttttccgagcttaatggaaggagccaggaacagtggcaggaaccctcttaataatacagtttgtctcaggactcaaggatgccaccctgatcattttcattaggtctcagattctgagaagtaggctaattagtttgaagtgtcccggggccgtttcttccctgtaaaacccttggcttctatgaaggccattgaataactgcgatatgcctgtgaaaaatcacaaaaggtgcaaagtcccctcgcaataaagatcagtcacgatgagatttgcaccaattgaacttttaagattgtaaaatattttgtcttgcagagctgatgcatatccattaaaaagtatatcttagtgagccttatcttcaagttagcagcgagaagagtaacaaaaacgtgccaatttaaaatactgaaattctgggaaaatgttttacttatgagtatttcttagtattgggctagtgtgataaagatggcagcatgttttgatatctactcagaaattcatttcacaaacgaagatgttttagagttggtgaacatacctggcccattactgacaaaaccaattaccgtatttattggtaatagagctgtttacaggatgctcactgta

SEQ ID NO: 341986 - DNA, 1545 bp, Homo sapiens
gggagggggatggggtgcgcgtagaggctccgcggcccgggttggacggaggagcccaggagccaccgcagccgccgcacgcccagagctccgagcttcgctgccagcccaggacaccggggccctgccgtgggccgaggggagccgggcggcgggagaggagccccggagccccggagccccggagccccgccgggcgccagccgagagggcgttttccccgcccccggagactcgcccgcccggcccgccccgccccgagcgcggggagttcacctccgcccgtcacctcctccccttgtcgcctaggtccacccgagccccctcccccgggccgcccccgagcacgaagttggcgggagcctataaaagctggtgccggcgcgacccgcggacacacagtgcaggcgcccaagccgccgccgccagatcggtgccgattcctgccctgccccgaccgccagcgcgaccatgtcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcaggtcagtgtttagaaaataacttgtgtcttttagccagtagctgttttccgagcttaatggaaggagccaggaacagtggcaggaaccctcttaataatacagtttgtctcaggactcaaggatgccaccctgatcattttcattaggtctcagattctgagaagtaggctaattagtttgaagtgtcccggggccgtttcttccctgtaaaacccttggcttctatgaaggccattgaataactgcgatatgcctgtgaaaaatcacaaaaggtgcaaagtcccctcgcaataaagatcagtcacgatgagatttgcaccaattgaacttttaagattgtaaaatattttgtcttgcagagctgatgcatatccattaaaaagtatatcttagtgagccttatcttcaagttagcagcgagaagagtaacaaaaacgtgccaatttaaaatactgaaattctgggaaaatgttttacttatgagtatttcttagtattgggctagtgtgataaagatggcagcatgttttgatatctactcagaaattcatttcacaaacgaagatgttttagagttggtgaacatacctggcccattactgacaaaaccaattaccgtatttattggtaatagagctgtttacaggatgctcactgtaaaaaaaaaaaaaaaagaaagagaaagaagaaaaaaaatcctgcttttttttttttatctctctctcttttgaaacaagagaacaatcccattcacacatagtagctgccttctttgctaagcagttaatttaattgccagtgccctattttcctgagtgctttcctctgaaggtcatagaatg

SEQ ID NO: 341987 - DNA, 1958 bp, Homo sapiens
gggagggggatggggtgcgcgtagaggctccgcggcccgggttggacggaggagcccaggagccaccgcagccgccgcacgcccagagctccgagcttcgctgccagcccaggacaccggggccctgccgtgggccgaggggagccgggcggcgggagaggagccccggagccccggagccccggagccccgccgggcgccagccgagagggcgttttccccgcccccggagactcgcccgcccggcccgccccgccccgagcgcggggagttcacctccgcccgtcacctcctccccttgtcgcctaggtccacccgagccccctcccccgggccgcccccgagcacgaagttggcgggagcctataaaagctggtgccggcgcgacccgcggacacacagtgcaggcgcccaagccgccgccgccagatcggtgccgattcctgccctgccccgaccgccagcgcgaccatgtcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaataagatggtcccatagtctgtatccaaataatgaatcttcgggtgtttccctttagctaagcacagatctaccttggtgatttggaccctggttgctttgtgtctagttttctagacccttcatctcttacttgatagacttactaataaaatgtgaagactagaccaattgtcatgcttgacacaactgctgtggctggttggtgctttgtttatggtagtagtttttctgtaacacagaatataggataagaaataagaataaagtaccttgactttgttcacagcatgtagggtgatgagcactcacaattgttgactaaaatgctgcttttaaaacataggaaagtagaatggttgagtgcaaatccatagcacaagataaattgagctagttaaggcaaatcaggtaaaatagtcatgattctatgtaatgtaaaccagaaaaaataaatgttcatgatttcaagatgttatattaaagaaaaactttaaaaattattatatatttatagcaaagttatcttaaatatgaattctgttgtaatttaatgacttttgaattacagagatataaatgaagtattatctgtaaaaattgttataattagagttgtgatacagagtatatttccattcagacaatatatcataacttaataaatattgtattttagatatattctctaataaaattcagaattcta

SEQ ID NO: 341988 - DNA, 786 bp, Homo sapiens
gggagggggatggggtgcgcgtagaggctccgcggcccgggttggacggaggagcccaggagccaccgcagccgccgcacgcccagagctccgagcttcgctgccagcccaggacaccggggccctgccgtgggccgaggggagccgggcggcgggagaggagccccggagccccggagccccggagccccgccgggcgccagccgagagggcgttttccccgcccccggagactcgcccgcccggcccgccccgccccgagcgcggggagttcacctccgcccgtcacctcctccccttgtcgcctaggtccacccgagccccctcccccgggccgcccccgagcacgaagttggcgggagcctataaaagctggtgccggcgcgacccgcggacacacagtgcaggcgcccaagccgccgccgccagatcggtgccgattcctgccctgccccgaccgccagcgcgaccatgtcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgcattccaaggcaatctctggcggctcctctccccccgcacggttacccctctggcaccacggacatgggcacccagttgtcactgagcacataggcagtcgaagcaatcggagctctgggcgtgtcgcacgtctccggtggatcctgggctcctccgactc

SEQ ID NO: 341989 - DNA, 2189 bp, Homo sapiens
gggagggggatggggtgcgcgtagaggctccgcggcccgggttggacggaggagcccaggagccaccgcagccgccgcacgcccagagctccgagcttcgctgccagcccaggacaccggggccctgccgtgggccgaggggagccgggcggcgggagaggagccccggagccccggagccccggagccccgccgggcgccagccgagagggcgttttccccgcccccggagactcgcccgcccggcccgccccgccccgagcgcggggagttcacctccgcccgtcacctcctccccttgtcgcctaggtccacccgagccccctcccccgggccgcccccgagcacgaagttggcgggagcctataaaagctggtgccggcgcgacccgcggacacacagtgcaggcgcccaagccgccgccgccagatcggtgccgattcctgccctgccccgaccgccagcgcgaccatgtcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaataagatggtcccatagtctgtatccaaataatgaatcttcgggtgtttccctttagctaagcacagatctaccttggtgatttggaccctggttgctttgtgtctagttttctagacccttcatctcttacttgatagacttactaataaaatgtgaagactagaccaattgtcatgcttgacacaactgctgtggctggttggtgctttgtttatggtagtagtttttctgtaacacagaatataggataagaaataagaataaagtaccttgactttgttcacagcatgtagggtgatgagcactcacaattgttgactaaaatgctgcttttaaaacataggaaagtagaatggttgagtgcaaatccatagcacaagataaattgagctagttaaggcaaatcaggtaaaatagtcatgattctatgtaatgtaaaccagaaaaaataaatgttcatgatttcaagatgttatattaaagaaaaactttaaaaattattatatatttatagcaaagttatcttaaatatgaattctgttgtaatttaatgacttttgaattacagagatataaatgaagtattatctgtaaaaattgttataattagagttgtgatacagagtatatttccattcagacaatatatcataacttaataaatattgtattttagatatattctctaataaaattcagaattctaaaaaaaaaaagcaaactataacaagcaaaaaggcagacactgaagctcacaaactccaactaacatatgccttcttagttggcagacatgcttgcaaaactcctgatggctttgatatttaaaaaaaaccctagagaggggtttgtttacctccggtcaaattttgcacgtcacagacaccggattttggcacatggctaccccccgggggaccggcaacatgttgtagat

SEQ ID NO: 341990 - DNA, 1439 bp, Homo sapiens
acttcggccgagcgacgggacagggttttaagtgacaaagaagggcgagtggcttctctgggccgggttcgtactccagcacagcgcccttctaacgggcgggaggaaggccgctgctcgcagggctaggtggagacacacttcccagatcaccgcaggcgggttttacccggagagctctgggccgttcggcctccctgccgggtggcttcttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaataagatggtcccatagtctgtatccaaataatgaatcttcgggtgtttccctttagctaagcacagatctaccttggtgatttggaccctggttgctttgtgtctagttttctagacccttcatctcttacttgatagacttactaataaaatgtgaagactagaccaattgtcatgcttgacacaactgctgtggctggttggtgctttgtttatggtagtagtttttctgtaacacagaatataggataagaaataagaataaagtaccttgactttgttcacagcatgtagggtgatgagcactcacaattgttgactaaaatgctgcttttaaaacataggaaagtagaatggttgagtgcaaatccatagcacaagataaattgagctagttaaggcaaatcaggtaaaatagtcatgattctatgtaatgtaaaccagaaaaaataaatgttcatgatttcaagatgttatattaaagaaaaactttaaaaattattatatatttatagcaaagttatcttaaatatgaattctgttgtaatttaatgacttttgaattacagagatataaatgaagtattatctgtaaaaattgttataattagagttgtgatacagagtatatttccattcagacaatatatcataacttaataaatattgtattttagatatattctctaataaaattcagaattcta

SEQ ID NO: 341991 - DNA, 1100 bp, Homo sapiens
  misc_feature (4)..(4): n is a, c, g, or t
  misc_feature (6)..(6): n is a, c, g, or t
gctngnatcatgattgactggccgtttaataaacactgcgtgaagggttgggcatacgcgtaaatccaggggacttcagagaaagttgtggatgtgctggcttccaattcaaaacggacaggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaataagatggtcccatagtctgtatccaaataatgaatcttcgggtgtttccctttagctaagcacagatctaccttggtgatttggaccctggttgctttgtgtctagttttctagacccttcatctcttacttgatagacttactaataaaatgtgaagactagaccaattgtcatgcttgacacaactgctgtggctggttggtgctttgtttatggtagtagtttttctgtaacacagaatataggataagaaataagaataaagtaccttgactttgttcacagcatgtagggtgatgagcactcacaattgttgactaaaatgctgcttttaaaacataggaaagtagaatggttgagtgcaaatccatagcacaagataaattgagctagttaaggcaaatcaggtaaaatagtcatgattctatgtaatgtaaaccagaaaaaataaatgttcatgatttcaagatgttatattaaagaaaaactttaaaaattattatatatttatagcaaagttatcttaaatatgaattctgttgtaatttaatgacttttgaattacagagatataaatgaagtattatctgtaaaaattgttataattagagttgtgatacagagtatatttccattcagacaatatatcataacttaataaatattgtattttagatatattctctaataaaattcagaattcta

SEQ ID NO: 341992 - DNA, 1027 bp, Homo sapiens
  misc_feature (42)..(42): n is a, c, g, or t
  misc_feature (46)..(47): n is a, c, g, or t
tgattctagagtatccccggtcatcttgctacacaattaaancaannggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaataagatggtcccatagtctgtatccaaataatgaatcttcgggtgtttccctttagctaagcacagatctaccttggtgatttggaccctggttgctttgtgtctagttttctagacccttcatctcttacttgatagacttactaataaaatgtgaagactagaccaattgtcatgcttgacacaactgctgtggctggttggtgctttgtttatggtagtagtttttctgtaacacagaatataggataagaaataagaataaagtaccttgactttgttcacagcatgtagggtgatgagcactcacaattgttgactaaaatgctgcttttaaaacataggaaagtagaatggttgagtgcaaatccatagcacaagataaattgagctagttaaggcaaatcaggtaaaatagtcatgattctatgtaatgtaaaccagaaaaaataaatgttcatgatttcaagatgttatattaaagaaaaactttaaaaattattatatatttatagcaaagttatcttaaatatgaattctgttgtaatttaatgacttttgaattacagagatataaatgaagtattatctgtaaaaattgttataattagagttgtgatacagagtatatttccattcagacaatatatcataacttaataaatattgtattttagatatattctctaataaaattcagaattcta

SEQ ID NO: 341993 - DNA, 433 bp, Homo sapiens
ctttttgtagagaccggatcttgctattctgcccaggctggtcttaaactcttcgcctcaagagatccttctgcctcagcctcccaaagtgctggaattacaggctctggccatctgctgttgctcccctttctctgtggccaaagccccactctggaaatttccatcatcggtggtcgtgtgtcgatcacagcacactgggttcactccatggcctcatccttgggtagtgagttcccacccgtccagtgctcctctccagcctcagtcaccagcatctcctacttggattattgcaacggctcctaagcatcagcattaagcaccaacacagatgaatcctcctcctacagacattagatcatgtcacacctctgcccagacctcccagtggcttccagtatcatgttgaataaaagaaaagtctttccct

SEQ ID NO: 341994 - DNA, 475 bp, Homo sapiens
ctttgggctagcccatactgaggccccccgcatctgcaacaggaagtcagtgggctgcgtcatctatctttccaaggattctcccagctctgatgaccgaaggttgtaagtctatgttattcccaacctcctttctcttttccaggctctggccatctgctgttgctcccctttctctgtggccaaagccccactctggaaatttccatcatcggtggtcgtgtgtcgatcacagcacactgggttcactccatggcctcatccttgggtagtgagttcccacccgtccagtgctcctctccagcctcagtcaccagcatctcctacttggattattgcaacggctcctaagcatcagcattaagcaccaacacagatgaatcctcctcctacagacattagatcatgtcacacctctgcccagacctcccagtggcttccagtatcatgttgaataaaagaaaagtctttccct

SEQ ID NO: 341995 - DNA, 1927 bp, Homo sapiens
atggggcaatgatttcagtttcctatatgacttgataaaaattatataagaatgtaatggtttgccttttttttttcctgcaataagagttccatccaagggactgagccagaagtcacataccacctttatccccctgttaaatgtcattttcttccttcctaaaacctttcttttgacagtcaaacttggttttatatccttctcttttaactcccctgattaggtaaagaaaagaaactagtatttgtgtgtatgcaagccaaccctgttcaaggtggctgtctcagatggtttaataagggggtccccaacccctgggcttcagactggtaccagtctgtggcctgttaggagccaggccactcagcaggaggtgagcagcagtgagcgagcattactgcctaagctctgcctcctatcagatcagtggcagcgttagatactcacaggagcgcgaaccctgttgtgaacagtgcgtgcaagggatctaggttgcgtgctccttatgagaatctaactaatgcctgacggtctgaggaggaacagtttcatcttgaaaccatcccccctaaccttgtccctggaaaaattgtcttccacaaaaccagtccctggtgccaaaaaggttggggactgctgcattaccataattcctttgtacctcttatgacacattttagttatttgttatagttttttctgcccatattagattatgaatacttctagggcagtgtaggtgactttcattatttgtttttaggaacctaataaatatttgttgaagaaataaaaggaaagatggatgagtggtaggtacatttaacatcatcctgtagtttccttgtgtatgaaaggaagggagatgaattttattttaaagaatctgagaataaaagcctcatttttcctcctccattaagatttttaattaaattaagttaactgattaatttattttttagagatagggtcttcccttgttactgaggccagagtgcagtggtgtgatcacagcctcaaactcctgagattaagcaatcccccaagtagctgggactgattattggtgtgtgtcaccaccctggctaattttctttatatttttagtgacaggagtctcgctatgttgcccaggctagtgttgaactcctgatctcaagtgatcctcctaccttagcatcctaagtagctggaatcacaggcatgagccaccacactcagcccattgagttttaaaacctccctaatgacagatataacagttggagaattctgttaaggtttaatgacagtattttatatcatgcccagatggagctaagcaaaataagtagatttaactgtgtttatactaagttgcacagccagttttggaatctgaaaagcatttaataaattgctgcctttattctgtccatttcattattgtttatagttattaaatttaagaataaccaggggttactataaggagatatatttataatgtgttaaatatgatatatcttaaagaagatggttaaactaaatttaagatatttcaatatataaaaatggctcttgaagtccctatcttaaatgaaaaaatttttatatatcaaatctgtctttcatactctcagaatggcacagagaagacataaaagagtaagaacatggactcgtcacataaacatttttaataaagattacatctttgtacctgtaaatgagtcgtaagtatttcagattatttaagaacatattggaaagaattcagaaaaaaattttgtagtgtttttagattcataatcagtaaaaattatggccacatacatctcaggtattattttaatttttttaaataaaagtagctaaggcaatgaattccttatcttggattttggtttgacaatggttatgttgtaaaagtagtaaaaaa

SEQ ID NO: 341996 - DNA, 4707 bp, Homo sapiens
tcctttcccctccccctccctctccaagccggaggggtcctgaggtgacagcgcctgcaactgaaatttcagcagcgggagaagatggacaagagaaagctcgggcgacggccatcttcatccgaaatcatcacagaaggaaaaaggaaaaagtcatcttctgatttatcggagataagaaagatgttaaatgcaaaaccagaggatgtccatgttcaatcaccactgtccaaattcagaagctcagaacgctggactctccctttgcagtgggaaagaagcctaaggaataaagtcatctctctagaccataaaaataaaaaacatatccgagggtgtcctgttacttccaagtcatcaccagaaaggcaactcaaagttatgttgacgaatgtcctatggacggatttaggacgaaaattcagaaagaccctacctagaaacgatgctaatttatgtgatgccaacaaggtgcaatcagactcattgccttcgacatctgttgacagcctagagacatgtcaaaaattagaacctcttcgccaaagccttaatttatctgaaaggggctcacaacgaagtaagacagtagatgacaattctgcaaagcagactgcgcacaataaagaaaaacgaagaaaggatgatggcatttctcttttaatatctgatactcagcctgaagaccttaacagtggaagtagaggttgtgatcatctcgaacaggaaagcagaaacaaggatgttaaatattctgattcaaaagtggaactcactctgatttccaggaagacaaagagaaggcttagaaataatttacctgattctcaatattgtacttctttggataagtcaacagaacagacaaaaaaacaagaagatgactcaacaatatccactgagtttgaaaagccaagtgaaaactatcatcaggatccaaaactgcctgaagaaattacaactaaacctacaaaaagtgattttactaaactatcctcacttaacagtcaggagttgactttgagtaatgccaccaaaagtgcctctgccggttcaaccactgaaaccgttgagaactctaattccattgatattgtggggatttcttccctggttgagaaggatgagaatgagttgaataccatagaaaagcctattctaagaggacataatgaagggaaccaatcactgatctcagctgaaccaattgttgtttccagtgatgaagaaggacctgttgaacataaaagttcagaaattcttaagttacaatctaagcaagaccgtgagacaactaatgaaaatgagagtacttctgaatcagcattgttagaactaccattgattacatgtgaatctgtacagatgtcatctgaattatgcccatataatcctgtcatggagaacatttccagtattatgcctagtaatgagatggatctacaactggattttatatttacttctgtttatattggtaaaataaaaggagcttctaaaggttgtgttacaatcacaaaaaaatatattaagatcccatttcaagtgtccctgaatgagatttcattgctagtggataccacacatttaaagcggtttgggttatggaaaagtaaggatgataatcacagtaaaaggagtcatgctattcttttcttctgggtctcttcagattatcttcaagagattcagacccaattagaacactctgtattaagccagcaatcaaaatctagtgaattcattttccttgaactacacaatcctgtttcacaaagagaagaattgaagctgaaagatattatgacggaaataagtataatcagtggagaattagagctttcttacccgttgtcttgggttcaggcatttcctttgtttcagaacctctcttcaaaagaaagttcttttattcattattactgtgtttcaacttgttctttccctgctggtgttgctgttgctgaagaaatgaagctgaaatcagtatctcagccctcaaacacagatgcggccaagcctacttacaccttcctgcagaagcaaagtagcggttgctactccctttctattacatctaatccagatgaagaatggcgagaagtcaggcacactggacttgttcagaagttgattgtatatcctccaccacctactaaggggggattaggagtaactaatgaagatctggagtgtttagaagaaggagagtttcttaatgatgtaatcattgatttttaccttaagtatcttatattggagaaggcatcagatgaacttgttgaacgaagtcacatttttagtagctttttctataaatgcttgacaagaaaggaaaataatttaacagaagataatccaaatctttcaatggcacagagaagacataaaagagtaagaacatggactcgtcacataaacatttttaataaagattacatctttgtacctgtaaatgagtcgtctcactggtatctcgcagtcatttgttttccatggttagaagaagctgtgtatgaagattttccacaaactgtatcccagcagtcccaggctcagcagtcccaaaatgacaacaaaacaatagataatgatctacgtactacttcgacactgtctttgagtgcagaggattcccaaagtaccgagtcgaatatgtcagtaccaaagaaaatgtgtaaaaggccatgtattcttatactagactccttgaaagctgcttctgtacaaaacacagttcagaatttacgagagtatttagaggtagagtgggaagttaaactaaaaactcatcgtcaattcagcaaaacaaacatggtggatctatgccctaaagttcctaaacaggacaatagcagtgattgtggagtatatttattgcagtatgtggaaagcttcttcaaggatcctattgttaactttgaacttccaattcatttggagaagtggtttcctcgtcatgtaataaagaccaaacgggaagatattcgagagctcatcttgaaacttcatttacagcaacagaagggcagcagtagctagttaatctgtacaaacatgacacagatgttctctaagattactggaaagcctcttaccagcatttgtgttagccagctcacagagaagaaaataacttgcagtagttttataataagtcattggaacattatttaaaatatgtaggacacattattagaattgttgggatctcatagatggaatgggaatgggggtgatatagataaacttactagatataaattaaaattttataaatatttcatatttttctgagtaaatatgattggattatgcaacagcatatgtaatatgggaatgttttgtagataataaaacttacatgatctgtacttccacgtgactgggtgctgaggggagttaaagcctccctggtgccagccccagtgcttgtcaaatttgctgacaggtcacatcatattgtaattctattctttgcagctcaagcatgcagtatgaatactgtgtattttttaaaaaaataatttagtatcaaggcttcagaaaatgccatttacggcatcccttctgtatgtaacaaaaagacattcataatgttaggaagatgataaaaattcgctcttttaaagtgcagcttattattctcaattgctaaatacgattactctgctttattttttttcatttcttttgatgtcatatgtgagtatcttataatttagttcatttgttcagggtaaaatttgaaacaaaaaattttacctgtgcaaaatagttttttaaaaattatacatgtagctcaacttgaggtactgctatataaatattcactcacattatcacggaatttatgtatagtttctctaatatagaagataaaattggtgtcctcataactttaacaaagaaaaccctcagtcctatttattaatgggtagaattaaatatataattttatagctcagtttacccagtattcatctgcaaagccagattgctctcattgcttttatatttttaaattgtagcttttagagacctatgatcctcatggaacttaattttttattaaatattcaggtaacagttctgaattcatgtgataatggtggcattatatatgattaaacacttcagaactttctaatgttatcaggagtattttgagggagatatgattatattgtattttctcagataagaaaaatgttttttaacaatattattttaatctgttttaagcatctcttagatttacattataactacataaagcagtgaagcaaaggcaaattaagataaagctagaaagtctgaacattttatttcaaaatcatacgaatcggggtcagttaagcctcagtattcttagcttttgttgattttggcactatctttatattattaaatatatttgttgtttggatatttcatataaagatggctataattacatatttcattcccaatttgtgtgtgttggggggtacttttaaaggtgactattgttttgtacatctaattttgggaaagcaagtctataagacatcttgtgatttcttaatgtttttgtttgtatgtttttcaaagatatcactgtcctttatcatgttttgaagattgtttaaaattcattttcctaaattaatgtgcaagtaatgttttgaggatatcagtgttttatattaaacatatttccaattc

SEQ ID NO: 341997 - DNA, 531 bp, Homo sapiens
ctttatattattaaatatagtgccaaaatcaacaaaaggctaagaatactgaggcttaactgaccccgattcgtatgattttgaaataaaatgttcagactattcttagcttttgttgattttggcactatctttatattattaaatatatttgttgtttggatatttcatataaagatggctataattacatatttcattcccaatttgtgtgtgttggggggtacttttaaaggtgactattgttttgtacatctaattttgggaaagcaagtctataagacatcttgtgatttcttaatgtttttgtttgtatgtttttcaaagatatcactgtcctttatcatgttttgaagattgtttaaaattcattttcctaaattaatgtgcaagtaatgttttgaggatatcagtgttttatattaaacatatttccaattcattaaattgaggtgtaatttttttccttaagaaacatgagctactgttagaaataaatttccagttgtatgctgctctgtgtatatcatg

SEQ ID NO: 341998 - DNA, 624 bp, Homo sapiens
cacatcaaattaaaaagcttctgcacagcaaagaaaacaatcaacaaagtgaggagataacccacagagtaggagaaaatatttgcaaactatccatctgacaaggataaatttaagatatttcaatatataaaaatggctcttgaagtccctatcttaaatgaaaaaatttttatatatcaaatctgtctttcatactctcagaatggcacagagaagacataaaagagtaagaacatggactcgtcacataaacatttttaataaagattacatctttgtacctgtaaatgagtcgtctcactggtatctcgcagtcatttgttttccatggttagaagaagctgtgtatgaagattttccacaaactgtatcccagcagtcccaggctcagcagtcccaaaatgacaacaaaacaataggtgacatccataacgtagatggtgtttttaataatgatgacaataatttaatggttacagggaagaaaatgaagttaacggtagtatagttatttactatcattaaacctactttaacaggatgaataaaaaatctgaaatttttaatgatagacaaaatataattctgaagttgtactgttatatcaagttttattatggc

SEQ ID NO: 341999 - DNA, 607 bp, Homo sapiens
catgttctgtcttctgggctgatgttttgcctctgggagtagctttttgtcttcagggatggctttttttcttctaggagtggctttttttcttcagaacgtatcttttcttcttcagggattagttttttttctgactcgtcagcaggaagtgaatctgtggtttctaacggagactgtggcaaggctttactggggacaggtacaatagtctttggacccctgggtggcatgtatgagcaccagtcatggtagggatgagccatttgtgccagttcttgggattcctggtggtaacatgggttagggtggtggttagggtccaggcaggtcagttcttgggtccctggtcagcatgtttggtgccagctgtggccgaggtaggtgacaggaaacaatgggtgggttctcaggccacttgggcattggcaatgtacttgggcattggcagtgtacttgggcattggcaatggtgagtagggtgggctagtgcttaggccccttgacagtgtgtgtgggctgtggtggtggcagtggacagggcagccctgtctttaggcacagtattgtgcgggcaggtcctgtggcagcagattgggtgggcctg

SEQ ID NO: 342000 - DNA, 4992 bp, Homo sapiens
tcctttcccctccccctccctctccaagccggaggggtcctgaggtgacagcgcctgcaactgaaatttcagcagcgggagaagatggacaagagaaagctcgggcgacggccatcttcatccgaaatcatcacagaaggaaaaaggaaaaagtcatcttctgatttatcggagataagaaagatgttaaatgcaaaaccagaggatgtccatgttcaatcaccactgtccaaattcagaagctcagaacgctggactctccctttgcagtgggaaagaagcctaaggaataaagtcatctctctagaccataaaaataaaaaacatatccgagggtgtcctgttacttccaagtcatcaccagaaaggcaactcaaagttatgttgacgaatgtcctatggacggatttaggacgaaaattcagaaagaccctacctagaaacgatgctaatttatgtgatgccaacaaggtgcaatcagactcattgccttcgacatctgttgacagcctagagacatgtcaaaaattagaacctcttcgccaaagccttaatttatctgaaaggatacccagagttatattgacgaatgtcctgggaacggagttaggaagaaaatacataaggaccccacctgtaactgagggaagtttgagtgatacagacaacttgcaatcagagcaactttcttcatcatctgatggcagcctagaatcttatcaaaatctaaaccctcacaagagctgttatttatctgaaaggggctcacaacgaagtaagacagtagatgacaattctgcaaagcagactgcgcacaataaagaaaaacgaagaaaggatgatggcatttctcttttaatatctgatactcagcctgaagaccttaacagtggaagtagaggttgtgatcatctcgaacaggaaagcagaaacaaggatgttaaatattctgattcaaaagtggaactcactctgatttccaggaagacaaagagaaggcttagaaataatttacctgattctcaatattgtacttctttggataagtcaacagaacagacaaaaaaacaagaagatgactcaacaatatccactgagtttgaaaagccaagtgaaaactatcatcaggatccaaaactgcctgaagaaattacaactaaacctacaaaaagtgattttactaaactatcctcacttaacagtcaggagttgactttgagtaatgccaccaaaagtgcctctgccggttcaaccactgaaaccgttgagaactctaattccattgatattgtggggatttcttccctggttgagaaggatgagaatgagttgaataccatagaaaagcctattctaagaggacataatgaagggaaccaatcactgatctcagctgaaccaattgttgtttccagtgatgaagaaggacctgttgaacataaaagttcagaaattcttaagttacaatctaagcaagaccgtgagacaactaatgaaaatgagagtacttctgaatcagcattgttagaactaccattgattacatgtgaatctgtacagatgtcatctgaattatgcccatataatcctgtcatggagaacatttccagtattatgcctagtaatgagatggatctacaactggattttatatttacttctgtttatattggtaaaataaaaggagcttctaaaggttgtgttacaatcacaaaaaaatatattaagatcccatttcaagtgtccctgaatgagatttcattgctagtggataccacacatttaaagcggtttgggttatggaaaagtaaggatgataatcacagtaaaaggagtcatgctattcttttcttctgggtctcttcagattatcttcaagagattcagacccaattagaacactctgtattaagccagcaatcaaaatctagtgaattcattttccttgaactacacaatcctgtttcacaaagagaagaattgaagctgaaagatattatgacggaaataagtataatcagtggagaattagagctttcttacccgttgtcttgggttcaggcatttcctttgtttcagaacctctcttcaaaagaaagttcttttattcattattactgtgtttcaacttgttctttccctgctggtgttgctgttgctgaagaaatgaagctgaaatcagtatctcagccctcaaacacagatgcggccaagcctacttacaccttcctgcagaagcaaagtagcggttgctactccctttctattacatctaatccagatgaagaatggcgagaagtcaggcacactggacttgttcagaagttgattgtatatcctccaccacctactaaggggggattaggagtaactaatgaagatctggagtgtttagaagaaggagagtttcttaatgatgtaatcattgatttttaccttaagtatcttatattggagaaggcatcagatgaacttgttgaacgaagtcacatttttagtagctttttctataaatgcttgacaagaaaggaaaataatttaacagaagataatccaaatctttcaatggcacagagaagacataaaagagtaagaacatggactcgtcacataaacatttttaataaagattacatctttgtacctgtaaatgagtcgtctcactggtatctcgcagtcatttgttttccatggttagaagaagctgtgtatgaagattttccacaaactgtatcccagcagtcccaggctcagcagtcccaaaatgacaacaaaacaatagataatgatctacgtactacttcgacactgtctttgagtgcagaggattcccaaagtaccgagtcgaatatgtcagtaccaaagaaaatgtgtaaaaggccatgtattcttatactagactccttgaaagctgcttctgtacaaaacacagttcagaatttacgagagtatttagaggtagagtgggaagttaaactaaaaactcatcgtcaattcagcaaaacaaacatggtggatctatgccctaaagttcctaaacaggacaatagcagtgattgtggagtatatttattgcagtatgtggaaagcttcttcaaggatcctattgttaactttgaacttccaattcatttggagaagtggtttcctcgtcatgtaataaagaccaaacgggaagatattcgagagctcatcttgaaacttcatttacagcaacagaagggcagcagtagctagttaatctgtacaaacatgacacagatgttctctaagattactggaaagcctcttaccagcatttgtgttagccagctcacagagaagaaaataacttgcagtagttttataataagtcattggaacattatttaaaatatgtaggacacattattagaattgttgggatctcatagatggaatgggaatgggggtgatatagataaacttactagatataaattaaaattttataaatatttcatatttttctgagtaaatatgattggattatgcaacagcatatgtaatatgggaatgttttgtagataataaaacttacatgatctgtacttccacgtgactgggtgctgaggggagttaaagcctccctggtgccagccccagtgcttgtcaaatttgctgacaggtcacatcatattgtaattctattctttgcagctcaagcatgcagtatgaatactgtgtattttttaaaaaaataatttagtatcaaggcttcagaaaatgccatttacggcatcccttctgtatgtaacaaaaagacattcataatgttaggaagatgataaaaattcgctcttttaaagtgcagcttattattctcaattgctaaatacgattactctgctttattttttttcatttcttttgatgtcatatgtgagtatcttataatttagttcatttgttcagggtaaaatttgaaacaaaaaattttacctgtgcaaaatagttttttaaaaattatacatgtagctcaacttgaggtactgctatataaatattcactcacattatcacggaatttatgtatagtttctctaatatagaagataaaattggtgtcctcataactttaacaaagaaaaccctcagtcctatttattaatgggtagaattaaatatataattttatagctcagtttacccagtattcatctgcaaagccagattgctctcattgcttttatatttttaaattgtagcttttagagacctatgatcctcatggaacttaattttttattaaatattcaggtaacagttctgaattcatgtgataatggtggcattatatatgattaaacacttcagaactttctaatgttatcaggagtattttgagggagatatgattatattgtattttctcagataagaaaaatgttttttaacaatattattttaatctgttttaagcatctcttagatttacattataactacataaagcagtgaagcaaaggcaaattaagataaagctagaaagtctgaacattttatttcaaaatcatacgaatcggggtcagttaagcctcagtattcttagcttttgttgattttggcactatctttatattattaaatatatttgttgtttggatatttcatataaagatggctataattacatatttcattcccaatttgtgtgtgttggggggtacttttaaaggtgactattgttttgtacatctaattttgggaaagcaagtctataagacatcttgtgatttcttaatgtttttgtttgtatgtttttcaaagatatcactgtcctttatcatgttttgaagattgtttaaaattcattttcctaaattaatgtgcaagtaatgttttgaggatatcagtgttttatattaaacatatttccaattcattaaattgaggtgtaatttttttccttaagaaacatgagctactgttagaaataaatttccagttgtatgctgctctgtgtatatcatg

SEQ ID NO: 342001 - DNA, 4797 bp, Homo sapiens
tcctttcccctccccctccctctccaagccggaggggtcctgaggtgacagcgcctgcaactgaaatttcagcagcgggagaagatggacaagagaaagctcgggcgacggccatcttcatccgaaatcatcacagaaggaaaaaggaaaaagtcatcttctgatttatcggagataagaaagatgttaaatgcaaaaccagaggatgtccatgttcaatcaccactgtccaaattcagaagctcagaacgctggactctccctttgcagtgggaaagaagcctaaggaataaagtcatctctctagaccataaaaataaaaaacatatccgagggtgtcctgttacttccaagtcatcaccagaaaggcaactcaaagttatgttgacgaatgtcctatggacggatttaggacgaaaattcagaaagaccctacctagaaacgatgctaatttatgtgatgccaacaaggtgcaatcagactcattgccttcgacatctgttgacagcctagagacatgtcaaaaattagaacctcttcgccaaagccttaatttatctgaaaggggctcacaacgaagtaagacagtagatgacaattctgcaaagcagactgcgcacaataaagaaaaacgaagaaaggatgatggcatttctcttttaatatctgatactcagcctgaagaccttaacagtggaagtagaggttgtgatcatctcgaacaggaaagcagaaacaaggatgttaaatattctgattcaaaagtggaactcactctgatttccaggaagacaaagagaaggcttagaaataatttacctgattctcaatattgtacttctttggataagtcaacagaacagacaaaaaaacaagaagatgactcaacaatatccactgagtttgaaaagccaagtgaaaactatcatcaggatccaaaactgcctgaagaaattacaactaaacctacaaaaagtgattttactaaactatcctcacttaacagtcaggagttgactttgagtaatgccaccaaaagtgcctctgccggttcaaccactgaaaccgttgagaactctaattccattgatattgtggggatttcttccctggttgagaaggatgagaatgagttgaataccatagaaaagcctattctaagaggacataatgaagggaaccaatcactgatctcagctgaaccaattgttgtttccagtgatgaagaaggacctgttgaacataaaagttcagaaattcttaagttacaatctaagcaagaccgtgagacaactaatgaaaatgagagtacttctgaatcagcattgttagaactaccattgattacatgtgaatctgtacagatgtcatctgaattatgcccatataatcctgtcatggagaacatttccagtattatgcctagtaatgagatggatctacaactggattttatatttacttctgtttatattggtaaaataaaaggagcttctaaaggttgtgttacaatcacaaaaaaatatattaagatcccatttcaagtgtccctgaatgagatttcattgctagtggataccacacatttaaagcggtttgggttatggaaaagtaaggatgataatcacagtaaaaggagtcatgctattcttttcttctgggtctcttcagattatcttcaagagattcagacccaattagaacactctgtattaagccagcaatcaaaatctagtgaattcattttccttgaactacacaatcctgtttcacaaagagaagaattgaagctgaaagatattatgacggaaataagtataatcagtggagaattagagctttcttacccgttgtcttgggttcaggcatttcctttgtttcagaacctctcttcaaaagaaagttcttttattcattattactgtgtttcaacttgttctttccctgctggtgttgctgttgctgaagaaatgaagctgaaatcagtatctcagccctcaaacacagatgcggccaagcctacttacaccttcctgcagaagcaaagtagcggttgctactccctttctattacatctaatccagatgaagaatggcgagaagtcaggcacactggacttgttcagaagttgattgtatatcctccaccacctactaaggggggattaggagtaactaatgaagatctggagtgtttagaagaaggagagtttcttaatgatgtaatcattgatttttaccttaagtatcttatattggagaaggcatcagatgaacttgttgaacgaagtcacatttttagtagctttttctataaatgcttgacaagaaaggaaaataatttaacagaagataatccaaatctttcaatggcacagagaagacataaaagagtaagaacatggactcgtcacataaacatttttaataaagattacatctttgtacctgtaaatgagtcgtctcactggtatctcgcagtcatttgttttccatggttagaagaagctgtgtatgaagattttccacaaactgtatcccagcagtcccaggctcagcagtcccaaaatgacaacaaaacaatagataatgatctacgtactacttcgacactgtctttgagtgcagaggattcccaaagtaccgagtcgaatatgtcagtaccaaagaaaatgtgtaaaaggccatgtattcttatactagactccttgaaagctgcttctgtacaaaacacagttcagaatttacgagagtatttagaggtagagtgggaagttaaactaaaaactcatcgtcaattcagcaaaacaaacatggtggatctatgccctaaagttcctaaacaggacaatagcagtgattgtggagtatatttattgcagtatgtggaaagcttcttcaaggatcctattgttaactttgaacttccaattcatttggagaagtggtttcctcgtcatgtaataaagaccaaacgggaagatattcgagagctcatcttgaaacttcatttacagcaacagaagggcagcagtagctagttaatctgtacaaacatgacacagatgttctctaagattactggaaagcctcttaccagcatttgtgttagccagctcacagagaagaaaataacttgcagtagttttataataagtcattggaacattatttaaaatatgtaggacacattattagaattgttgggatctcatagatggaatgggaatgggggtgatatagataaacttactagatataaattaaaattttataaatatttcatatttttctgagtaaatatgattggattatgcaacagcatatgtaatatgggaatgttttgtagataataaaacttacatgatctgtacttccacgtgactgggtgctgaggggagttaaagcctccctggtgccagccccagtgcttgtcaaatttgctgacaggtcacatcatattgtaattctattctttgcagctcaagcatgcagtatgaatactgtgtattttttaaaaaaataatttagtatcaaggcttcagaaaatgccatttacggcatcccttctgtatgtaacaaaaagacattcataatgttaggaagatgataaaaattcgctcttttaaagtgcagcttattattctcaattgctaaatacgattactctgctttattttttttcatttcttttgatgtcatatgtgagtatcttataatttagttcatttgttcagggtaaaatttgaaacaaaaaattttacctgtgcaaaatagttttttaaaaattatacatgtagctcaacttgaggtactgctatataaatattcactcacattatcacggaatttatgtatagtttctctaatatagaagataaaattggtgtcctcataactttaacaaagaaaaccctcagtcctatttattaatgggtagaattaaatatataattttatagctcagtttacccagtattcatctgcaaagccagattgctctcattgcttttatatttttaaattgtagcttttagagacctatgatcctcatggaacttaattttttattaaatattcaggtaacagttctgaattcatgtgataatggtggcattatatatgattaaacacttcagaactttctaatgttatcaggagtattttgagggagatatgattatattgtattttctcagataagaaaaatgttttttaacaatattattttaatctgttttaagcatctcttagatttacattataactacataaagcagtgaagcaaaggcaaattaagataaagctagaaagtctgaacattttatttcaaaatcatacgaatcggggtcagttaagcctcagtattcttagcttttgttgattttggcactatctttatattattaaatatatttgttgtttggatatttcatataaagatggctataattacatatttcattcccaatttgtgtgtgttggggggtacttttaaaggtgactattgttttgtacatctaattttgggaaagcaagtctataagacatcttgtgatttcttaatgtttttgtttgtatgtttttcaaagatatcactgtcctttatcatgttttgaagattgtttaaaattcattttcctaaattaatgtgcaagtaatgttttgaggatatcagtgttttatattaaacatatttccaattcattaaattgaggtgtaatttttttccttaagaaacatgagctactgttagaaataaatttccagttgtatgctgctctgtgtatatcatg

SEQ ID NO: 342002 - DNA, 1229 bp, Homo sapiens
gtcaggaaggaatgataacgattggctctcgtaacagtgcaggttattagtactcttagagtgttaaattacgattactctgattctggtctgacatagtgtttggatgcttcaaatgtgagtatatgcatcaggtgagtacagatgggttcagggtaaaatttagatggagtacatgtttgatccatgttagtgaatcattatcaattagagaagttctatacgtgtatcgactatcattgaggtactgctatataaatattcactcacattatcacggaatttatgtatagtttctctaatatagaagataaaattggtgtcctcataactttaacaaagaaaaccctcagtcctatttattaatgggtagaattaaatatataattttatagctcagtttacccagtattcatctgcaaagccagattgctctcattgcttttatatttttaaattgtagcttttagagacctatgatcctcatggaacttaattttttattaaatattcaggtaacagttctgaattcatgtgataatggtggcattatatatgattaaacacttcagaactttctaatgttatcaggagtattttgagggagatatgattatattgtattttctcagataagaaaaatgttttttaacaatattattttaatctgttttaagcatctcttagatttacattataactacataaagcagtgaagcaaaggcaaattaagataaagctagaaagtctgaacattttatttcaaaatcatacgaatcggggtcagttaagcctcagtattcttagcttttgttgattttggcactatctttatattattaaatatatttgttgtttggatatttcatataaagatggctataattacatatttcattcccaatttgtgtgtgttggggggtacttttaaaggtgactattgttttgtacatctaattttgggaaagcaagtctataagacatcttgtgatttcttaatgtttttgtttgtatgtttttcaaagatatcactgtcctttatcatgttttgaagattgtttaaaattcattttcctaaattaatgtgcaagtaatgttttgaggatatcagtgttttatattaaacatatttccaattcattaaattgaggtgtaatttttttccttaagaaacatgagctactgttagaaataaatttccagttgtatgctgctctgtgtatatcatg

SEQ ID NO: 342003 - DNA, 1045 bp, Homo sapiens
tcctttcccctccccctccctctccaagccggaggggtcctgaggtgacagcgcctgcaactgaaatttcagcagcgggagaagatggacaagagaaagctcgggcgacggccatcttcatccgaaatcatcacagaaggaaaaaggaaaaagtcatcttctgatttatcggagataagaaagatgttaaatgcaaaaccagaggatgtccatgttcaatcaccactgtccaaattcagaagctcagaacgctggactctccctttgcagtgggaaagaagcctaaggaataaagtcatctctctagaccataaaaataaaaaacatatccgagggtgtcctgttacttccaagtcatcaccagaaaggcaactcaaagttatgttgacgaatgtcctatggacggatttaggacgaaaattcagaaagaccctacctagaaacgatgctaatttatgtgatgccaacaaggtgcaatcagactcattgccttcgacatctgttgacagcctagagacatgtcaaaaattagaacctcttcgccaaagccttaatttatctgaaaggatacccagagttatattgacgaatgtcctgggaacggagttaggaagaaaatacataaggaccccacctgtaactgagggaagtttgagtgatacagacaacttgcaatcagagcaactttcttcatcatctgatggcagcctagaatcttatcaaaatctaaaccctcacaagagctgttatttatctgaaaggggctcacaacgaagtaagacagtagatgacaattctgcaaagcagactgcgcacaataaagaaaaacgaagaaaggatgatggcatttctcttttaatatctgatactcagcctgaaggtttgtgaaccttagaaaactgttggaatttgaattttttcttattgtattaataataatttttgttataaataaattattttattttactttgaaaggatatgtgaaagtaaagggagattatttggcaacacaaataaaattgctaaacctacaaaaaatgta

SEQ ID NO: 342004 - DNA, 2321 bp, Homo sapiens
tcctttcccctccccctccctctccaagccggaggggtcctgaggtgacagcgcctgcaactgaaatttcagcagcgggagaagatggacaagagaaagctcgggcgacggccatcttcatccgaaatcatcacagaaggaaaaaggaaaaagtcatcttctgatttatcggagataagaaagatgttaaatgcaaaaccagaggatgtccatgttcaatcaccactgtccaaattcagaagctcagaacgctggactctccctttgcagtgggaaagaagcctaaggaataaagtcatctctctagaccataaaaataaaaaacatatccgagggtgtcctgttacttccaagtcatcaccagaaaggcaactcaaagttatgttgacgaatgtcctatggacggatttaggacgaaaattcagaaagaccctacctagaaacgatgctaatttatgtgatgccaacaaggtgcaatcagactcattgccttcgacatctgttgacagcctagagacatgtcaaaaattagaacctcttcgccaaagccttaatttatctgaaaggatacccagagttatattgacgaatgtcctgggaacggagttaggaagaaaatacataaggaccccacctgtaactgagggaagtttgagtgatacagacaacttgcaatcagagcaactttcttcatcatctgatggcagcctagaatcttatcaaaatctaaaccctcacaagagctgttatttatctgaaaggggctcacaacgaagtaagacagtagatgacaattctgcaaagcagactgcgcacaataaagaaaaacgaagaaaggatgatggcatttctcttttaatatctgatactcagcctgaagaccttaacagtggaagtagaggttgtgatcatctcgaacaggaaagcagaaacaaggatgttaaatattctgattcaaaagtggaactcactctgatttccaggaagacaaagagaaggcttagaaataatttacctgattctcaatattgtacttctttggataagtcaacagaacagacaaaaaaacaagaagatgactcaacaatatccactgagtttgaaaagccaagtgaaaactatcatcaggatccaaaactgcctgaagaaattacaactaaacctacaaaaagtgattttactaaactatcctcacttaacagtcaggagttgactttgagtaatgccaccaaaagtgcctctgccggttcaaccactgaaaccgttgagaactctaattccattgatattgtggggatttcttccctggttgagaaggatgagaatgagttgaataccatagaaaagcctattctaagaggacataatgaagggaaccaatcactgatctcagctgaaccaattgttgtttccagtgatgaagaaggacctgttgaacataaaagttcagaaattcttaagttacaatctaagcaagaccgtgagacaactaatgaaaatgagagtacttctgaatcagcattgttagaactaccattgattacatgtgaatctgtacagatgtcatctgaattatgcccatataatcctgtcatggagaacatttccagtattatgcctagtaatgagatggatctacaactggattttatatttacttctgtttatattggtaaaataaaaggagcttctaaaggttgtgttacaatcacaaaaaaatatattaagatcccatttcaagtgtccctgaatgagatttcattgctagtggataccacacatttaaagcggtttgggttatggaaaagtaaggatgataatcacagtaaaaggagtcatgctattcttttcttctgggtctcttcagattatcttcaagagattcagacccaattagaacactctgtattaagccagcaatatggagtctcgctttgtcacccaggctggagtgcagtggcactatctctgctcaccgcaagctctgcctcccgggttcacgccattctcctgcctcagcctcctgagtagctgggactacaggtgcccgccaccgtgcccggctaattttttgtatttttagtagagacggggtttcatcgtgttagccaggatggtctcgatctcctgaccttgtgatccgcccgcctcagcctcccaaagtgctgggattacaggcgtgagccactgcgcctggccctaattttgtttcttaattttaggatagattatttaattcacataatttctccttatagttgtattcaaccaattgaaattctcatctaaaataaaaagaatagcttaaaaaatcttaaatg

SEQ ID NO: 342005 - DNA, 759 bp, Homo sapiens
  misc_feature (10)..(10): n is a, c, g, or t
ctcggtctancttgttatcttcgcctgcaactgaaatttcagcagcgggagaagatggacaagagaaagctcgggcgacggccatcttcatccgataagaaagatgttaaatgcaaaaccagaggatgtccatgttcaatcaccactgtccaaattcagaagctcagaacgctggactctccctttgcagtgggaaagaagcctaaggaataaagtcatctctctagaccataaaaataaaaaacatatccgagggtgtcctgttacttccaagtcatcaccagaaagactcgtcagcaggaagtgaatctgtggtttctaacggagactgtggcaaggctttactggggacaggtacaatagtctttggacccctgggtggcatgtatgagcaccagtcatggtagggatgagccatttgtgccagttcttgggattcctggtggtaacatgggttagggtggtggttagggtccaggcaggtcagttcttgggtccctggtcagcatgtttggtgccagctgtggccgaggtaggtgacaggaaacaatgggtgggttctcaggccacttgggcattggcaatgtacttgggcattggcagtgtacttgggcattggcaatggtgagtagggtgggctagtgcttaggccccttgacagtgtgtgtgggctgtggtggtggcagtggacagggcagccctgtctttaggcacagtattgtgcgggcaggtcctgtggcagcagattgggtgggcctg

SEQ ID NO: 342006 - DNA, 4942 bp, Homo sapiens
tcctttcccctccccctccctctccaagccggaggggtcctgaggtgacagcgcctgcaactgaaatttcagcagcgggagaagatggacaagagaaagctcgggcgacggccatcttcatccgataagaaagatgttaaatgcaaaaccagaggatgtccatgttcaatcaccactgtccaaattcagaagctcagaacgctggactctccctttgcagtgggaaagaagcctaaggaataaagtcatctctctagaccataaaaataaaaaacatatccgagggtgtcctgttacttccaagtcatcaccagaaaggcaactcaaagttatgttgacgaatgtcctatggacggatttaggacgaaaattcagaaagaccctacctagaaacgatgctaatttatgtgatgccaacaaggtgcaatcagactcattgccttcgacatctgttgacagcctagagacatgtcaaaaattagaacctcttcgccaaagccttaatttatctgaaaggatacccagagttatattgacgaatgtcctgggaacggagttaggaagaaaatacataaggaccccacctgtaactgagggaagtttgagtgatacagacaacttgcaatcagagcaactttcttcatcatctgatggcagcctagaatcttatcaaaatctaaaccctcacaagagctgttatttatctgaaaggggctcacaacgaagtaagacagtagatgacaattctgcaaagcagactgcgcacaataaagaaaaacgaagaaaggatgatggcatttctcttttaatatctgatactcagcctgaagaccttaacagtggaagtagaggttgtgatcatctcgaacaggaaagcagaaacaaggatgttaaatattctgattcaaaagtggaactcactctgatttccaggaagacaaagagaaggcttagaaataatttacctgattctcaatattgtacttctttggataagtcaacagaacagacaaaaaaacaagaagatgactcaacaatatccactgagtttgaaaagccaagtgaaaactatcatcaggatccaaaactgcctgaagaaattacaactaaacctacaaaaagtgattttactaaactatcctcacttaacagtcaggagttgactttgagtaatgccaccaaaagtgcctctgccggttcaaccactgaaaccgttgagaactctaattccattgatattgtggggatttcttccctggttgagaaggatgagaatgagttgaataccatagaaaagcctattctaagaggacataatgaagggaaccaatcactgatctcagctgaaccaattgttgtttccagtgatgaagaaggacctgttgaacataaaagttcagaaattcttaagttacaatctaagcaagaccgtgagacaactaatgaaaatgagagtacttctgaatcagcattgttagaactaccattgattacatgtgaatctgtacagatgtcatctgaattatgcccatataatcctgtcatggagaacatttccagtattatgcctagtaatgagatggatctacaactggattttatatttacttctgtttatattggtaaaataaaaggagcttctaaaggttgtgttacaatcacaaaaaaatatattaagatcccatttcaagtgtccctgaatgagatttcattgctagtggataccacacatttaaagcggtttgggttatggaaaagtaaggatgataatcacagtaaaaggagtcatgctattcttttcttctgggtctcttcagattatcttcaagagattcagacccaattagaacactctgtattaagccagcaatcaaaatctagtgaattcattttccttgaactacacaatcctgtttcacaaagagaagaattgaagctgaaagatattatgacggaaataagtataatcagtggagaattagagctttcttacccgttgtcttgggttcaggcatttcctttgtttcagaacctctcttcaaaagaaagttcttttattcattattactgtgtttcaacttgttctttccctgctggtgttgctgttgctgaagaaatgaagctgaaatcagtatctcagccctcaaacacagatgcggccaagcctacttacaccttcctgcagaagcaaagtagcggttgctactccctttctattacatctaatccagatgaagaatggcgagaagtcaggcacactggacttgttcagaagttgattgtatatcctccaccacctactaaggggggattaggagtaactaatgaagatctggagtgtttagaagaaggagagtttcttaatgatgtaatcattgatttttaccttaagtatcttatattggagaaggcatcagatgaacttgttgaacgaagtcacatttttagtagctttttctataaatgcttgacaagaaaggaaaataatttaacagaagataatccaaatctttcaatggcacagagaagacataaaagagtaagaacatggactcgtcacataaacatttttaataaagattacatctttgtacctgtaaatgagtcgtctcactggtatctcgcagtcatttgttttccatggttagaagaagctgtgtatgaagattttccacaaactgtatcccagcagtcccaggctcagcagtcccaaaatgacaacaaaacaatagataatgatctacgtactacttcgacactgtctttgagtgcagaggattcccaaagtaccgagtcgaatatgtcagtaccaaagaaaatgtgtaaaaggccatgtattcttatactagactccttgaaagctgcttctgtacaaaacacagttcagaatttacgagagtatttagaggtagagtgggaagttaaactaaaaactcatcgtcaattcagcaaaacaaacatggtggatctatgccctaaagttcctaaacaggacaatagcagtgattgtggagtatatttattgcagtatgtggaaagcttcttcaaggatcctattgttaactttgaacttccaattcatttggagaagtggtttcctcgtcatgtaataaagaccaaacgggaagatattcgagagctcatcttgaaacttcatttacagcaacagaagggcagcagtagctagttaatctgtacaaacatgacacagatgttctctaagattactggaaagcctcttaccagcatttgtgttagccagctcacagagaagaaaataacttgcagtagttttataataagtcattggaacattatttaaaatatgtaggacacattattagaattgttgggatctcatagatggaatgggaatgggggtgatatagataaacttactagatataaattaaaattttataaatatttcatatttttctgagtaaatatgattggattatgcaacagcatatgtaatatgggaatgttttgtagataataaaacttacatgatctgtacttccacgtgactgggtgctgaggggagttaaagcctccctggtgccagccccagtgcttgtcaaatttgctgacaggtcacatcatattgtaattctattctttgcagctcaagcatgcagtatgaatactgtgtattttttaaaaaaataatttagtatcaaggcttcagaaaatgccatttacggcatcccttctgtatgtaacaaaaagacattcataatgttaggaagatgataaaaattcgctcttttaaagtgcagcttattattctcaattgctaaatacgattactctgctttattttttttcatttcttttgatgtcatatgtgagtatcttataatttagttcatttgttcagggtaaaatttgaaacaaaaaattttacctgtgcaaaatagttttttaaaaattatacatgtagctcaacttgaggtactgctatataaatattcactcacattatcacggaatttatgtatagtttctctaatatagaagataaaattggtgtcctcataactttaacaaagaaaaccctcagtcctatttattaatgggtagaattaaatatataattttatagctcagtttacccagtattcatctgcaaagccagattgctctcattgcttttatatttttaaattgtagcttttagagacctatgatcctcatggaacttaattttttattaaatattcaggtaacagttctgaattcatgtgataatggtggcattatatatgattaaacacttcagaactttctaatgttatcaggagtattttgagggagatatgattatattgtattttctcagataagaaaaatgttttttaacaatattattttaatctgttttaagcatctcttagatttacattataactacataaagcagtgaagcaaaggcaaattaagataaagctagaaagtctgaacattttatttcaaaatcatacgaatcggggtcagttaagcctcagtattcttagcttttgttgattttggcactatctttatattattaaatatatttgttgtttggatatttcatataaagatggctataattacatatttcattcccaatttgtgtgtgttggggggtacttttaaaggtgactattgttttgtacatctaattttgggaaagcaagtctataagacatcttgtgatttcttaatgtttttgtttgtatgtttttcaaagatatcactgtcctttatcatgttttgaagattgtttaaaattcattttcctaaattaatgtgcaagtaatgttttgaggatatcagtgttttatattaaacatatttccaattcattaaattgaggtgtaatttttttccttaagaaacatgagctactgttagaaataaatttccagttgtatgctgctctgtgtatatcatg

SEQ ID NO: 342007 - DNA, 2863 bp, Homo sapiens
tcctttcccctccccctccctctccaagccggaggggtcctgaggtgacagcgcctgcaactgaaatttcagcagcgggagaagatggacaagagaaagctcgggcgacggccatcttcatccgaaatcatcacagaaggaaaaaggaaaaagtcatcttctgatttatcggagataagaaagatgttaaatgcaaaaccagaggatgtccatgttcaatcaccactgtccaaattcagaagctcagaacgctggactctccctttgcagtgggaaagaagcctaaggaataaagtcatctctctagaccataaaaataaaaaacatatccgagggtgtcctgttacttccaagtcatcaccagaaaggcaactcaaagttatgttgacgaatgtcctatggacggatttaggacgaaaattcagaaagaccctacctagaaacgatgctaatttatgtgatgccaacaaggtgcaatcagactcattgccttcgacatctgttgacagcctagagacatgtcaaaaattagaacctcttcgccaaagccttaatttatctgaaaggatacccagagttatattgacgaatgtcctgggaacggagttaggaagaaaatacataaggaccccacctgtaactgagggaagtttgagtgatacagacaacttgcaatcagagcaactttcttcatcatctgatggcagcctagaatcttatcaaaatctaaaccctcacaagagctgttatttatctgaaaggggctcacaacgaagtaagacagtagatgacaattctgcaaagcagactgcgcacaataaagaaaaacgaagaaaggatgatggcatttctcttttaatatctgatactcagcctgaagaccttaacagtggaagtagaggttgtgatcatctcgaacaggaaagcagaaacaaggatgttaaatattctgattcaaaagtggaactcactctgatttccaggaagacaaagagaaggcttagaaataatttacctgattctcaatattgtacttctttggataagtcaacagaacagacaaaaaaacaagaagatgactcaacaatatccactgagtttgaaaagccaagtgaaaactatcatcaggatccaaaactgcctgaagaaattacaactaaacctacaaaaagtgattttactaaactatcctcacttaacagtcaggagttgactttgagtaatgccaccaaaagtgcctctgccggttcaaccactgaaaccgttgagaactctaattccattgatattgtggggatttcttccctggttgagaaggatgagaatgagttgaataccatagaaaagcctattctaagaggacataatgaagggaaccaatcactgatctcagctgaaccaattgttgtttccagtgatgaagaaggacctgttgaacataaaagttcagaaattcttaagttacaatctaagcaagaccgtgagacaactaatgaaaatgagagtacttctgaatcagcattgttagaactaccattgattacatgtgaatctgtacagatgtcatctgaattatgcccatataatcctgtcatggagaacatttccagtattatgcctagtaatgagatggatctacaactggattttatatttacttctgtttatattggtaaaataaaaggagcttctaaaggttgtgttacaatcacaaaaaaatatattaagatcccatttcaagtgtccctgaatgagatttcattgctagtggataccacacatttaaagcggtttgggttatggaaaagtaaggatgataatcacagtaaaaggagtcatgctattcttttcttctgggtctcttcagattatcttcaagagattcagacccaattagaacactctgtattaagccagcaatcaaaatctagtgaattcattttccttgaactacacaatcctgtttcacaaagagaagaattgaagctgaaagatattatgacggaaataagtataatcagtggagaattagagctttcttacccgttgtcttgggttcaggcatttcctttgtttcagaacctctcttcaaaagaaagttcttttattcattattactgtgtttcaacttgttctttccctgctggtgttgctgttgctgaagaaatgaagctgaaatcagtatctcagccctcaaacacagatgcggccaagcctacttacaccttcctgcagaagcaaagtagcggttgctactccctttctattacatctaatccagatgaagaatggcgagaagtcaggcacactggacttgttcagaagttgattgtatatcctccaccacctactaaggggggattaggagtaactaatgaagatctggagtgtttagaagaaggagagtttcttaatgatgtaatcattgatttttaccttaagtatcttatattggagaaggcatcagatgaacttgttgaacgaagtcacatttttagtagctttttctataaatgcttgacaagaaaggaaaataatttaacagaagataatccaaatctttcaatggcacagagaagacataaaagagtaagaacatggactcgtcacataaacatttttaataaagattacatctttgtacctgtaaatgagtcgtaagtatttcagattatttaagaacatattggaaagaattcagaaaaaaattttgtagtgtttttagattcataatcagtaaaaattatggccacatacatctcaggtattattttaatttttttaaataaaagtagctaaggcaatgaattccttatcttggattttggtttgacaatggttatgttgtaaaagtagtaaaaaa

SEQ ID NO: 342008 - DNA, 850 bp, Homo sapiens
tcctttcccctccccctccctctccaagccggaggggtcctgaggtgacagcgcctgcaactgaaatttcagcagcgggagaagatggacaagagaaagctcgggcgacggccatcttcatccgaaatcatcacagaaggaaaaaggaaaaagtcatcttctgatttatcggagataagaaagatgttaaatgcaaaaccagaggatgtccatgttcaatcaccactgtccaaattcagaagctcagaacgctggactctccctttgcagtgggaaagaagcctaaggaataaagtcatctctctagaccataaaaataaaaaacatatccgagggtgtcctgttacttccaagtcatcaccagaaaggcaactcaaagttatgttgacgaatgtcctatggacggatttaggacgaaaattcagaaagaccctacctagaaacgatgctaatttatgtgatgccaacaaggtgcaatcagactcattgccttcgacatctgttgacagcctagagacatgtcaaaaattagaacctcttcgccaaagccttaatttatctgaaaggggctcacaacgaagtaagacagtagatgacaattctgcaaagcagactgcgcacaataaagaaaaacgaagaaaggatgatggcatttctcttttaatatctgatactcagcctgaaggtttgtgaaccttagaaaactgttggaatttgaattttttcttattgtattaataataatttttgttataaataaattattttattttactttgaaaggatatgtgaaagtaaagggagattatttggcaacacaaataaaattgctaaacctacaaaaaatgta

SEQ ID NO: 342009 - DNA, 4056 bp, Homo sapiens
atggggcaatgatttcagtttcctatatgacttgataaaaattatataagaatgtaatggtttgccttttttttttcctgcaataagagttccatccaagggactgagccagaagtcacataccacctttatccccctgttaaatgtcattttcttccttcctaaaacctttcttttgacagtcaaacttggttttatatccttctcttttaactcccctgattaggtaaagaaaagaaactagtatttgtgtgtatgcaagccaaccctgttcaaggtggctgtctcagatggtttaataagggggtccccaacccctgggcttcagactggtaccagtctgtggcctgttaggagccaggccactcagcaggaggtgagcagcagtgagcgagcattactgcctaagctctgcctcctatcagatcagtggcagcgttagatactcacaggagcgcgaaccctgttgtgaacagtgcgtgcaagggatctaggttgcgtgctccttatgagaatctaactaatgcctgacggtctgaggaggaacagtttcatcttgaaaccatcccccctaaccttgtccctggaaaaattgtcttccacaaaaccagtccctggtgccaaaaaggttggggactgctgcattaccataattcctttgtacctcttatgacacattttagttatttgttatagttttttctgcccatattagattatgaatacttctagggcagtgtaggtgactttcattatttgtttttaggaacctaataaatatttgttgaagaaataaaaggaaagatggatgagtggtaggtacatttaacatcatcctgtagtttccttgtgtatgaaaggaagggagatgaattttattttaaagaatctgagaataaaagcctcatttttcctcctccattaagatttttaattaaattaagttaactgattaatttattttttagagatagggtcttcccttgttactgaggccagagtgcagtggtgtgatcacagcctcaaactcctgagattaagcaatcccccaagtagctgggactgattattggtgtgtgtcaccaccctggctaattttctttatatttttagtgacaggagtctcgctatgttgcccaggctagtgttgaactcctgatctcaagtgatcctcctaccttagcatcctaagtagctggaatcacaggcatgagccaccacactcagcccattgagttttaaaacctccctaatgacagatataacagttggagaattctgttaaggtttaatgacagtattttatatcatgcccagatggagctaagcaaaataagtagatttaactgtgtttatactaagttgcacagccagttttggaatctgaaaagcatttaataaattgctgcctttattctgtccatttcattattgtttatagttattaaatttaagaataaccaggggttactataaggagatatatttataatgtgttaaatatgatatatcttaaagaagatggttaaactaaatttaagatatttcaatatataaaaatggctcttgaagtccctatcttaaatgaaaaaatttttatatatcaaatctgtctttcatactctcagaatggcacagagaagacataaaagagtaagaacatggactcgtcacataaacatttttaataaagattacatctttgtacctgtaaatgagtcgtctcactggtatctcgcagtcatttgttttccatggttagaagaagctgtgtatgaagattttccacaaactgtatcccagcagtcccaggctcagcagtcccaaaatgacaacaaaacaatagataatgatctacgtactacttcgacactgtctttgagtgcagaggattcccaaagtaccgagtcgaatatgtcagtaccaaagaaaatgtgtaaaaggccatgtattcttatactagactccttgaaagctgcttctgtacaaaacacagttcagaatttacgagagtatttagaggtagagtgggaagttaaactaaaaactcatcgtcaattcagcaaaacaaacatggtggatctatgccctaaagttcctaaacaggacaatagcagtgattgtggagtatatttattgcagtatgtggaaagcttcttcaaggatcctattgttaactttgaacttccaattcatttggagaagtggtttcctcgtcatgtaataaagaccaaacgggaagatattcgagagctcatcttgaaacttcatttacagcaacagaagggcagcagtagctagttaatctgtacaaacatgacacagatgttctctaagattactggaaagcctcttaccagcatttgtgttagccagctcacagagaagaaaataacttgcagtagttttataataagtcattggaacattatttaaaatatgtaggacacattattagaattgttgggatctcatagatggaatgggaatgggggtgatatagataaacttactagatataaattaaaattttataaatatttcatatttttctgagtaaatatgattggattatgcaacagcatatgtaatatgggaatgttttgtagataataaaacttacatgatctgtacttccacgtgactgggtgctgaggggagttaaagcctccctggtgccagccccagtgcttgtcaaatttgctgacaggtcacatcatattgtaattctattctttgcagctcaagcatgcagtatgaatactgtgtattttttaaaaaaataatttagtatcaaggcttcagaaaatgccatttacggcatcccttctgtatgtaacaaaaagacattcataatgttaggaagatgataaaaattcgctcttttaaagtgcagcttattattctcaattgctaaatacgattactctgctttattttttttcatttcttttgatgtcatatgtgagtatcttataatttagttcatttgttcagggtaaaatttgaaacaaaaaattttacctgtgcaaaatagttttttaaaaattatacatgtagctcaacttgaggtactgctatataaatattcactcacattatcacggaatttatgtatagtttctctaatatagaagataaaattggtgtcctcataactttaacaaagaaaaccctcagtcctatttattaatgggtagaattaaatatataattttatagctcagtttacccagtattcatctgcaaagccagattgctctcattgcttttatatttttaaattgtagcttttagagacctatgatcctcatggaacttaattttttattaaatattcaggtaacagttctgaattcatgtgataatggtggcattatatatgattaaacacttcagaactttctaatgttatcaggagtattttgagggagatatgattatattgtattttctcagataagaaaaatgttttttaacaatattattttaatctgttttaagcatctcttagatttacattataactacataaagcagtgaagcaaaggcaaattaagataaagctagaaagtctgaacattttatttcaaaatcatacgaatcggggtcagttaagcctcagtattcttagcttttgttgattttggcactatctttatattattaaatatatttgttgtttggatatttcatataaagatggctataattacatatttcattcccaatttgtgtgtgttggggggtacttttaaaggtgactattgttttgtacatctaattttgggaaagcaagtctataagacatcttgtgatttcttaatgtttttgtttgtatgtttttcaaagatatcactgtcctttatcatgttttgaagattgtttaaaattcattttcctaaattaatgtgcaagtaatgttttgaggatatcagtgttttatattaaacatatttccaattcattaaattgaggtgtaatttttttccttaagaaacatgagctactgttagaaataaatttccagttgtatgctgctctgtgtatatcatg

SEQ ID NO: 342010 - DNA, 419 bp, Homo sapiens
attacacagacgagttcttttcattagattggttgacataagcttgtcctttcagaatactgcagcaaatataggttgtatgattccattaggataaaagaaatatttttacacaatttttctctgtggcgcagtttagttcaccctctgttagagcaaattactggaagaactggttcttaggtttctaatggcgcagcgttaacagagtgaatgattcacggatgttcttcttaacattcaggagtaacaaggaaggctagcagtgcagcccaggtccagagctgatgaatggtgcagtgctgctgttgtcatagcaaccaagaggaaaaaagcagcaccatataaggatctgtgacatggattctgggaacaatttatattaaaaagctgtaagctcctcatgccttaaagctgta

SEQ ID NO: 342011 - DNA, 295 bp, Homo sapiens
agggtctcatactgtcacccaggctggaatgcaatgaagtaatcacggctcactacaactttaccttcccagcctcaggcgattctcctacctaaacctcccaagcagctgggaccagaggagtaacaaggaaggctagcagtgcagcccaggtccagagctgatgaatggtgcagtgctgctgttgtcatagcaaccaagaggaaaaaagcagcaccatataaggatctgtgacatggattctgggaacaatttatattaaaaagctgtaagctcctcatgccttaaagctgta

SEQ ID NO: 342012 - DNA, 390 bp, Homo sapiens
gattctcccttttggataatgaaagaactaagttttggcttctaacaaccagaagagtctccctgtggaggcaggagagaactgcagctgggctgcccctttgtgaggctcctcagaaggtacccgtggcttacagggcaaagacgaacctccctagcgtaacgcacaggctcttcatgatttctcatcactgtgtttcttaacaagagtatctcccaccattcctacacctacacacgcaccctaccccttagccacaccagacagtcatgattccttcctgttctccatgccaagcctcctcatccttgaggacccaactcaaataacagctaataacacttagcattaaatgagtgcttactgcctaccaggcactagtctcaatgc

SEQ ID NO: 342013 - DNA, 155 bp, Homo sapiens
cgaagtcggatcacccagtagcacgctcacccagcatgactcgccgaatgcatgctgtgtggctgcttctagaatccatttagggataatgtcaaaaggctgcttcttcagagaggccctcgggggtcatcctcagtaaagtcccctcccacccc

SEQ ID NO: 342014 - DNA, 468 bp, Homo sapiens
gaatttgcaatctggtggggtaaagaagggcatgtgggtacaggagagttttggataatggagtcagggttgactagctgttcagacaggtctcggggtggtttataaggtcaccatggtacaggatcagacctcaggtttgcaagtccaaagatgggatttggtcacccagagtgtttcaggctcaggggaactgacttgttgcaggcaaccccacaagagcacaaaccagaatgtcattttattaatatgcattgagaactagaattcacaagcagatcagaatactacaccggctgtgcattttctcccagtaggaaagtctaaatgggaagcatattataaacaagtggctcagtgagctgaggcaggagaatcacttgaacctgggaggcggaggttgcagtgagctgagattgcgccattgcactctagcctgggtgacagagcgagactccatctcaaaaa

SEQ ID NO: 342015 - DNA, 1382 bp, Homo sapiens
ccgcatcgccctgggtctctcgagcctgctgcctgctcccccgccccaccagccatggtggtttctggagcgcccccagccctgggtgggggctgtctcggcaccttcacctccctgctgctgctggcgtcgacagccatcctcaatgcggccaggatacctgttcccccagcctgtgggaagccccagcagctgaaccgggttgtgggcggcgaggacagcactgacagcgagtggccctggatcgtgagcatccagaagaatgggacccaccactgcgcaggttctctgctcaccagccgctgggtgatcactgctgcccactgtttcaaggacaacctgaacaaaccatacctgttctctgtgctgctgggggcctggcagctggggaaccctggctctcggtcccagaaggtgggtgttgcctgggtggagccccaccctgtgtattcctggaaggaaggtgcctgtgcagacattgccctggtgcgtctcgagcgctccatacagttctcagagcgggtcctgcccatctgcctacctgatgcctctatccacctccctccaaacacccactgctggatctcaggctgggggagcatccaagatggagttcccttgccccaccctcagaccctgcagaagctgaaggttcctatcatcgactcggaagtctgcagccatctgtactggcggggagcaggacagggacccatcactgaggacatgctgtgtgccggctacttggagggggagcgggatgcttgtctgggcgactccgggggccccctcatgtgccaggtggacggcgcctggctgctggccggcatcatcagctggggcgagggctgtgccgagcgcaacaggcccggggtctacatcagcctctctgcgcaccgctcctgggtggagaagatcgtgcaaggggtgcagctccgcgggcgcgctcaggggggtggggccctcagggcaccgagccagggctctggggccgccgcgcgctcctagggcgcagcgggacgcggggctcggatctgaaaggcggccagatccagatctggatctggatctgcggcggcctcgggcggtttcccccgccgtaaataggctcatctacctctacctctgggggcccggacggctgctgcggaaaggaaaccccctccccgacccgcccgacggcctcaggccccgcctccaaggcatcaggccccgcccaacggcctcatgtccccgcccccacgacttccggccccgcccccgggccccagcgcttttgtgtatataaatgttaatgatttttataggtatttgtaaccctgcccacatatcttatttattcctccaatttcaataaattatttattctccagaaaaaattt

SEQ ID NO: 342016 - DNA, 1180 bp, Homo sapiens
gttcaatcttggtgcccctcgattctacctagaagcctctcctgccttcaggggccttcacacccatgctgttcccccaggtacctcctcccagaccaggcctggctgatcctccccttccctttccttccagcaacctgaacaaaccatacctgttctctgtgctgctgggggcctggcagctggggaaccctggctctcggtcccagaaggtgggtgttgcctgggtggagccccaccctgtgtattcctggaaggaaggtgcctgtgcagacattgccctggtgcgtctcgagcgctccatacagttctcagagcgggtcctgcccatctgcctacctgatgcctctatccacctccctccaaacacccactgctggatctcaggctgggggagcatccaagatggagttcccttgccccaccctcagaccctgcagaagctgaaggttcctatcatcgactcggaagtctgcagccatctgtactggcggggagcaggacagggacccatcactgaggacatgctgtgtgccggctacttggagggggagcgggatgcttgtctgggcgactccgggggccccctcatgtgccaggtggacggcgcctggctgctggccggcatcatcagctggggcgagggctgtgccgagcgcaacaggcccggggtctacatcagcctctctgcgcaccgctcctgggtggagaagatcgtgcaaggggtgcagctccgcgggcgcgctcaggggggtggggccctcagggcaccgagccagggctctggggccgccgcgcgctcctagggcgcagcgggacgcggggctcggatctgaaaggcggccagatccagatctggatctggatctgcggcggcctcgggcggtttcccccgccgtaaataggctcatctacctctacctctgggggcccggacggctgctgcggaaaggaaaccccctccccgacccgcccgacggcctcaggccccgcctccaaggcatcaggccccgcccaacggcctcatgtccccgcccccacgacttccggccccgcccccgggccccagcgcttttgtgtatataaatgttaatgatttttataggtatttgtaaccctgcccacatatcttatttattcctccaatttcaataaattatttattctccagaaaaaattt

SEQ ID NO: 342017 - DNA, 1340 bp, Homo sapiens
gttcaatcttggtgcccctcgattctacctagaagcctctcctgccttcaggggccttcacacccatgctgttcccccaggtacctcctcccagaccaggcctggctgatcctccccttccctttccttccagcaacctgaacaaaccatacctgttctctgtgctgctgggggcctggcagctggggaaccctggctctcggtcccagaaggtgggtgttgcctgggtggagccccaccctgtgtattcctggaaggaaggtgcctgtgcagacattgccctggtgcgtctcgagcgctccatacagttctcagagcgggtcctgcccatctgcctacctgatgcctctatccacctccctccaaacacccactgctggatctcaggctgggggagcatccaagatggaggggcttcttcaagagctagaatcgcggactttcagtccacaatctgcagaccacagtctgtagaccagctccagcagtcccagtgctggatgaagtaatgcagtatctgagacaggaagggctctaaccatctgtggatataagaaaatttattaaagagttcccttgccccaccctcagaccctgcagaagctgaaggttcctatcatcgactcggaagtctgcagccatctgtactggcggggagcaggacagggacccatcactgaggacatgctgtgtgccggctacttggagggggagcgggatgcttgtctgggcgactccgggggccccctcatgtgccaggtggacggcgcctggctgctggccggcatcatcagctggggcgagggctgtgccgagcgcaacaggcccggggtctacatcagcctctctgcgcaccgctcctgggtggagaagatcgtgcaaggggtgcagctccgcgggcgcgctcaggggggtggggccctcagggcaccgagccagggctctggggccgccgcgcgctcctagggcgcagcgggacgcggggctcggatctgaaaggcggccagatccagatctggatctggatctgcggcggcctcgggcggtttcccccgccgtaaataggctcatctacctctacctctgggggcccggacggctgctgcggaaaggaaaccccctccccgacccgcccgacggcctcaggccccgcctccaaggcatcaggccccgcccaacggcctcatgtccccgcccccacgacttccggccccgcccccgggccccagcgcttttgtgtatataaatgttaatgatttttataggtatttgtaaccctgcccacatatcttatttattcctccaatttcaataaattatttattctccagaaaaaattt

SEQ ID NO: 342018 - DNA, 932 bp, Homo sapiens
ccgcatcgccctgggtctctcgagcctgctgcctgctcccccgccccaccagccatggtggtttctggagcgcccccagccctgggtgggggctgtctcggcaccttcacctccctgctgctgctggcgtcgacagccatcctcaatgcggccaggatacctgttcccccagcctgtgggaagccccagcagctgaaccgggttgtgggcggcgaggacagcactgacagcgagtggccctggatcgtgagcatccagaagaatgggacccaccactgcgcaggttctctgctcaccagccgctgggtgatcactgctgcccactgtttcaaggacaacctgaacaaaccatacctgttctctgtgctgctgggggcctggcagctggggaaccctggctctcggtcccagaaggtgggtgttgcctgggtggagccccaccctgtgtattcctgggtggagaagatcgtgcaaggggtgcagctccgcgggcgcgctcaggggggtggggccctcagggcaccgagccagggctctggggccgccgcgcgctcctagggcgcagcgggacgcggggctcggatctgaaaggcggccagatccagatctggatctggatctgcggcggcctcgggcggtttcccccgccgtaaataggctcatctacctctacctctgggggcccggacggctgctgcggaaaggaaaccccctccccgacccgcccgacggcctcaggccccgcctccaaggcatcaggccccgcccaacggcctcatgtccccgcccccacgacttccggccccgcccccgggccccagcgcttttgtgtatataaatgttaatgatttttataggtatttgtaaccctgcccacatatcttatttattcctccaatttcaataaattatttattctccagaaaaaattt

SEQ ID NO: 342019 - DNA, 545 bp, Homo sapiens
gaggtggagacctggaatttcaattttctgaaggcatcttgggagagacctggtagagctaatctgttagcctttgagaaccgctgctgagaggaatggtgttgggggggaatagtcctttgaggaggcaacgaggaggggagacccccaaacctgattctgtcctctttcctcccagttcccttgccccaccctcagaccctgcagaagctgaaggttcctatcatcgactcggaagtctgcagccatctgtactggcggggagcaggacagggacccatcactgaggacatgctgtgtgccggctacttggagggggagcgggatgcttgtctggtgagctccctcgagccccccacccctggccaggagggcctcgggaaggagccagcgtcagtcctgtccccactgagccccacaacctctccctggcctcctccccagaactggctgtgcctgacagtcccgggtccccatagaaccagcctcagcctggctcagccactcacttatttgttcagacattaaactgggcatcccagctg

SEQ ID NO: 342020 - DNA, 401 bp, Homo sapiens
caagagctagaatcgcggactttcagtccacaatctgcagaccacagtctgtagaccagctccaggcaaggcgtggggatccctcaggtcctggtaattttcaacatcgagtggacatttattgaacacttcttctatagcagtcccagtgctggatgaagtaatgcagtatctgagacaggaagggctctaaccatctgtggatataagaaaatttattaaagaggtagggtcttaggtttcacattcatgttctaattcagcagggccagaggtggagacctggaatttcaattttctgaaggcatcttgggagagacctggtagagctaatctgttagcctttgagaaccgctgctgagaggaatggtgttgggggggaatagtcctttgaggaggca

SEQ ID NO: 342021 - DNA, 351 bp, Homo sapiens
gaccccttctcactgggtgctgggggcttctcgctgggcgctgagggaccctcctcactgggtactgggacccctcctcactgggcgctgagggaccctcctcagggggtgctgggacccctcctcactgggcgctgagggaccctcctcactgggtgctgggacctccacctcactgggcactgggatcccttcttactgggtgttgggggccttcctcactgggcgttgagggcccctcaccactgtgtcctggggcccctcaccggcctaaccgtttccttctcttgccctcagccatcctcaatgcggccaggatacctggtgagtggagctggcagctctgacggg

SEQ ID NO: 342022 - DNA, 699 bp, Homo sapiens
cctctctccctcctggccttgcctctctcatctcctttccgcttctgctctgtttatctcttgctccttaactgctctgtgcctcggtttcttctacggctgtgaggatgaaacagaaaacgcagcaagtacgcagcgcgcctcggtctccagttaccgtcggcgtcgccatcgcctgctccctctcgcctccgtgttctcccatctcctcgtcctccgctgcttgcctctggggaagcaccgttttgtgttgttcctgccgcaggaggtcaggggagggcacaccagcggcagcagcgtccagagccgaggggctcaggtctgtgcctccctcgaggagccggtcctggtccccggaaggcaggctggacgggaagctgcgggagggcagggtcacagctgtgcagccagggcctggccaggccccaggaaatgccccgccggtaggggccctggggttgagagacttgagagtctccctgggcactggagggctagaggttcctcaccaccaggtactcaaggggaccccctcctcactgggcgctgggacgcctgctcactgggcgctgggacccctcctcactgggcgctgggaccccctcctcactgagcgctgggaccccctcgtcactgggcgctggggacccctcctcactgggcgctggggagccctcctcactgggcgctggggacccc

SEQ ID NO: 342023 - DNA, 1322 bp, Homo sapiens
cctctctccctcctggccttgcctctctcatctcctttccgcttctgctctgtttatctcttgctccttaactgctctgtgcctcggtttcttctacggctgtgaggatgaaacagaaaacgcagcaaccatcctcaatgcggccaggatacctgttcccccagcctgtgggaagccccagcagctgaaccgggttgtgggcggcgaggacagcactgacagcgagtggccctggatcgtgagcatccagaagaatgggacccaccactgcgcagcaacctgaacaaaccatacctgttctctgtgctgctgggggcctggcagctggggaaccctggctctcggtcccagaaggtgggtgttgcctgggtggagccccaccctgtgtattcctggaaggaaggtgcctgtgcagacattgccctggtgcgtctcgagcgctccatacagttctcagagcgggtcctgcccatctgcctacctgatgcctctatccacctccctccaaacacccactgctggatctcaggctgggggagcatccaagatggagttcccttgccccaccctcagaccctgcagaagctgaaggttcctatcatcgactcggaagtctgcagccatctgtactggcggggagcaggacagggacccatcactgaggacatgctgtgtgccggctacttggagggggagcgggatgcttgtctgggcgactccgggggccccctcatgtgccaggtggacggcgcctggctgctggccggcatcatcagctggggcgagggctgtgccgagcgcaacaggcccggggtctacatcagcctctctgcgcaccgctcctgggtggagaagatcgtgcaaggggtgcagctccgcgggcgcgctcaggggggtggggccctcagggcaccgagccagggctctggggccgccgcgcgctcctagggcgcagcgggacgcggggctcggatctgaaaggcggccagatccagatctggatctggatctgcggcggcctcgggcggtttcccccgccgtaaataggctcatctacctctacctctgggggcccggacggctgctgcggaaaggaaaccccctccccgacccgcccgacggcctcaggccccgcctccaaggcatcaggccccgcccaacggcctcatgtccccgcccccacgacttccggccccgcccccgggccccagcgcttttgtgtatataaatgttaatgatttttataggtatttgtaaccctgcccacatatcttatttattcctccaatttcaataaattatttattctccagaaaaaattt

SEQ ID NO: 342024 - DNA, 200 bp, Homo sapiens
catcgccctgggtctctcgagcctgctgcctgctcccccgccccaccagccatggtggtttctggagcgcccccagccctgggtgggggctgtctcggcaccttcacctccctgctgctgctggcgtcgacaggtacgtccggaggctgctcctccctcctccctctcacctccaccctccttccctccttccctccctc

SEQ ID NO: 342025 - DNA, 324 bp, Homo sapiens
atcagactcaaaacataacaaaaatctaatcttctcatttagaggtcaccccataaacatcaggacaaaatcccaataacttatattggcattcaagtcccttcacaacttggcctaaacttatatcctccccctgatctccaccacttcccacaagtcctctatattctagccacatgtttctctcataactcttctttgaaatgtctttccacaacagctttgcatatgctgctctgcttccccatctagaccatgagcatctcaaaggcagaaacaacatttaattcatctttgcatcccaacagcctaaccctgagtctg

SEQ ID NO: 342026 - DNA, 1153 bp, Homo sapiens
caaaaaacaaaaatgtagcatgtaaccatagatatcatataagaatgtctgagttatgcaggatagtcagctggaaaattagttaccagagaacagccaataaaagtgagagtgttgcaacagttttagttaccacagtcctatagagttgcacattattatcctttgtactgaaagattcagctaacaaccatgacatgattcagatatacaaatgcagctaaaaggaatgatgggacatgaatctgtttccacattctacactagaacaccattcttaggtctatagctacagtaaccgtttatagggcttttctcgtcatttgtgactgaagactcatgaaacactagtcaattttctttgtttaaaaaaagtcacggccgggtgcagtggctcacgcctgtaattccagcacattgggaggccgaggcgggcggatcagctgaggtcaggagtttgagaccagcatggccaacatggagaaaccccatctctaccaaaaatacaaaattagctgggcgtggtggcgcatgcctgtaatcccagctactcaggaggctgaggcaggagaatcacttgaacccaggaggcggaggttgcagtgagccgagatcatgccattgtactcctgcatgggcaacgagaggcgaaactctgtctcaaaacaaaacaaaacaaacaaacaaacaaaaaaagtcacttcatctcttcttccttcaggataagtcagtatatctctaagagccttaagataaaaaagaacatggatgaaccttgaaaacatcatattaagtgaaaaaagccagtcataaaggatacatttttaaaatcctatttatataagaggcccagaataagcaaatctatagaaatagaaagtagattggtagttgcttagagcaagggaagggggaggagcggggagaatgaggggactgaggagcgaaggccattctttttggaataatgataactaaaatgttctaaaattgattgtggtgatagacagaaaactctaatattctaaaagccactgaattgtacactttgagcaaactatatgtcacacacctcactgtctcataaacgttctaagggactatgatattcgcctcatacatcatctttcgcgcttcggtccgatgtcgcgcc

SEQ ID NO: 342027 - DNA, 310 bp, Homo sapiens
ccttttatcctttgtgactttacaaccttggatttgaaaatcatggtgctgtctatggcaggcatatatgcggccccgccaggggctctgggctcttgtcctcacaggtagagactgtgggttccaaatacagtgaggaacagtggaggagcatgggccttgagaccagacacacataggcctgaatgctagccagctaggagaccttgatcatgttcttgtacctctcctttgccagctaggagaccttgatcatgtccttacaactctctgagccacagcttccctgtcattagctgaggggagttgc

SEQ ID NO: 342028 - DNA, 501 bp, Homo sapiens
tatttccagctcctcttggacgttgccctgatggatgctgaactccctgtgggcccgcctgtttcactggcccggcccctcactctgatggggcaagatggagcgatgtctatacacggacagatgttatgcaccaaggaagaaaatctgctaatcgaaagcagcttcagctaattgtggcactctcccttctgcgtggtgccctgaaatagtagccatgctctgttcttttttcacatcagggagccccaactggcaacttaaatgaggttgcaaagaagtcagttacacagacctctgctgccagtttccatggatgaggccttgctgatgctccttggataggacccgtgtgcaactgtttgtggacttggcttcttgctgtggataatttggacccactgttgggctggaaaagcctcatttaaccctggggaaaactggaaccttcagaaatttaatggaatactaagcccaagaacacatggtctgaccttgaac

SEQ ID NO: 342029 - DNA, 142 bp, Homo sapiens
tacctttatgtgtccaggcactgtgaggccactaaggattcagaaatgaaacaattcctgctcacagatgatggaagagtgatcttacaagacaaatgatagaaagcagcatactctatttcataagaaatcagaacactta

SEQ ID NO: 342030 - DNA, 762 bp, Homo sapiens
tggattagagctgccttcctggaccagtaggatgcagtggagggagcaccatgccactcttagggtccaggccatgagaggcattgcagattttgcttgtgctgtcttggaattcagccctgacaccaccttgtcatcaagccagtccagcctactggaagataagcagccgcatggaggagaaccaaggggtgcagtcaacagccagcaccaacttgtgacatatgagtgaaacatcgtggaccctccagcccagttactcctccagagccacaggagtgaacccaggaaaaaccagcagagaggccagccaacacacagaactataggaaataaatccttgctattttacatgcctgtctcatataggcatgtacaataacaaggatcatttacacgcctttataatacaatattataggtgtgtaaaatacttatgccacatgcagggagatgccccttcctcccagcaagtcagtcccacagcccaacaaattcctcccaccacagactctgtcaggagagccctgacgtgtgaatccaccctgtttgccaagttccaatgtgtaacacagttcttagcaaaacacattggatttgggttttgttatgttttgtttaaagcattctcccaaatccacatgcacacaattggctggggtttgtcaaatatctgctggatccaagctcgcagcctctattatcccactccccatctggatggcagctctgtacatcagctggctgagttctgcctatcca

SEQ ID NO: 342031 - DNA, 218 bp, Homo sapiens
tttctgggaagttctttatatcccttcgattgtatttttttctgtctaaacttgcacaaatgggtacttttgtttccaactaagaatcatggcttgcaaagattaggagatttgttaagtagagtgaccaaaagaacatgtatatcctcagaatagtgttaagcaagaaaagtgaatttacttagtgagctccttctaggggaaagcaggaattaagt

SEQ ID NO: 342032 - DNA, 670 bp, Homo sapiens
cttagcctcctgagtagctgggactagaggcatgagccacagttcctggctaattttaattttaatttttatttttgtagaaattgggcttcactatgttgcccaggctggtctcaagctcctgggctcctgccccaaccttccaaagcgctgagattacaggcatgagccattgcatctggccaaaaatttttagaaatggaaaaaagcatacagaatatgagtataaagaaaggaaatatttttgtatagctgtataatgtatttgggttttaagctaagtgttataagagtcaaaacttaggaaaaaaactacaaagcttattaagtaaaaatgttacagttgtttattgttgtagaaagaaacacttcaaaaattttagtgtagcctaagggtatagtgttttgaagccacagtagtgtatagtcatcctggatcttcccattcactcaccactcacttgctgactcacccagagcaacttccagtcctgcagcctccattcctggtaagtgctctatgcaggtgtaccactttttatgattcccccgttgctggatgctatctttatgagatggccagagtacacctcttctactacttcacttgccacttctagcctagacagtgacccttgttaaaacggtagaggaagtacagtgacaactg

SEQ ID NO: 342033 - DNA, 416 bp, Homo sapiens
ccatgtacagtgacccacaaaataagccttcatcaagtgatagacaatttcttttctggaaaggttggcagtagcagactggaacaaatgagaacaaaaaggatctagatatttctgatttagtgctggcaaacattcaataaaataatgaactaacctggcgttagacatttacctagtaaatttttactcttttcaaaaacgattcttttaaatgacaagggctaagttaggatttcagaattaatgataataaattaaaattaaaagttatttgaacaatactccatcctgactcaacttcagccatagtcaaaagagggactttcacctttctaacattaaagaattaagtaattaggaaaaaaggaacaattatctcaaaaagtttttttttgtttttttttttttttttt

SEQ ID NO: 342034 - DNA, 196 bp, Homo sapiens
  misc_feature (10)..(10): n is a, c, g, or t
cagctggcantagagctactccagcctgggcagtagagctactccagcctgggcataagagctactccatcctgactcaacttcagccatagtcaaaagagggactttcacctttctaacattaaagaattaagtaattaggaaaaaaggaacaattatctcaaaaagtttttttttgtttttttttttttttttt

SEQ ID NO: 342035 - DNA, 812 bp, Homo sapiens
gggaataatgctgcaataaacatgtgtgcatgtgtctttatagtagcatgatttataatcctttggatatatacccagtaatgggatcgctgggtcaaatggtatttgtagttctagatccttgaggaatcgtcacactgtcttccacaatggttgaactaatttacactcccaccaacagtgtaaatagagttcctctttcacccagcaccacgtaaaagcaattgtttgagctttgactcttgcctctccacttggtgtggtgttgcagacccctaattcccattgatgtgatcactctttggtcacacagaacagaagatcccagaactggctcagtctcaggtcaggctccttagactgagaactaatattatggtatccaaaagcagcagttgagcttttccttttgctcccctgcgattacatcaatatttacaaagtggtccatgataatcagttacacccccaacatccccttgggagtctccgggactgctgtcctacagtctcctcgactctgggatccagcatgcttgcctctgatggccgctgcccgtgggctgcccagaactcctcccaaggctgatgctgtctggaccatgtgtgggcagcacctgtcccgaagcgaggcctgtgttccgtggcctgtgctctgggcttgtctggtagcggcccacctgagtgggatgaggccccggactaggagggtccccaacgctgtttgtttctttagtccttcagcccagggtttctttagaggaatgttctaattgcaaatgatcaagactatgatcattatggtctttgta

SEQ ID NO: 342036 - DNA, 706 bp, Homo sapiens
ggaaatttgatgaaagcaactctttagggggattatcttgccagtgcatgtgtaggacgcgttgtttcagaagaccagttagaatattacaacagtctggagctagtgtttcccaaactatacaactgggaatagtaattctgagagctcaaaatagtaataaaagcacctatttgggggatttttttttcttgactggacattaaaggcctgtgccagagaaatccataatttcacaaacttatttgcagataaaaggctttgttcattgtgtacctattcataaacatatcactgtgttccactgaaattactggaaattttggtcttatcaattacctacttatttataaatctatctaagaaacaatagaagaaagggaaagataaaactcaaaacttcattagaaaggtactgagacatcatttagtccagaccctgtctttaatcttggtaatcagaaaccgaatgttacctttgactttgacacctttctggtcaaattaagtagtgcctttaatgatacttgtttgccaatcctctttccctcatgagaccataaaatacccaataatcagattaacctttgtcttaccatcattgtaatctctaaatctggctgatagtaggtggtagaaaaatacttgttgacttgaaagtgatgagaaaactaaacagtttgtggcatacctgtaattacatgga

SEQ ID NO: 342037 - DNA, 764 bp, Homo sapiens
ggaaatttgatgaaagcaactctttagggggattatcttgccagtgcatgtgtaggacgcgttgtttcagaagaccagttagaatattacaacagtctggagctagtgtttcccaaactatacaactgggaatagtaattctgagagctcaaaatagtaataaaagcacctatttgggggatttttttttcttgactggaaaaaaaaggaaacattacatataaaatcttcttcttggagatacactacacattaacacattaaaggcctgtgccagagaaatccataatttcacaaacttatttgcagataaaaggctttgttcattgtgtacctattcataaacatatcactgtgttccactgaaattactggaaattttggtcttatcaattacctacttatttataaatctatctaagaaacaatagaagaaagggaaagataaaactcaaaacttcattagaaaggtactgagacatcatttagtccagaccctgtctttaatcttggtaatcagaaaccgaatgttacctttgactttgacacctttctggtcaaattaagtagtgcctttaatgatacttgtttgccaatcctctttccctcatgagaccataaaatacccaataatcagattaacctttgtcttaccatcattgtaatctctaaatctggctgatagtaggtggtagaaaaatacttgttgacttgaaagtgatgagaaaactaaacagtttgtggcatacctgtaattacatgga

SEQ ID NO: 342038 - DNA, 961 bp, Homo sapiens
ctgctgagaaaaccaaacacatacatcgacagttttagaaggcaatgtgttcttcttgcattgagtgtaatgggaagagagttagaactggaaatagagagaaagttttctggaaggagtgtcacctgaactgaaaaattgtctagaaacaaagttgtcaaattatgcagtttagcttgctgcctgatttttttgtaaagaaagttttatgggaaccacagcaatatttatttcagtgttgtctgtggctgctttagcactacaattgcaaagttaagtagatgtgatgaaggcatatgatccacaaagcctcaaatatgtactacatggcccattacaaaaagttggtcaacacctgcattctagaaagcagaaacatatggtactattcaaggaatcacaagcaaagattaaggcagggaatggtagtgtctgaagctggtgaggtggcagagtctagatcactgagatcctgcaccccatagggaacgttcgctttctccagggcaatgaggatcaatgcagggtattaagcagtgacactacagagtcaagcttgaactttggatcgattagtctgtttgcttcatggggtatagattggagggggaaaagactgttagaaaggaaactattaggaggtttgtagaagtaatttatgctgtaattaatgaactgagtagaagtttgaccataaatatgtgaaatggaatattacatgatcattataaagaaatatatctggattatattgacaaggaaagataactacagtatgtttagtaaaaataatcaaggaaactgcctatacaaacatacaaaacatatgtgttactttatgcatagaagaaaaatgaagagaatatacagaaaaatgtcaaaagtcttttgtggacggagaggaggtaaaattacaggaaactatcgcctttaattttacatatttctatactctttttgc

SEQ ID NO: 342039 - DNA, 1374 bp, Homo sapiens
aaaatcactatatttggtgacgaaggagtcccagtgcaagtggatggtgaagcgtgggttcagcctccagggattatcaaaattgtgcacaaaaacagagcacaaatgctaacaagggacagagcctttgagagcactctgaaatcttgggaagataagcagaagtgtgattctggtaaaccagttctccgaacccatttgtacatccatcacgccattgacttggcaacagaagaggtgtcgcagatgcagctatgctcccaggctgcagaggagctcattactaggatatgtgacgcagccacaattcactgtcttttggagcaagaactggcccatgctgtgaatgcctgctcccatgccctgaataaagccaacccaaggtgcccggagagtcttacaagagacactgccactgaaatagccatcaatgtgaaggcgctgtataatgaaacagaatctttgctagttggcagggttcctttgcagctggaatcgccacatgaagagcgagtatccaatgccttacactctgtggaggtggaattacagaaactgacagagattccttggctttattatatcttacacccaaatgaggatgaggaacctcctatggattgcaccaaaaggaacaacagaagcaccgtatttcgaatagtgccaaagtttaaaaaggaaaaggttcagaagcagaagacaagttcacagcctggatctggggataccgaaagtgggtcatgtgaagcgaattctccagggaattaaagagcttggaaggagcactccacagtcggaggtgtaatcatattggtgctatttcttggaagagaagttattgccacttaatacaaagtccttggaagcaagtggctgttcttgtagttttctgcatagataagtaagcaccactgaagcacctctgtggcttgatattttgctgtgggtgaaattttgatttgaggtattagaaaatatttttgtgccgaacaatacattccacaaagccattttctttttgtgcaaacctgacatgttcaaatatattcacaatggtaataaggtaggaggaatctgagacgattgcattgtctaaacagtggaattgcaaaatgtttactttccatagatctggtctgatggaatgttcctactgtgcaactgcataacaatatgtggttaaaacttcctaggtttcattacgggggggcattggccattttcttaaaatcataggttaggagactaaaatataaattaagttgtgatttgaatgtagattggtatcacctccaactcctagtgcttagtggtcaaatatgttgaaaacctttccaatactatgaatgaatgcaaatcttaatgcacgatgtt

SEQ ID NO: 342040 - DNA, 1603 bp, Homo sapiens
aaaatcactatatttggtgacgaaggagtcccagtgcaagtggatggtgaagcgtgggttcagcctccagggattatcaaaattgtgcacaaaaacagagcacaaatgctaacaagggacagagcctttgagagcactctgaaatcttgggaagataagcagaagtgtgattctggtaaaccagttctccgaacccatttgtacatccatcacgccattgacttggcaacagaagaggtgtcgcagatgcagctatgctcccaggctgcagaggagctcattactaggatatgtgacgcagccacaattcactgtcttttggagcaagaactggcccatgctgtgaatgcctgctcccatgccctgaataaagccaacccaaggtgcccggagagtcttacaagagacactgccactgaaatagccatcaatgtgaaggcgctgtataatgaaacagaatctttgctagttggcagggttcctttgaaaagtgccacctttggggcatcctttgctctgagaagagaagctgaaaggctgcatgaaagccatcgctcttacctacctccgccaagaaaagcttttagaagttgatttcagaattgaccagcagctaaacacgcgctggccttgagataagcaatattaaacaattgcagctcatccaccagcagagctgactaactgaggccccctgctccacaagccagaactacagctttgattgaataaaagactggtttcagtatttttctcctgctaagagaccacccacagatcgactagttccagccgagttacagatgctgtgcatttgagtgccttcctttccctgcttcaccttttgacatatagggcttacttgtaatatatttcaatgttaagtctccacctaagggaagcatgagatgcatgtaacatgcatgtttattcagtatgcatgccatgttcccccttcatgaatatctggacgaaagactgcatagctcctcccgtaacctgttgaatatatacatatatttggccaacctgttcaacaaaacgtatgtctcatccttccctccctcgaagtacccgctgacagaggcttctcacagaagctacacttctcagcctgtcagaatggccacattgtaggctgcgagtctttatagcaaacaaagtctcctttctaaatttgtgatttttaagctgataccatagaattcatctttcaaatcaggacacttttaagagtgaaatgaagtgctaaaaatcctggtatcttttttcaaaaatttactaactgacaaatacatttttattttttgatggatctgccaaataattattttgaaacactatttcaaaaatattttttctagaaagtagaataacatatatctgtgtacaccaaagaaaacttttaaaacttctttacatatataaaaagtagaaattttataataatataatcagaataattacccctttagtcattttttgaaaacacatttgtctcaaataccatgtcattctatttttctaaagaatgttttcttttccttatatggtcttgctatgttaaaattttgaataaaattgtcccaatattttcttcaaa

SEQ ID NO: 342041 - DNA, 262 bp, Homo sapiens
agatgcagtcttactgtgttgcccaggatggtctcaaactcctggctacaagctatcctcctgcctctgtctcccaaagtgctggggttacaagcgagagccaccaggcctggcctaattgcttcttaacaacttactattctttgttcactacagtgtatacataactgactgtttctttggagcttcattttgtaatgaaggctctggtcacgtgtaaaacttgtattaaataaatttgcatgcttttctcctgttaatc

SEQ ID NO: 342042 - DNA, 171 bp, Homo sapiens
cttgtccccttttgcctgaggacacaccccagcaaacacaccccaggctttccacaaaacttaatgcaggggggacgggaaatcccatttccctcacgatgaccctgggagcgccggtgagtagaggtgcccacttctgcccttgggtcccagacccgcctgttcttccga

SEQ ID NO: 342043 - DNA, 1042 bp, Homo sapiens
tcattttattttattttacagggagtttctaatttagagaatgcaaaaccaaaaaagagaaagttattccggagatttatgtctgaaaataaaatatttgaaggaaaaactgtgaatgacaaaatctggcaggaacacagcaagcataagaatgattcccacatcagaaggccctgtcagctaaaagatctaaatgaagatgattttctaagtaacaacatacatacctatcaaggaaaaactctacaaggaacttcctatcaggtgacctctgaatgttggagtccatttcactatcaaagacatgttgagaccactgttgatgaactggctcaagaatttatgtaaagtaacaaaagaagatacttatctagtcaaatgtccccaaggatatttgaggaacaatgaattcctgtgatccaatccttcaatttaaagatgaagggctgaagtgcagagaggagaagtggctcactcaagttcacatggccagtcacaaagcagattttcaaagcagaacaatcattagtcggcacacaagggcaggttcttactctaggttttcttaacatttcttgtgtatatgaaataaatattagataaaaatgtttttttactgtgtaattttccattcatagctcctcttcttgctaagaatccaatagatacttaataaaaattaattaatttgcatactggctcttaaatttcctattgttcataatttttggtcagctaggaggtgtacccagaaacagaaatgttcttatgagtagttctagaaacttcttcaaaatttcagagcagaggatattacgcaggaagtaagaaagatgtggcttctgtggccttttctcttaaatcaacacaacccccatttgcaatgctggtttgtgtaatcctggcaactcccagctagcttggcagtgtgtccacattcaaagactgacccaaagctataggtcagtgagcaaaaagcagtcttggcttcccctgcagaagtggagaaatggcagtgacattgcgacttcattatactatg

SEQ ID NO: 342044 - DNA, 418 bp, Homo sapiens
ggcaatcatatttttcaaagcagggcaacaagagagtgaagctggtcaaaatgaatcttttctgcatttcgctggagggctctatggatagcttatatgagccaatcccagagcaacaagctaaccaagaaaacatgtctagtagaactgattctcctatcccaccctttggagagagtgaacaaacaccaaacaatctcttcgtgggagtttctaatttagagaatgcaaaaccaaaaaagagaaagttattccggagatttatgtctgaaaataaaatatttgaataatcctctttggtagttcattggctgctcatcttccagctctccatgtgtagcttggctgctccgtggtcaaggtgacttgttagagatcattttagatctgtgaatctaggagacaataaaaaattagc

SEQ ID NO: 342045 - DNA, 648 bp, Homo sapiens
ggcaatcatatttttcaaagcagggcaacaagagagtgaagctggtcaaaatgaatcttttctgcatttcgctggagggctctatggatagcttatatgagccaatcccagagcaacaagctaaccaagaaaacatgtctagtagaactgattctcctatcccaccctttggagagagtgaacaaacaccaaacaatctcttcgtgggagtttctaatttagagaatgcaaaaccaaaaaagagaaagttattccggagatttatgtctgaaaataaaatatttggttagtgattcctaaggttacaagtgtaaacgatgtattctgtctccccacaagttcttttctcctgctcctgccacaaagcaacaaaactgattaatgaaagtcaaattgagttgtctttgaattatatagaagaacattttttaaaagtggcttcattctaactttaaatggctatgacaaagaaatcattgatttatttgcaatattttccgtttatatttaaacagaataatcctctttggtagttcattggctgctcatcttccagctctccatgtgtagcttggctgctccgtggtcaaggtgacttgttagagatcattttagatctgtgaatctaggagacaataaaaaattagc

SEQ ID NO: 342046 - DNA, 747 bp, Homo sapiens
ggcaatcatatttttcaaagcagggcaacaagagagtgaagctggtcaaaatgaatcttttctgcatttcgctggagggctctatggatagcttatatgagccaatcccagagcaacaagctaaccaagaaaacatgtctagtagaactgattctcctatcccaccctttggagagagtgaacaaacaccaaacaatctcttcgtgggagtttctaatttagagaatgcaaaaccaaaaaagagaaagttattccggagatttatgtctgaaaataaaatatttgaaggaaaaactgtgaatgacaaaatctggcaggaacacagcaagcataagaatgattcccacatcagaaggccctgtcagctaaaagatctaaatgaagatgattttctaagtaacaacatacatacctatcaaggaaaaactctacaaggaacttcctatcaggtgacctctgaatgttggagtccatttcactatcaaagacatgttgagaccactgttgatgaactggtgagacatttcttcccagatgtaactatttaagtggatttcccatctcttttccactcattttaatgccacaagcactgttttctatagttctttattacttctgttttcagctgccacatggaagtgtttctaaagaacataaatagaggcttgtccttactgagtggttttctgaactaaaaggaacataaagcatttccttcaaagaaggaaaggttgttatataaaa

SEQ ID NO: 342047 - DNA, 749 bp, Homo sapiens
  misc_feature (720)..(720): n is a, c, g, or t
gcgtctgtgtagttctctcagacagtcagagaggagagacggagcagcgtggcagacaggctggctctgcacgagctcctggcggggaccagcagcgcctgcaagggggtggagggacaggcgctcgggtggcctgggccgccggcccctcacgctgcccccgctcagccttcatgctctcccctgcttttccacaggcaactggacaacaaccacatcagctgcattgaagatggagccttccgagcgctgcgcgatttggagatccttaccctcaacaacaacaacatcagtcgcatcctggtcaccagcttcaaccacatgccgaagatccgaactctgcgcctccactccaaccacctgtactgcgactgccacctggcctggctctcggattggctgcgacagcgacggacagttggccagttcacactctgcatggctcctgtgcatttgaggggcttcaacgtggcggatgtgcagaagaaggagtacgtgtgcccagccccccactcggagcccccatcctgcaatgccaactccatctcctgcccttcgccctgcacgtgcagcaataacatcgtggactgtcgaggaaagggcttgatggagattcctgccaacttgccggagggcatcgtcgaaatacgcctagaacagaactccatcaaagccatccctgcaggagccttcacccagtacaagaaactgaagcgaatngactcccagaatcgattcggtatgcccca

SEQ ID NO: 342048 - DNA, 511 bp, Homo sapiens
acatgtagggtgatccaaattggtctggggtcaggatttggcccacagtctatcagtttgcgtcatctagttttagttttgactttaggtttcttgaaggaagggaccaagcctgcttttgtcatcattatatcctcacggcttaggtgtaagcctgtcagagagcctggtacaggaaaggcacctgtttgtaaaatagatgggtggatggaggggagggtaggcagatggatgagtgaataaattcttacagtcttcagagcacaagtatttcaaagcagcctacctgggaactgctcatggtcctgctggccacctagaccaccaatgccctgacttctatgccctctgcagagaatccgtgcctgggacaagtagtccgagaggtgatccgccgccagaaaggttatgcatcatgtgccacagcctccaaggtgcccatcatggaatgtcgtgggggctgtgggccccagtgctgccagcccacccttatgcttaacattttcgtatg

SEQ ID NO: 342049 - DNA, 421 bp, Homo sapiens
ttttttttgctcacacccatttatttcccattagctttacacattgtgagtactcatcattggacaggagagagaggtgacgaacaagctggttagaaagccagcctgccacagaacttgagtaaactgaggaaataaagccagtgcgcttcctggattggtgaagaggtttcttgtccctttaggggatgttctgtcaatatatcaacattgaaaagataaaccatttgctttgtttcacaacgtgaacagtgcacctatgcatggtagagaatagaaagacacaacagggcacatgcctccttttccacaggatcctgagctacaaccggctgaggtgcatccccgtccacgccttcaacgggctgcggtccctgcgagtgctgtgagtaccccaatgtgctgattttgacttacacat

SEQ ID NO: 342050 - DNA, 534 bp, Homo sapiens
tttcctaaaggagattccaatcagtattgcctatcaggactttaccttgatgcaacgaggagagtagctgccagctgagcccgcgctgcccggagcagtgcacctgtatggagacagtggtgcgatgcagcaacaaggggctccgcgccctccccagaggcatgcccaaggatgtgaccgagctgtaagtacccccagctgcctccaagcaccctgtcatctcaccatcagcagcatcctccatactttaccccagaatctcaagcaaggctacatggcgaaactgccggggggtagaccctacttgaatggtatcccagcaagtatggcagtggagccctcaccaagtatggcagccatggtctttgacaagggcacaggaaacatggctcccacagtgtctctgcctggcagaggaggagtctctgaccctgtaattctctaaagataccctgtagtataagtgggagggttattgcctcattttccgtatcacacctgaaacctctgctccgtacaccctcttcctaagac

SEQ ID NO: 342051 - DNA, 9546 bp, Homo sapiens
  misc_feature (6750)..(6750): n is a, c, g, or t
  misc_feature (6958)..(6958): n is a, c, g, or t
  misc_feature (8820)..(8820): n is a, c, g, or t
gcgctccgcacctgggcactcccagcgatgcgcagcggggcagcgccggccccgccgatggagctgctgttgctgccgccgccgccgcccggagcgccccgctccgcccgcgccccgtgcgcctgagcaccgagctcgcccctcctccgcgctaactccgccgcccgctccccaggccgcccgcgctccccgcgcgcctcctcgggctccacgcgtcttgccccgcagaggcagcctcctccaggagcggggccctgcacaccatggcccccgggtgggcaggggtcggcgccgccgtgcgcgcccgcctggcgctggccttggcgctggcgagcgtcctgagtgggcctccagccgtcgcctgccccaccaagtgtacctgctccgctgccagcgtggactgccacgggctgggcctccgcgcggttcctcggggcatcccccgcaacgctgagcgccttgacctggacagaaataatatcaccaggatcaccaagatggacttcgctgggctcaagaacctccgagtcttgcatctggaagacaaccaggtcagcgtcatcgagagaggcgccttccaggacctgaagcagctagagcgactgcgcctgaacaagaataagctgcaagtccttccagaattgcttttccagagcacgccgaagctcaccagactagatttgagtgaaaaccagatccaggggatcccgaggaaggcgttccgcggcatcaccgatgtgaagaacctgcaactggacaacaaccacatcagctgcattgaagatggagccttccgagcgctgcgcgatttggagatccttaccctcaacaacaacaacatcagtcgcatcctggtcaccagcttcaaccacatgccgaagatccgaactctgcgcctccactccaaccacctgtactgcgactgccacctggcctggctctcggattggctgcgacagcgacggacagttggccagttcacactctgcatggctcctgtgcatttgaggggcttcaacgtggcggatgtgcagaagaaggagtacgtgtgcccagccccccactcggagcccccatcctgcaatgccaactccatctcctgcccttcgccctgcacgtgcagcaataacatcgtggactgtcgaggaaagggcttgatggagattcctgccaacttgccggagggcatcgtcgaaatacgcctagaacagaactccatcaaagccatccctgcaggagccttcacccagtacaagaaactgaagcgaatagacatcagcaagaatcagatatcggatattgctccagatgccttccagggcctgaaatcactcacatcgctggtcctgtatgggaacaagatcaccgagattgccaagggactgtttgatgggctggtgtccctacagctgctcctcctcaatgccaacaagatcaactgcctgcgggtgaacacgtttcaggacctgcagaacctcaacttgctctccctgtatgacaacaagctgcagaccatcagcaaggggctcttcgcccctctgcagtccatccagacactccacttagcccaaaacccatttgtgtgcgactgccacttgaagtggctggccgactacctccaggacaaccccatcgagacaagcggggcccgctgcagcagcccgcgccgactcgccaacaagcgcatcagccagatcaagagcaagaagttccgctgctcaggctccgaggattaccgcagcaggttcagcagcgagtgcttcatggacctcgtgtgccccgagaagtgtcgctgtgagggcacgattgtggactgctccaaccagaagctggtccgcatcccaagccacctccctgaatatgtcaccgacctgcgactgaatgacaatgaggtatctgttctggaggccactggcatcttcaagaagttgcccaacctgcggaaaataaatctgagtaacaataagatcaaggaggtgcgagagggagctttcgatggagcagccagcgtgcaggagctgatgctgacagggaaccagctggagaccgtgcacgggcgcgtgttccgtggcctcagtggcctcaaaaccttgatgctgaggagtaacttgatcggctgtgtgagtaatgacacctttgccggcctgagttcggtgagactgctgtccctctatgacaatcggatcaccaccatcacccctggggccttcaccacgcttgtctccctgtccaccataaacctcctgtccaaccccttcaactgcaactgccacctggcctggctcggcaagtggttgaggaagaggcggatcgtcagtgggaaccctaggtgccagaagccatttttcctcaaggagattcccatccaggatgtggccatccaggacttcacctgtgatggcaacgaggagagtagctgccagctgagcccgcgctgcccggagcagtgcacctgtatggagacagtggtgcgatgcagcaacaaggggctccgcgccctccccagaggcatgcccaaggatgtgaccgagctgtacctggaaggaaaccacctaacagccgtgcccagagagctgtccgccctccgacacctgacgcttattgacctgagcaacaacagcatcagcatgctgaccaattacaccttcagtaacatgtctcacctctccactctgatcctgagctacaaccggctgaggtgcatccccgtccacgccttcaacgggctgcggtccctgcgagtgctaaccctccatggcaatgacatttccagcgttcctgaaggctccttcaacgacctcacatctctttcccatctggcgctgggaaccaacccactccactgtgactgcagtcttcggtggctgtcggagtgggtgaaggcggggtacaaggagcctggcatcgcccgctgcagtagccctgagcccatggctgacaggctcctgctcaccaccccaacccaccgcttccagtgcaaagggccagtggacatcaacattgtggccaaatgcaatgcctgcctctccagcccgtgcaagaataacgggacatgcacccaggaccctgtggagctgtaccgctgtgcctgcccctacagctacaagggcaaggactgcactgtgcccatcaacacctgcatccagaacccctgtcagcatggaggcacctgccacctgagtgacagccacaaggatgggttcagctgctcctgccctctgggctttgaggggcagcggtgtgagatcaacccagatgactgtgaggacaacgactgcgaaaacaatgccacctgcgtggacgggatcaacaactacgtgtgtatctgtccgcctaactacacaggtgagctatgcgacgaggtgattgaccactgtgtgcctgagctgaacctctgtcagcatgaggccaagtgcatccccctggacaaaggattcagctgcgagtgtgtccctggctacagcgggaagctctgtgagacagacaatgatgactgtgtggcccacaagtgccgccacggggcccagtgcgtggacacaatcaatggctacacatgcacctgcccccagggcttcagtggacccttctgtgaacaccccccacccatggtcctactgcagaccagcccatgcgaccagtacgagtgccagaacggggcccagtgcatcgtggtgcagcaggagcccacctgccgctgcccaccaggcttcgccggccccagatgcgagaagctcatcactgtcaacttcgtgggcaaagactcctacgtggaactggcctccgccaaggtccgaccccaggccaacatctccctgcaggtggccactgacaaggacaacggcatccttctctacaaaggagacaatgaccccctggcactggagctgtaccagggccacgtgcggctggtctatgacagcctgagttcccctccaaccacagtgtacagtgtggagacagtgaatgatgggcagtttcacagtgtggagctggtgacgctaaaccagaccctgaacctagtagtggacaaaggaactccaaagagcctggggaagctccagaagcagccagcagtgggcatcaacagccccctctaccttggaggcatccccacctccaccggcctctccgccttgcgccagggcacggaccggcctctaggcggcttccacggatgcatccatgaggtgcgcatcaacaacgagctgcaggacttcaaggccctcccaccacagtccctgggggtgtcaccaggctgcaagtcctgcaccgtgtgcaagcacggcctgtgccgctccgtggagaaggacagcgtggtgtgcgagtgccgcccaggctggaccggcccactctgcgatcaggaggcccgggacccctgcctcggccacagatgccaccatggaaaatgtgtggcaactgggacctcatacatgtgcaagtgtgccgagggctatggaggggacttgtgtgacaacaagaatgactctgccaatgcctgctcagccttcaagtgtcaccatgggcagtgccacatctcagaccaaggggagccctactgcctgtgccagcccggctttagcggcgagcactgccaacaagagaatccgtgcctgggacaagtagtccgagaggtgatccgccgccagaaaggttatgcatcatgtgccacagcctccaaggtgcccatcatggaatgtcgtgggggctgtgggccccagtgctgccagcccacccgcagcaagcggcggaaatacgtcttccagtgcacggacggctcctcgtttgtagaagaggtggagagacacttagagtgcggctgcctcgcgtgttcctaagcccctgcccgcctgcctgccacctctcggactccagcttgatggagttgggacagccatgtgggaccccctggtgattcagcatgaaggaaatgaagctggagaggaaggtaaagaagaagagaatattaagtatattgtaaaataaacaaaaaatagaacttatttttattatggaaagtgactattttcatcttttattatataaatatattacaccatctgcgtatatgtaccatatagtgagttatttttaccaagttttgtgttgtgtatttgttgtgtttttaaaaatagctgtttaaaaatttaagaaaaaaatagactaataaaaatgctttaaaacaaaaggataagaataaagaatgatagcctgtctgaggaaggaggaagatgttttcatgtttatgaaacggtattatgtcggcagtagaccaagagctgctcattgagatcagaaaaaggaataagaggaagagagagaaggaaaagacctttgtttcttgttttttaactcccttttatttttcctcccctaaaattacccagcttttcggagtcctggatgtcagtgcccaaaatgcccagttcttccaggaaaagctgctgagccctggccttctcagtctcactgccactcaaaaatattgctgtccctgtctgtcccagaccccccttcagggtatctgaacccactgggggacccctcttctccttcctgggtggccctggcttccgtatctgaacccactgggggacccctcttctccttcctggctggccctggcttccaatcgaggactgactattgaagtctgctacaggtgtcatttggaactgtcttaccaaattttaaaacagctgctatttttcctgctcctccccaggagaggggtcttcctagaggaggcgagggaagagaatatcatggtgtctcctcaggacccatgcactggccctctctcctccttccaggtaatttttcattggaatgtatcccagtagagaaggtagtcagcccttcttggaagcggaaggctgggagccaagtcaagtctgcccacagcgctagatgtccaactctggaaggttcttggaggctcttgttgtaagacaggcctctgccacctgatcctccaggtcaccagcatgacgatagagactccttgcccatctgtgacactttccaatgcatatccaaactttaccttattttatctatgcaacccctgcctccctgggaaggataagggagtagagctgggttcactaagaaggaagtttaggccctcacaggctctggaacttgccttaagccacacaccagataagtggaggagccagaccagaagtccagacccaaagcttgagattcttcctctagaatgggtgagcacaggtgattcaggcggcttaaatccatcagagcagccctgccggaaaaggaaataatatgatgttttttcctgctcttgttctgccttgctcactccttctccctccgcagtatctggaaagattctggagaccagggcttatgcatctagggaaagtgaccaagggcagcctatccagcctctgcctccattcctgaaggggacttccctgcccctgtttctttccatgtctctccctccctcactcccatttgcccccttccaccccatcaggttagccacatatcttccagggctcagctgttcacaccaactccctggctcttatcatccatccctccttcccccaggagcttccactgtaggagtttcagggagaagagtttggaattcattggacctttcagccctcaggttccctagaggagcctagttgatctgtgagtaccaatggtgggccaaagacgcagggaataatgaagggagaaagaaaagaaaggaagatggaggaaaacgangcaactggaagaagaaggaagggatggaggggatgaagagaagggagagagggatatagctgaggaatttatctaaaaatgtgcatgtaaatctccattatgttccaggtactgtgccttatgatggctttgttttttgttgtcattagagacaaggtcttgctttgtcacccaggctggagtagagtggttcgatcatagctcaccncagcctcaacctcctaggctcaagccatcttcctgcctcagtctcccaaaatgctgggattacaggtgtgagccactatgctcagcctgtttcaaacattattataatagcagatttatttagtactttattatacatcagataccactctaattgtgaaatagatatatattcatttaattattgaaacaaccatgtagttaaaacactattaactcattttacagttgagtagactgagacacagagaagttaaagaacttgcccaagagtaaatgtctaataaaccgtagagccaggatctgggcccaggctgtctgactccagaacttgctcactcaaccactaaaccatcctgcttctcatgggaaagaaacacatcctgcctttgaggatcctacagcctgtgacaaaaacagtcataaaaatggacaattgccttattacacaaggagctcttaagtggcaatacaagcaatggaagtggctgtccagaggagggaacttctagtcctaggtctttaaggatgaataggagtttgccagagtgagaaagggaattgaactttcctgggagtggccttttaaaaagcaatgagatatggccaggcctggcttgtttggggaagagtcaaaatctagggtggcaagagtatgggaagcacactgaggagcagagagaaatggggtaggtaggaaggtagggttttgaccacaaagagctgtgcatgctaaactgggccacaggtgccagcagggttgtttgaggaagggaagagcaagacaagctctggtttaggaagagagctgtggcagcataaaggcctgaaagaggagacagagctgtcacccaaaatggacttgagagctccctgtggtttactctgtggctagaaaacactgccggccagatggatcacaaatgtctatggtagcttagaagctctgctcttgaagaggatcctgggatctgcccaacacccttcccaacctccatttccccatccccacctccattgccccatcccccctctccccctaggcaggtggatctgagccttatcccaccaccaatgcccctgctagcctctccccacccagcccagagcctactcagcctgccatctcaagagccccaccgagggtcactggcttcctgggaggagtcaccaggctgccagctttccctctgcctccccaaggaacctgagacctccctctgctcatcaccctgggcccaatcctgaatccagcccccatcaaccaagacagcaaaagggccaggtctgtcccttataattttgagccttctccctcaagtttggaagccctgactttaagaaatgccaaatgcaaggaccattaagaaaattctccccgaaatgaggctcctctaacaaatgatgattaaaacgctctctccttgagcagtcacattctagaaacaggacattccatgaggcaggaagagttcagttaatttgctcctgaaaaagtgtggttcagtgtttgtgtggcaatgtacgtgggcagaagaggccgctcaagctgtgtcccccctgagcaggattcaggaaagggaaaagaagttctcttcaactcagccaaggggccgtacgatggccgatgagattatgtatttaaaagttctttgtaaagtgtaaactaaaaaccttaaatgtaagatgctgttgttattattactgttgttgttgctgttatggacatgccaaaaggcccttgttagaagacagttttgccttttcaatctcatagcaaggaactcaagtctgatgcttcaaaaagatgagaagaagggcaagaagagggataactcccaagctcagagggaaaaaaaaggngggggaaaagagccccagggtgaccttcaggaaaggccaggaccaggatgatctaacctttcccttcaccagaaacaaagctattgccagactgaaccctaaagtcaagcagtcacccactgcctttgctgggagcagaagcccatagcaacaagtgacctgcccctcagactcaagatcccagataccagagctggaggagtcatagggcattactggtaggcaggaaaactgagggtcgaacaaatggaagaatgcggtgatcatagaccaaagacacacagataattaaccccatgtgtccacccaggccaaagttcttcctgctaccccacagtggatgtccaggcagatggtccccacatgatggggaagcagagggcatagtgtggttttgtgggacttgttcatgttttgtagtgtgggctcaacagtgccaaaggaaacactagggaaaagttggtgaaacatgccagctagcaggaccagtaaaggcataatcaggcatttggcaaagcttgcttttctaattcaatgataggttctaataggaaatttttgaagattttttaaaacaatgttatagtggcacttccccagtatggaataaataacatgcattcttttttcaatatactgtcatattcagatgtcattaaaataaatggatgagtcacagaggagctatcagatgctctcatgactaccataactcagaaaaaaaca

SEQ ID NO: 342052 - DNA, 8995 bp, Homo sapiens
  misc_feature (6199)..(6199): n is a, c, g, or t
  misc_feature (6407)..(6407): n is a, c, g, or t
  misc_feature (8269)..(8269): n is a, c, g, or t
gcgtctgtgtagttctctcagacagtcagagaggagagacggagcagcgtggcagacaggctggctctgcacgagctcctggcggggaccagcagcgcctgcaagggggtggagggacaggcgctcgggtggcctgggccgccggcccctcacgctgcccccgctcagccttcatgctctcccctgcttttccacaggcaactggacaacaaccacatcagctgcattgaagatggagccttccgagcgctgcgcgatttggagatccttaccctcaacaacaacaacatcagtcgcatcctggtcaccagcttcaaccacatgccgaagatccgaactctgcgcctccactccaaccacctgtactgcgactgccacctggcctggctctcggattggctgcgacagcgacggacagttggccagttcacactctgcatggctcctgtgcatttgaggggcttcaacgtggcggatgtgcagaagaaggagtacgtgtgcccagccccccactcggagcccccatcctgcaatgccaactccatctcctgcccttcgccctgcacgtgcagcaataacatcgtggactgtcgaggaaagggcttgatggagattcctgccaacttgccggagggcatcgtcgaaatacgcctagaacagaactccatcaaagccatccctgcaggagccttcacccagtacaagaaactgaagcgaatagacatcagcaagaatcagatatcggatattgctccagatgccttccagggcctgaaatcactcacatcgctggtcctgtatgggaacaagatcaccgagattgccaagggactgtttgatgggctggtgtccctacagctgctcctcctcaatgccaacaagatcaactgcctgcgggtgaacacgtttcaggacctgcagaacctcaacttgctctccctgtatgacaacaagctgcagaccatcagcaaggggctcttcgcccctctgcagtccatccagacactccacttagcccaaaacccatttgtgtgcgactgccacttgaagtggctggccgactacctccaggacaaccccatcgagacaagcggggcccgctgcagcagcccgcgccgactcgccaacaagcgcatcagccagatcaagagcaagaagttccgctgctcaggctccgaggattaccgcagcaggttcagcagcgagtgcttcatggacctcgtgtgccccgagaagtgtcgctgtgagggcacgattgtggactgctccaaccagaagctggtccgcatcccaagccacctccctgaatatgtcaccgacctgcgactgaatgacaatgaggtatctgttctggaggccactggcatcttcaagaagttgcccaacctgcggaaaataaatctgagtaacaataagatcaaggaggtgcgagagggagctttcgatggagcagccagcgtgcaggagctgatgctgacagggaaccagctggagaccgtgcacgggcgcgtgttccgtggcctcagtggcctcaaaaccttgatgctgaggagtaacttgatcggctgtgtgagtaatgacacctttgccggcctgagttcggtgagactgctgtccctctatgacaatcggatcaccaccatcacccctggggccttcaccacgcttgtctccctgtccaccataaacctcctgtccaaccccttcaactgcaactgccacctggcctggctcggcaagtggttgaggaagaggcggatcgtcagtgggaaccctaggtgccagaagccatttttcctcaaggagattcccatccaggatgtggccatccaggacttcacctgtgatggcaacgaggagagtagctgccagctgagcccgcgctgcccggagcagtgcacctgtatggagacagtggtgcgatgcagcaacaaggggctccgcgccctccccagaggcatgcccaaggatgtgaccgagctgtacctggaaggaaaccacctaacagccgtgcccagagagctgtccgccctccgacacctgacgcttattgacctgagcaacaacagcatcagcatgctgaccaattacaccttcagtaacatgtctcacctctccactctgatcctgagctacaaccggctgaggtgcatccccgtccacgccttcaacgggctgcggtccctgcgagtgctaaccctccatggcaatgacatttccagcgttcctgaaggctccttcaacgacctcacatctctttcccatctggcgctgggaaccaacccactccactgtgactgcagtcttcggtggctgtcggagtgggtgaaggcggggtacaaggagcctggcatcgcccgctgcagtagccctgagcccatggctgacaggctcctgctcaccaccccaacccaccgcttccagtgcaaagggccagtggacatcaacattgtggccaaatgcaatgcctgcctctccagcccgtgcaagaataacgggacatgcacccaggaccctgtggagctgtaccgctgtgcctgcccctacagctacaagggcaaggactgcactgtgcccatcaacacctgcatccagaacccctgtcagcatggaggcacctgccacctgagtgacagccacaaggatgggttcagctgctcctgccctctgggctttgaggggcagcggtgtgagatcaacccagatgactgtgaggacaacgactgcgaaaacaatgccacctgcgtggacgggatcaacaactacgtgtgtatctgtccgcctaactacacaggtgagctatgcgacgaggtgattgaccactgtgtgcctgagctgaacctctgtcagcatgaggccaagtgcatccccctggacaaaggattcagctgcgagtgtgtccctggctacagcgggaagctctgtgagacagacaatgatgactgtgtggcccacaagtgccgccacggggcccagtgcgtggacacaatcaatggctacacatgcacctgcccccagggcttcagtggacccttctgtgaacaccccccacccatggtcctactgcagaccagcccatgcgaccagtacgagtgccagaacggggcccagtgcatcgtggtgcagcaggagcccacctgccgctgcccaccaggcttcgccggccccagatgcgagaagctcatcactgtcaacttcgtgggcaaagactcctacgtggaactggcctccgccaaggtccgaccccaggccaacatctccctgcaggtggccactgacaaggacaacggcatccttctctacaaaggagacaatgaccccctggcactggagctgtaccagggccacgtgcggctggtctatgacagcctgagttcccctccaaccacagtgtacagtgtggagacagtgaatgatgggcagtttcacagtgtggagctggtgacgctaaaccagaccctgaacctagtagtggacaaaggaactccaaagagcctggggaagctccagaagcagccagcagtgggcatcaacagccccctctaccttggaggcatccccacctccaccggcctctccgccttgcgccagggcacggaccggcctctaggcggcttccacggatgcatccatgaggtgcgcatcaacaacgagctgcaggacttcaaggccctcccaccacagtccctgggggtgtcaccaggctgcaagtcctgcaccgtgtgcaagcacggcctgtgccgctccgtggagaaggacagcgtggtgtgcgagtgccgcccaggctggaccggcccactctgcgatcaggaggcccgggacccctgcctcggccacagatgccaccatggaaaatgtgtggcaactgggacctcatacatgtgcaagtgtgccgagggctatggaggggacttgtgtgacaacaagaatgactctgccaatgcctgctcagccttcaagtgtcaccatgggcagtgccacatctcagaccaaggggagccctactgcctgtgccagcccggctttagcggcgagcactgccaacaagagaatccgtgcctgggacaagtagtccgagaggtgatccgccgccagaaaggttatgcatcatgtgccacagcctccaaggtgcccatcatggaatgtcgtgggggctgtgggccccagtgctgccagcccacccgcagcaagcggcggaaatacgtcttccagtgcacggacggctcctcgtttgtagaagaggtggagagacacttagagtgcggctgcctcgcgtgttcctaagcccctgcccgcctgcctgccacctctcggactccagcttgatggagttgggacagccatgtgggaccccctggtgattcagcatgaaggaaatgaagctggagaggaaggtaaagaagaagagaatattaagtatattgtaaaataaacaaaaaatagaacttatttttattatggaaagtgactattttcatcttttattatataaatatattacaccatctgcgtatatgtaccatatagtgagttatttttaccaagttttgtgttgtgtatttgttgtgtttttaaaaatagctgtttaaaaatttaagaaaaaaatagactaataaaaatgctttaaaacaaaaggataagaataaagaatgatagcctgtctgaggaaggaggaagatgttttcatgtttatgaaacggtattatgtcggcagtagaccaagagctgctcattgagatcagaaaaaggaataagaggaagagagagaaggaaaagacctttgtttcttgttttttaactcccttttatttttcctcccctaaaattacccagcttttcggagtcctggatgtcagtgcccaaaatgcccagttcttccaggaaaagctgctgagccctggccttctcagtctcactgccactcaaaaatattgctgtccctgtctgtcccagaccccccttcagggtatctgaacccactgggggacccctcttctccttcctgggtggccctggcttccgtatctgaacccactgggggacccctcttctccttcctggctggccctggcttccaatcgaggactgactattgaagtctgctacaggtgtcatttggaactgtcttaccaaattttaaaacagctgctatttttcctgctcctccccaggagaggggtcttcctagaggaggcgagggaagagaatatcatggtgtctcctcaggacccatgcactggccctctctcctccttccaggtaatttttcattggaatgtatcccagtagagaaggtagtcagcccttcttggaagcggaaggctgggagccaagtcaagtctgcccacagcgctagatgtccaactctggaaggttcttggaggctcttgttgtaagacaggcctctgccacctgatcctccaggtcaccagcatgacgatagagactccttgcccatctgtgacactttccaatgcatatccaaactttaccttattttatctatgcaacccctgcctccctgggaaggataagggagtagagctgggttcactaagaaggaagtttaggccctcacaggctctggaacttgccttaagccacacaccagataagtggaggagccagaccagaagtccagacccaaagcttgagattcttcctctagaatgggtgagcacaggtgattcaggcggcttaaatccatcagagcagccctgccggaaaaggaaataatatgatgttttttcctgctcttgttctgccttgctcactccttctccctccgcagtatctggaaagattctggagaccagggcttatgcatctagggaaagtgaccaagggcagcctatccagcctctgcctccattcctgaaggggacttccctgcccctgtttctttccatgtctctccctccctcactcccatttgcccccttccaccccatcaggttagccacatatcttccagggctcagctgttcacaccaactccctggctcttatcatccatccctccttcccccaggagcttccactgtaggagtttcagggagaagagtttggaattcattggacctttcagccctcaggttccctagaggagcctagttgatctgtgagtaccaatggtgggccaaagacgcagggaataatgaagggagaaagaaaagaaaggaagatggaggaaaacgangcaactggaagaagaaggaagggatggaggggatgaagagaagggagagagggatatagctgaggaatttatctaaaaatgtgcatgtaaatctccattatgttccaggtactgtgccttatgatggctttgttttttgttgtcattagagacaaggtcttgctttgtcacccaggctggagtagagtggttcgatcatagctcaccncagcctcaacctcctaggctcaagccatcttcctgcctcagtctcccaaaatgctgggattacaggtgtgagccactatgctcagcctgtttcaaacattattataatagcagatttatttagtactttattatacatcagataccactctaattgtgaaatagatatatattcatttaattattgaaacaaccatgtagttaaaacactattaactcattttacagttgagtagactgagacacagagaagttaaagaacttgcccaagagtaaatgtctaataaaccgtagagccaggatctgggcccaggctgtctgactccagaacttgctcactcaaccactaaaccatcctgcttctcatgggaaagaaacacatcctgcctttgaggatcctacagcctgtgacaaaaacagtcataaaaatggacaattgccttattacacaaggagctcttaagtggcaatacaagcaatggaagtggctgtccagaggagggaacttctagtcctaggtctttaaggatgaataggagtttgccagagtgagaaagggaattgaactttcctgggagtggccttttaaaaagcaatgagatatggccaggcctggcttgtttggggaagagtcaaaatctagggtggcaagagtatgggaagcacactgaggagcagagagaaatggggtaggtaggaaggtagggttttgaccacaaagagctgtgcatgctaaactgggccacaggtgccagcagggttgtttgaggaagggaagagcaagacaagctctggtttaggaagagagctgtggcagcataaaggcctgaaagaggagacagagctgtcacccaaaatggacttgagagctccctgtggtttactctgtggctagaaaacactgccggccagatggatcacaaatgtctatggtagcttagaagctctgctcttgaagaggatcctgggatctgcccaacacccttcccaacctccatttccccatccccacctccattgccccatcccccctctccccctaggcaggtggatctgagccttatcccaccaccaatgcccctgctagcctctccccacccagcccagagcctactcagcctgccatctcaagagccccaccgagggtcactggcttcctgggaggagtcaccaggctgccagctttccctctgcctccccaaggaacctgagacctccctctgctcatcaccctgggcccaatcctgaatccagcccccatcaaccaagacagcaaaagggccaggtctgtcccttataattttgagccttctccctcaagtttggaagccctgactttaagaaatgccaaatgcaaggaccattaagaaaattctccccgaaatgaggctcctctaacaaatgatgattaaaacgctctctccttgagcagtcacattctagaaacaggacattccatgaggcaggaagagttcagttaatttgctcctgaaaaagtgtggttcagtgtttgtgtggcaatgtacgtgggcagaagaggccgctcaagctgtgtcccccctgagcaggattcaggaaagggaaaagaagttctcttcaactcagccaaggggccgtacgatggccgatgagattatgtatttaaaagttctttgtaaagtgtaaactaaaaaccttaaatgtaagatgctgttgttattattactgttgttgttgctgttatggacatgccaaaaggcccttgttagaagacagttttgccttttcaatctcatagcaaggaactcaagtctgatgcttcaaaaagatgagaagaagggcaagaagagggataactcccaagctcagagggaaaaaaaaggngggggaaaagagccccagggtgaccttcaggaaaggccaggaccaggatgatctaacctttcccttcaccagaaacaaagctattgccagactgaaccctaaagtcaagcagtcacccactgcctttgctgggagcagaagcccatagcaacaagtgacctgcccctcagactcaagatcccagataccagagctggaggagtcatagggcattactggtaggcaggaaaactgagggtcgaacaaatggaagaatgcggtgatcatagaccaaagacacacagataattaaccccatgtgtccacccaggccaaagttcttcctgctaccccacagtggatgtccaggcagatggtccccacatgatggggaagcagagggcatagtgtggttttgtgggacttgttcatgttttgtagtgtgggctcaacagtgccaaaggaaacactagggaaaagttggtgaaacatgccagctagcaggaccagtaaaggcataatcaggcatttggcaaagcttgcttttctaattcaatgataggttctaataggaaatttttgaagattttttaaaacaatgttatagtggcacttccccagtatggaataaataacatgcattcttttttcaatatactgtcatattcagatgtcattaaaataaatggatgagtcacagaggagctatcagatgctctcatgactaccataactcagaaaaaaaca

SEQ ID NO: 342053 - DNA, 8695 bp, Homo sapiens
  misc_feature (5899)..(5899): n is a, c, g, or t
  misc_feature (6107)..(6107): n is a, c, g, or t
  misc_feature (7969)..(7969): n is a, c, g, or t
gcgtctgtgtagttctctcagacagtcagagaggagagacggagcagcgtggcagacaggctggctctgcacgagctcctggcggggaccagcagcgcctgcaagggggtggagggacaggcgctcgggtggcctgggccgccggcccctcacgctgcccccgctcagccttcatgctctcccctgcttttccacaggcaactggacaacaaccacatcagctgcattgaagatggagccttccgagcgctgcgcgatttggagatccttaccctcaacaacaacaacatcagtcgcatcctggtcaccagcttcaaccacatgccgaagatccgaactctgcgcctccactccaaccacctgtactgcgactgccacctggcctggctctcggattggctgcgacagcgacggacagttggccagttcacactctgcatggctcctgtgcatttgaggggcttcaacgtggcggatgtgcagaagaaggagtacgtgtgcccagccccccactcggagcccccatcctgcaatgccaactccatctcctgcccttcgccctgcacgtgcagcaataacatcgtggactgtcgaggaaagggcttgatggagattcctgccaacttgccggagggcatcgtcgaaatacgcctagaacagaactccatcaaagccatccctgcaggagccttcacccagtacaagaaactgaagcgaatagacatcagcaagaatcagatatcggatattgctccagatgccttccagggcctgaaatcactcacatcgctggtcctgtatgggaacaagatcaccgagattgccaagggactgtttgatgggctggtgtccctacagctgctcctcctcaatgccaacaagatcaactgcctgcgggtgaacacgtttcaggacctgcagaacctcaacttgctctccctgtatgacaacaagctgcagaccatcagcaaggggctcttcgcccctctgcagtccatccagacactccacttagcccaaaacccatttgtgtgcgactgccacttgaagtggctggccgactacctccaggacaaccccatcgagacaagcggggcccgctgcagcagcccgcgccgactcgccaacaagcgcatcagccagatcaagagcaagaagttccgctgctcaggctccgaggattaccgcagcaggttcagcagcgagtgcttcatggacctcgtgtgccccgagaagtgtcgctgtgagggcacgattgtggactgctccaaccagaagctggtccgcatcccaagccacctccctgaatatgtcaccgacctgcgactgaatgacaatgaggtatctgttctggaggccactggcatcttcaagaagttgcccaacctgcggaaaataaatctgagtaacaataagatcaaggaggtgcgagagggagctttcgatggagcagccagcgtgcaggagctgatgctgacagggaaccagctggagaccgtgcacgggcgcgtgttccgtggcctcagtggcctcaaaaccttgatgctgaggagtaacttgatcggctgtgtgagtaatgacacctttgccggcctgagttcggtgagactgctgtccctctatgacaatcggatcaccaccatcacccctggggccttcaccacgcttgtctccctgtccaccataaacctcctgtccaaccccttcaactgcaactgccacctggcctggctcggcaagtggttgaggaagaggcggatcgtcagtgggaaccctaggtgccagaagccatttttcctcaaggagattcccatccaggatgtggccatccaggacttcacctgtgatggcaacgaggagagtagctgccagctgagcccgcgctgcccggagcagtgcacctgtatggagacagtggtgcgatgcagcaacaaggggctccgcgccctccccagaggcatgcccaaggatgtgaccgagctgtacctggaaggaaaccacctaacagccgtgcccagagagctgtccgccctccgacacctgacgcttattgacctgagcaacaacagcatcagcatgctgaccaattacaccttcagtaacatgtctcacctctccactctgatcctgagctacaaccggctgaggtgcatccccgtccacgccttcaacgggctgcggtccctgcgagtgctaaccctccatggcaatgacatttccagcgttcctgaaggctccttcaacgacctcacatctctttcccatctggcgctgggaaccaacccactccactgtgactgcagtcttcggtggctgtcggagtgggtgaaggcggggtacaaggagcctggcatcgcccgctgcagtagccctgagcccatggctgacaggctcctgctcaccaccccaacccaccgcttccagtgcaaagggccagtggacatcaacattgtggccaaatgcaatgcctgcctctccagcccgtgcaagaataacgggacatgcacccaggaccctgtggagctgtaccgctgtgcctgcccctacagctacaagggcaaggactgcactgtgcccatcaacacctgcatccagaacccctgtcagcatggaggcacctgccacctgagtgacagccacaaggatgggttcagctgctcctgccctctgggctttgaggggcagcggtgtgagatcaacccagatgactgtgaggacaacgactgcgaaaacaatgccacctgcgtggacgggatcaacaactacgtgtgtatctgtccgcctaactacacaggtgagctatgcgacgaggtgattgaccactgtgtgcctgagctgaacctctgtcagcatgaggccaagtgcatccccctggacaaaggattcagctgcgagtgtgtccctggctacagcgggaagctctgtgagacagacaatgatgactgtgtggcccacaagtgccgccacggggcccagtgcgtggacacaatcaatggctacacatgcacctgcccccagggcttcagtggacccttctgtgaacaccccccacccatggtctatgacagcctgagttcccctccaaccacagtgtacagtgtggagacagtgaatgatgggcagtttcacagtgtggagctggtgacgctaaaccagaccctgaacctagtagtggacaaaggaactccaaagagcctggggaagctccagaagcagccagcagtgggcatcaacagccccctctaccttggaggcatccccacctccaccggcctctccgccttgcgccagggcacggaccggcctctaggcggcttccacggatgcatccatgaggtgcgcatcaacaacgagctgcaggacttcaaggccctcccaccacagtccctgggggtgtcaccaggctgcaagtcctgcaccgtgtgcaagcacggcctgtgccgctccgtggagaaggacagcgtggtgtgcgagtgccgcccaggctggaccggcccactctgcgatcaggaggcccgggacccctgcctcggccacagatgccaccatggaaaatgtgtggcaactgggacctcatacatgtgcaagtgtgccgagggctatggaggggacttgtgtgacaacaagaatgactctgccaatgcctgctcagccttcaagtgtcaccatgggcagtgccacatctcagaccaaggggagccctactgcctgtgccagcccggctttagcggcgagcactgccaacaagagaatccgtgcctgggacaagtagtccgagaggtgatccgccgccagaaaggttatgcatcatgtgccacagcctccaaggtgcccatcatggaatgtcgtgggggctgtgggccccagtgctgccagcccacccgcagcaagcggcggaaatacgtcttccagtgcacggacggctcctcgtttgtagaagaggtggagagacacttagagtgcggctgcctcgcgtgttcctaagcccctgcccgcctgcctgccacctctcggactccagcttgatggagttgggacagccatgtgggaccccctggtgattcagcatgaaggaaatgaagctggagaggaaggtaaagaagaagagaatattaagtatattgtaaaataaacaaaaaatagaacttatttttattatggaaagtgactattttcatcttttattatataaatatattacaccatctgcgtatatgtaccatatagtgagttatttttaccaagttttgtgttgtgtatttgttgtgtttttaaaaatagctgtttaaaaatttaagaaaaaaatagactaataaaaatgctttaaaacaaaaggataagaataaagaatgatagcctgtctgaggaaggaggaagatgttttcatgtttatgaaacggtattatgtcggcagtagaccaagagctgctcattgagatcagaaaaaggaataagaggaagagagagaaggaaaagacctttgtttcttgttttttaactcccttttatttttcctcccctaaaattacccagcttttcggagtcctggatgtcagtgcccaaaatgcccagttcttccaggaaaagctgctgagccctggccttctcagtctcactgccactcaaaaatattgctgtccctgtctgtcccagaccccccttcagggtatctgaacccactgggggacccctcttctccttcctgggtggccctggcttccgtatctgaacccactgggggacccctcttctccttcctggctggccctggcttccaatcgaggactgactattgaagtctgctacaggtgtcatttggaactgtcttaccaaattttaaaacagctgctatttttcctgctcctccccaggagaggggtcttcctagaggaggcgagggaagagaatatcatggtgtctcctcaggacccatgcactggccctctctcctccttccaggtaatttttcattggaatgtatcccagtagagaaggtagtcagcccttcttggaagcggaaggctgggagccaagtcaagtctgcccacagcgctagatgtccaactctggaaggttcttggaggctcttgttgtaagacaggcctctgccacctgatcctccaggtcaccagcatgacgatagagactccttgcccatctgtgacactttccaatgcatatccaaactttaccttattttatctatgcaacccctgcctccctgggaaggataagggagtagagctgggttcactaagaaggaagtttaggccctcacaggctctggaacttgccttaagccacacaccagataagtggaggagccagaccagaagtccagacccaaagcttgagattcttcctctagaatgggtgagcacaggtgattcaggcggcttaaatccatcagagcagccctgccggaaaaggaaataatatgatgttttttcctgctcttgttctgccttgctcactccttctccctccgcagtatctggaaagattctggagaccagggcttatgcatctagggaaagtgaccaagggcagcctatccagcctctgcctccattcctgaaggggacttccctgcccctgtttctttccatgtctctccctccctcactcccatttgcccccttccaccccatcaggttagccacatatcttccagggctcagctgttcacaccaactccctggctcttatcatccatccctccttcccccaggagcttccactgtaggagtttcagggagaagagtttggaattcattggacctttcagccctcaggttccctagaggagcctagttgatctgtgagtaccaatggtgggccaaagacgcagggaataatgaagggagaaagaaaagaaaggaagatggaggaaaacgangcaactggaagaagaaggaagggatggaggggatgaagagaagggagagagggatatagctgaggaatttatctaaaaatgtgcatgtaaatctccattatgttccaggtactgtgccttatgatggctttgttttttgttgtcattagagacaaggtcttgctttgtcacccaggctggagtagagtggttcgatcatagctcaccncagcctcaacctcctaggctcaagccatcttcctgcctcagtctcccaaaatgctgggattacaggtgtgagccactatgctcagcctgtttcaaacattattataatagcagatttatttagtactttattatacatcagataccactctaattgtgaaatagatatatattcatttaattattgaaacaaccatgtagttaaaacactattaactcattttacagttgagtagactgagacacagagaagttaaagaacttgcccaagagtaaatgtctaataaaccgtagagccaggatctgggcccaggctgtctgactccagaacttgctcactcaaccactaaaccatcctgcttctcatgggaaagaaacacatcctgcctttgaggatcctacagcctgtgacaaaaacagtcataaaaatggacaattgccttattacacaaggagctcttaagtggcaatacaagcaatggaagtggctgtccagaggagggaacttctagtcctaggtctttaaggatgaataggagtttgccagagtgagaaagggaattgaactttcctgggagtggccttttaaaaagcaatgagatatggccaggcctggcttgtttggggaagagtcaaaatctagggtggcaagagtatgggaagcacactgaggagcagagagaaatggggtaggtaggaaggtagggttttgaccacaaagagctgtgcatgctaaactgggccacaggtgccagcagggttgtttgaggaagggaagagcaagacaagctctggtttaggaagagagctgtggcagcataaaggcctgaaagaggagacagagctgtcacccaaaatggacttgagagctccctgtggtttactctgtggctagaaaacactgccggccagatggatcacaaatgtctatggtagcttagaagctctgctcttgaagaggatcctgggatctgcccaacacccttcccaacctccatttccccatccccacctccattgccccatcccccctctccccctaggcaggtggatctgagccttatcccaccaccaatgcccctgctagcctctccccacccagcccagagcctactcagcctgccatctcaagagccccaccgagggtcactggcttcctgggaggagtcaccaggctgccagctttccctctgcctccccaaggaacctgagacctccctctgctcatcaccctgggcccaatcctgaatccagcccccatcaaccaagacagcaaaagggccaggtctgtcccttataattttgagccttctccctcaagtttggaagccctgactttaagaaatgccaaatgcaaggaccattaagaaaattctccccgaaatgaggctcctctaacaaatgatgattaaaacgctctctccttgagcagtcacattctagaaacaggacattccatgaggcaggaagagttcagttaatttgctcctgaaaaagtgtggttcagtgtttgtgtggcaatgtacgtgggcagaagaggccgctcaagctgtgtcccccctgagcaggattcaggaaagggaaaagaagttctcttcaactcagccaaggggccgtacgatggccgatgagattatgtatttaaaagttctttgtaaagtgtaaactaaaaaccttaaatgtaagatgctgttgttattattactgttgttgttgctgttatggacatgccaaaaggcccttgttagaagacagttttgccttttcaatctcatagcaaggaactcaagtctgatgcttcaaaaagatgagaagaagggcaagaagagggataactcccaagctcagagggaaaaaaaaggngggggaaaagagccccagggtgaccttcaggaaaggccaggaccaggatgatctaacctttcccttcaccagaaacaaagctattgccagactgaaccctaaagtcaagcagtcacccactgcctttgctgggagcagaagcccatagcaacaagtgacctgcccctcagactcaagatcccagataccagagctggaggagtcatagggcattactggtaggcaggaaaactgagggtcgaacaaatggaagaatgcggtgatcatagaccaaagacacacagataattaaccccatgtgtccacccaggccaaagttcttcctgctaccccacagtggatgtccaggcagatggtccccacatgatggggaagcagagggcatagtgtggttttgtgggacttgttcatgttttgtagtgtgggctcaacagtgccaaaggaaacactagggaaaagttggtgaaacatgccagctagcaggaccagtaaaggcataatcaggcatttggcaaagcttgcttttctaattcaatgataggttctaataggaaatttttgaagattttttaaaacaatgttatagtggcacttccccagtatggaataaataacatgcattcttttttcaatatactgtcatattcagatgtcattaaaataaatggatgagtcacagaggagctatcagatgctctcatgactaccataactcagaaaaaaaca

SEQ ID NO: 342054 - DNA, 6190 bp, Homo sapiens
  misc_feature (3394)..(3394): n is a, c, g, or t
  misc_feature (3602)..(3602): n is a, c, g, or t
  misc_feature (5464)..(5464): n is a, c, g, or t
tctcccccatctgtgccaggtgagctatgcgacgaggtgattgaccactgtgtgcctgagctgaacctctgtcagcatgaggccaagtgcatccccctggacaaaggattcagctgcgagtgtgtccctggctacagcgggaagctctgtgagacagacaatgatgactgtgtggcccacaagtgccgccacggggcccagtgcgtggacacaatcaatggctacacatgcacctgcccccagggcttcagtggacccttctgtgaacaccccccacccatggtcctactgcagaccagcccatgcgaccagtacgagtgccagaacggggcccagtgcatcgtggtgcagcaggagcccacctgccgctgcccaccaggcttcgccggccccagatgcgagaagctcatcactgtcaacttcgtgggcaaagactcctacgtggaactggcctccgccaaggtggccactgacaaggacaacggcatccttctctacaaaggagacaatgaccccctggcactggagctgtaccagggccacgtgcggctggtctatgacagcctgagttcccctccaaccacagtgtacagtgtggagacagtgaatgatgggcagtttcacagtgtggagctggtgacgctaaaccagaccctgaacctagtagtggacaaaggaactccaaagagcctggggaagctccagaagcagccagcagtgggcatcaacagccccctctaccttggaggcatccccacctccaccggcctctccgccttgcgccagggcacggaccggcctctaggcggcttccacggatgcatccatgaggtgcgcatcaacaacgagctgcaggacttcaaggccctcccaccacagtccctgggggtgtcaccaggctgcaagtcctgcaccgtgtgcaagcacggcctgtgccgctccgtggagaaggacagcgtggtgtgcgagtgccgcccaggctggaccggcccactctgcgatcaggaggcccgggacccctgcctcggccacagatgccaccatggaaaatgtgtggcaactgggacctcatacatgtgcaagtgtgccgagggctatggaggggacttgtgtgacaacaagaatgactctgccaatgcctgctcagccttcaagtgtcaccatgggcagtgccacatctcagaccaaggggagccctactgcctgtgccagcccggctttagcggcgagcactgccaacaagagaatccgtgcctgggacaagtagtccgagaggtgatccgccgccagaaaggttatgcatcatgtgccacagcctccaaggtgcccatcatggaatgtcgtgggggctgtgggccccagtgctgccagcccacccgcagcaagcggcggaaatacgtcttccagtgcacggacggctcctcgtttgtagaagaggtggagagacacttagagtgcggctgcctcgcgtgttcctaagcccctgcccgcctgcctgccacctctcggactccagcttgatggagttgggacagccatgtgggaccccctggtgattcagcatgaaggaaatgaagctggagaggaaggtaaagaagaagagaatattaagtatattgtaaaataaacaaaaaatagaacttatttttattatggaaagtgactattttcatcttttattatataaatatattacaccatctgcgtatatgtaccatatagtgagttatttttaccaagttttgtgttgtgtatttgttgtgtttttaaaaatagctgtttaaaaatttaagaaaaaaatagactaataaaaatgctttaaaacaaaaggataagaataaagaatgatagcctgtctgaggaaggaggaagatgttttcatgtttatgaaacggtattatgtcggcagtagaccaagagctgctcattgagatcagaaaaaggaataagaggaagagagagaaggaaaagacctttgtttcttgttttttaactcccttttatttttcctcccctaaaattacccagcttttcggagtcctggatgtcagtgcccaaaatgcccagttcttccaggaaaagctgctgagccctggccttctcagtctcactgccactcaaaaatattgctgtccctgtctgtcccagaccccccttcagggtatctgaacccactgggggacccctcttctccttcctgggtggccctggcttccgtatctgaacccactgggggacccctcttctccttcctggctggccctggcttccaatcgaggactgactattgaagtctgctacaggtgtcatttggaactgtcttaccaaattttaaaacagctgctatttttcctgctcctccccaggagaggggtcttcctagaggaggcgagggaagagaatatcatggtgtctcctcaggacccatgcactggccctctctcctccttccaggtaatttttcattggaatgtatcccagtagagaaggtagtcagcccttcttggaagcggaaggctgggagccaagtcaagtctgcccacagcgctagatgtccaactctggaaggttcttggaggctcttgttgtaagacaggcctctgccacctgatcctccaggtcaccagcatgacgatagagactccttgcccatctgtgacactttccaatgcatatccaaactttaccttattttatctatgcaacccctgcctccctgggaaggataagggagtagagctgggttcactaagaaggaagtttaggccctcacaggctctggaacttgccttaagccacacaccagataagtggaggagccagaccagaagtccagacccaaagcttgagattcttcctctagaatgggtgagcacaggtgattcaggcggcttaaatccatcagagcagccctgccggaaaaggaaataatatgatgttttttcctgctcttgttctgccttgctcactccttctccctccgcagtatctggaaagattctggagaccagggcttatgcatctagggaaagtgaccaagggcagcctatccagcctctgcctccattcctgaaggggacttccctgcccctgtttctttccatgtctctccctccctcactcccatttgcccccttccaccccatcaggttagccacatatcttccagggctcagctgttcacaccaactccctggctcttatcatccatccctccttcccccaggagcttccactgtaggagtttcagggagaagagtttggaattcattggacctttcagccctcaggttccctagaggagcctagttgatctgtgagtaccaatggtgggccaaagacgcagggaataatgaagggagaaagaaaagaaaggaagatggaggaaaacgangcaactggaagaagaaggaagggatggaggggatgaagagaagggagagagggatatagctgaggaatttatctaaaaatgtgcatgtaaatctccattatgttccaggtactgtgccttatgatggctttgttttttgttgtcattagagacaaggtcttgctttgtcacccaggctggagtagagtggttcgatcatagctcaccncagcctcaacctcctaggctcaagccatcttcctgcctcagtctcccaaaatgctgggattacaggtgtgagccactatgctcagcctgtttcaaacattattataatagcagatttatttagtactttattatacatcagataccactctaattgtgaaatagatatatattcatttaattattgaaacaaccatgtagttaaaacactattaactcattttacagttgagtagactgagacacagagaagttaaagaacttgcccaagagtaaatgtctaataaaccgtagagccaggatctgggcccaggctgtctgactccagaacttgctcactcaaccactaaaccatcctgcttctcatgggaaagaaacacatcctgcctttgaggatcctacagcctgtgacaaaaacagtcataaaaatggacaattgccttattacacaaggagctcttaagtggcaatacaagcaatggaagtggctgtccagaggagggaacttctagtcctaggtctttaaggatgaataggagtttgccagagtgagaaagggaattgaactttcctgggagtggccttttaaaaagcaatgagatatggccaggcctggcttgtttggggaagagtcaaaatctagggtggcaagagtatgggaagcacactgaggagcagagagaaatggggtaggtaggaaggtagggttttgaccacaaagagctgtgcatgctaaactgggccacaggtgccagcagggttgtttgaggaagggaagagcaagacaagctctggtttaggaagagagctgtggcagcataaaggcctgaaagaggagacagagctgtcacccaaaatggacttgagagctccctgtggtttactctgtggctagaaaacactgccggccagatggatcacaaatgtctatggtagcttagaagctctgctcttgaagaggatcctgggatctgcccaacacccttcccaacctccatttccccatccccacctccattgccccatcccccctctccccctaggcaggtggatctgagccttatcccaccaccaatgcccctgctagcctctccccacccagcccagagcctactcagcctgccatctcaagagccccaccgagggtcactggcttcctgggaggagtcaccaggctgccagctttccctctgcctccccaaggaacctgagacctccctctgctcatcaccctgggcccaatcctgaatccagcccccatcaaccaagacagcaaaagggccaggtctgtcccttataattttgagccttctccctcaagtttggaagccctgactttaagaaatgccaaatgcaaggaccattaagaaaattctccccgaaatgaggctcctctaacaaatgatgattaaaacgctctctccttgagcagtcacattctagaaacaggacattccatgaggcaggaagagttcagttaatttgctcctgaaaaagtgtggttcagtgtttgtgtggcaatgtacgtgggcagaagaggccgctcaagctgtgtcccccctgagcaggattcaggaaagggaaaagaagttctcttcaactcagccaaggggccgtacgatggccgatgagattatgtatttaaaagttctttgtaaagtgtaaactaaaaaccttaaatgtaagatgctgttgttattattactgttgttgttgctgttatggacatgccaaaaggcccttgttagaagacagttttgccttttcaatctcatagcaaggaactcaagtctgatgcttcaaaaagatgagaagaagggcaagaagagggataactcccaagctcagagggaaaaaaaaggngggggaaaagagccccagggtgaccttcaggaaaggccaggaccaggatgatctaacctttcccttcaccagaaacaaagctattgccagactgaaccctaaagtcaagcagtcacccactgcctttgctgggagcagaagcccatagcaacaagtgacctgcccctcagactcaagatcccagataccagagctggaggagtcatagggcattactggtaggcaggaaaactgagggtcgaacaaatggaagaatgcggtgatcatagaccaaagacacacagataattaaccccatgtgtccacccaggccaaagttcttcctgctaccccacagtggatgtccaggcagatggtccccacatgatggggaagcagagggcatagtgtggttttgtgggacttgttcatgttttgtagtgtgggctcaacagtgccaaaggaaacactagggaaaagttggtgaaacatgccagctagcaggaccagtaaaggcataatcaggcatttggcaaagcttgcttttctaattcaatgataggttctaataggaaatttttgaagattttttaaaacaatgttatagtggcacttccccagtatggaataaataacatgcattcttttttcaatatactgtcatattcagatgtcattaaaataaatggatgagtcacagaggagctatcagatgctctcatgactaccataactcagaaaaaaaca

SEQ ID NO: 342055 - DNA, 8729 bp, Homo sapiens
  misc_feature (5933)..(5933): n is a, c, g, or t
  misc_feature (6141)..(6141): n is a, c, g, or t
  misc_feature (8003)..(8003): n is a, c, g, or t
gcgtctgtgtagttctctcagacagtcagagaggagagacggagcagcgtggcagacaggctggctctgcacgagctcctggcggggaccagcagcgcctgcaagggggtggagggacaggcgctcgggtggcctgggccgccggcccctcacgctgcccccgctcagccttcatgctctcccctgcttttccacaggcaactggacaacaaccacatcagctgcattgaagatggagccttccgagcgctgcgcgatttggagatccttaccctcaacaacaacaacatcagtcgcatcctggtcaccagcttcaaccacatgccgaagatccgaactctgcgcctccactccaaccacctgtactgcgactgccacctggcctggctctcggattggctgcgacagcgacggacagttggccagttcacactctgcatggctcctgtgcatttgaggggcttcaacgtggcggatgtgcagaagaaggagtacgtgtgcccagccccccactcggagcccccatcctgcaatgccaactccatctcctgcccttcgccctgcacgtgcagcaataacatcgtggactgtcgaggaaagggcttgatggagattcctgccaacttgccggagggcatcgtcgaaatacgcctagaacagaactccatcaaagccatccctgcaggagccttcacccagtacaagaaactgaagcgaatagacatcagcaagaatcagatatcggatattgctccagatgccttccagggcctgaaatcactcacatcgctggtcctgtatgggaacaagatcaccgagattgccaagggactgtttgatgggctggtgtccctacagctgctcctcctcaatgccaacaagatcaactgcctgcgggtgaacacgtttcaggacctgcagaacctcaacttgctctccctgtatgacaacaagctgcagaccatcagcaaggggctcttcgcccctctgcagtccatccagacactccacttagcccaaaacccatttgtgtgcgactgccacttgaagtggctggccgactacctccaggacaaccccatcgagacaagcggggcccgctgcagcagcccgcgccgactcgccaacaagcgcatcagccagatcaagagcaagaagttccgctgctcaggctccgaggattaccgcagcaggttcagcagcgagtgcttcatggacctcgtgtgccccgagaagtgtcgctgtgagggcacgattgtggactgctccaaccagaagctggtccgcatcccaagccacctccctgaatatgtcaccgacctgcgactgaatgacaatgaggtatctgttctggaggccactggcatcttcaagaagttgcccaacctgcggaaaataaatctgagtaacaataagatcaaggaggtgcgagagggagctttcgatggagcagccagcgtgcaggagctgatgctgacagggaaccagctggagaccgtgcacgggcgcgtgttccgtggcctcagtggcctcaaaaccttgatgctgaggagtaacttgatcggctgtgtgagtaatgacacctttgccggcctgagttcggtgagactgctgtccctctatgacaatcggatcaccaccatcacccctggggccttcaccacgcttgtctccctgtccaccataaacctcctgtccaaccccttcaactgcaactgccacctggcctggctcggcaagtggttgaggaagaggcggatcgtcagtgggaaccctaggtgccagaagccatttttcctcaaggagattcccatccaggatgtggccatccaggacttcacctgtgatggcaacgaggagagtagctgccagctgagcccgcgctgcccggagcagtgcacctgtatggagacagtggtgcgatgcagcaacaaggggctccgcgccctccccagaggcatgcccaaggatgtgaccgagctgtacctggaaggaaaccacctaacagccgtgcccagagagctgtccgccctccgacacctgacgcttattgacctgagcaacaacagcatcagcatgctgaccaattacaccttcagtaacatgtctcacctctccactctgatcctgagctacaaccggctgaggtgcatccccgtccacgccttcaacgggctgcggtccctgcgagtgctaaccctccatggcaatgacatttccagcgttcctgaaggctccttcaacgacctcacatctctttcccatctggcgctgggaaccaacccactccactgtgactgcagtcttcggtggctgtcggagtgggtgaaggcggggtacaaggagcctggcatcgcccgctgcagtagccctgagcccatggctgacaggctcctgctcaccaccccaacccaccgcttccagtgcaaagggccagtggacatcaacattgtggccaaatgcaatgcctgcctctccagcccgtgcaagaataacgggacatgcacccaggaccctgtggagctgtaccgctgtgcctgcccctacagctacaagggcaaggactgcactgtgcccatcaacacctgcatccagaacccctgtcagcatggaggcacctgccacctgagtgacagccacaaggatgggttcagctgctcctgccctctgggctttgaggggcagcggtgtgagatcaacccagatgactgtgaggacaacgactgcgaaaacaatgccacctgcgtggacgggatcaacaactacgtgtgtatctgtccgcctaactacacaggtgagctatgcgacgaggtgattgaccactgtgtgcctgagctgaacctctgtcagcatgaggccaagtgcatccccctggacaaaggattcagctgcgagtgtgtccctggctacagcgggaagctctgtgagacagacaatgatgactgtgtggcccacaagtgccgccacggggcccagtgcgtggacacaatcaatggctacacatgcacctgcccccagggcttcagtggacccttctgtgaacaccccccacccatggtcctactgcagaccagcccatgcgaccagtacgagtgccagaacggggcccagtgcatcgtggtgcagcaggagcccacctgccgctgcccaccaggcttcgccggccccagatgcgagaagctcatcactgtcaacttcgtgggcaaagactcctacgtggaactggcctccgccaaggtccgaccccaggccaacatctccctgcaggtggccactgacaaggacaacggcatccttctctacaaaggagacaatgaccccctggcactggagctgtaccagggccacgtgcggctggtctatgacagcctgagttcccctccaaccacagtgtacagtgtggagacagtgaatgatgggcagtttcacagtgtggagctggtgacgctaaaccagaccctgaacctagtagtggacaaaggaactccaaagagcctggggaagctccagaagcagccagcagtgggcatcaacagccccctctaccttggaggcatccccacctccaccggcctctccgccttgcgccagggcacggaccggcctctaggcggcttccacggatgcatccatgaggtgcgcatcaacaacgagctgcaggacttcaaggccctcccaccacagtccctgggggtgtcaccaggctgcaagtcctgcaccgtgtgcaagcacggcctgtgccgctccgtggagaaggacagcgtggtgtgcgagtgccgcccaggctggaccggcccactctgcgatcaggaggcccgggacccctgcctcggccacagatgccaccatggaaaatgtgtggcaactgggacctcatacatgtgcaagtgtgccgagggctatggaggggacttgtgtgacaacaagaatgactctgccaatgcctgctcagccttcaagtgtcaccatgggcagtgccacatctcagaccaaggggagccctactgcctgtgccagcccggctttagcggcgagcactgccaacaagactccagcttgatggagttgggacagccatgtgggaccccctggtgattcagcatgaaggaaatgaagctggagaggaaggtaaagaagaagagaatattaagtatattgtaaaataaacaaaaaatagaacttatttttattatggaaagtgactattttcatcttttattatataaatatattacaccatctgcgtatatgtaccatatagtgagttatttttaccaagttttgtgttgtgtatttgttgtgtttttaaaaatagctgtttaaaaatttaagaaaaaaatagactaataaaaatgctttaaaacaaaaggataagaataaagaatgatagcctgtctgaggaaggaggaagatgttttcatgtttatgaaacggtattatgtcggcagtagaccaagagctgctcattgagatcagaaaaaggaataagaggaagagagagaaggaaaagacctttgtttcttgttttttaactcccttttatttttcctcccctaaaattacccagcttttcggagtcctggatgtcagtgcccaaaatgcccagttcttccaggaaaagctgctgagccctggccttctcagtctcactgccactcaaaaatattgctgtccctgtctgtcccagaccccccttcagggtatctgaacccactgggggacccctcttctccttcctgggtggccctggcttccgtatctgaacccactgggggacccctcttctccttcctggctggccctggcttccaatcgaggactgactattgaagtctgctacaggtgtcatttggaactgtcttaccaaattttaaaacagctgctatttttcctgctcctccccaggagaggggtcttcctagaggaggcgagggaagagaatatcatggtgtctcctcaggacccatgcactggccctctctcctccttccaggtaatttttcattggaatgtatcccagtagagaaggtagtcagcccttcttggaagcggaaggctgggagccaagtcaagtctgcccacagcgctagatgtccaactctggaaggttcttggaggctcttgttgtaagacaggcctctgccacctgatcctccaggtcaccagcatgacgatagagactccttgcccatctgtgacactttccaatgcatatccaaactttaccttattttatctatgcaacccctgcctccctgggaaggataagggagtagagctgggttcactaagaaggaagtttaggccctcacaggctctggaacttgccttaagccacacaccagataagtggaggagccagaccagaagtccagacccaaagcttgagattcttcctctagaatgggtgagcacaggtgattcaggcggcttaaatccatcagagcagccctgccggaaaaggaaataatatgatgttttttcctgctcttgttctgccttgctcactccttctccctccgcagtatctggaaagattctggagaccagggcttatgcatctagggaaagtgaccaagggcagcctatccagcctctgcctccattcctgaaggggacttccctgcccctgtttctttccatgtctctccctccctcactcccatttgcccccttccaccccatcaggttagccacatatcttccagggctcagctgttcacaccaactccctggctcttatcatccatccctccttcccccaggagcttccactgtaggagtttcagggagaagagtttggaattcattggacctttcagccctcaggttccctagaggagcctagttgatctgtgagtaccaatggtgggccaaagacgcagggaataatgaagggagaaagaaaagaaaggaagatggaggaaaacgangcaactggaagaagaaggaagggatggaggggatgaagagaagggagagagggatatagctgaggaatttatctaaaaatgtgcatgtaaatctccattatgttccaggtactgtgccttatgatggctttgttttttgttgtcattagagacaaggtcttgctttgtcacccaggctggagtagagtggttcgatcatagctcaccncagcctcaacctcctaggctcaagccatcttcctgcctcagtctcccaaaatgctgggattacaggtgtgagccactatgctcagcctgtttcaaacattattataatagcagatttatttagtactttattatacatcagataccactctaattgtgaaatagatatatattcatttaattattgaaacaaccatgtagttaaaacactattaactcattttacagttgagtagactgagacacagagaagttaaagaacttgcccaagagtaaatgtctaataaaccgtagagccaggatctgggcccaggctgtctgactccagaacttgctcactcaaccactaaaccatcctgcttctcatgggaaagaaacacatcctgcctttgaggatcctacagcctgtgacaaaaacagtcataaaaatggacaattgccttattacacaaggagctcttaagtggcaatacaagcaatggaagtggctgtccagaggagggaacttctagtcctaggtctttaaggatgaataggagtttgccagagtgagaaagggaattgaactttcctgggagtggccttttaaaaagcaatgagatatggccaggcctggcttgtttggggaagagtcaaaatctagggtggcaagagtatgggaagcacactgaggagcagagagaaatggggtaggtaggaaggtagggttttgaccacaaagagctgtgcatgctaaactgggccacaggtgccagcagggttgtttgaggaagggaagagcaagacaagctctggtttaggaagagagctgtggcagcataaaggcctgaaagaggagacagagctgtcacccaaaatggacttgagagctccctgtggtttactctgtggctagaaaacactgccggccagatggatcacaaatgtctatggtagcttagaagctctgctcttgaagaggatcctgggatctgcccaacacccttcccaacctccatttccccatccccacctccattgccccatcccccctctccccctaggcaggtggatctgagccttatcccaccaccaatgcccctgctagcctctccccacccagcccagagcctactcagcctgccatctcaagagccccaccgagggtcactggcttcctgggaggagtcaccaggctgccagctttccctctgcctccccaaggaacctgagacctccctctgctcatcaccctgggcccaatcctgaatccagcccccatcaaccaagacagcaaaagggccaggtctgtcccttataattttgagccttctccctcaagtttggaagccctgactttaagaaatgccaaatgcaaggaccattaagaaaattctccccgaaatgaggctcctctaacaaatgatgattaaaacgctctctccttgagcagtcacattctagaaacaggacattccatgaggcaggaagagttcagttaatttgctcctgaaaaagtgtggttcagtgtttgtgtggcaatgtacgtgggcagaagaggccgctcaagctgtgtcccccctgagcaggattcaggaaagggaaaagaagttctcttcaactcagccaaggggccgtacgatggccgatgagattatgtatttaaaagttctttgtaaagtgtaaactaaaaaccttaaatgtaagatgctgttgttattattactgttgttgttgctgttatggacatgccaaaaggcccttgttagaagacagttttgccttttcaatctcatagcaaggaactcaagtctgatgcttcaaaaagatgagaagaagggcaagaagagggataactcccaagctcagagggaaaaaaaaggngggggaaaagagccccagggtgaccttcaggaaaggccaggaccaggatgatctaacctttcccttcaccagaaacaaagctattgccagactgaaccctaaagtcaagcagtcacccactgcctttgctgggagcagaagcccatagcaacaagtgacctgcccctcagactcaagatcccagataccagagctggaggagtcatagggcattactggtaggcaggaaaactgagggtcgaacaaatggaagaatgcggtgatcatagaccaaagacacacagataattaaccccatgtgtccacccaggccaaagttcttcctgctaccccacagtggatgtccaggcagatggtccccacatgatggggaagcagagggcatagtgtggttttgtgggacttgttcatgttttgtagtgtgggctcaacagtgccaaaggaaacactagggaaaagttggtgaaacatgccagctagcaggaccagtaaaggcataatcaggcatttggcaaagcttgcttttctaattcaatgataggttctaataggaaatttttgaagattttttaaaacaatgttatagtggcacttccccagtatggaataaataacatgcattcttttttcaatatactgtcatattcagatgtcattaaaataaatggatgagtcacagaggagctatcagatgctctcatgactaccataactcagaaaaaaaca

SEQ ID NO: 342056 - DNA, 7161 bp, Homo sapiens
  misc_feature (4365)..(4365): n is a, c, g, or t
  misc_feature (4573)..(4573): n is a, c, g, or t
  misc_feature (6435)..(6435): n is a, c, g, or t
gcgtctgtgtagttctctcagacagtcagagaggagagacggagcagcgtggcagacaggctggctctgcacgagctcctggcggggaccagcagcgcctgcaagggggtggagggacaggcgctcgggtggcctgggccgccggcccctcacgctgcccccgctcagccttcatgctctcccctgcttttccacaggcaactggacaacaaccacatcagctgcattgaagatggagccttccgagcgctgcgcgatttggagatccttaccctcaacaacaacaacatcagtcgcatcctggtcaccagcttcaaccacatgccgaagatccgaactctgcgcctccactccaaccacctgtactgcgactgccacctggcctggctctcggattggctgcgacagcgacggacagttggccagttcacactctgcatggctcctgtgcatttgaggggcttcaacgtggcggatgtgcagaagaaggagtacgtgtgcccagccccccactcggagcccccatcctgcaatgccaactccatctcctgcccttcgccctgcacgtgcagcaataacatcgtggactgtcgaggaaagggcttgatggagattcctgccaacttgccggagggcatcgtcgaaatacgcctagaacagaactccatcaaagccatccctgcaggagccttcacccagtacaagaaactgaagcgaatagacatcagcaagaatcagatatcggatattgctccagatgccttccagggcctgaaatcactcacatcgctggtcctgtatgggaacaagatcaccgagattgccaagggactgtttgatgggctggtgtccctacagctgctcctcctcaatgccaacaagatcaactgcctgcgggtgaacacgtttcaggacctgcagaacctcaacttgctctccctgtatgacaacaagctgcagaccatcagcaaggggctcttcgcccctctgcagtccatccagacactccacttagcccaaaacccatttgtgtgcgactgccacttgaagtggctggccgactacctccaggacaaccccatcgagacaagcggggcccgctgcagcagcccgcgccgactcgccaacaagcgcatcagccagatcaagagcaagaagttccgctgctcaggctccgaggattaccgcagcaggttcagcagcgagtgcttcatggacctcgtgtgccccgagaagtgtcgctgtgagggcacgattgtggactgctccaaccagaagctggtccgcatcccaagccacctccctgaatatgtcaccgacctgcgactgaatgacaatgaggtatctgttctggaggccactggcatcttcaagaagttgcccaacctgcggaaaataaatctgagtaacaataagatcaaggaggtgcgagagggagctttcgatggagcagccagcgtgcaggagctgatgctgacagggaaccagctggagaccgtgcacgggcgcgtgttccgtggcctcagtggcctcaaaaccttgatgctgaggagtaacttgatcggctgtgtgagtaatgacacctttgccggcctgagttcggtgagactgctgtccctctatgacaatcggatcaccaccatcacccctggggccttcaccacgcttgtctccctgtccaccataaacctcctgtccaaccccttcaactgcaactgccacctggcctggctcggcaagtggttgaggaagaggcggatcgtcagtgggaaccctaggtgccagaagccatttttcctcaaggagattcccatccaggatgtggccatccaggacttcacctgtgatggcaacgaggagagtagctgccagctgagcccgcgctgcccggagcagtgcacctgtatggagacagtggtgcgatgcagcaacaaggggctccgcgccctccccagaggcatgcccaaggatgtgaccgagctgtacctggaaggaaaccacctaacagccgtgcccagagagctgtccgccctccgacacctgacgcttattgacctgagcaacaacagcatcagcatgctgaccaattacaccttcagtaacatgtctcacctctccactctgatcctgagctacaaccggctgaggtgcatccccgtccacgccttcaacgggctgcggtccctgcgagtgctaaccctccatggcaatgacatttccagcgttcctgaaggctccttcaacgacctcacatctctttcccatctggcgctgggaaccaacccactccactgtgactgcagtcttcggtggctgtcggagtgggtgaaggcggggtacaaggagcctggcatcgcccgctgcagtagccctgagcccatggctgacaggctcctgctcaccaccccaacccaccgcttccagtgcaaagggccagtggacatcaacattgtggccaaatgcaatgcctgcctctccagactccagcttgatggagttgggacagccatgtgggaccccctggtgattcagcatgaaggaaatgaagctggagaggaaggtaaagaagaagagaatattaagtatattgtaaaataaacaaaaaatagaacttatttttattatggaaagtgactattttcatcttttattatataaatatattacaccatctgcgtatatgtaccatatagtgagttatttttaccaagttttgtgttgtgtatttgttgtgtttttaaaaatagctgtttaaaaatttaagaaaaaaatagactaataaaaatgctttaaaacaaaaggataagaataaagaatgatagcctgtctgaggaaggaggaagatgttttcatgtttatgaaacggtattatgtcggcagtagaccaagagctgctcattgagatcagaaaaaggaataagaggaagagagagaaggaaaagacctttgtttcttgttttttaactcccttttatttttcctcccctaaaattacccagcttttcggagtcctggatgtcagtgcccaaaatgcccagttcttccaggaaaagctgctgagccctggccttctcagtctcactgccactcaaaaatattgctgtccctgtctgtcccagaccccccttcagggtatctgaacccactgggggacccctcttctccttcctgggtggccctggcttccgtatctgaacccactgggggacccctcttctccttcctggctggccctggcttccaatcgaggactgactattgaagtctgctacaggtgtcatttggaactgtcttaccaaattttaaaacagctgctatttttcctgctcctccccaggagaggggtcttcctagaggaggcgagggaagagaatatcatggtgtctcctcaggacccatgcactggccctctctcctccttccaggtaatttttcattggaatgtatcccagtagagaaggtagtcagcccttcttggaagcggaaggctgggagccaagtcaagtctgcccacagcgctagatgtccaactctggaaggttcttggaggctcttgttgtaagacaggcctctgccacctgatcctccaggtcaccagcatgacgatagagactccttgcccatctgtgacactttccaatgcatatccaaactttaccttattttatctatgcaacccctgcctccctgggaaggataagggagtagagctgggttcactaagaaggaagtttaggccctcacaggctctggaacttgccttaagccacacaccagataagtggaggagccagaccagaagtccagacccaaagcttgagattcttcctctagaatgggtgagcacaggtgattcaggcggcttaaatccatcagagcagccctgccggaaaaggaaataatatgatgttttttcctgctcttgttctgccttgctcactccttctccctccgcagtatctggaaagattctggagaccagggcttatgcatctagggaaagtgaccaagggcagcctatccagcctctgcctccattcctgaaggggacttccctgcccctgtttctttccatgtctctccctccctcactcccatttgcccccttccaccccatcaggttagccacatatcttccagggctcagctgttcacaccaactccctggctcttatcatccatccctccttcccccaggagcttccactgtaggagtttcagggagaagagtttggaattcattggacctttcagccctcaggttccctagaggagcctagttgatctgtgagtaccaatggtgggccaaagacgcagggaataatgaagggagaaagaaaagaaaggaagatggaggaaaacgangcaactggaagaagaaggaagggatggaggggatgaagagaagggagagagggatatagctgaggaatttatctaaaaatgtgcatgtaaatctccattatgttccaggtactgtgccttatgatggctttgttttttgttgtcattagagacaaggtcttgctttgtcacccaggctggagtagagtggttcgatcatagctcaccncagcctcaacctcctaggctcaagccatcttcctgcctcagtctcccaaaatgctgggattacaggtgtgagccactatgctcagcctgtttcaaacattattataatagcagatttatttagtactttattatacatcagataccactctaattgtgaaatagatatatattcatttaattattgaaacaaccatgtagttaaaacactattaactcattttacagttgagtagactgagacacagagaagttaaagaacttgcccaagagtaaatgtctaataaaccgtagagccaggatctgggcccaggctgtctgactccagaacttgctcactcaaccactaaaccatcctgcttctcatgggaaagaaacacatcctgcctttgaggatcctacagcctgtgacaaaaacagtcataaaaatggacaattgccttattacacaaggagctcttaagtggcaatacaagcaatggaagtggctgtccagaggagggaacttctagtcctaggtctttaaggatgaataggagtttgccagagtgagaaagggaattgaactttcctgggagtggccttttaaaaagcaatgagatatggccaggcctggcttgtttggggaagagtcaaaatctagggtggcaagagtatgggaagcacactgaggagcagagagaaatggggtaggtaggaaggtagggttttgaccacaaagagctgtgcatgctaaactgggccacaggtgccagcagggttgtttgaggaagggaagagcaagacaagctctggtttaggaagagagctgtggcagcataaaggcctgaaagaggagacagagctgtcacccaaaatggacttgagagctccctgtggtttactctgtggctagaaaacactgccggccagatggatcacaaatgtctatggtagcttagaagctctgctcttgaagaggatcctgggatctgcccaacacccttcccaacctccatttccccatccccacctccattgccccatcccccctctccccctaggcaggtggatctgagccttatcccaccaccaatgcccctgctagcctctccccacccagcccagagcctactcagcctgccatctcaagagccccaccgagggtcactggcttcctgggaggagtcaccaggctgccagctttccctctgcctccccaaggaacctgagacctccctctgctcatcaccctgggcccaatcctgaatccagcccccatcaaccaagacagcaaaagggccaggtctgtcccttataattttgagccttctccctcaagtttggaagccctgactttaagaaatgccaaatgcaaggaccattaagaaaattctccccgaaatgaggctcctctaacaaatgatgattaaaacgctctctccttgagcagtcacattctagaaacaggacattccatgaggcaggaagagttcagttaatttgctcctgaaaaagtgtggttcagtgtttgtgtggcaatgtacgtgggcagaagaggccgctcaagctgtgtcccccctgagcaggattcaggaaagggaaaagaagttctcttcaactcagccaaggggccgtacgatggccgatgagattatgtatttaaaagttctttgtaaagtgtaaactaaaaaccttaaatgtaagatgctgttgttattattactgttgttgttgctgttatggacatgccaaaaggcccttgttagaagacagttttgccttttcaatctcatagcaaggaactcaagtctgatgcttcaaaaagatgagaagaagggcaagaagagggataactcccaagctcagagggaaaaaaaaggngggggaaaagagccccagggtgaccttcaggaaaggccaggaccaggatgatctaacctttcccttcaccagaaacaaagctattgccagactgaaccctaaagtcaagcagtcacccactgcctttgctgggagcagaagcccatagcaacaagtgacctgcccctcagactcaagatcccagataccagagctggaggagtcatagggcattactggtaggcaggaaaactgagggtcgaacaaatggaagaatgcggtgatcatagaccaaagacacacagataattaaccccatgtgtccacccaggccaaagttcttcctgctaccccacagtggatgtccaggcagatggtccccacatgatggggaagcagagggcatagtgtggttttgtgggacttgttcatgttttgtagtgtgggctcaacagtgccaaaggaaacactagggaaaagttggtgaaacatgccagctagcaggaccagtaaaggcataatcaggcatttggcaaagcttgcttttctaattcaatgataggttctaataggaaatttttgaagattttttaaaacaatgttatagtggcacttccccagtatggaataaataacatgcattcttttttcaatatactgtcatattcagatgtcattaaaataaatggatgagtcacagaggagctatcagatgctctcatgactaccataactcagaaaaaaaca

SEQ ID NO: 342057 - DNA, 436 bp, Homo sapiens
gaagctccagaagcagccagcagtgggcatcaacagccccctctaccttggaggtaatgccctctttccctaccacctctacctccctctggccctctgtgctccagtacagaaacccaggccactgccaaagccaatcagggaaggcttcctggaggaagggacaacgaagctgatctctaaaaggtgaataagcactagccaggccatggaggaaagagaatgtgggacaggtgcttggaaaggaaagagaacaggactcctggaaactacacgttgtgacgggcaagggtgagaagggggaggcaggagatggaagcagggtctaggctctgctgaagtctgccagcttcaggtcatattccctctgctctgccacctcctcaaaccctcggaggttcaattaatgaatgtagaagaatttgagattaaaatc

SEQ ID NO: 342058 - DNA, 339 bp, Homo sapiens
ctgtactgtttttatttttgcaacttatgtaagtttaaagttatttccaaataaaaagtaaaacaaaatgtaagcaatgcaggtcaagtccacagcacagggcccagccatggaaggcccttagtgaactctccggctttctccccttctctactggccagtgtggagacagtgaatgatgggcagtttcacagtgtggagctggtgacgctaaaccagaccctgaacctagtagtggacaaaggaactccaaagagcctggggaagctccagaagcagccagcagtgggcatcaacagccccctctaccttggaggtaatgccctctttccctaccac

SEQ ID NO: 342059 - DNA, 4227 bp, Homo sapiens
  misc_feature (1)..(1): n is a, c, g, or t
  misc_feature (849)..(849): n is a, c, g, or t
  misc_feature (944)..(944): n is a, c, g, or t
nctggagtgcatttttaatctacaccctcgtgaggtttgagaagcactggtcaagagtcatcccagtgcccagaatcagttctaggagcagctgctgtggctagggacaggtcatgcatggaggtcagtgggcagctggagccatctcccatctgccttccagctcaatgccctgcattgtgcctccatcacaacaaaatagcagagggggccttgagctgataggagacttgagatgcttgctctgtgcccaaatggctgtgtccagtcacttatggctccaggtacttcacctctcagggctgctgtttccttcttgcagaattaagaattaagacgcagtttgccaaatgttctcacttatacatggaatctaaacaaagccaaactcttagaagcagaaagtagaatggtgatgttcagaggccggtggggtgagggtggggtagagatgaagatgacacagatgttcgtcaaagggtgcaaaatttcaggtagacaggagaagtaagttcaagagatccattgtgttatacaacacggtgaatgtagttaacaacaatgtatcgtatacttgaaaatagctcagagagtagattttaagtgttcttaccacaaataaatgataagcatgtgaggtaatgcataggttaagtagcttgacttagctattccacaatgaaagcatatatcaaaacattgtgttgcacaccaaatatgtatacatttttaaaagactagttgagtacagtagtgaaaaaggaggaaagagtagaacaaggagtttgatctgtaactgactgtgaacaatccattgagagaactcactacctttgaaccagcctaaanatgcagtttttataataataaagaaaaagacaaagtgaccaaggtcaattcccagctaaactgtctatcacttctccaattcccactctccagcncctccaaaccgtggggcatctcacctcatactgtagggagagatgggtccagaagtctagttgtggactgaaaaccagtttgccctcccagagctaaagcagagggtttccgtgctggccacatagcttcctcttgcaactagaggtctcagcaccttgaagggacaattcataatcaggggaaaaaaagacaacacaggccttcccgctagtccagtctaaacagatccttcgtgtttgtctggaatgctttgcataggcagccatgctgagggcaagtgagattaggataatccagagtatttgcttgttaagacccttaaacaaaaccggagcgcggaagaaaagcccggtgtaagctgacgagtttgtgagtgcaatctgcggatttgtcggaggtgatttcgccagctaaagggataaactagacagctgtgccgaagagccttaacctgtgaaatatcgttcaaagtacaggctttggaggcagggaggggaggaagtagaggcctcagcaaaggttgtggcatggttcttttgaaatctattagaagaaggaaggaaacaggctcagagagattcccactgcatgtgcttaagaggctggagtgtctggcttcgctggagtcaattgcttaagaatctgctctgttgtgcttttttttctccacattctctcttcacctccttgttgaccttccaagatcccagctctcccacttctgcacaaaagcaaagacccatttatttattttgttaaagaaaaggaactggagaggtttgatgtcgcaggaaattggagcatctctccttccagtgacaggatcccagaggccatccctgagctaatgactctaagagaaagaatttcccctcagtgaagggccattagcaagagctggtgtccaggttctcagaagtcactgggatgcccgtaattgagcagcctcagggcctctgggaaggagccagggtcgaggagattcctttgcacctgcaaagcctggttagctgccccagaccccgggcccagcattaatagaatcctcctggcccacagcatccctcttgctctcattatccaaagcctgggacattcttatgccctggacttgctcccagatgaggaacacactgccagccagtgacaagcccacatctccaaggcgtccctgagaatcccaggatgtgcttacatcacacagcctagagtttgcaccagaccagacagagacttaagtcactgctcaaaagctcctttcaggtcagggaggaaaagtcactggggaggtgaaatgactctggactttctgggagaaaaatgagcagctgctgaggcatgaggcaagaagatgatgcctacaggaaccctggcttgtggttggttgggtgaagccggttcctgtttcatctgtgtcgttaattgcttggtaatgaaacgtaaggccctaatttgactgggctcaattttccacctacaaagtgatggttcacgtgttcacagcctcgtgtcccgatgaagatgccacgggtgagtattctttgaaaaccaagaagagtgatgtaaatgtggtgcactttatcatgaggtagttgaactgaaggctctttaagctccttctcttgcactatgagtaaatgaattgcttgattgattgattaatccttaccattttgaatgtctgaaatgcttgattcacacttaggagtgaccgttatcgcacctttgagccatgttctcagactttaccgttaacgttttcagagacatcagcaagaatcagatatcggatattgctccagatgccttccagggcctgaaatcactcacatcgctggtcctgtatgggaacaagatcaccgagattgccaagggactgtttgatgggctggtgtccctacagctgctcctcctcaatgccaacaagatcaactgcctgcgggtgaacacgtttcaggacctgcagaacctcaacttgctctccctgtatgacaacaagctgcagaccatcagcaaggggctcttcgcccctctgcagtccatccagacactccacttagcccaaaacccatttgtgtgcgactgccacttgaagtggctggccgactacctccaggacaaccccatcgagacaagcggggcccgctgcagcagcccgcgccgactcgccaacaagcgcatcagccagatcaagagcaagaagttccgctgctcaggctccgaggattaccgcagcaggttcagcagcgagtgcttcatggacctcgtgtgccccgagaagtgtcgctgtgagggcacgattgtggactgctccaaccagaagctggtccgcatcccaagccacctccctgaatatgtcaccgacctgcgactgaatgacaatgaggtatctgttctggaggccactggcatcttcaagaagttgcccaacctgcggaaaataaatctgagtaacaataagatcaaggaggtgcgagagggagctttcgatggagcagccagcgtgcaggagctgatgctgacagggaaccagctggagaccgtgcacgggcgcgtgttccgtggcctcagtggcctcaaaaccttgatgctgaggagtaacttgatcggctgtgtgagtaatgacacctttgccggcctgagttcggtgagactgctgtccctctatgacaatcggatcaccaccatcacccctggggccttcaccacgcttgtctccctgtccaccatgtaagttctcctgggtccactgcccacggactctgggatcccactctgcagcgctctctcctcccagctccctgctacctctagccaggctcatctatctgtctgtccacttaaaaactcgtcaggctttctgtatgtgccaggcaggcatcgtctaggtgttgaggctgcacacacccggcccctccttcctggaactcacagcatagtgaattgccacagaaagcatgtccacagtgatttgaaaacccaagctggaaggccaggcatggtggctcacgcctgtaatcctaacactttgggaggctgaggtgggtggatcacctgaggtgaggaattcgaaaccagcctgaccaacatggtgaaaccccttctctactaaaaattcaaaagttagccagttatggtggtgagtatccgtaatcccagctacctgggagactgaggcaggacagttgctggaacccgggaggcggaggctgcagtgagctgagatcatgccactgcattccagcctaggcgacagagcaagattccgtgtcaaaaaaaaaa

SEQ ID NO: 342060 - DNA, 490 bp, Homo sapiens
acaaaaaatagctggtacctgtttgagcggctgagcccgcgctgcccggagcagtgcacctgtatggagacagtggtgcgatgcagcaacaaggggctccgcgccctccccagaggcatgcccaaggatgtgaccgagctgtaagtacccccagctgcctccaagcaccctgtcatctcaccatcagcagcatcctccatactttaccccagaatctcaagcaaggctacatggcgaaactgccggggggtagaccctacttgaatggtatcccagcaagtatggcagtggagccctcaccaagtatggcagccatggtctttgacaagggcacaggaaacatggctcccacagtgtctctgcctggcagaggaggagtctctgaccctgtaattctctaaagataccctgtagtataagtgggagggttattgcctcattttccgtatcacacctgaaacctctgctccgtacaccctcttcctaagac

SEQ ID NO: 342061 - DNA, 8202 bp, Homo sapiens
  misc_feature (5406)..(5406): n is a, c, g, or t
  misc_feature (5614)..(5614): n is a, c, g, or t
  misc_feature (7476)..(7476): n is a, c, g, or t
gcgctccgcacctgggcactcccagcgatgcgcagcggggcagcgccggccccgccgatggagctgctgttgctgccgccgccgccgcccggagcgccccgctccgcccgcgccccgtgcgcctgagcaccgagctcgcccctcctccgcgctaactccgccgcccgctccccaggccgcccgcgctccccgcgcgcctcctcgggctccacgcgtcttgccccgcagaggcagcctcctccaggagcggggccctgcacaccatggcccccgggtgggcaggggtcggcgccgccgtgcgcgcccgcctggcgctggccttggcgctggcgagcgtcctgagtgggcctccagccgtcgcctgccccaccaagtgtacctgctccgctgccagcgtggactgccacgggctgggcctccgcgcggttcctcggggcatcccccgcaacgctgagcgccttgacctggacagaaataatatcaccaggatcaccaagatggacttcgctgggctcaagaacctccgagtcttgcatctggaagacaaccaggtcagcgtcatcgagagaggcgccttccaggacctgaagcagctagagcgactgcgcctgaacaagaataagctgcaagtccttccagaattgcttttccagagcacgccgaagctcaccagactagatttgagtgaaaaccagatccaggggatcccgaggaaggcgttccgcggcatcaccgatgtgaagaacctgcaactggacaacaaccacatcagctgcattgaagatggagccttccgagcgctgcgcgatttggagatccttaccctcaacaacaacaacatcagtcgcatcctggtcaccagcttcaaccacatgccgaagatccgaactctaaacctcctgtccaaccccttcaactgcaactgccacctggcctggctcggcaagtggttgaggaagaggcggatcgtcagtgggaaccctaggtgccagaagccatttttcctcaaggagattcccatccaggatgtggccatccaggacttcacctgtgatggcaacgaggagagtagctgccagctgagcccgcgctgcccggagcagtgcacctgtatggagacagtggtgcgatgcagcaacaaggggctccgcgccctccccagaggcatgcccaaggatgtgaccgagctgtacctggaaggaaaccacctaacagccgtgcccagagagctgtccgccctccgacacctgacgcttattgacctgagcaacaacagcatcagcatgctgaccaattacaccttcagtaacatgtctcacctctccactctgatcctgagctacaaccggctgaggtgcatccccgtccacgccttcaacgggctgcggtccctgcgagtgctaaccctccatggcaatgacatttccagcgttcctgaaggctccttcaacgacctcacatctctttcccatctggcgctgggaaccaacccactccactgtgactgcagtcttcggtggctgtcggagtgggtgaaggcggggtacaaggagcctggcatcgcccgctgcagtagccctgagcccatggctgacaggctcctgctcaccaccccaacccaccgcttccagtgcaaagggccagtggacatcaacattgtggccaaatgcaatgcctgcctctccagcccgtgcaagaataacgggacatgcacccaggaccctgtggagctgtaccgctgtgcctgcccctacagctacaagggcaaggactgcactgtgcccatcaacacctgcatccagaacccctgtcagcatggaggcacctgccacctgagtgacagccacaaggatgggttcagctgctcctgccctctgggctttgaggggcagcggtgtgagatcaacccagatgactgtgaggacaacgactgcgaaaacaatgccacctgcgtggacgggatcaacaactacgtgtgtatctgtccgcctaactacacaggtgagctatgcgacgaggtgattgaccactgtgtgcctgagctgaacctctgtcagcatgaggccaagtgcatccccctggacaaaggattcagctgcgagtgtgtccctggctacagcgggaagctctgtgagacagacaatgatgactgtgtggcccacaagtgccgccacggggcccagtgcgtggacacaatcaatggctacacatgcacctgcccccagggcttcagtggacccttctgtgaacaccccccacccatggtcctactgcagaccagcccatgcgaccagtacgagtgccagaacggggcccagtgcatcgtggtgcagcaggagcccacctgccgctgcccaccaggcttcgccggccccagatgcgagaagctcatcactgtcaacttcgtgggcaaagactcctacgtggaactggcctccgccaaggtccgaccccaggccaacatctccctgcaggtggccactgacaaggacaacggcatccttctctacaaaggagacaatgaccccctggcactggagctgtaccagggccacgtgcggctggtctatgacagcctgagttcccctccaaccacagtgtacagtgtggagacagtgaatgatgggcagtttcacagtgtggagctggtgacgctaaaccagaccctgaacctagtagtggacaaaggaactccaaagagcctggggaagctccagaagcagccagcagtgggcatcaacagccccctctaccttggaggcatccccacctccaccggcctctccgccttgcgccagggcacggaccggcctctaggcggcttccacggatgcatccatgaggtgcgcatcaacaacgagctgcaggacttcaaggccctcccaccacagtccctgggggtgtcaccaggctgcaagtcctgcaccgtgtgcaagcacggcctgtgccgctccgtggagaaggacagcgtggtgtgcgagtgccgcccaggctggaccggcccactctgcgatcaggaggcccgggacccctgcctcggccacagatgccaccatggaaaatgtgtggcaactgggacctcatacatgtgcaagtgtgccgagggctatggaggggacttgtgtgacaacaagaatgactctgccaatgcctgctcagccttcaagtgtcaccatgggcagtgccacatctcagaccaaggggagccctactgcctgtgccagcccggctttagcggcgagcactgccaacaagagaatccgtgcctgggacaagtagtccgagaggtgatccgccgccagaaaggttatgcatcatgtgccacagcctccaaggtgcccatcatggaatgtcgtgggggctgtgggccccagtgctgccagcccacccgcagcaagcggcggaaatacgtcttccagtgcacggacggctcctcgtttgtagaagaggtggagagacacttagagtgcggctgcctcgcgtgttcctaagcccctgcccgcctgcctgccacctctcggactccagcttgatggagttgggacagccatgtgggaccccctggtgattcagcatgaaggaaatgaagctggagaggaaggtaaagaagaagagaatattaagtatattgtaaaataaacaaaaaatagaacttatttttattatggaaagtgactattttcatcttttattatataaatatattacaccatctgcgtatatgtaccatatagtgagttatttttaccaagttttgtgttgtgtatttgttgtgtttttaaaaatagctgtttaaaaatttaagaaaaaaatagactaataaaaatgctttaaaacaaaaggataagaataaagaatgatagcctgtctgaggaaggaggaagatgttttcatgtttatgaaacggtattatgtcggcagtagaccaagagctgctcattgagatcagaaaaaggaataagaggaagagagagaaggaaaagacctttgtttcttgttttttaactcccttttatttttcctcccctaaaattacccagcttttcggagtcctggatgtcagtgcccaaaatgcccagttcttccaggaaaagctgctgagccctggccttctcagtctcactgccactcaaaaatattgctgtccctgtctgtcccagaccccccttcagggtatctgaacccactgggggacccctcttctccttcctgggtggccctggcttccgtatctgaacccactgggggacccctcttctccttcctggctggccctggcttccaatcgaggactgactattgaagtctgctacaggtgtcatttggaactgtcttaccaaattttaaaacagctgctatttttcctgctcctccccaggagaggggtcttcctagaggaggcgagggaagagaatatcatggtgtctcctcaggacccatgcactggccctctctcctccttccaggtaatttttcattggaatgtatcccagtagagaaggtagtcagcccttcttggaagcggaaggctgggagccaagtcaagtctgcccacagcgctagatgtccaactctggaaggttcttggaggctcttgttgtaagacaggcctctgccacctgatcctccaggtcaccagcatgacgatagagactccttgcccatctgtgacactttccaatgcatatccaaactttaccttattttatctatgcaacccctgcctccctgggaaggataagggagtagagctgggttcactaagaaggaagtttaggccctcacaggctctggaacttgccttaagccacacaccagataagtggaggagccagaccagaagtccagacccaaagcttgagattcttcctctagaatgggtgagcacaggtgattcaggcggcttaaatccatcagagcagccctgccggaaaaggaaataatatgatgttttttcctgctcttgttctgccttgctcactccttctccctccgcagtatctggaaagattctggagaccagggcttatgcatctagggaaagtgaccaagggcagcctatccagcctctgcctccattcctgaaggggacttccctgcccctgtttctttccatgtctctccctccctcactcccatttgcccccttccaccccatcaggttagccacatatcttccagggctcagctgttcacaccaactccctggctcttatcatccatccctccttcccccaggagcttccactgtaggagtttcagggagaagagtttggaattcattggacctttcagccctcaggttccctagaggagcctagttgatctgtgagtaccaatggtgggccaaagacgcagggaataatgaagggagaaagaaaagaaaggaagatggaggaaaacgangcaactggaagaagaaggaagggatggaggggatgaagagaagggagagagggatatagctgaggaatttatctaaaaatgtgcatgtaaatctccattatgttccaggtactgtgccttatgatggctttgttttttgttgtcattagagacaaggtcttgctttgtcacccaggctggagtagagtggttcgatcatagctcaccncagcctcaacctcctaggctcaagccatcttcctgcctcagtctcccaaaatgctgggattacaggtgtgagccactatgctcagcctgtttcaaacattattataatagcagatttatttagtactttattatacatcagataccactctaattgtgaaatagatatatattcatttaattattgaaacaaccatgtagttaaaacactattaactcattttacagttgagtagactgagacacagagaagttaaagaacttgcccaagagtaaatgtctaataaaccgtagagccaggatctgggcccaggctgtctgactccagaacttgctcactcaaccactaaaccatcctgcttctcatgggaaagaaacacatcctgcctttgaggatcctacagcctgtgacaaaaacagtcataaaaatggacaattgccttattacacaaggagctcttaagtggcaatacaagcaatggaagtggctgtccagaggagggaacttctagtcctaggtctttaaggatgaataggagtttgccagagtgagaaagggaattgaactttcctgggagtggccttttaaaaagcaatgagatatggccaggcctggcttgtttggggaagagtcaaaatctagggtggcaagagtatgggaagcacactgaggagcagagagaaatggggtaggtaggaaggtagggttttgaccacaaagagctgtgcatgctaaactgggccacaggtgccagcagggttgtttgaggaagggaagagcaagacaagctctggtttaggaagagagctgtggcagcataaaggcctgaaagaggagacagagctgtcacccaaaatggacttgagagctccctgtggtttactctgtggctagaaaacactgccggccagatggatcacaaatgtctatggtagcttagaagctctgctcttgaagaggatcctgggatctgcccaacacccttcccaacctccatttccccatccccacctccattgccccatcccccctctccccctaggcaggtggatctgagccttatcccaccaccaatgcccctgctagcctctccccacccagcccagagcctactcagcctgccatctcaagagccccaccgagggtcactggcttcctgggaggagtcaccaggctgccagctttccctctgcctccccaaggaacctgagacctccctctgctcatcaccctgggcccaatcctgaatccagcccccatcaaccaagacagcaaaagggccaggtctgtcccttataattttgagccttctccctcaagtttggaagccctgactttaagaaatgccaaatgcaaggaccattaagaaaattctccccgaaatgaggctcctctaacaaatgatgattaaaacgctctctccttgagcagtcacattctagaaacaggacattccatgaggcaggaagagttcagttaatttgctcctgaaaaagtgtggttcagtgtttgtgtggcaatgtacgtgggcagaagaggccgctcaagctgtgtcccccctgagcaggattcaggaaagggaaaagaagttctcttcaactcagccaaggggccgtacgatggccgatgagattatgtatttaaaagttctttgtaaagtgtaaactaaaaaccttaaatgtaagatgctgttgttattattactgttgttgttgctgttatggacatgccaaaaggcccttgttagaagacagttttgccttttcaatctcatagcaaggaactcaagtctgatgcttcaaaaagatgagaagaagggcaagaagagggataactcccaagctcagagggaaaaaaaaggngggggaaaagagccccagggtgaccttcaggaaaggccaggaccaggatgatctaacctttcccttcaccagaaacaaagctattgccagactgaaccctaaagtcaagcagtcacccactgcctttgctgggagcagaagcccatagcaacaagtgacctgcccctcagactcaagatcccagataccagagctggaggagtcatagggcattactggtaggcaggaaaactgagggtcgaacaaatggaagaatgcggtgatcatagaccaaagacacacagataattaaccccatgtgtccacccaggccaaagttcttcctgctaccccacagtggatgtccaggcagatggtccccacatgatggggaagcagagggcatagtgtggttttgtgggacttgttcatgttttgtagtgtgggctcaacagtgccaaaggaaacactagggaaaagttggtgaaacatgccagctagcaggaccagtaaaggcataatcaggcatttggcaaagcttgcttttctaattcaatgataggttctaataggaaatttttgaagattttttaaaacaatgttatagtggcacttccccagtatggaataaataacatgcattcttttttcaatatactgtcatattcagatgtcattaaaataaatggatgagtcacagaggagctatcagatgctctcatgactaccataactcagaaaaaaaca

SEQ ID NO: 342062 - DNA, 7185 bp, Homo sapiens
  misc_feature (4389)..(4389): n is a, c, g, or t
  misc_feature (4597)..(4597): n is a, c, g, or t
  misc_feature (6459)..(6459): n is a, c, g, or t
ttttttttgctcacacccatttatttcccattagctttacacattgtgagtactcatcattggacaggagagagaggtgacgaacaagctggttagaaagccagcctgccacagaacttgagtaaactgaggaaataaagccagtgcgcttcctggattggtgaagaggtttcttgtccctttaggggatgttctgtcaatatatcaacattgaaaagataaaccatttgctttgtttcacaacgtgaacagtgcacctatgcatggtagagaatagaaagacacaacagggcacatgcctccttttccacaggatcctgagctacaaccggctgaggtgcatccccgtccacgccttcaacgggctgcggtccctgcgagtgctaaccctccatggcaatgacatttccagcgttcctgaaggctccttcaacgacctcacatctctttcccatctggcgctgggaaccaacccactccactgtgactgcagtcttcggtggctgtcggagtgggtgaaggcggggtacaaggagcctggcatcgcccgctgcagtagccctgagcccatggctgacaggctcctgctcaccaccccaacccaccgcttccagtgcaaagggccagtggacatcaacattgtggccaaatgcaatgcctgcctctccagcccgtgcaagaataacgggacatgcacccaggaccctgtggagctgtaccgctgtgcctgcccctacagctacaagggcaaggactgcactgtgcccatcaacacctgcatccagaacccctgtcagcatggaggcacctgccacctgagtgacagccacaaggatgggttcagctgctcctgccctctgggctttgaggggcagcggtgtgagatcaacccagatgactgtgaggacaacgactgcgaaaacaatgccacctgcgtggacgggatcaacaactacgtgtgtatctgtccgcctaactacacaggtgagctatgcgacgaggtgattgaccactgtgtgcctgagctgaacctctgtcagcatgaggccaagtgcatccccctggacaaaggattcagctgcgagtgtgtccctggctacagcgggaagctctgtgagacagacaatgatgactgtgtggcccacaagtgccgccacggggcccagtgcgtggacacaatcaatggctacacatgcacctgcccccagggcttcagtggacccttctgtgaacaccccccacccatggtcctactgcagaccagcccatgcgaccagtacgagtgccagaacggggcccagtgcatcgtggtgcagcaggagcccacctgccgctgcccaccaggcttcgccggccccagatgcgagaagctcatcactgtcaacttcgtgggcaaagactcctacgtggaactggcctccgccaaggtccgaccccaggccaacatctccctgcaggtggccactgacaaggacaacggcatccttctctacaaaggagacaatgaccccctggcactggagctgtaccagggccacgtgcggctggtctatgacagcctgagttcccctccaaccacagtgtacagtgtggagacagtgaatgatgggcagtttcacagtgtggagctggtgacgctaaaccagaccctgaacctagtagtggacaaaggaactccaaagagcctggggaagctccagaagcagccagcagtgggcatcaacagccccctctaccttggaggcatccccacctccaccggcctctccgccttgcgccagggcacggaccggcctctaggcggcttccacggatgcatccatgaggtgcgcatcaacaacgagctgcaggacttcaaggccctcccaccacagtccctgggggtgtcaccaggctgcaagtcctgcaccgtgtgcaagcacggcctgtgccgctccgtggagaaggacagcgtggtgtgcgagtgccgcccaggctggaccggcccactctgcgatcaggaggcccgggacccctgcctcggccacagatgccaccatggaaaatgtgtggcaactgggacctcatacatgtgcaagtgtgccgagggctatggaggggacttgtgtgacaacaagaatgactctgccaatgcctgctcagccttcaagtgtcaccatgggcagtgccacatctcagaccaaggggagccctactgcctgtgccagcccggctttagcggcgagcactgccaacaagagaatccgtgcctgggacaagtagtccgagaggtgatccgccgccagaaaggttatgcatcatgtgccacagcctccaaggtgcccatcatggaatgtcgtgggggctgtgggccccagtgctgccagcccacccgcagcaagcggcggaaatacgtcttccagtgcacggacggctcctcgtttgtagaagaggtggagagacacttagagtgcggctgcctcgcgtgttcctaagcccctgcccgcctgcctgccacctctcggactccagcttgatggagttgggacagccatgtgggaccccctggtgattcagcatgaaggaaatgaagctggagaggaaggtaaagaagaagagaatattaagtatattgtaaaataaacaaaaaatagaacttatttttattatggaaagtgactattttcatcttttattatataaatatattacaccatctgcgtatatgtaccatatagtgagttatttttaccaagttttgtgttgtgtatttgttgtgtttttaaaaatagctgtttaaaaatttaagaaaaaaatagactaataaaaatgctttaaaacaaaaggataagaataaagaatgatagcctgtctgaggaaggaggaagatgttttcatgtttatgaaacggtattatgtcggcagtagaccaagagctgctcattgagatcagaaaaaggaataagaggaagagagagaaggaaaagacctttgtttcttgttttttaactcccttttatttttcctcccctaaaattacccagcttttcggagtcctggatgtcagtgcccaaaatgcccagttcttccaggaaaagctgctgagccctggccttctcagtctcactgccactcaaaaatattgctgtccctgtctgtcccagaccccccttcagggtatctgaacccactgggggacccctcttctccttcctgggtggccctggcttccgtatctgaacccactgggggacccctcttctccttcctggctggccctggcttccaatcgaggactgactattgaagtctgctacaggtgtcatttggaactgtcttaccaaattttaaaacagctgctatttttcctgctcctccccaggagaggggtcttcctagaggaggcgagggaagagaatatcatggtgtctcctcaggacccatgcactggccctctctcctccttccaggtaatttttcattggaatgtatcccagtagagaaggtagtcagcccttcttggaagcggaaggctgggagccaagtcaagtctgcccacagcgctagatgtccaactctggaaggttcttggaggctcttgttgtaagacaggcctctgccacctgatcctccaggtcaccagcatgacgatagagactccttgcccatctgtgacactttccaatgcatatccaaactttaccttattttatctatgcaacccctgcctccctgggaaggataagggagtagagctgggttcactaagaaggaagtttaggccctcacaggctctggaacttgccttaagccacacaccagataagtggaggagccagaccagaagtccagacccaaagcttgagattcttcctctagaatgggtgagcacaggtgattcaggcggcttaaatccatcagagcagccctgccggaaaaggaaataatatgatgttttttcctgctcttgttctgccttgctcactccttctccctccgcagtatctggaaagattctggagaccagggcttatgcatctagggaaagtgaccaagggcagcctatccagcctctgcctccattcctgaaggggacttccctgcccctgtttctttccatgtctctccctccctcactcccatttgcccccttccaccccatcaggttagccacatatcttccagggctcagctgttcacaccaactccctggctcttatcatccatccctccttcccccaggagcttccactgtaggagtttcagggagaagagtttggaattcattggacctttcagccctcaggttccctagaggagcctagttgatctgtgagtaccaatggtgggccaaagacgcagggaataatgaagggagaaagaaaagaaaggaagatggaggaaaacgangcaactggaagaagaaggaagggatggaggggatgaagagaagggagagagggatatagctgaggaatttatctaaaaatgtgcatgtaaatctccattatgttccaggtactgtgccttatgatggctttgttttttgttgtcattagagacaaggtcttgctttgtcacccaggctggagtagagtggttcgatcatagctcaccncagcctcaacctcctaggctcaagccatcttcctgcctcagtctcccaaaatgctgggattacaggtgtgagccactatgctcagcctgtttcaaacattattataatagcagatttatttagtactttattatacatcagataccactctaattgtgaaatagatatatattcatttaattattgaaacaaccatgtagttaaaacactattaactcattttacagttgagtagactgagacacagagaagttaaagaacttgcccaagagtaaatgtctaataaaccgtagagccaggatctgggcccaggctgtctgactccagaacttgctcactcaaccactaaaccatcctgcttctcatgggaaagaaacacatcctgcctttgaggatcctacagcctgtgacaaaaacagtcataaaaatggacaattgccttattacacaaggagctcttaagtggcaatacaagcaatggaagtggctgtccagaggagggaacttctagtcctaggtctttaaggatgaataggagtttgccagagtgagaaagggaattgaactttcctgggagtggccttttaaaaagcaatgagatatggccaggcctggcttgtttggggaagagtcaaaatctagggtggcaagagtatgggaagcacactgaggagcagagagaaatggggtaggtaggaaggtagggttttgaccacaaagagctgtgcatgctaaactgggccacaggtgccagcagggttgtttgaggaagggaagagcaagacaagctctggtttaggaagagagctgtggcagcataaaggcctgaaagaggagacagagctgtcacccaaaatggacttgagagctccctgtggtttactctgtggctagaaaacactgccggccagatggatcacaaatgtctatggtagcttagaagctctgctcttgaagaggatcctgggatctgcccaacacccttcccaacctccatttccccatccccacctccattgccccatcccccctctccccctaggcaggtggatctgagccttatcccaccaccaatgcccctgctagcctctccccacccagcccagagcctactcagcctgccatctcaagagccccaccgagggtcactggcttcctgggaggagtcaccaggctgccagctttccctctgcctccccaaggaacctgagacctccctctgctcatcaccctgggcccaatcctgaatccagcccccatcaaccaagacagcaaaagggccaggtctgtcccttataattttgagccttctccctcaagtttggaagccctgactttaagaaatgccaaatgcaaggaccattaagaaaattctccccgaaatgaggctcctctaacaaatgatgattaaaacgctctctccttgagcagtcacattctagaaacaggacattccatgaggcaggaagagttcagttaatttgctcctgaaaaagtgtggttcagtgtttgtgtggcaatgtacgtgggcagaagaggccgctcaagctgtgtcccccctgagcaggattcaggaaagggaaaagaagttctcttcaactcagccaaggggccgtacgatggccgatgagattatgtatttaaaagttctttgtaaagtgtaaactaaaaaccttaaatgtaagatgctgttgttattattactgttgttgttgctgttatggacatgccaaaaggcccttgttagaagacagttttgccttttcaatctcatagcaaggaactcaagtctgatgcttcaaaaagatgagaagaagggcaagaagagggataactcccaagctcagagggaaaaaaaaggngggggaaaagagccccagggtgaccttcaggaaaggccaggaccaggatgatctaacctttcccttcaccagaaacaaagctattgccagactgaaccctaaagtcaagcagtcacccactgcctttgctgggagcagaagcccatagcaacaagtgacctgcccctcagactcaagatcccagataccagagctggaggagtcatagggcattactggtaggcaggaaaactgagggtcgaacaaatggaagaatgcggtgatcatagaccaaagacacacagataattaaccccatgtgtccacccaggccaaagttcttcctgctaccccacagtggatgtccaggcagatggtccccacatgatggggaagcagagggcatagtgtggttttgtgggacttgttcatgttttgtagtgtgggctcaacagtgccaaaggaaacactagggaaaagttggtgaaacatgccagctagcaggaccagtaaaggcataatcaggcatttggcaaagcttgcttttctaattcaatgataggttctaataggaaatttttgaagattttttaaaacaatgttatagtggcacttccccagtatggaataaataacatgcattcttttttcaatatactgtcatattcagatgtcattaaaataaatggatgagtcacagaggagctatcagatgctctcatgactaccataactcagaaaaaaaca

SEQ ID NO: 342063 - DNA, 5301 bp, Homo sapiens
  misc_feature (2505)..(2505): n is a, c, g, or t
  misc_feature (2713)..(2713): n is a, c, g, or t
  misc_feature (4575)..(4575): n is a, c, g, or t
acatgtagggtgatccaaattggtctggggtcaggatttggcccacagtctatcagtttgcgtcatctagttttagttttgactttaggtttcttgaaggaagggaccaagcctgcttttgtcatcattatatcctcacggcttaggtgtaagcctgtcagagagcctggtacaggaaaggcacctgtttgtaaaatagatgggtggatggaggggagggtaggcagatggatgagtgaataaattcttacagtcttcagagcacaagtatttcaaagcagcctacctgggaactgctcatggtcctgctggccacctagaccaccaatgccctgacttctatgccctctgcagagaatccgtgcctgggacaagtagtccgagaggtgatccgccgccagaaaggttatgcatcatgtgccacagcctccaaggtgcccatcatggaatgtcgtgggggctgtgggccccagtgctgccagcccacccgcagcaagcggcggaaatacgtcttccagtgcacggacggctcctcgtttgtagaagaggtggagagacacttagagtgcggctgcctcgcgtgttcctaagcccctgcccgcctgcctgccacctctcggactccagcttgatggagttgggacagccatgtgggaccccctggtgattcagcatgaaggaaatgaagctggagaggaaggtaaagaagaagagaatattaagtatattgtaaaataaacaaaaaatagaacttatttttattatggaaagtgactattttcatcttttattatataaatatattacaccatctgcgtatatgtaccatatagtgagttatttttaccaagttttgtgttgtgtatttgttgtgtttttaaaaatagctgtttaaaaatttaagaaaaaaatagactaataaaaatgctttaaaacaaaaggataagaataaagaatgatagcctgtctgaggaaggaggaagatgttttcatgtttatgaaacggtattatgtcggcagtagaccaagagctgctcattgagatcagaaaaaggaataagaggaagagagagaaggaaaagacctttgtttcttgttttttaactcccttttatttttcctcccctaaaattacccagcttttcggagtcctggatgtcagtgcccaaaatgcccagttcttccaggaaaagctgctgagccctggccttctcagtctcactgccactcaaaaatattgctgtccctgtctgtcccagaccccccttcagggtatctgaacccactgggggacccctcttctccttcctgggtggccctggcttccgtatctgaacccactgggggacccctcttctccttcctggctggccctggcttccaatcgaggactgactattgaagtctgctacaggtgtcatttggaactgtcttaccaaattttaaaacagctgctatttttcctgctcctccccaggagaggggtcttcctagaggaggcgagggaagagaatatcatggtgtctcctcaggacccatgcactggccctctctcctccttccaggtaatttttcattggaatgtatcccagtagagaaggtagtcagcccttcttggaagcggaaggctgggagccaagtcaagtctgcccacagcgctagatgtccaactctggaaggttcttggaggctcttgttgtaagacaggcctctgccacctgatcctccaggtcaccagcatgacgatagagactccttgcccatctgtgacactttccaatgcatatccaaactttaccttattttatctatgcaacccctgcctccctgggaaggataagggagtagagctgggttcactaagaaggaagtttaggccctcacaggctctggaacttgccttaagccacacaccagataagtggaggagccagaccagaagtccagacccaaagcttgagattcttcctctagaatgggtgagcacaggtgattcaggcggcttaaatccatcagagcagccctgccggaaaaggaaataatatgatgttttttcctgctcttgttctgccttgctcactccttctccctccgcagtatctggaaagattctggagaccagggcttatgcatctagggaaagtgaccaagggcagcctatccagcctctgcctccattcctgaaggggacttccctgcccctgtttctttccatgtctctccctccctcactcccatttgcccccttccaccccatcaggttagccacatatcttccagggctcagctgttcacaccaactccctggctcttatcatccatccctccttcccccaggagcttccactgtaggagtttcagggagaagagtttggaattcattggacctttcagccctcaggttccctagaggagcctagttgatctgtgagtaccaatggtgggccaaagacgcagggaataatgaagggagaaagaaaagaaaggaagatggaggaaaacgangcaactggaagaagaaggaagggatggaggggatgaagagaagggagagagggatatagctgaggaatttatctaaaaatgtgcatgtaaatctccattatgttccaggtactgtgccttatgatggctttgttttttgttgtcattagagacaaggtcttgctttgtcacccaggctggagtagagtggttcgatcatagctcaccncagcctcaacctcctaggctcaagccatcttcctgcctcagtctcccaaaatgctgggattacaggtgtgagccactatgctcagcctgtttcaaacattattataatagcagatttatttagtactttattatacatcagataccactctaattgtgaaatagatatatattcatttaattattgaaacaaccatgtagttaaaacactattaactcattttacagttgagtagactgagacacagagaagttaaagaacttgcccaagagtaaatgtctaataaaccgtagagccaggatctgggcccaggctgtctgactccagaacttgctcactcaaccactaaaccatcctgcttctcatgggaaagaaacacatcctgcctttgaggatcctacagcctgtgacaaaaacagtcataaaaatggacaattgccttattacacaaggagctcttaagtggcaatacaagcaatggaagtggctgtccagaggagggaacttctagtcctaggtctttaaggatgaataggagtttgccagagtgagaaagggaattgaactttcctgggagtggccttttaaaaagcaatgagatatggccaggcctggcttgtttggggaagagtcaaaatctagggtggcaagagtatgggaagcacactgaggagcagagagaaatggggtaggtaggaaggtagggttttgaccacaaagagctgtgcatgctaaactgggccacaggtgccagcagggttgtttgaggaagggaagagcaagacaagctctggtttaggaagagagctgtggcagcataaaggcctgaaagaggagacagagctgtcacccaaaatggacttgagagctccctgtggtttactctgtggctagaaaacactgccggccagatggatcacaaatgtctatggtagcttagaagctctgctcttgaagaggatcctgggatctgcccaacacccttcccaacctccatttccccatccccacctccattgccccatcccccctctccccctaggcaggtggatctgagccttatcccaccaccaatgcccctgctagcctctccccacccagcccagagcctactcagcctgccatctcaagagccccaccgagggtcactggcttcctgggaggagtcaccaggctgccagctttccctctgcctccccaaggaacctgagacctccctctgctcatcaccctgggcccaatcctgaatccagcccccatcaaccaagacagcaaaagggccaggtctgtcccttataattttgagccttctccctcaagtttggaagccctgactttaagaaatgccaaatgcaaggaccattaagaaaattctccccgaaatgaggctcctctaacaaatgatgattaaaacgctctctccttgagcagtcacattctagaaacaggacattccatgaggcaggaagagttcagttaatttgctcctgaaaaagtgtggttcagtgtttgtgtggcaatgtacgtgggcagaagaggccgctcaagctgtgtcccccctgagcaggattcaggaaagggaaaagaagttctcttcaactcagccaaggggccgtacgatggccgatgagattatgtatttaaaagttctttgtaaagtgtaaactaaaaaccttaaatgtaagatgctgttgttattattactgttgttgttgctgttatggacatgccaaaaggcccttgttagaagacagttttgccttttcaatctcatagcaaggaactcaagtctgatgcttcaaaaagatgagaagaagggcaagaagagggataactcccaagctcagagggaaaaaaaaggngggggaaaagagccccagggtgaccttcaggaaaggccaggaccaggatgatctaacctttcccttcaccagaaacaaagctattgccagactgaaccctaaagtcaagcagtcacccactgcctttgctgggagcagaagcccatagcaacaagtgacctgcccctcagactcaagatcccagataccagagctggaggagtcatagggcattactggtaggcaggaaaactgagggtcgaacaaatggaagaatgcggtgatcatagaccaaagacacacagataattaaccccatgtgtccacccaggccaaagttcttcctgctaccccacagtggatgtccaggcagatggtccccacatgatggggaagcagagggcatagtgtggttttgtgggacttgttcatgttttgtagtgtgggctcaacagtgccaaaggaaacactagggaaaagttggtgaaacatgccagctagcaggaccagtaaaggcataatcaggcatttggcaaagcttgcttttctaattcaatgataggttctaataggaaatttttgaagattttttaaaacaatgttatagtggcacttccccagtatggaataaataacatgcattcttttttcaatatactgtcatattcagatgtcattaaaataaatggatgagtcacagaggagctatcagatgctctcatgactaccataactcagaaaaaaaca

SEQ ID NO: 342064 - DNA, 3086 bp, Homo sapiens
gcgtctgtgtagttctctcagacagtcagagaggagagacggagcagcgtggcagacaggctggctctgcacgagctcctggcggggaccagcagcgcctgcaagggggtggagggacaggcgctcgggtggcctgggccgccggcccctcacgctgcccccgctcagccttcatgctctcccctgcttttccacaggcaactggacaacaaccacatcagctgcattgaagatggagccttccgagcgctgcgcgatttggagatccttaccctcaacaacaacaacatcagtcgcatcctggtcaccagcttcaaccacatgccgaagatccgaactctgcgcctccactccaaccacctgtactgcgactgccacctggcctggctctcggattggctgcgacagcgacggacagttggccagttcacactctgcatggctcctgtgcatttgaggggcttcaacgtggcggatgtgcagaagaaggagtacgtgtgcccagccccccactcggagcccccatcctgcaatgccaactccatctcctgcccttcgccctgcacgtgcagcaataacatcgtggactgtcgaggaaagggcttgatggagattcctgccaacttgccggagggcatcgtcgaaatacgcctagaacagaactccatcaaagccatccctgcaggagccttcacccagtacaagaaactgaagcgaatagacatcagcaagaatcagatatcggatattgctccagatgccttccagggcctgaaatcactcacatcgctggtcctgtatgggaacaagatcaccgagattgccaagggactgtttgatgggctggtgtccctacagctgctcctcctcaatgccaacaagatcaactgcctgcgggtgaacacgtttcaggacctgcagaacctcaacttgctctccctgtatgacaacaagctgcagaccatcagcaaggggctcttcgcccctctgcagtccatccagacactccacttagcccaaaacccatttgtgtgcgactgccacttgaagtggctggccgactacctccaggacaaccccatcgagacaagcggggcccgctgcagcagcccgcgccgactcgccaacaagcgcatcagccagatcaagagcaagaagttccgctgctcaggctccgaggattaccgcagcaggttcagcagcgagtgcttcatggacctcgtgtgccccgagaagtgtcgctgtgagggcacgattgtggactgctccaaccagaagctggtccgcatcccaagccacctccctgaatatgtcaccgacctgcgactgaatgacaatgaggtatctgttctggaggccactggcatcttcaagaagttgcccaacctgcggaaaataaatctgagtaacaataagatcaaggaggtgcgagagggagctttcgatggagcagccagcgtgcaggagctgatgctgacagggaaccagctggagaccgtgcacgggcgcgtgttccgtggcctcagtggcctcaaaaccttgatgctgaggagtaacttgatcggctgtgtgagtaatgacacctttgccggcctgagttcggtgagactgctgtccctctatgacaatcggatcaccaccatcacccctggggccttcaccacgcttgtctccctgtccaccataaacctcctgtccaaccccttcaactgcaactgccacctggcctggctcggcaagtggttgaggaagaggcggatcgtcagtgggaaccctaggtgccagaagccatttttcctcaaggagattcccatccaggatgtggccatccaggacttcacctgtgatggcaacgaggagagtagctgccagctgagcccgcgctgcccggagcagtgcacctgtatggagacagtggtgcgatgcagcaacaaggggctccgcgccctccccagaggcatgcccaaggatgtgaccgagctgtacctggaaggaaaccacctaacagccgtgcccagagagctgtccgccctccgacacctgacgcttattgacctgagcaacaacagcatcagcatgctgaccaattacaccttcagtaacatgtctcacctctccactctgatcctgagctacaaccggctgaggtgcatccccgtccacgccttcaacgggctgcggtccctgcgagtgctaaccctccatggcaatgacatttccagcgttcctgaaggctccttcaacgacctcacatctctttcccatctggcgctgggaaccaacccactccactgtgactgcagtcttcggtggctgtcggagtgggtgaaggcggggtacaaggagcctggcatcgcccgctgcagtagccctgagcccatggctgacaggctcctgctcaccaccccaacccaccgcttccagtgcaaagggccagtggacatcaacattgtggccaaatgcaatgcctgcctctccagcccgtgcaagaataacgggacatgcacccaggaccctgtggagctgtaccgctgtgcctgcccctacagctacaagggcaaggactgcactgtgcccatcaacacctgcatccagaacccctgtcagcatggaggcacctgccacctgagtgacagccacaaggatgggttcagctgctcctgccctctgggctttgaggggcagcggtgtgagatcaacccagatgactgtgaggacaacgactgcgaaaacaatgccacctgcgtggacgggatcaacaactacgtgtgtatctgtccgcctaactacacaggtgagctatgcgacgaggtgattgaccactgtgtgcctgagctgaacctctgtcagcatgaggccaagtgcatccccctggacaaaggattcagctgcgagtgtgtccctggctacagcgggaagctctgtgagacagacaatgatgactgtgtggcccacaagtgccgccacggggcccagtgcgtggacacaatcaatggctacacatgcacctgcccccagggcttcagtaggaccatgggtggggggtgttcacagaagggtccactgacagccctgggggcagcgtg

SEQ ID NO: 342065 - DNA, 1005 bp, Homo sapiens
agggcttgaaacaatattaggattactacccagggcacttactggtgcatgttgtaacatatctatgataaaagccatagtttacctaaaatggtgatttccagcctttactgctttgaagaaacagaatttgtaaaggtatgcatgtagaacataaaaaatatttcttaattattttttatattgatggtaatatattacgttcaacaatgcttaaagctctacaagcaggtcttttcccacctcttgatatctgtgatactgaaacttgaggatgttgaaatgtattacattttggcttctttctacatgttaactgcactgtagatgtaaaaattcaggttatatataggattgccatcttcagaggtgatgctgaactgtgaggtttcctagtaattgccaaatgagccgtaagtctgcagaattcccttctactttgaagagaaggggataggaatgtatatttggctgggggcatggagatgttcgtatgtatgaggagttagggatggggagtcaagttctagaaagttttgtctgaaaacctttgaatagaatggcatgaagattttaatcaattacttataaacaaagtcttagagacttccttttaggaatcaacttccatgagaagttaaaaataaattattaattttaggtacagacattaaacatggaatttaaggactgttgggggaaattgatcacttcttagcatttccattcagtgaatggagctgatgtttgcctgtcattttaagatgataccataccttctttggttattataggtccagtttgaagcattctgacttctggtttttccaccctgaaaggaaatgtttttctttgcagcagtattagataatgaaaaatgctaattcagtagttattaacttctaaattttattcgccatgactttctagtgaattattaccataaataacaatttcagaaacttagtttttagaataaatattaatttttccacttcagtttta

SEQ ID NO: 342066 - DNA, 348 bp, Homo sapiens
tgtccttgccatattttctcaactctaggatatctaacattggagattaaagattcaataaaaaatgaaaactcagtgcaaaaatccactattatgttgatgtaaaatacttataaaatggtaaaagaaaactaaagcaccactgacaacaaaggagaaaaacagtttgtgttaagcggtgggtgactcattaagtcagtccttggctccttcagctaaatttccaaatataaatgaaacttggttcaggaaaagaaagtcaaaggtttccatccttggggataggtgtaaggcggggggcgcaactcttagaatgacctctaaaaaaaccttccaaattttctaaga

SEQ ID NO: 342067 - DNA, 480 bp, Homo sapiens
agataagaaaacagaagaccagagcccaaggtcacaaagttagtaagtgacaaacctagacttccaatctagcaaattggttaaactctatgcctctcaaaaggccttacaggacaggatgggagagctgtttgtgagtacacaccacagagtacttctccaaacagtcctgctaacaaggccatgccagcccctcgtgaacttcagagctggacttcacagccagcgtgtattactgtttacaagagttggtctcaagtatgtgaggattaaagcaaactgaccccctttctagaaataaaattcaaagcacacattccatcacgagttggtcaacatcatcttcatataaaagtacaacttattactcaacccacattcctaccttctaccctcccaagaatggaaaaaaagtcccatctctctgctatagaaaaataatggggccaggcgcggtggctcacgcctgtaatcccagca

SEQ ID NO: 342068 - DNA, 3205 bp, Homo sapiens
agcatcgagtcggccttgttgacctactggataacgggaggagagcgccaggcggagctggggcgtccctcccgctcgcttcttgactcgcgttgctgccggcctcctcccgcgcctagtgtccgggacgcgcctgaacctgccgcctccgtgcctggggcggcgccgcgcggccccgagcgctccagaaagctgcggcgcgagtccgcggggccgacctcggagacgcagctggggccgggcgcggcttggcgggagggtctgcagcgccgagggaggctgccagtgcgtgaggaagagagctagagactggacaggggagacagagcagcgtcggagccgcgcaggggacgggagtgagagcgggagtgagagcaggaacgacgcagagcggccgtcctcaaggtgctgctgcttctccccactcagacttggagccccgtaggagcaggaaatccacctgactgtgatgctccactggcctctgccttgcctaggtcatccttcagcagctcctcagagctgtccagcagccacggcccggggttttcaaggcttaatcgaagagatggagctggtggctggaccccacttgtgtcaaataaataccaatggctgcaaattgaccttggagagagaatggaggtcactgctgtcgccacccaaggaggatatgggagctctgactgggtgaccagctacctcctgatgttcagtgatggtgggagaaactggaagcagtatcgccgagaagaaagcatctggggttttccaggaaacacaaacgcagacagtgtggtgcactacagactccagcctccctttgaagccaggttcctgcgctttctccctttagcctggaaccccaggggcaggattgggatgcggattgaagtgtacggatgtgcatataaatctgaggtggtttattttgatggacaaagtgctctgctgtatacacttgataaaaaacctttaaaaccactaagagatgttatttctttgaaatttaaagccatgcagagcaatggaattctacttcacagagaaggacaacatggaaatcacattactctggaattaattaaaggaaagcttgtcttttttcttaactcaggcaatgctaagctgccttccactattgctcctgtgaccctcaccctgggcagcctgctggatgaccagcactggcattccgtcctcatcgagctcctcgacacgcaggtcaacttcaccgtggacaaacacactcatcatttccaagcaaagggagattccagtaacttggatcttaattttgagatcagctttgggggaattccgacacccggaagatcgcgggcattcacacgtaaaagctttcatgggtgtttagaaaatctttattataatggagtggatgttaccgaattagccaagaaacacaaaccacagatcctcatgatggagttggctcatgggttgcaggaccaaaacctgaaaatatctctgactgtgtgtcaccagaccacacaatgaatacatcacttaggttagcatgagaaaaggggaaaaacagctgtgaagcccatgaactttccaagaaggtaaaggagaaaaaaaaaaaaagttgggtttgaagtctaagttttactatgaacagcaccctgctgagatcataaaaatgaaaaataccatcaagatacatgaaaaaggaaacaccaaagggaagagtgataacaaggctccacagagcgcagtttcctttgacaagatgaaaaagaaatgaaaagaggaaggagataaatggaacagccctctacctaaagtttctgcccatggagaaactgacatttaagtgctgctcaacaggaaaaagaaaaaagacctggttattgaagttggctttgttggagatgcgttactcagatacagatacaaagatgggtttggccaatgggcatccgtgtcaagaagcctgacctaacacgttctgaatattaagctaccttttatctgccagtccttggtgttcagaagaatccctcctcctcaccctaacttctatggggctatttccaaagacactgtcattgaagtgaggaagagtgagttgggccttatgacacaaagagacaagactatttgaggacaatagacacaggttttcatatacattccatgttattctgaattactgaggggttcactgatggaattattgagtatagccaataaggagaaccacagttaagctggtgtctctgggttctggacatcatcctcaagaaaactatttactaattacattgaatgaggttattaaaatgtgtaagtttcacacaaaaacaaaaagacaattcattccaaattgtgcatatggatatataatgttaattatgggaattccattttaagaattactacaattctatgtgttctgtataaaaacaggaaaatagttgttccaatatataaaaggaaaacatttaaaaatgtattttcttgggaaaatcagttgccagaattcattagtcaactaacaagcactcctctgtggcaagaagccctgcttctctgttgtagcaggcagctacccacctaaatgatgaggtcaagaaatatacagctgataaaaagataaaaaatatgtaatagtccagtgattacatgtgtactacggatcagcgccaattagttgtaagcttttggtatttagctcgttacagcaaatgttttcttttttaaattttcttctgcaaatgttttcttgtcatgaaaactgttttccatttagcagaattacaaaaatagtcaagaagaaatgttctgattgatgtatacagttagaatgtgtattaaagattattataaaatgataactgaattatatccatttctaaagtatgttgggacaaaattttttaaacatgtgattctgttttgaaaattgttttaccactggatcagtgtggttcttaaacttggctttatcttggagtcaccagaggagattcaaaagatacctttacctggctccacctccagagatcgggattttaaatggtctgtatctggattttaagagcccttctggtgattcgactgtttagctaggtttgagagccactaccctagatgagctgtcctgctccagtaacattctttttctaaaatcatttatagtatattagaaataaatccatggaaattccaagtaaaatca

SEQ ID NO: 342069 - DNA, 2852 bp, Homo sapiens
agggcgcctggctgaagagagcatggcttcagtggcctgggccgtcctcaaggtgctgctgcttctccccactcagacttggagccccgtaggagcaggaaatccacctgactgtgatgctccactggcctctgccttgcctaggtcatccttcagcagctcctcagagctgtccagcagccacggcccggggttttcaaggcttaatcgaagagatggagctggtggctggaccccacttgtgtcaaataaataccaatggctgcaaattgaccttggagagagaatggaggtcactgctgtcgccacccaaggaggatatgggagctctgactgggtgaccagctacctcctgatgttcagtgatggtgggagaaactggaagcagtatcgccgagaagaaagcatctggggttttccaggaaacacaaacgcagacagtgtggtgcactacagactccagcctccctttgaagccaggttcctgcgctttctccctttagcctggaaccccaggggcaggattgggatgcggattgaagtgtacggatgtgcatataaatctgaggtggtttattttgatggacaaagtgctctgctgtatacacttgataaaaaacctttaaaaccactaagagatgttatttctttgaaatttaaagccatgcagagcaatggaattctacttcacagagaaggacaacatggaaatcacattactctggaattaattaaaggaaagcttgtcttttttcttaactcaggcaatgctaagctgccttccactattgctcctgtgaccctcaccctgggcagcctgctggatgaccagcactggcattccgtcctcatcgagctcctcgacacgcaggtcaacttcaccgtggacaaacacactcatcatttccaagcaaagggagattccagtaacttggatcttaattttgagatcagctttgggggaattccgacacccggaagatcgcgggcattcacacgtaaaagctttcatgggtgtttagaaaatctttattataatggagtggatgttaccgaattagccaagaaacacaaaccacagatcctcatgatggagttggctcatgggttgcaggaccaaaacctgaaaatatctctgactgtgtgtcaccagaccacacaatgaatacatcacttaggttagcatgagaaaaggggaaaaacagctgtgaagcccatgaactttccaagaaggtaaaggagaaaaaaaaaaaaagttgggtttgaagtctaagttttactatgaacagcaccctgctgagatcataaaaatgaaaaataccatcaagatacatgaaaaaggaaacaccaaagggaagagtgataacaaggctccacagagcgcagtttcctttgacaagatgaaaaagaaatgaaaagaggaaggagataaatggaacagccctctacctaaagtttctgcccatggagaaactgacatttaagtgctgctcaacaggaaaaagaaaaaagacctggttattgaagttggctttgttggagatgcgttactcagatacagatacaaagatgggtttggccaatgggcatccgtgtcaagaagcctgacctaacacgttctgaatattaagctaccttttatctgccagtccttggtgttcagaagaatccctcctcctcaccctaacttctatggggctatttccaaagacactgtcattgaagtgaggaagagtgagttgggccttatgacacaaagagacaagactatttgaggacaatagacacaggttttcatatacattccatgttattctgaattactgaggggttcactgatggaattattgagtatagccaataaggagaaccacagttaagctggtgtctctgggttctggacatcatcctcaagaaaactatttactaattacattgaatgaggttattaaaatgtgtaagtttcacacaaaaacaaaaagacaattcattccaaattgtgcatatggatatataatgttaattatgggaattccattttaagaattactacaattctatgtgttctgtataaaaacaggaaaatagttgttccaatatataaaaggaaaacatttaaaaatgtattttcttgggaaaatcagttgccagaattcattagtcaactaacaagcactcctctgtggcaagaagccctgcttctctgttgtagcaggcagctacccacctaaatgatgaggtcaagaaatatacagctgataaaaagataaaaaatatgtaatagtccagtgattacatgtgtactacggatcagcgccaattagttgtaagcttttggtatttagctcgttacagcaaatgttttcttttttaaattttcttctgcaaatgttttcttgtcatgaaaactgttttccatttagcagaattacaaaaatagtcaagaagaaatgttctgattgatgtatacagttagaatgtgtattaaagattattataaaatgataactgaattatatccatttctaaagtatgttgggacaaaattttttaaacatgtgattctgttttgaaaattgttttaccactggatcagtgtggttcttaaacttggctttatcttggagtcaccagaggagattcaaaagatacctttacctggctccacctccagagatcgggattttaaatggtctgtatctggattttaagagcccttctggtgattcgactgtttagctaggtttgagagccactaccctagatgagctgtcctgctccagtaacattctttttctaaaatcatttatagtatattagaaataaatccatggaaattccaagtaaaatca

SEQ ID NO: 342070 - DNA, 536 bp, Homo sapiens
agagatgttatttctttgaaatttaaagccatgcagagcaatggaattctacttcacagagaaggacaacatggaaatcacattactctggaattaattaaaggaaagcttgtcttttttcttaactcaggtaaaaaaatacttgaactttataccagtagttaaaaaaaatctgtttacatttgttggtactcagtcttttcacagttagataaaatgaccatataattcatcatctaaaccagaacacctttaagaaataaaaaatacacaagtgatagttactctgggacagtaagtgcaaagtagaactgcaatgaacaaatgtaaatgaaagtttaagagcattactaccagatgcatgcaatacatatcctaagtatgatttctgtaaacagcatatattttgacaaactgtgcaagatcaccatatgtgtgtataatatatatgtaatatatgattatccatatcataaagacaatacatcattataaaattatgagataatgctgataatgaggttctaagaaagaaa

SEQ ID NO: 342071 - DNA, 198 bp, Homo sapiens
catttcctgcacagatgatggctattagaatgttcctacttttaagacttaattccactactccaacaattgaaaaatgtgaatactcaacaaccacagagaagtacgttgtcattaagctaaacaatacactccaaaataaagtctagagaggctgggtgcagtggctcatgcctgtaatccaagcactttgggagg

SEQ ID NO: 342072 - DNA, 817 bp, Homo sapiens
ggaatttgttttcccataaaaaataatgttggctaaatttttgagccaacacacagaacctatttcttcacaactgacttaatcaccatttatagcttgttttttgggataaaatgcattgcaccttctaactcttgtaattgtagctgctgctgcttttcttctacttttttaaagagacagggtctcatgccagtcagaatggtgattattaaaaagtcaagaaacaacagatgtggtgaggttacagagaaatatgaacacttttacactgttggtgggaatgaaaattagttcaaccattgtggaagacagtgtggtgattcctccaagatttagaactggaaatacaatttgacccagcaatctcattactgggtatatacccaaaggaatataaatcattctgttataaaaatacgtgcatgtatatgttcattgtagcactattcacaatagcaaagacatagaatcaacccaaatgccaatcaatgataggctggataaagaaaatgtacatatacaccatggaatactgtgcagccgtagaaggaacaagatcatgtcctttgcagggacatggatggagctggaagccattatcctcagcaaactaatgcaggaacagtatcacttgagagatatttgggttgtttccacctcttggcaatggccaattggtttttgacaaaggtgcaaagcaattagtgaagaaagggtattcttttcaacaaatgatgttgaatcaattggatattcatgtgggaaaaaaaaggtgcatcaacctaaacctcacatcttataaaaacatgaatgc

SEQ ID NO: 342073 - DNA, 871 bp, Homo sapiens
ggaatttgttttcccataaaaaataatgttggctaaatttttgagccaacacacagaacctatttcttcacaactgacttaatcaccatttatagcttgttttttgggataaaatgcattgcaccttctaactcttgtaattgtagctgctgctgcttttcttctacttttttaaagagacagggtctcatgccagtcagaatggtgattattaaaaagtcaagaaacaacagatgtggtgaggttacagagaaatatgaacacttttacactgttggtgggaatgaaaattagttcaaccattgtggaagacagtgtggtgattcctccaagatttagaactggaaatacaatttgacccagcaatctcattactgggtatatacccaaaggaatataaatcattctgttataaaaatacgtgcatgtatatgttcattgtagcactattcacaatagcaaagacatagaatcaacccaaatgccaatcaatgataggctggataaagaaaatgtacatatacaccatggaatactgtgcagccgtagaaggaacaagatcatgtcctttgcagggacatggatggagctggaagccattatcctcagcaaactaatgcaggaacagaaaaccaaataccacatgttctcacttacgtataccacattttctttatctctttatcacttgagagatatttgggttgtttccacctcttggcaatggccaattggtttttgacaaaggtgcaaagcaattagtgaagaaagggtattcttttcaacaaatgatgttgaatcaattggatattcatgtgggaaaaaaaaggtgcatcaacctaaacctcacatcttataaaaacatgaatgc

SEQ ID NO: 342074 - DNA, 1825 bp, Homo sapiens
gtcgttcctgagagcacatgcacccccaaatgtgaagtgcactcggacacacacacacacacacacgcacgcacacacaagcactcatgttctaaagagagaggtctgagtccgaagttgctgctgctgggagcttgagctgagatggactggtcttcatgggcgcccaaggcgctgggtgcagctttccccgagacccccagatggaaaggagggaaggaggaaccccacacactcgccttttgcgagaagatcggcgcgcaccccagagtgccccaagcctttggaatctgcctgctgagcggagcgcgcgagcgtggtggacaggtcccgaacttggccagcgggctttcttggcaacttgctttgcgcagttctccatggaaccctggacccactgtgctcccggcgccttgcctttttttttctttttctttctctcactgtctctttttaaatttatgaactcgaaatgaagcggaaagcagatatgcgcgtcagcatactttggcggaccttttaaaaatggaactgtcggctgcggctggaaggcgcaggcaggcgccctggagagaattcacagggaggcacaggacagaacgctcccaggaacgaggaagcacccccagaaaggagcgctctatgggctccaggcagccgaggaaacgcgaacgtgagccccgtgactgcactcccacgtgcaccaacgctgccagtgtgagcagaagcggagcccgcagagcgccaggctgcgccgggagatgcatcacgatgaaaaactgcgccagagcatggcgggaactttccgagagggcgtgttgtttccaggcggttccaccttctaatatgaaacagtcttggttgattttccttgatactactttatgctcggcctggttgttggcaagtagctgcccgcgtctgtacgcgcccttgattagtttccactgcatgtgttttaacacagtcctcctttttccacgtttatttgggccaaccctgtctgcaaagatccagtttaatacagatttgagtctacgtgctatagcctggaaatgtactaaagacactacaacatattgctgaaagaatagaatctttattctgaatgcaaagcggacacctagtaaaaaattctggaataataaaacaagcaaggcttatgtgctcagttttggggacgctccaatttaaaggcttagtcattgtcacggtgtaaggtttacccattgcccccatcacacagatgtgggattgttgagagctgagtgtcctatgacctcttctgctgcccaagaacttggggtgggtggtaactggagaaatcaaagtgatcagctgcaaagaacgcttccattgctggagcttggttgtgcgggattctccacggaggtcttaaggcagagacaaaaacaaggactttgggaggctcctgtgagcagccaaaagggtttagagtcaggcagcctcaggttacaaatccagtcctgcaggctaggagttgtgtaagcttaaaaaagtgactgcacttccaggaacatcatttccctacctgctcctccttctgacgggttttctgaggacaatggaatccacactctgtgtcgaacacttttctaattagcgatgtgcagacactgtttattttacaggaataaaaatgccagaagaacccaagtcatattcatttaaagcagggtgacaagtacaccaaaatctgaaaaatcatcactaaagaacttatccatgtaaccaaaaaccattgaaataaaagtaaactatggaaacaaaatttaaaagtaataaaatttaaaagtccaaaaaa

SEQ ID NO: 342075 - DNA, 453 bp, Homo sapiens
actagtccagtgtggtcacggtggcatcgataaacaccgggtttatcgatgccacatcagtgcagttccttttccctggactgatgtggcaccttcaattcctctcaaatcgattaaatcaagtttgacttttgtgttccattttttttttcaacatttccatgaattaccaagacacagctttctacagagaagcacctttctccagatcttcattgccattttggacacacagctccaaacccaaaatgtgtccactggatcaacccacaatgcaaacaactgctttctaaggaaaagccgagtttctaggaggcagcccacttctgacgtgtccttcagttaacaggctgcagtggacagcgtgtggtgggtggaggaagacggcagatgagaaattcaaggagattcaccacagagcagctttctggctcagctgttctagggtgccat

SEQ ID NO: 342076 - DNA, 1249 bp, Homo sapiens
gtcgttcctgagagcacatgcacccccaaatgtgaagtgcactcggacacacacacacacacacacgcacgcacacacaagcactcatgttctaaagagagaggtctgagtccgaagttgctgctgctgggagcttgagctgagatggactggtcttcatgggcgcccaaggcgctgggtgcagctttccccgagacccccagatggaaaggagggaaggaggaactttccgagagggcgtgttgtttccaggcggttccaccttctaatatgaaacagtcttggttgattttccttgatactactttatgctcggcctggttgttggcaagtagctgcccgcgtctgtacgcgcccttgattagtttccactgcatgtgttttaacacagtcctcctttttccacgtttatttgggccaaccctgtctgcaaagatccagtttaatacagatttgagtctacgtgctatagcctggaaatgtactaaagacactacaacatattgctgaaagaatagaatctttattctgaatgcaaagcggacacctagtaaaaaattctggaataataaaacaagcaaggcttatgtgctcagttttggggacgctccaatttaaaggcttagtcattgtcacggtgtaaggtttacccattgcccccatcacacagatgtgggattgttgagagctgagtgtcctatgacctcttctgctgcccaagaacttggggtgggtggtaactggagaaatcaaagtgatcagctgcaaagaacgcttccattgctggagcttggttgtgcgggattctccacggaggtcttaaggcagagacaaaaacaaggactttgggaggctcctgtgagcagccaaaagggtttagagtcaggcagcctcaggttacaaatccagtcctgcaggctaggagttgtgtaagcttaaaaaagtgactgcacttccaggaacatcatttccctacctgctcctccttctgacgggttttctgaggacaatggaatccacactctgtgtcgaacacttttctaattagcgatgtgcagacactgtttattttacaggaataaaaatgccagaagaacccaagtcatattcatttaaagcagggtgacaagtacaccaaaatctgaaaaatcatcactaaagaacttatccatgtaaccaaaaaccattgaaataaaagtaaactatggaaacaaaatttaaaagtaataaaatttaaaagtccaaaaaa

SEQ ID NO: 342077 - DNA, 918 bp, Homo sapiens
gtcgttcctgagagcacatgcacccccaaatgtgaagtgcactcggacacacacacacacacacacgcacgcacacacaagcactcatgttctaaagagagaggtctgagtccgaagttgctgctgctgggagcttgagctgagatggactggtcttcatgggcgcccaaggcgctgggtgcagctttccccgagacccccagatggaaaggagggaaggaggaaccccacacactcgccttttgcgagaagatcggcgcgcaccccagagtgccccaagcctttggaatctgcctgctgagcggagcgcgcgagcgtggtggacaggtcccgaacttggccagcgggctttcttggcaacttgctttgcgcagttctccatggaaccctggacccactgtgctcccggcgccttgcctttttttttctttttctttctctcactgtctctttttaaatttatgaactcgaaatgaagcggaaagcagatatgcgcgtcagcatactttggcggaccagtcccagtgctgaccagtcccatcgtatctctgacggtgcatatcaggatccgcattgatcagatgccgaaaccatggcttggaatggctgcgatgaagctgagctgcgattcaaacccagacacagctttctacagagaagcacctttctccagatcttcattgccattttggacacacagctccaaacccaaaatgtgtccactggatcaacccacaatgcaaacaactgctttctaaggaaaagccgagtttctaggaggcagcccacttctgacgtgtccttcagttaacaggctgcagtggacagcgtgtggtgggtggaggaagacggcagatgagaaattcaaggagattcaccacagagcagctttctggctcagctgttctagggtgccat

SEQ ID NO: 342078 - DNA, 365 bp, Homo sapiens
ggagaaggtgcaatcagtgttatcttttaacattgcaccaaccacacccctcccccatttcttctgttcagagtcagattcctcgcttcatggaggcccaggtctacgacattaggctgcttctaccccatggtggcttattaacctattttccaactgaggaattctcaggcagcctaatgagagtaagactttttttttttatctcttctaaaaaaaatatgttgataccagactttttcacagtttttcctgttatgtattactaattgtcttcagtcaagaaatgattatttttaactcctgtgacaccaaaatgagttacatctctacaaaaatcagtgtttaacttttattcttggtac

SEQ ID NO: 342079 - DNA, 585 bp, Homo sapiens
cgcagggaatcccctctcccgccgccgccgccgtgtctggtctgtacgtctttagagggtcgaggaagtcacgtcgggacagactggggcgagtaaggttaagaaaggctgacatgttttatgttttagtgacgacgcttaataggctgtatatctgctctatatgcagcacatacatacatagctttttaaaaaactcttattttgtggaatgaaatagctaccttcagtgtacatagctgtaatttatctttgtagctaagttgctttcaacagaagaaatactgttctccgtaccttcaccccctccttgtttcttggaaagagaggcgggaaaggtaaattctcctcataatactggtcctaagcagttaccctgtaaatagttaatgtgagctccacgggtcaccaatataaagtttcctgccttctgatggacaaaggaagcggcgatggccagaatttgcagggacgctaaatgtccaaaacgtatgccttaaggcatttctctccctgatgcgtggattattttggttactagcccttcataggagatactggtaaaataaattcgagttttaaagt

SEQ ID NO: 342080 - DNA, 422 bp, Homo sapiens
atttaaattaatgtttttggaaattttcactaaaaccttggcaggatctcctggaaaactgcttatcctaagtagtacagaatagggcaggtgatggcatgcgctttctaagagaaaacccagcagaggaattgggacccccagctgcgtttcctccgtgtcacagctgagcaagtccctgctctcgagtggagccagggttggctacctcgttgtccgatatcatttaggtctgctgagatgctgagagggccatgagtgggccctggatgccgtcagtgccttccgtagtcggtctccccagcctcctgtgctgtaaagtgagtttattgttaggagatactgaggagtggtgagttgggttttatttaaattacttacattcaggcaaaaatgttcctttctaaccattctttgataat

SEQ ID NO: 342081 - DNA, 7571 bp, Homo sapiens
ggtattaaaactgatcttttgacatttttgacaatgttcttataaattactttcttttttatcatatatggatgggatgaagcacagagtaagatagagtgcacagcaaaggggatctgcccctcctatctgtccaataccccacaggttttggtgataatcttgggcaatgttccagtcaaacctgcctcccacttctcactaaagttagtgaacatgtgacccacattccccaaataagagcctcttataaactccattcttggctttttcattcatagagatagctattttatgagacatagataaagcattttttagtgatgtgcacgatgccttttttcttaattattaacttctcaaaacataaacacattggaggcacttaataaagggagctgtagctaccgccgtccgcgcctccaaggtttcacggcttcctcagcagagactcgggctcgtccgccatgtccgccgcagacgaggttgacgggctgggcgtggcccggccgcactatggctctgtcctggataatgaaagacttactgcagaggagatggatgaaaggagacgtcagaacgtggcttatgagtacctttgtcatttggaagaagcgaagaggtggatggaagcatgcctaggggaagatctgcctcccaccacagaactggaggaggggcttaggaatggggtctaccttgccaaactggggaacttcttctctcccaaagtagtgtccctgaaaaaaatctatgatcgagaacagaccagatacaaggcgactggcctccactttagacacactgataatgtgattcagtggttgaatgccatggatgagattggattgcctaagattttttacccagaaactacagatatctatgatcgaaagaacatgccaagatgtatctactgtatccatgcactcagtttgtacctgttcaagctaggcctggcccctcagattcaagacctatatggaaaggttgacttcacagaagaagaaatcaacaacatgaagactgagttggagaagtatggcatccagatgcctgcctttagcaagattgggggcatcttggctaatgaactgtcagtggatgaagccgcattacatgctgctgttattgctattaatgaagctattgaccgtagaattccagccgacacatttgcagctttgaaaaatccgaatgccatgcttgtaaatcttgaagagcccttggcatccacttaccaggatatactttaccaggctaagcaggacaaaatgacaaatgctaaaaacaggacagaaaactcagagagagaaagagatgtttatgaggagctgctcacgcaagctgaaattcaaggcaatataaacaaagtcaatacattttctgcattagcaaatatcgacctggctttagaacaaggagatgcactggccttgttcagggctctgcagtcaccagccctggggcttcgaggactgcagcaacagaatagcgactggtacttgaagcagctcctgagtgataaacagcagaagagacagagtggtcagactgaccccctgcagaaggaggagctgcagtctggagtggatgctgcaaacagtgctgcccagcaatatcagagaagattggcagcagtagcactgattaatgctgcaatccagaagggtgttgctgagaagactgttttggaactgatgaatcccgaagcccagctgccccaggtgtatccatttgccgccgatctctatcagaaggagctggctaccctgcagcgacaaagtcctgaacataatctcacccacccagagctctctgtcgcagtggagatgttgtcatcggtggccctgatcaacagggcattggaatcaggagatgtgaatacagtgtggaagcaattgagcagttcagttactggtcttaccaatattgaggaagaaaactgtcagaggtatctcgatgagttgatgaaactgaaggctcaggcacatgcagagaataatgaattcattacatggaatgatatccaagcttgcgtggaccatgtgaacctggtggtgcaagaggaacatgagaggattttagccattggtttaattaatgaagccctggatgaaggtgatgcccaaaagactctgcaggccctacagattcctgcagctaaacttgagggagtccttgcagaagtggcccagcattaccaagacacgctgattagagcgaagagagagaaagcccaggaaatccaggatgagtcagctgtgttatggttggatgaaattcaaggtggaatctggcagtccaacaaagacacccaagaagcacagaagtttgccttaggaatctttgccattaatgaggcagtagaaagtggtgatgttggcaaaacactgagtgcccttcgctcccctgatgttggcttgtatggagtcatccctgagtgtggtgaaacttaccacagtgatcttgctgaagccaagaagaaaaaactggcagtaggagataataacagcaagtgggtgaagcactgggtaaaaggtggatattattattaccacaatctggagacccaggaaggaggatgggatgaacctccaaattttgtgcaaaattctatgcagctttctcgggaggagatccagagttctatctctggggtgactgccgcatataaccgagaacagctgtggctggccaatgaaggcctgatcaccaggctgcaggctcgctgccgtggatacttagttcgacaggaattccgatccaggatgaatttcctgaagaaacaaatccctgccatcacctgcattcagtcacagtggagaggatacaagcagaagaaggcatatcaagatcggttagcttacctgcgctcccacaaagatgaagttgtaaagattcagtccctggcaaggatgcaccaagctcgaaagcgctatcgagatcgcctgcagtacttccgggaccatataaatgacattatcaaaatccaggcttttattcgggcaaacaaagctcgggatgactacaagactctcatcaatgctgaggatcctcctatggttgtggtccgaaaatttgtccacctgctggaccaaagtgaccaggattttcaggaggagcttgaccttatgaagatgcgggaagaggttatcaccctcattcgttctaaccagcagctggagaatgacctcaatctcatggatatcaaaattggactgctagtgaaaaataagattacgttgcaggatgtggtttcccacagtaaaaaacttaccaaaaaaaataaggaacagttgtctgatatgatgatgataaataaacagaagggaggtctcaaggctttgagcaaggagaagagagagaagttggaagcttaccagcacctgttttatttattgcaaaccaatcccacctatctggccaagctcatttttcagatgccccagaacaagtccaccaagttcatggactctgtaatcttcacactctacaactacgcgtccaaccagcgagaggagtacctgctcctgcggctctttaagacagcactccaagaggaaatcaagtcgaaggtagatcagattcaagagattgtgacaggaaatcctacggttattaaaatggttgtaagtttcaaccgtggtgcccgtggccagaatgccctgagacagatcttggccccagtcgtgaaggaaattatggatgacaaatctctcaacatcaaaactgaccctgtggatatttacaaatcttgggttaatcagatggagtctcagacaggagaggcaagcaaactgccctatgatgtgacccctgagcaggcgctagctcatgaagaagtgaagacacggctagacagctccatcaggaacatgcgggctgtgacagacaagtttctctcagccattgtcagctctgtggacaaaatcccttatgggatgcgcttcattgccaaagtgctgaaggactcgttgcatgagaagttccctgatgctggtgaggatgagctgctgaagattattggtaacttgctttattatcgatacatgaatccagccattgttgctcctgatgcctttgacatcattgacctgtcagcaggaggccagcttaccacagaccaacgccgaaatctgggctccattgcaaaaatgcttcagcatgctgcttccaataagatgtttctgggagataatgcccacttaagcatcattaatgaatatctttcccagtcctaccagaaattcagacggtttttccaaactgcttgtgatgtcccagagcttcaggataaatttaatgtggatgagtactctgatttagtaaccctcaccaaaccagtaatctacatttccattggtgaaatcatcaacacccacactctcctgttggatcaccaggatgccattgctccggagcacaatgatccaatccacgaactgctggacgacctcggcgaggtgcccaccatcgagtccctgataggggaaagctctggcaatttaaatgacccaaataaggaggcactggctaagacggaagtgtctctcaccctgaccaacaagttcgacgtgcctggagatgagaatgcagaaatggatgctcgaaccatcttactgaatacaaaacgtttaattgtggatgtcatccggttccagccaggagagaccttgactgaaatcctagaaacaccagccaccagtgaacaggaagcagaacatcagagagccatgcagagacgtgctatccgtgatgccaaaacacctgacaagatgaaaaagtcaaaatctgtaaaggaagacagcaacctcactcttcaagagaagaaagagaagatccagacaggtttaaagaagctaacagagcttggaaccgtggacccaaagaacaaataccaggaactgatcaacgacattgccagggatattcggaatcagcggaggtaccgacagaggagaaaggccgaactagtgaaactgcaacagacatacgctgctctgaactctaaggccaccttttatggggagcaggtggattactataaaagctatatcaaaacctgcttggataacttagccagcaagggcaaagtctccaaaaagcctagggaaatgaaaggaaagaaaagcaaaaagatttctctgaaatatacagcagcaagactacatgaaaaaggagttcttctggaaattgaggacctgcaagtgaatcagtttaaaaatgttatatttgaaatcagtccaacagaagaagttggagacttcgaagtgaaagccaaattcatgggagttcaaatggagacttttatgttacattatcaggacctgctgcagctacagtatgaaggagttgcagtcatgaaattatttgatagagctaaagtaaatgtcaacctcctgatcttccttctcaacaaaaagttctacgggaagtaattgatcgtttgctgccagcccagaaggatgaaggaaagaagcacctcacagctcctttctaggtccttctttcctcattggaagcaaagacctagccaacaacagcacctcaatctgatacactcccgatgccacatttttaactcctctcgctctgatgggacatttgttacccttttttcatagtgaaattgtgtttcaggcttagtctgacctttctggtttcttcattttcttccattacttaggaaagagtggaaactccactaaaatttctctgtgttgttacagtcttagaggttgcagtactatattgtaagctttggtgtttgtttaattagcaatagggatggtaggattcaaatgtgtgtcatttagaagtggaagctattagcaccaatgacataaatacatacaagacacagaactaaaatgtcatgttattaacagttattaggttgtcatttaaaaataaagttcctttatatttctgtcccatcaggaaaactgaaggatatggggaatcattggttatcttccattgtgtttttctttatggacaggagctaatggaagtgacagtcatgttcaaaggaagcatttctagaaaaaaggagataatgtttttaaatttcattatcaaacttgggcaattctgtttgtgtaactccccgactagtggatgggagagtcccattgctaaaattcagctactcagataaattcagaatgggtcaaggcacctgcctgtttttgttggtgcacagagattgacttgattcagagagacaattcactccatccctatggcagaggaatgggttagccctaatgtagaatgtcattgtttttaaaactgttttatatcttaagagtgccttattaaagtatagatgtatgtcttaaaatgtgggtgataggaattttaaagatttatataatgcatcaaaagccttagaataagaaaagctttttttaaattgctttatctgtatatctgaactcttgaaacttatagctaaaacactaggatttatctgcagtgttgcagggagataattctgccttaaattgtctaaaacaaaaacaaaaccagccaacctatgttacacgtgagattaaaaccaattttttccccattttttctccttttttctcttgctgcccacattgtgcctttattttatgagccccagttttctgggcttagtttaaaaaaaaaatcaagtctaaacattgcatttagaaagcttttgttcttggataaaaagtcatacactttaaaaaaaaaaaaaactttttccaggaaaatatattgaaatcatgctgctgagcctctattttctttctttgatgttttgattcagtattcttttatcataaatttttagcatttaaaaattcactgatgtacattaagccaataaactgctttaatgaataacaaactatgtagtgtgtccctattataaatgcattggagaagtatttttatgagactctttactcaggtgcatggttacagcccacagggaggcatggagtgccatggaaggattcgccactacccagaccttgttttttgttgtattttggaagacaggttttttaaagaaacattttcctcagattaaaagatgatgctattacaactagcattgcctcaaaaactgggaccaaccaaagtgtgtcaaccctgtttccttaaaagaggctatgaatcccaaaggccacatccaagacaggcaataatgagcagagtttacagctcctttaataaaatgtgtcagtaattttaaggtttatagttccctcaacacaattgctaatgcagaatagtgtaaaatgcgcttcaagaatgttgatgatgatgatatagaattgtggctttagtagcacagaggatgccccaacaaactcatggcgttgaaaccacacagttctcattactgttatttattagctgtagcattctctgtctcctctctctcctcctttgaccttctcctcgaccagccatcatgacatttaccatgaatttacttcctcccaagagtttggactgcccgtcagattgtttctgcacatagttgcctttgtatctctgtatgaaataaaaggtcatttgtt

SEQ ID NO: 342082 - DNA, 350 bp, Homo sapiens
aggaaacagggttgacacactttggttgttccctcaacacaattgctaatgcagaatagtgtaaaatgcgcttcaagaatgttgatgatgatgatatagaattgtggctttagtagcacagaggatgccccaacaaactcatggcgttgaaaccacacagttctcattactgttatttattagctgtagcattctctgtctcctctctctcctcctttgaccttctcctcgaccagccatcatgacatttaccatgaatttacttcctcccaagagtttggactgcccgtcagattgtttctgcacatagttgcctttgtatctctgtatgaaataaaaggtcatttgtt

SEQ ID NO: 342083 - DNA, 842 bp, Homo sapiens
cttagaactttttgaggcttttcatgtaatatgtttaagaatgtactggtatctgtaaagtcactctaccccagctttggcaaaggcatttggctctacctggggctgccgacactctggctgcatgtagcctgagctgtcacttatgactatggctctctctgtccctagtgactgcttttgagagatgagaaccttaaggcctggagtcataggaatgagtaatctttacataattttctttgctttgctcagagtggtcagactgaccccctgcagaaggaggagctgcagtctggagtggatgctgcaaacagtgctgcccagcaatatcagagaagtaagagtccattgaaattgtatgggaggaaagttgtggctttgtgttattgaagggtctgaggttagcttctgtcatcgtcatcacccactctgagcctactagccataaccaactgccaggtacttttggtggcaggagggttcctccagtttgttgttgtggtggttttaattgctgtgtaatagttgtacatattttgagggtacatgtgttttgttttttaaaccaaccaagaagcactgacaccaaccaagaagcactgacgtatgatattttgatacatgcatacaatgtattatgatcaaatcagggtaattggaatatttgtcacctaacgcatttatcttttgttgatgttgggaacattccagttcttctgttttgaactatacattattgttaactatcatcatcctactgtgctatctaacactagacctattccttgtatctaatggtaattttgtacccgttagccaacctctctatgtcctcctcc

SEQ ID NO: 342084 - DNA, 608 bp, Homo sapiens
gttcttccagatggagggatggcccgtgcccttgttcccctgtcactgctggaagtggtccttcctaaaacttcatcatgaaattgcacttggatcatgtatcaagatgaaagtttttttttaacttccattgatgcttgggaagtaatatgtcttctgtaacatttgactgtttcagtcacagtggagaggatacaagcagaagaaggcatatcaagatcggttagcttacctgcgctcccacaaagatgaagttgtaaaggtatggtagcctgaacagggtttctccatgaggggcacaggtataacacgtgttgagatgaaggactcttctaatttccaggatcccttttccacagattcagtccctggcaaggatgcaccaagctcgaaagcgctatcgagatcgcctgcagtacttccgggaccatataaatgacattatcaaaatccaggcttttattcgggcaaacaaagctcgggatgactacaagactctcagtgagtaactggctccgcatgaagagttgaggcagtggctgggagccacacaagttcagggtattctccacagacctcttttgttatcctgaaggcaaggcttgggg

SEQ ID NO: 342085 - DNA, 531 bp, Homo sapiens
ccactttagtccactttttcaagacaatgctatttcctgagacgtagtactttttctgctaactccattctttgatgcatactttctgtcagtcaatgctgaggatcctcctatggttgtggtccgaaaatttgtccacctgctggaccaaagtgaccaggattttcaggaggagcttgaccttatgaagatgcgggaagaggttatcaccctcattcgttctaaccagcagctggagaatgacctcaatctcatggatatcaaaattggactgctagtgaaaaataagattacgttgcaggtatggcccagtgccagcgggggccttggaacggttcatcctgctttgtaacccctgcattcccctttctgactggtggggagggtggaggctgactttctcctcagctactgccataagagctttttttttttcttttgactgagtctcactctgttgcccaggttgcagtgagccgagattgcatgactgcactccggactgggtgacagagtgaaactctatctcca

SEQ ID NO: 342086 - DNA, 7274 bp, Homo sapiens
  misc_feature (8)..(8): n is a, c, g, or t
gacggcanggggcggggcctcggggaccccggcaagcccgcgcacttggcaggagctgtagctaccgccgtccgcgcctccaaggtttcacggcttcctcagcagagactcgggctcgtccgccatgtccgccgcagacgaggttgacgggctgggcgtggcccggccgcactatggctctgtcctggataatgaaagacttactgcagaggagatggatgaaaggagacgtcagaacgtggcttatgagtacctttgtcatttggaagaagcgaagaggtggatggaagcatgcctaggggaagatctgcctcccaccacagaactggaggaggggcttaggaatggggtctaccttgccaaactggggaacttcttctctcccaaagtagtgtccctgaaaaaaatctatgatcgagaacagaccagatacaaggcgactggcctccactttagacacactgataatgtgattcagtggttgaatgccatggatgagattggattgcctaagattttttacccagaaactacagatatctatgatcgaaagaacatgccaagatgtatctactgtatccatgcactcagtttgtacctgttcaagctaggcctggcccctcagattcaagacctatatggaaaggttgacttcacagaagaagaaatcaacaacatgaagactgagttggagaagtatggcatccagatgcctgcctttagcaagattgggggcatcttggctaatgaactgtcagtggatgaagccgcattacatgctgctgttattgctattaatgaagctattgaccgtagaattccagccgacacatttgcagctttgaaaaatccgaatgccatgcttgtaaatcttgaagagcccttggcatccacttaccaggatatactttaccaggctaagcaggacaaaatgacaaatgctaaaaacaggacagaaaactcagagagagaaagagatgtttatgaggagctgctcacgcaagctgaaattcaaggcaatataaacaaagtcaatacattttctgcattagcaaatatcgacctggctttagaacaaggagatgcactggccttgttcagggctctgcagtcaccagccctggggcttcgaggactgcagcaacagaatagcgactggtacttgaagcagctcctgagtgataaacagcagaagagacagagtggtcagactgaccccctgcagaaggaggagctgcagtctggagtggatgctgcaaacagtgctgcccagcaatatcagagaagattggcagcagtagcactgattaatgctgcaatccagaagggtgttgctgagaagactgttttggaactgatgaatcccgaagcccagctgccccaggtgtatccatttgccgccgatctctatcagaaggagctggctaccctgcagcgacaaagtcctgaacataatctcacccacccagagctctctgtcgcagtggagatgttgtcatcggtggccctgatcaacagggcattggaatcaggagatgtgaatacagtgtggaagcaattgagcagttcagttactggtcttaccaatattgaggaagaaaactgtcagaggtatctcgatgagttgatgaaactgaaggctcaggcacatgcagagaataatgaattcattacatggaatgatatccaagcttgcgtggaccatgtgaacctggtggtgcaagaggaacatgagaggattttagccattggtttaattaatgaagccctggatgaaggtgatgcccaaaagactctgcaggccctacagattcctgcagctaaacttgagggagtccttgcagaagtggcccagcattaccaagacacgctgattagagcgaagagagagaaagcccaggaaatccaggatgagtcagctgtgttatggttggatgaaattcaaggtggaatctggcagtccaacaaagacacccaagaagcacagaagtttgccttaggaatctttgccattaatgaggcagtagaaagtggtgatgttggcaaaacactgagtgcccttcgctcccctgatgttggcttgtatggagtcatccctgagtgtggtgaaacttaccacagtgatcttgctgaagccaagaagaaaaaactggcagtaggagataataacagcaagtgggtgaagcactgggtaaaaggtggatattattattaccacaatctggagacccaggaaggaggatgggatgaacctccaaattttgtgcaaaattctatgcagctttctcgggaggagatccagagttctatctctggggtgactgccgcatataaccgagaacagctgtggctggccaatgaaggcctgatcaccaggctgcaggctcgctgccgtggatacttagttcgacaggaattccgatccaggatgaatttcctgaagaaacaaatccctgccatcacctgcattcagtcacagtggagaggatacaagcagaagaaggcatatcaagatcggttagcttacctgcgctcccacaaagatgaagttgtaaagattcagtccctggcaaggatgcaccaagctcgaaagcgctatcgagatcgcctgcagtacttccgggaccatataaatgacattatcaaaatccaggcttttattcgggcaaacaaagctcgggatgactacaagactctcatcaatgctgaggatcctcctatggttgtggtccgaaaatttgtccacctgctggaccaaagtgaccaggattttcaggaggagcttgaccttatgaagatgcgggaagaggttatcaccctcattcgttctaaccagcagctggagaatgacctcaatctcatggatatcaaaattggactgctagtgaaaaataagattacgttgcaggatgtggtttcccacagtaaaaaacttaccaaaaaaaataaggaacagttgtctgatatgatgatgataaataaacagaagggaggtctcaaggctttgagcaaggagaagagagagaagttggaagcttaccagcacctgttttatttattgcaaaccaatcccacctatctggccaagctcatttttcagatgccccagaacaagtccaccaagttcatggactctgtaatcttcacactctacaactacgcgtccaaccagcgagaggagtacctgctcctgcggctctttaagacagcactccaagaggaaatcaagtcgaaggtagatcagattcaagagattgtgacaggaaatcctacggttattaaaatggttgtaagtttcaaccgtggtgcccgtggccagaatgccctgagacagatcttggccccagtcgtgaaggaaattatggatgacaaatctctcaacatcaaaactgaccctgtggatatttacaaatcttgggttaatcagatggagtctcagacaggagaggcaagcaaactgccctatgatgtgacccctgagcaggcgctagctcatgaagaagtgaagacacggctagacagctccatcaggaacatgcgggctgtgacagacaagtttctctcagccattgtcagctctgtggacaaaatcccttatgggatgcgcttcattgccaaagtgctgaaggactcgttgcatgagaagttccctgatgctggtgaggatgagctgctgaagattattggtaacttgctttattatcgatacatgaatccagccattgttgctcctgatgcctttgacatcattgacctgtcagcaggaggccagcttaccacagaccaacgccgaaatctgggctccattgcaaaaatgcttcagcatgctgcttccaataagatgtttctgggagataatgcccacttaagcatcattaatgaatatctttcccagtcctaccagaaattcagacggtttttccaaactgcttgtgatgtcccagagcttcaggataaatttaatgtggatgagtactctgatttagtaaccctcaccaaaccagtaatctacatttccattggtgaaatcatcaacacccacactctcctgttggatcaccaggatgccattgctccggagcacaatgatccaatccacgaactgctggacgacctcggcgaggtgcccaccatcgagtccctgataggggaaagctctggcaatttaaatgacccaaataaggaggcactggctaagacggaagtgtctctcaccctgaccaacaagttcgacgtgcctggagatgagaatgcagaaatggatgctcgaaccatcttactgaatacaaaacgtttaattgtggatgtcatccggttccagccaggagagaccttgactgaaatcctagaaacaccagccaccagtgaacaggaagcagaacatcagagagccatgcagagacgtgctatccgtgatgccaaaacacctgacaagatgaaaaagtcaaaatctgtaaaggaagacagcaacctcactcttcaagagaagaaagagaagatccagacaggtttaaagaagctaacagagcttggaaccgtggacccaaagaacaaataccaggaactgatcaacgacattgccagggatattcggaatcagcggaggtaccgacagaggagaaaggccgaactagtgaaactgcaacagacatacgctgctctgaactctaaggccaccttttatggggagcaggtggattactataaaagctatatcaaaacctgcttggataacttagccagcaagggcaaagtctccaaaaagcctagggaaatgaaaggaaagaaaagcaaaaagatttctctgaaatatacagcagcaagactacatgaaaaaggagttcttctggaaattgaggacctgcaagtgaatcagtttaaaaatgttatatttgaaatcagtccaacagaagaagttggagacttcgaagtgaaagccaaattcatgggagttcaaatggagacttttatgttacattatcaggacctgctgcagctacagtatgaaggagttgcagtcatgaaattatttgatagagctaaagtaaatgtcaacctcctgatcttccttctcaacaaaaagttctacgggaagtaattgatcgtttgctgccagcccagaaggatgaaggaaagaagcacctcacagctcctttctaggtccttctttcctcattggaagcaaagacctagccaacaacagcacctcaatctgatacactcccgatgccacatttttaactcctctcgctctgatgggacatttgttacccttttttcatagtgaaattgtgtttcaggcttagtctgacctttctggtttcttcattttcttccattacttaggaaagagtggaaactccactaaaatttctctgtgttgttacagtcttagaggttgcagtactatattgtaagctttggtgtttgtttaattagcaatagggatggtaggattcaaatgtgtgtcatttagaagtggaagctattagcaccaatgacataaatacatacaagacacagaactaaaatgtcatgttattaacagttattaggttgtcatttaaaaataaagttcctttatatttctgtcccatcaggaaaactgaaggatatggggaatcattggttatcttccattgtgtttttctttatggacaggagctaatggaagtgacagtcatgttcaaaggaagcatttctagaaaaaaggagataatgtttttaaatttcattatcaaacttgggcaattctgtttgtgtaactccccgactagtggatgggagagtcccattgctaaaattcagctactcagataaattcagaatgggtcaaggcacctgcctgtttttgttggtgcacagagattgacttgattcagagagacaattcactccatccctatggcagaggaatgggttagccctaatgtagaatgtcattgtttttaaaactgttttatatcttaagagtgccttattaaagtatagatgtatgtcttaaaatgtgggtgataggaattttaaagatttatataatgcatcaaaagccttagaataagaaaagctttttttaaattgctttatctgtatatctgaactcttgaaacttatagctaaaacactaggatttatctgcagtgttgcagggagataattctgccttaaattgtctaaaacaaaaacaaaaccagccaacctatgttacacgtgagattaaaaccaattttttccccattttttctccttttttctcttgctgcccacattgtgcctttattttatgagccccagttttctgggcttagtttaaaaaaaaaatcaagtctaaacattgcatttagaaagcttttgttcttggataaaaagtcatacactttaaaaaaaaaaaaaactttttccaggaaaatatattgaaatcatgctgctgagcctctattttctttctttgatgttttgattcagtattcttttatcataaatttttagcatttaaaaattcactgatgtacattaagccaataaactgctttaatgaataacaaactatgtagtgtgtccctattataaatgcattggagaagtatttttatgagactctttactcaggtgcatggttacagcccacagggaggcatggagtgccatggaaggattcgccactacccagaccttgttttttgttgtattttggaagacaggttttttaaagaaacattttcctcagattaaaagatgatgctattacaactagcattgcctcaaaaactgggaccaaccaaagtgtgtcaaccctgtttccttaaaagaggctatgaatcccaaaggccacatccaagacaggcaataatgagcagagtttacagctcctttaataaaatgtgtcagtaattttaaggtttatagttccctcaacacaattgctaatgcagaatagtgtaaaatgcgcttcaagaatgttgatgatgatgatatagaattgtggctttagtagcacagaggatgccccaacaaactcatggcgttgaaaccacacagttctcattactgttatttattagctgtagcattctctgtctcctctctctcctcctttgaccttctcctcgaccagccatcatgacatttaccatgaatttacttcctcccaagagtttggactgcccgtcagattgtttctgcacatagttgcctttgtatctctgtatgaaataaaaggtcatttgttaaaaaaaaaaggggggggtaaaaatcctcgagggccaagtaggtcc

SEQ ID NO: 342087 - DNA, 7218 bp, Homo sapiens
  misc_feature (8)..(8): n is a, c, g, or t
gacggcanggggcggggcctcggggaccccggcaagcccgcgcacttggcaggagctgtagctaccgccgtccgcgcctccaaggtttcacggcttcctcagcagagactcgggctcgtccgccatgtccgccgcagacgaggttgacgggctgggcgtggcccggccgcactatggctctgtcctggataatgaaagacttactgcagaggagatggatgaaaggagacgtcagaacgtggcttatgagtacctttgtcatttggaagaagcgaagaggtggatggaagcatgcctaggggaagatctgcctcccaccacagaactggaggaggggcttaggaatggggtctaccttgccaaactggggaacttcttctctcccaaagtagtgtccctgaaaaaaatctatgatcgagaacagaccagatacaaggcgactggcctccactttagacacactgataatgtgattcagtggttgaatgccatggatgagattggattgcctaagattttttacccagaaactacagatatctatgatcgaaagaacatgccaagatgtatctactgtatccatgcactcagtttgtacctgttcaagctaggcctggcccctcagattcaagacctatatggaaaggttgacttcacagaagaagaaatcaacaacatgaagactgagttggagaagtatggcatccagatgcctgcctttagcaagattgggggcatcttggctaatgaactgtcagtggatgaagccgcattacatgctgctgttattgctattaatgaagctattgaccgtagaattccagccgacacatttgcagctttgaaaaatccgaatgccatgcttgtaaatcttgaagagcccttggcatccacttaccaggatatactttaccaggctaagcaggacaaaatgacaaatgctaaaaacaggacagaaaactcagagagagaaagagatgtttatgaggagctgctcacgcaagctgaaattcaaggcaatataaacaaagtcaatacattttctgcattagcaaatatcgacctggctttagaacaaggagatgcactggccttgttcagggctctgcagtcaccagccctggggcttcgaggactgcagcaacagaatagcgactggtacttgaagcagctcctgagtgataaacagcagaagagacagagtggtcagactgaccccctgcagaaggaggagctgcagtctggagtggatgctgcaaacagtgctgcccagcaatatcagagaagattggcagcagtagcactgattaatgctgcaatccagaagggtgttgctgagaagactgttttggaactgatgaatcccgaagcccagctgccccaggtgtatccatttgccgccgatctctatcagaaggagctggctaccctgcagcgacaaagtcctgaacataatctcacccacccagagctctctgtcgcagtggagatgttgtcatcggtggccctgatcaacagggcattggaatcaggagatgtgaatacagtgtggaagcaattgagcagttcagttactggtcttaccaatattgaggaagaaaactgtcagaggtatctcgatgagttgatgaaactgaaggctcaggcacatgcagagaataatgaattcattacatggaatgatatccaagcttgcgtggaccatgtgaacctggtggtgcaagaggaacatgagaggattttagccattggtttaattaatgaagccctggatgaaggtgatgcccaaaagactctgcaggccctacagattcctgcagctaaacttgagggagtccttgcagaagtggcccagcattaccaagacacgctgattagagcgaagagagagaaagcccaggaaatccaggatgagtcagctgtgttatggttggatgaaattcaaggtggaatctggcagtccaacaaagacacccaagaagcacagaagtttgccttaggaatctttgccattaatgaggcagtagaaagtggtgatgttggcaaaacactgagtgcccttcgctcccctgatgttggcttgtatggagtcatccctgagtgtggtgaaacttaccacagtgatcttgctgaagccaagaagaaaaaactggcagtaggagataataacagcaagtgggtgaagcactgggtaaaaggtggatattattattaccacaatctggagacccaggaaggaggatgggatgaacctccaaattttgtgcaaaattctatgcagctttctcgggaggagatccagagttctatctctggggtgactgccgcatataaccgagaacagctgtggctggccaatgaaggcctgatcaccaggctgcaggctcgctgccgtggatacttagttcgacaggaattccgatccaggatgaatttcctgaagaaacaaatccctgccatcacctgcattcagtcacagtggagaggatacaagcagaagaaggcatatcaagatcggttagcttacctgcgctcccacaaagatgaagttgtaaagattcagtccctggcaaggatgcaccaagctcgaaagcgctatcgagatcgcctgcagtacttccgggaccatataaatgacattatcaaaatccaggcttttattcgggcaaacaaagctcgggatgactacaagactctcatcaatgctgaggatcctcctatggttgtggtccgaaaatttgtccacctgctggaccaaagtgaccaggattttcaggaggagcttgaccttatgaagatgcgggaagaggttatcaccctcattcgttctaaccagcagctggagaatgacctcaatctcatggatatcaaaattggactgctagtgaaaaataagattacgttgcaggatgtggtttcccacagtaaaaaacttaccaaaaaaaataaggaacagttgtctgatatgatgatgataaataaacagaagggaggtctcaaggctttgagcaaggagaagagagagaagttggaagcttaccagcacctgttttatttattgcaaaccaatcccacctatctggccaagctcatttttcagatgccccagaacaagtccaccaagttcatggactctgtaatcttcacactctacaactacgcgtccaaccagcgagaggagtacctgctcctgcggctctttaagacagcactccaagaggaaatcaagtcgaaggtagatcagattcaagagattgtgacaggaaatcctacggttattaaaatggttgtaagtttcaaccgtggtgcccgtggccagaatgccctgagacagatcttggccccagtcgtgaaggaaattatggatgacaaatctctcaacatcaaaactgaccctgtggatatttacaaatcttgggttaatcagatggagtctcagacaggagaggcaagcaaactgccctatgatgtgacccctgagcaggcgctagctcatgaagaagtgaagacacggctagacagctccatcaggaacatgcgggctgtgacagacaagtttctctcagccattgtcagctctgtggacaaaatcccttatgggatgcgcttcattgccaaagtgctgaaggactcgttgcatgagaagttccctgatgctggtgaggatgagctgctgaagattattggtaacttgctttattatcgatacatgaatccagccattgttgctcctgatgcctttgacatcattgacctgtcagcaggaggccagcttaccacagaccaacgccgaaatctgggctccattgcaaaaatgcttcagcatgctgcttccaataagatgtttctgggagataatgcccacttaagcatcattaatgaatatctttcccagtcctaccagaaattcagacggtttttccaaactgcttgtgatgtcccagagcttcaggataaatttaatgtggatgagtactctgatttagtaaccctcaccaaaccagtaatctacatttccattggtgaaatcatcaacacccacactctcctgttggatcaccaggatgccattgctccggagcacaatgatccaatccacgaactgctggacgacctcggcgaggtgcccaccatcgagtccctgataggggaaagctctggcaatttaaatgacccaaataaggaggcactggctaagacggaagtgtctctcaccctgaccaacaagttcgacgtgcctggagatgagaatgcagaaatggatgctcgaaccatcttactgaatacaaaacgtttaattgtggatgtcatccggttccagccaggagagaccttgactgaaatcctagaaacaccagccaccagtgaacaggaagcagaacatcagagagccatgcagagacgtgctatccgtgatgccaaaacacctgacaagatgaaaaagtcaaaatctgtaaaggaagacagcaacctcactcttcaagagaagaaagagaagatccagacaggtttaaagaagctaacagagcttggaaccgtggacccaaagaacaaataccaggaactgatcaacgacattgccagggatattcggaatcagcggaggtaccgacagaggagaaaggccgaactagtgaaactgcaacagacatacgctgctctgaactctaaggccaccttttatggggagcaggtggattactataaaagctatatcaaaacctgcttggataacttagccagcaagggcaaagtctccaaaaagcctagggaaatgaaaggaaagaaaagcaaaaagatttctctgaaatatacagcagcaagactacatgaaaaaggagttcttctggaaattgaggacctgcaagtgaatcagtttaaaaatgttatatttgaaatcagtccaacagaagaagttggagacttcgaagtgaaagccaaattcatgggagttcaaatggagacttttatgttacattatcaggacctgctgcagctacagtatgaaggagttgcagtcatgaaattatttgatagagctaaagtaaatgtcaacctcctgatcttccttctcaacaaaaagttctacgggaagtaattgatcgtttgctgccagcccagaaggatgaaggaaagaagcacctcacagctcctttctaggtccttctttcctcattggaagcaaagacctagccaacaacagcacctcaatctgatacactcccgatgccacatttttaactcctctcgctctgatgggacatttgttacccttttttcatagtgaaattgtgtttcaggcttagtctgacctttctggtttcttcattttcttccattacttaggaaagagtggaaactccactaaaatttctctgtgttgttacagtcttagaggttgcagtactatattgtaagctttggtgtttgtttaattagcaatagggatggtaggattcaaatgtgtgtcatttagaagtggaagctattagcaccaatgacataaatacatacaagacacagaactaaaatgtcatgttattaacagttattaggttgtcatttaaaaataaagttcctttatatttctgtcccatcaggaaaactgaaggatatggggaatcattggttatcttccattgtgtttttctttatggacaggagctaatggaagtgacagtcatgttcaaaggaagcatttctagaaaaaaggagataatgtttttaaatttcattatcaaacttgggcaattctgtttgtgtaactccccgactagtggatgggagagtcccattgctaaaattcagctactcagataaattcagaatgggtcaaggcacctgcctgtttttgttggtgcacagagattgacttgattcagagagacaattcactccatccctatggcagaggaatgggttagccctaatgtagaatgtcattgtttttaaaactgttttatatcttaagagtgccttattaaagtatagatgtatgtcttaaaatgtgggtgataggaattttaaagatttatataatgcatcaaaagccttagaataagaaaagctttttttaaattgctttatctgtatatctgaactcttgaaacttatagctaaaacactaggatttatctgcagtgttgcagggagataattctgccttaaattgtctaaaacaaaaacaaaaccagccaacctatgttacacgtgagattaaaaccaattttttccccattttttctccttttttctcttgctgcccacattgtgcctttattttatgagccccagttttctgggcttagtttaaaaaaaaaatcaagtctaaacattgcatttagaaagcttttgttcttggataaaaagtcatacactttaaaaaaaaaaaaaactttttccaggaaaatatattgaaatcatgctgctgagcctctattttctttctttgatgttttgattcagtattcttttatcataaatttttagcatttaaaaattcactgatgtacattaagccaataaactgctttaatgaataacaaactatgtagtgtgtccctattataaatgcattggagaagtatttttatgagactctttactcaggtgcatggttacagcccacagggaggcatggagtgccatggaaggattcgccactacccagaccttgttttttgttgtattttggaagacaggttttttaaagaaacattttcctcagattaaaagatgatgctattacaactagcattgcctcaaaaactgggaccaaccaaagtgtgtcaaccctgtttccttaaaagaggctatgaatcccaaaggccacatccaagacaggcaataatgagcagagtttacagctcctttaataaaatgtgtcagtaattttaaggtttatagttccctcaacacaattgctaatgcagaatagtgtaaaatgcgcttcaagaatgttgatgatgatgatatagaattgtggctttagtagcacagaggatgccccaacaaactcatggcgttgaaaccacacagttctcattactgttatttattagctgtagcattctctgtctcctctctctcctcctttgaccttctcctcgaccagccatcatgacatttaccatgaatttacttcctcccaagagtttggactgcccgtcagattgtttctgcacatagttgcctttcggagaagagggatcctctaga

SEQ ID NO: 342088 - DNA, 5632 bp, Homo sapiens
gtggagtagtctccagtccagcgccaacgctgccttgtcgccgcaggccctggggtgcaggcacgcagttgatagcaggtgtagtgcgcagcgctcagtgctcgttcatctcgtccaagtggagatgcgttttccaatagtgtcaaagggtgtctgtactcagcaaaaggccctggatgaaggtgatgcccaaaagactctgcaggccctacagattcctgcagctaaacttgagggagtccttgcagaagtggcccagcattaccaagacacgctgattagagcgaagagagagaaagcccaggaaatccaggatgagtcagctgtgttatggttggatgaaattcaaggtggaatctggcagtccaacaaagacacccaagaagcacagaagtttgccttaggaatctttgccattaatgaggcagtagaaagtggtgatgttggcaaaacactgagtgcccttcgctcccctgatgttggcttgtatggagtcatccctgagtgtggtgaaacttaccacagtgatcttgctgaagccaagaagaaaaaactggcagtaggagataataacagcaagtgggtgaagcactgggtaaaaggtggatattattattaccacaatctggagacccaggaaggaggatgggatgaacctccaaattttgtgcaaaattctatgcagctttctcgggaggagatccagagttctatctctggggtgactgccgcatataaccgagaacagctgtggctggccaatgaaggcctgatcaccaggctgcaggctcgctgccgtggatacttagttcgacaggaattccgatccaggatgaatttcctgaagaaacaaatccctgccatcacctgcattcagtcacagtggagaggatacaagcagaagaaggcatatcaagatcggttagcttacctgcgctcccacaaagatgaagttgtaaagattcagtccctggcaaggatgcaccaagctcgaaagcgctatcgagatcgcctgcagtacttccgggaccatataaatgacattatcaaaatccaggcttttattcgggcaaacaaagctcgggatgactacaagactctcatcaatgctgaggatcctcctatggttgtggtccgaaaatttgtccacctgctggaccaaagtgaccaggattttcaggaggagcttgaccttatgaagatgcgggaagaggttatcaccctcattcgttctaaccagcagctggagaatgacctcaatctcatggatatcaaaattggactgctagtgaaaaataagattacgttgcaggatgtggtttcccacagtaaaaaacttaccaaaaaaaataaggaacagttgtctgatatgatgatgataaataaacagaagggaggtctcaaggctttgagcaaggagaagagagagaagttggaagcttaccagcacctgttttatttattgcaaaccaatcccacctatctggccaagctcatttttcagatgccccagaacaagtccaccaagttcatggactctgtaatcttcacactctacaactacgcgtccaaccagcgagaggagtacctgctcctgcggctctttaagacagcactccaagaggaaatcaagtcgaaggtagatcagattcaagagattgtgacaggaaatcctacggttattaaaatggttgtaagtttcaaccgtggtgcccgtggccagaatgccctgagacagatcttggccccagtcgtgaaggaaattatggatgacaaatctctcaacatcaaaactgaccctgtggatatttacaaatcttgggttaatcagatggagtctcagacaggagaggcaagcaaactgccctatgatgtgacccctgagcaggcgctagctcatgaagaagtgaagacacggctagacagctccatcaggaacatgcgggctgtgacagacaagtttctctcagccattgtcagctctgtggacaaaatcccttatgggatgcgcttcattgccaaagtgctgaaggactcgttgcatgagaagttccctgatgctggtgaggatgagctgctgaagattattggtaacttgctttattatcgatacatgaatccagccattgttgctcctgatgcctttgacatcattgacctgtcagcaggaggccagcttaccacagaccaacgccgaaatctgggctccattgcaaaaatgcttcagcatgctgcttccaataagatgtttctgggagataatgcccacttaagcatcattaatgaatatctttcccagtcctaccagaaattcagacggtttttccaaactgcttgtgatgtcccagagcttcaggataaatttaatgtggatgagtactctgatttagtaaccctcaccaaaccagtaatctacatttccattggtgaaatcatcaacacccacactctcctgttggatcaccaggatgccattgctccggagcacaatgatccaatccacgaactgctggacgacctcggcgaggtgcccaccatcgagtccctgataggggaaagctctggcaatttaaatgacccaaataaggaggcactggctaagacggaagtgtctctcaccctgaccaacaagttcgacgtgcctggagatgagaatgcagaaatggatgctcgaaccatcttactgaatacaaaacgtttaattgtggatgtcatccggttccagccaggagagaccttgactgaaatcctagaaacaccagccaccagtgaacaggaagcagaacatcagagagccatgcagagacgtgctatccgtgatgccaaaacacctgacaagatgaaaaagtcaaaatctgtaaaggaagacagcaacctcactcttcaagagaagaaagagaagatccagacaggtttaaagaagctaacagagcttggaaccgtggacccaaagaacaaataccaggaactgatcaacgacattgccagggatattcggaatcagcggaggtaccgacagaggagaaaggccgaactagtgaaactgcaacagacatacgctgctctgaactctaaggccaccttttatggggagcaggtggattactataaaagctatatcaaaacctgcttggataacttagccagcaagggcaaagtctccaaaaagcctagggaaatgaaaggaaagaaaagcaaaaagatttctctgaaatatacagcagcaagactacatgaaaaaggagttcttctggaaattgaggacctgcaagtgaatcagtttaaaaatgttatatttgaaatcagtccaacagaagaagttggagacttcgaagtgaaagccaaattcatgggagttcaaatggagacttttatgttacattatcaggacctgctgcagctacagtatgaaggagttgcagtcatgaaattatttgatagagctaaagtaaatgtcaacctcctgatcttccttctcaacaaaaagttctacgggaagtaattgatcgtttgctgccagcccagaaggatgaaggaaagaagcacctcacagctcctttctaggtccttctttcctcattggaagcaaagacctagccaacaacagcacctcaatctgatacactcccgatgccacatttttaactcctctcgctctgatgggacatttgttacccttttttcatagtgaaattgtgtttcaggcttagtctgacctttctggtttcttcattttcttccattacttaggaaagagtggaaactccactaaaatttctctgtgttgttacagtcttagaggttgcagtactatattgtaagctttggtgtttgtttaattagcaatagggatggtaggattcaaatgtgtgtcatttagaagtggaagctattagcaccaatgacataaatacatacaagacacagaactaaaatgtcatgttattaacagttattaggttgtcatttaaaaataaagttcctttatatttctgtcccatcaggaaaactgaaggatatggggaatcattggttatcttccattgtgtttttctttatggacaggagctaatggaagtgacagtcatgttcaaaggaagcatttctagaaaaaaggagataatgtttttaaatttcattatcaaacttgggcaattctgtttgtgtaactccccgactagtggatgggagagtcccattgctaaaattcagctactcagataaattcagaatgggtcaaggcacctgcctgtttttgttggtgcacagagattgacttgattcagagagacaattcactccatccctatggcagaggaatgggttagccctaatgtagaatgtcattgtttttaaaactgttttatatcttaagagtgccttattaaagtatagatgtatgtcttaaaatgtgggtgataggaattttaaagatttatataatgcatcaaaagccttagaataagaaaagctttttttaaattgctttatctgtatatctgaactcttgaaacttatagctaaaacactaggatttatctgcagtgttgcagggagataattctgccttaaattgtctaaaacaaaaacaaaaccagccaacctatgttacacgtgagattaaaaccaattttttccccattttttctccttttttctcttgctgcccacattgtgcctttattttatgagccccagttttctgggcttagtttaaaaaaaaaatcaagtctaaacattgcatttagaaagcttttgttcttggataaaaagtcatacactttaaaaaaaaaaaaaactttttccaggaaaatatattgaaatcatgctgctgagcctctattttctttctttgatgttttgattcagtattcttttatcataaatttttagcatttaaaaattcactgatgtacattaagccaataaactgctttaatgaataacaaactatgtagtgtgtccctattataaatgcattggagaagtatttttatgagactctttactcaggtgcatggttacagcccacagggaggcatggagtgccatggaaggattcgccactacccagaccttgttttttgttgtattttggaagacaggttttttaaagaaacattttcctcagattaaaagatgatgctattacaactagcattgcctcaaaaactgggaccaaccaaagtgtgtcaaccctgtttccttaaaagaggctatgaatcccaaaggccacatccaagacaggcaataatgagcagagtttacagctcctttaataaaatgtgtcagtaattttaaggtttatagttccctcaacacaattgctaatgcagaatagtgtaaaatgcgcttcaagaatgttgatgatgatgatatagaattgtggctttagtagcacagaggatgccccaacaaactcatggcgttgaaaccacacagttctcattactgttatttattagctgtagcattctctgtctcctctctctcctcctttgaccttctcctcgaccagccatcatgacatttaccatgaatttacttcctcccaagagtttggactgcccgtcagattgtttctgcacatagttgcctttgtatctctgtatgaaataaaaggtcatttgtt

SEQ ID NO: 342089 - DNA, 4621 bp, Homo sapiens
ccactttagtccactttttcaagacaatgctatttcctgagacgtagtactttttctgctaactccattctttgatgcatactttctgtcagtcaatgctgaggatcctcctatggttgtggtccgaaaatttgtccacctgctggaccaaagtgaccaggattttcaggaggagcttgaccttatgaagatgcgggaagaggttatcaccctcattcgttctaaccagcagctggagaatgacctcaatctcatggatatcaaaattggactgctagtgaaaaataagattacgttgcaggatgtggtttcccacagtaaaaaacttaccaaaaaaaataaggaacagttgtctgatatgatgatgataaataaacagaagggaggtctcaaggctttgagcaaggagaagagagagaagttggaagcttaccagcacctgttttatttattgcaaaccaatcccacctatctggccaagctcatttttcagatgccccagaacaagtccaccaagttcatggactctgtaatcttcacactctacaactacgcgtccaaccagcgagaggagtacctgctcctgcggctctttaagacagcactccaagaggaaatcaagtcgaaggtagatcagattcaagagattgtgacaggaaatcctacggttattaaaatggttgtaagtttcaaccgtggtgcccgtggccagaatgccctgagacagatcttggccccagtcgtgaaggaaattatggatgacaaatctctcaacatcaaaactgaccctgtggatatttacaaatcttgggttaatcagatggagtctcagacaggagaggcaagcaaactgccctatgatgtgacccctgagcaggcgctagctcatgaagaagtgaagacacggctagacagctccatcaggaacatgcgggctgtgacagacaagtttctctcagccattgtcagctctgtggacaaaatcccttatgggatgcgcttcattgccaaagtgctgaaggactcgttgcatgagaagttccctgatgctggtgaggatgagctgctgaagattattggtaacttgctttattatcgatacatgaatccagccattgttgctcctgatgcctttgacatcattgacctgtcagcaggaggccagcttaccacagaccaacgccgaaatctgggctccattgcaaaaatgcttcagcatgctgcttccaataagatgtttctgggagataatgcccacttaagcatcattaatgaatatctttcccagtcctaccagaaattcagacggtttttccaaactgcttgtgatgtcccagagcttcaggataaatttaatgtggatgagtactctgatttagtaaccctcaccaaaccagtaatctacatttccattggtgaaatcatcaacacccacactctcctgttggatcaccaggatgccattgctccggagcacaatgatccaatccacgaactgctggacgacctcggcgaggtgcccaccatcgagtccctgataggggaaagctctggcaatttaaatgacccaaataaggaggcactggctaagacggaagtgtctctcaccctgaccaacaagttcgacgtgcctggagatgagaatgcagaaatggatgctcgaaccatcttactgaatacaaaacgtttaattgtggatgtcatccggttccagccaggagagaccttgactgaaatcctagaaacaccagccaccagtgaacaggaagcagaacatcagagagccatgcagagacgtgctatccgtgatgccaaaacacctgacaagatgaaaaagtcaaaatctgtaaaggaagacagcaacctcactcttcaagagaagaaagagaagatccagacaggtttaaagaagctaacagagcttggaaccgtggacccaaagaacaaataccaggaactgatcaacgacattgccagggatattcggaatcagcggaggtaccgacagaggagaaaggccgaactagtgaaactgcaacagacatacgctgctctgaactctaaggccaccttttatggggagcaggtggattactataaaagctatatcaaaacctgcttggataacttagccagcaagggcaaagtctccaaaaagcctagggaaatgaaaggaaagaaaagcaaaaagatttctctgaaatatacagcagcaagactacatgaaaaaggagttcttctggaaattgaggacctgcaagtgaatcagtttaaaaatgttatatttgaaatcagtccaacagaagaagttggagacttcgaagtgaaagccaaattcatgggagttcaaatggagacttttatgttacattatcaggacctgctgcagctacagtatgaaggagttgcagtcatgaaattatttgatagagctaaagtaaatgtcaacctcctgatcttccttctcaacaaaaagttctacgggaagtaattgatcgtttgctgccagcccagaaggatgaaggaaagaagcacctcacagctcctttctaggtccttctttcctcattggaagcaaagacctagccaacaacagcacctcaatctgatacactcccgatgccacatttttaactcctctcgctctgatgggacatttgttacccttttttcatagtgaaattgtgtttcaggcttagtctgacctttctggtttcttcattttcttccattacttaggaaagagtggaaactccactaaaatttctctgtgttgttacagtcttagaggttgcagtactatattgtaagctttggtgtttgtttaattagcaatagggatggtaggattcaaatgtgtgtcatttagaagtggaagctattagcaccaatgacataaatacatacaagacacagaactaaaatgtcatgttattaacagttattaggttgtcatttaaaaataaagttcctttatatttctgtcccatcaggaaaactgaaggatatggggaatcattggttatcttccattgtgtttttctttatggacaggagctaatggaagtgacagtcatgttcaaaggaagcatttctagaaaaaaggagataatgtttttaaatttcattatcaaacttgggcaattctgtttgtgtaactccccgactagtggatgggagagtcccattgctaaaattcagctactcagataaattcagaatgggtcaaggcacctgcctgtttttgttggtgcacagagattgacttgattcagagagacaattcactccatccctatggcagaggaatgggttagccctaatgtagaatgtcattgtttttaaaactgttttatatcttaagagtgccttattaaagtatagatgtatgtcttaaaatgtgggtgataggaattttaaagatttatataatgcatcaaaagccttagaataagaaaagctttttttaaattgctttatctgtatatctgaactcttgaaacttatagctaaaacactaggatttatctgcagtgttgcagggagataattctgccttaaattgtctaaaacaaaaacaaaaccagccaacctatgttacacgtgagattaaaaccaattttttccccattttttctccttttttctcttgctgcccacattgtgcctttattttatgagccccagttttctgggcttagtttaaaaaaaaaatcaagtctaaacattgcatttagaaagcttttgttcttggataaaaagtcatacactttaaaaaaaaaaaaaactttttccaggaaaatatattgaaatcatgctgctgagcctctattttctttctttgatgttttgattcagtattcttttatcataaatttttagcatttaaaaattcactgatgtacattaagccaataaactgctttaatgaataacaaactatgtagtgtgtccctattataaatgcattggagaagtatttttatgagactctttactcaggtgcatggttacagcccacagggaggcatggagtgccatggaaggattcgccactacccagaccttgttttttgttgtattttggaagacaggttttttaaagaaacattttcctcagattaaaagatgatgctattacaactagcattgcctcaaaaactgggaccaaccaaagtgtgtcaaccctgtttccttaaaagaggctatgaatcccaaaggccacatccaagacaggcaataatgagcagagtttacagctcctttaataaaatgtgtcagtaattttaaggtttatagttccctcaacacaattgctaatgcagaatagtgtaaaatgcgcttcaagaatgttgatgatgatgatatagaattgtggctttagtagcacagaggatgccccaacaaactcatggcgttgaaaccacacagttctcattactgttatttattagctgtagcattctctgtctcctctctctcctcctttgaccttctcctcgaccagccatcatgacatttaccatgaatttacttcctcccaagagtttggactgcccgtcagattgtttctgcacatagttgcctttgtatctctgtatgaaataaaaggtcatttgtt

SEQ ID NO: 342090 - DNA, 3134 bp, Homo sapiens
gttggaggattactatttgcctcggcgaggtgcccaccatcgagtccctgataggggaaagctctggcaatttaaatgacccaaataaggaggcactggctaagacggaagtgtctctcaccctgaccaacaagttcgacgtgcctggagatgagaatgcagaaatggatgctcgaaccatcttactgaatacaaaacgtttaattgtggatgtcatccggttccagccaggagagaccttgactgaaatcctagaaacaccagccaccagtgaacaggaagcagaacatcagagagccatgcagagacgtgctatccgtgatgccaaaacacctgacaagatgaaaaagtcaaaatctgtaaaggaagacagcaacctcactcttcaagagaagaaagagaagatccagacaggtttaaagaagctaacagagcttggaaccgtggacccaaagaacaaataccaggaactgatcaacgacattgccagggatattcggaatcagcggaggtaccgacagaggagaaaggccgaactagtgaaactgcaacagacatacgctgctctgaactctaaggccaccttttatggggagcaggtggattactataaaagctatatcaaaacctgcttggataacttagccagcaagggcaaagtctccaaaaagcctagggaaatgaaaggaaagaaaagcaaaaagatttctctgaaatatacagcagcaagactacatgaaaaaggagttcttctggaaattgaggacctgcaagtgaatcagtttaaaaatgttatatttgaaatcagtccaacagaagaagttggagacttcgaagtgaaagccaaattcatgggagttcaaatggagacttttatgttacattatcaggacctgctgcagctacagtatgaaggagttgcagtcatgaaattatttgatagagctaaagtaaatgtcaacctcctgatcttccttctcaacaaaaagttctacgggaagtaattgatcgtttgctgccagcccagaaggatgaaggaaagaagcacctcacagctcctttctaggtccttctttcctcattggaagcaaagacctagccaacaacagcacctcaatctgatacactcccgatgccacatttttaactcctctcgctctgatgggacatttgttacccttttttcatagtgaaattgtgtttcaggcttagtctgacctttctggtttcttcattttcttccattacttaggaaagagtggaaactccactaaaatttctctgtgttgttacagtcttagaggttgcagtactatattgtaagctttggtgtttgtttaattagcaatagggatggtaggattcaaatgtgtgtcatttagaagtggaagctattagcaccaatgacataaatacatacaagacacagaactaaaatgtcatgttattaacagttattaggttgtcatttaaaaataaagttcctttatatttctgtcccatcaggaaaactgaaggatatggggaatcattggttatcttccattgtgtttttctttatggacaggagctaatggaagtgacagtcatgttcaaaggaagcatttctagaaaaaaggagataatgtttttaaatttcattatcaaacttgggcaattctgtttgtgtaactccccgactagtggatgggagagtcccattgctaaaattcagctactcagataaattcagaatgggtcaaggcacctgcctgtttttgttggtgcacagagattgacttgattcagagagacaattcactccatccctatggcagaggaatgggttagccctaatgtagaatgtcattgtttttaaaactgttttatatcttaagagtgccttattaaagtatagatgtatgtcttaaaatgtgggtgataggaattttaaagatttatataatgcatcaaaagccttagaataagaaaagctttttttaaattgctttatctgtatatctgaactcttgaaacttatagctaaaacactaggatttatctgcagtgttgcagggagataattctgccttaaattgtctaaaacaaaaacaaaaccagccaacctatgttacacgtgagattaaaaccaattttttccccattttttctccttttttctcttgctgcccacattgtgcctttattttatgagccccagttttctgggcttagtttaaaaaaaaaatcaagtctaaacattgcatttagaaagcttttgttcttggataaaaagtcatacactttaaaaaaaaaaaaaactttttccaggaaaatatattgaaatcatgctgctgagcctctattttctttctttgatgttttgattcagtattcttttatcataaatttttagcatttaaaaattcactgatgtacattaagccaataaactgctttaatgaataacaaactatgtagtgtgtccctattataaatgcattggagaagtatttttatgagactctttactcaggtgcatggttacagcccacagggaggcatggagtgccatggaaggattcgccactacccagaccttgttttttgttgtattttggaagacaggttttttaaagaaacattttcctcagattaaaagatgatgctattacaactagcattgcctcaaaaactgggaccaaccaaagtgtgtcaaccctgtttccttaaaagaggctatgaatcccaaaggccacatccaagacaggcaataatgagcagagtttacagctcctttaataaaatgtgtcagtaattttaaggtttatagttccctcaacacaattgctaatgcagaatagtgtaaaatgcgcttcaagaatgttgatgatgatgatatagaattgtggctttagtagcacagaggatgccccaacaaactcatggcgttgaaaccacacagttctcattactgttatttattagctgtagcattctctgtctcctctctctcctcctttgaccttctcctcgaccagccatcatgacatttaccatgaatttacttcctcccaagagtttggactgcccgtcagattgtttctgcacatagttgcctttgtatctctgtatgaaataaaaggtcatttgtt

SEQ ID NO: 342091 - DNA, 6624 bp, Homo sapiens
  misc_feature (8)..(8): n is a, c, g, or t
gacggcanggggcggggcctcggggaccccggcaagcccgcgcacttggcaggagctgtagctaccgccgtccgcgcctccaaggtttcacggcttcctcagcagagactcgggctcgtccgccatgtccgccgcagacgaggttgacgggctgggcgtggcccggccgcactatggctctgtcctggataatgaaagacttactgcagaggagatggatgaaaggagacgtcagaacgtggcttatgagtacctttgtcatttggaagaagcgaagaggtggatggaagcatgcctaggggaagatctgcctcccaccacagaactggaggaggggcttaggaatggggtctaccttgccaaactggggaacttcttctctcccaaagtagtgtccctgaaaaaaatctatgatcgagaacagaccagatacaaggcgactggcctccactttagacacactgataatgtgattcagtggttgaatgccatggatgagattggattgcctaagattttttacccagaaactacagatatctatgatcgaaagaacatgccaagatgtatctactgtatccatgcactcagtttgtacctgttcaagctaggcctggcccctcagattcaagacctatatggaaaggttgacttcacagaagaagaaatcaacaacatgaagactgagttggagaagtatggcatccagatgcctgcctttagcaagattgggggcatcttggctaatgaactgtcagtggatgaagccgcattacatgctgctgttattgctattaatgaagctattgaccgtagaattccagccgacacatttgcagctttgaaaaatccgaatgccatgcttgtaaatcttgaagagcccttggcatccacttaccaggatatactttaccaggctaagcaggacaaaatgacaaatgctaaaaacaggacagaaaactcagagagagaaagagatgtttatgaggagctgctcacgcaagctgaaattcaaggcaatataaacaaagtcaatacattttctgcattagcaaatatcgacctggctttagaacaaggagatgcactggccttgttcagggctctgcagtcaccagccctggggcttcgaggactgcagcaacagaatagcgactggtacttgaagcagctcctgagtgataaacagcagaagagacagagtggtcagactgaccccctgcagaaggaggagctgcagtctggagtggatgctgcaaacagtgctgcccagcaatatcagagaagattggcagcagtagcactgattaatgctgcaatccagaagggtgttgctgagaagactgttttggaactgatgaatcccgaagcccagctgccccaggtgtatccatttgccgccgatctctatcagaaggagctggctaccctgcagcgacaaagtcctgaacataatctcacccacccagagctctctgtcgcagtggagatgttgtcatcggtggccctgatcaacagggcattggaatcaggagatgtgaatacagtgtggaagcaattgagcagttcagttactggtcttaccaatattgaggaagaaaactgtcagaggtatctcgatgagttgatgaaactgaaggctcaggcacatgcagagaataatgaattcattacatggaatgatatccaagcttgcgtggaccatgtgaacctggtggtgcaagaggaacatgagaggattttagccattggtttaattaatgaagccctggatgaaggtgatgcccaaaagactctgcaggccctacagattcctgcagctaaacttgagggagtccttgcagaagtggcccagcattaccaagacacgctgattagagcgaagagagagaaagcccaggaaatccaggatgagtcagctgtgttatggttggatgaaattcaaggtggaatctggcagtccaacaaagacacccaagaagcacagaagtttgccttaggaatctttgccattaatgaggcagtagaaagtggtgatgttggcaaaacactgagtgcccttcgctcccctgatgttggcttgtatggagtcatccctgagtgtggtgaaacttaccacagtgatcttgctgaagccaagaagaaaaaactggcagtaggagataataacagcaagtgggtgaagcactgggtaaaaggtggatattattattaccacaatctggagacccaggaaggaggatgggatgaacctccaaattttgtgcaaaattctatgcagctttctcgggaggagatccagagttctatctctggggtgactgccgcatataaccgagaacagctgtggctggccaatgaaggcctgatcaccaggctgcaggctcgctgccgtggatacttagttcgacaggaattccgatccaggatgaatttcctgaagaaacaaatccctgccatcacctgcattcagtcacagtggagaggatacaagcagaagaaggcatatcaagatcggttagcttacctgcgctcccacaaagatgaagttgtaaagattcagtccctggcaaggatgcaccaagctcgaaagcgctatcgagatcgcctgcagtacttccgggaccatataaatgacattatcaaaatccaggcttttattcgggcaaacaaagctcgggatgactacaagactctcatcaatgctgaggatcctcctatggttgtggtccgaaaatttgtccacctgctggaccaaagtgaccaggattttcaggaggagcttgaccttatgaagatgcgggaagaggttatcaccctcattcgttctaaccagcagctggagaatgacctcaatctcatggatatcaaaattggactgctagtgaaaaataagattacgttgcaggatgtggtttcccacagtaaaaaacttaccaaaaaaaataaggaacagttgtctgatatgatgatgataaataaacagaagggaggtctcaaggctttgagcaaggagaagagagagaagttggaagcttaccagcacctgttttatttattgcaaaccaatcccacctatctggccaagctcatttttcagatgccccagaacaagtccaccaagttcatggactctgtaatcttcacactctacaactacgcgtccaaccagcgagaggagtacctgctcctgcggctctttaagacagcactccaagaggaaatcaagtcgaaggtagatcagattcaagagattgtgacaggaaatcctacggttattaaaatggttgtaagtttcaaccgtggtgcccgtggccagaatgccctgagacagatcttggccccagtcgtgaaggaaattatggatgacaaatctctcaacatcaaaactgaccctgtggatatttacaaatcttgggttaatcagatggagtctcagacaggagaggcaagcaaactgccctatgatgtgacccctgagcaggcgctagctcatgaagaagtgaagacacggctagacagctccatcaggaacatgcgggctgtgacagacaagtttctctcagccattgtcagctctgtggacaaaatcccttatgggatgcgcttcattgccaaagtgctgaaggactcgttgcatgagaagttccctgatgctggtgaggatgagctgctgaagattattggtaacttgctttattatcgatacatgaatccagccattgttgctcctgatgcctttgacatcattgacctgtcagcaggaggccagcttaccacagaccaacgccgaaatctgggctccattgcaaaaatgcttcagcatgctgcttccaataagatgtttctgggagataatgcccacttaagcatcattaatgaatatctttcccagtcctaccagaaattcagacggtttttccaaactgcttgtgatgtcccagagcttcaggataaatttaatgtggatgagtactctgatttagtaaccctcaccaaaccagtaatctacatttccattggtgaaatcatcaacacccacactctcctgttggatcaccaggatgccattgctccggagcacaatgatccaatccacgaactgctggacgacctcggcgaggtgcccaccatcgagtccctgataggggaaagctctggcaatttaaatgacccaaataaggaggcactggctaagacggaagtgtctctcaccctgaccaacaagttcgacgtgcctggagatgagaatgcagaaatggatgctcgaaccatcttactgaatacaaaacgtttaattgtggatgtcatccggttccagccaggagagaccttgactgaaatcctagaaacaccagccaccagtgaacaggaagcagaacatcagagagccatgcagagacgtgctatccgtgatgccaaaacacctgacaagatgaaaaagtcaaaatctgtaaaggaagacagcaacctcactcttcaagagaagaaagagaagatccagacaggtttaaagaagctaacagagcttggaaccgtggacccaaagaacaaataccaggaactgatcaacgacattgccagggatattcggaatcagcggaggtaccgacagaggagaaaggccgaactagtgaaactgcaacagacatacgctgctctgaactctaaggccaccttttatggggagcaggtggattactataaaagctatatcaaaacctgcttggataacttagccagcaagggcaaagtctccaaaaagcctagggaaatgaaaggaaagaaaagcaaaaagatttctctgaaatatacagcagcaagactacatgaaaaaggagttcttctggaaattgaggacctgcaagtgaatcagtttaaaaatgttatatttgaaatcagtccaacagaagaagttggagacttcgaagtgaaagccaaattcatgggagttcaaatggagacttttatgttacattatcaggacctgctgcagctacagtatgaaggagttgcagtcatgaaattatttgatagagctaaagtaaatgtcaacctcctgatcttccttctcaacaaaaagttctacgggaagtaattgatcgtttgctgccagcccagaaggatgaaggaaagaagcacctcacagctcctttctaggtccttctttcctcattggaagcaaagacctagccaacaacagcacctcaatctgatacactcccgatgccacatttttaactcctctcgctctgatgggacatttgttacccttttttcatagtgaaattgtgtttcaggcttagtctgacctttctggtttcttcattttcttccattacttaggaaagagtggaaactccactaaaatttctctgtgttgttacagtcttagaggttgcagtactatattgtaagctttggtgtttgtttaattagcaatagggatggtaggattcaaatgtgtgtcatttagaagtggaagctattagcaccaatgacataaatacatacaagacacagaactaaaatgtcatgttattaacagttattaggttgtcatttaaaaataaagttcctttatatttctgtcccatcaggaaaactgaaggatatggggaatcattggttatcttccattgtgtttttctttatggacaggagctaatggaagtgacagtcatgttcaaaggaagcatttctagaaaaaaggagataatgtttttaaatttcattatcaaacttgggcaattctgtttgtgtaactccccgactagtggatgggagagtcccattgctaaaattcagctactcagataaattcagaatgggtcaaggcacctgcctgtttttgttggtgcacagagattgacttgattcagagagacaattcactccatccctatggcagaggaatgggttagccctaatgtagaatgtcattgtttttaaaactgttttatatcttaagagtgccttattaaagtatagatgtatgtcttaaaatgtgggtgataggaattttaaagatttatataatgcatcaaaagccttagaataagaaaagctttttttaaattgctttatctgtatatctgaactcttgaaacttatagctaaaacactaggatttatctgcagtgttgcagggagataattctgccttaaattgtctaaaacaaaaacaaaaccagccaacctatgttacacgtgagattaaaaccaattttttccccattttttctccttttttctcttgctgcccacattgtgcctttattttatgagccccagttttctgggcttagtttaaaaaaaaaatcaagtctaaacattgcatttagaaagcttttgttcttggataaaaagtcatacactttaaaaaaaaaaaaaactttttccaggaaaatatattgaaatcatgctgctgagcctctattttctttctttgatgttttgattcagtattcttttatcataaatttttagcatttaaaaattcactgatgtacattaagccaataaactgctttaatgaataatgacatttaagtggtgtgtctggtatgtatatatgtcatgggggctaatagctcccacttctaaaggacaggggggctacgt

SEQ ID NO: 342092 - DNA, 2297 bp, Homo sapiens
ttgcatgttgagatgacttcacaaacatttttaaataaataaaaaatctggaggacctgctgcagctacagtatgaaggagttgcagtcatgaaattatttgatagagctaaagtaaatgtcaacctcctgatcttccttctcaacaaaaagttctacgggaagtaattgatcgtttgctgccagcccagaaggatgaaggaaagaagcacctcacagctcctttctaggtccttctttcctcattggaagcaaagacctagccaacaacagcacctcaatctgatacactcccgatgccacatttttaactcctctcgctctgatgggacatttgttacccttttttcatagtgaaattgtgtttcaggcttagtctgacctttctggtttcttcattttcttccattacttaggaaagagtggaaactccactaaaatttctctgtgttgttacagtcttagaggttgcagtactatattgtaagctttggtgtttgtttaattagcaatagggatggtaggattcaaatgtgtgtcatttagaagtggaagctattagcaccaatgacataaatacatacaagacacagaactaaaatgtcatgttattaacagttattaggttgtcatttaaaaataaagttcctttatatttctgtcccatcaggaaaactgaaggatatggggaatcattggttatcttccattgtgtttttctttatggacaggagctaatggaagtgacagtcatgttcaaaggaagcatttctagaaaaaaggagataatgtttttaaatttcattatcaaacttgggcaattctgtttgtgtaactccccgactagtggatgggagagtcccattgctaaaattcagctactcagataaattcagaatgggtcaaggcacctgcctgtttttgttggtgcacagagattgacttgattcagagagacaattcactccatccctatggcagaggaatgggttagccctaatgtagaatgtcattgtttttaaaactgttttatatcttaagagtgccttattaaagtatagatgtatgtcttaaaatgtgggtgataggaattttaaagatttatataatgcatcaaaagccttagaataagaaaagctttttttaaattgctttatctgtatatctgaactcttgaaacttatagctaaaacactaggatttatctgcagtgttgcagggagataattctgccttaaattgtctaaaacaaaaacaaaaccagccaacctatgttacacgtgagattaaaaccaattttttccccattttttctccttttttctcttgctgcccacattgtgcctttattttatgagccccagttttctgggcttagtttaaaaaaaaaatcaagtctaaacattgcatttagaaagcttttgttcttggataaaaagtcatacactttaaaaaaaaaaaaaactttttccaggaaaatatattgaaatcatgctgctgagcctctattttctttctttgatgttttgattcagtattcttttatcataaatttttagcatttaaaaattcactgatgtacattaagccaataaactgctttaatgaataacaaactatgtagtgtgtccctattataaatgcattggagaagtatttttatgagactctttactcaggtgcatggttacagcccacagggaggcatggagtgccatggaaggattcgccactacccagaccttgttttttgttgtattttggaagacaggttttttaaagaaacattttcctcagattaaaagatgatgctattacaactagcattgcctcaaaaactgggaccaaccaaagtgtgtcaaccctgtttccttaaaagaggctatgaatcccaaaggccacatccaagacaggcaataatgagcagagtttacagctcctttaataaaatgtgtcagtaattttaaggtttatagttccctcaacacaattgctaatgcagaatagtgtaaaatgcgcttcaagaatgttgatgatgatgatatagaattgtggctttagtagcacagaggatgccccaacaaactcatggcgttgaaaccacacagttctcattactgttatttattagctgtagcattctctgtctcctctctctcctcctttgaccttctcctcgaccagccatcatgacatttaccatgaatttacttcctcccaagagtttggactgcccgtcagattgtttctgcacatagttgcctttgtatctctgtatgaaataaaaggtcatttgtt

SEQ ID NO: 342093 - DNA, 2347 bp, Homo sapiens
ggcaggcctcagtccatctggatccctccctacattgtgtcctttttccttgttccacagacttgattaactgtcaaaatgttttgttttgttttgttaataggacctgctgcagctacagtatgaaggagttgcagtcatgaaattatttgatagagctaaagtaaatgtcaacctcctgatcttccttctcaacaaaaagttctacgggaagtaattgatcgtttgctgccagcccagaaggatgaaggaaagaagcacctcacagctcctttctaggtccttctttcctcattggaagcaaagacctagccaacaacagcacctcaatctgatacactcccgatgccacatttttaactcctctcgctctgatgggacatttgttacccttttttcatagtgaaattgtgtttcaggcttagtctgacctttctggtttcttcattttcttccattacttaggaaagagtggaaactccactaaaatttctctgtgttgttacagtcttagaggttgcagtactatattgtaagctttggtgtttgtttaattagcaatagggatggtaggattcaaatgtgtgtcatttagaagtggaagctattagcaccaatgacataaatacatacaagacacagaactaaaatgtcatgttattaacagttattaggttgtcatttaaaaataaagttcctttatatttctgtcccatcaggaaaactgaaggatatggggaatcattggttatcttccattgtgtttttctttatggacaggagctaatggaagtgacagtcatgttcaaaggaagcatttctagaaaaaaggagataatgtttttaaatttcattatcaaacttgggcaattctgtttgtgtaactccccgactagtggatgggagagtcccattgctaaaattcagctactcagataaattcagaatgggtcaaggcacctgcctgtttttgttggtgcacagagattgacttgattcagagagacaattcactccatccctatggcagaggaatgggttagccctaatgtagaatgtcattgtttttaaaactgttttatatcttaagagtgccttattaaagtatagatgtatgtcttaaaatgtgggtgataggaattttaaagatttatataatgcatcaaaagccttagaataagaaaagctttttttaaattgctttatctgtatatctgaactcttgaaacttatagctaaaacactaggatttatctgcagtgttgcagggagataattctgccttaaattgtctaaaacaaaaacaaaaccagccaacctatgttacacgtgagattaaaaccaattttttccccattttttctccttttttctcttgctgcccacattgtgcctttattttatgagccccagttttctgggcttagtttaaaaaaaaaatcaagtctaaacattgcatttagaaagcttttgttcttggataaaaagtcatacactttaaaaaaaaaaaaaactttttccaggaaaatatattgaaatcatgctgctgagcctctattttctttctttgatgttttgattcagtattcttttatcataaatttttagcatttaaaaattcactgatgtacattaagccaataaactgctttaatgaataacaaactatgtagtgtgtccctattataaatgcattggagaagtatttttatgagactctttactcaggtgcatggttacagcccacagggaggcatggagtgccatggaaggattcgccactacccagaccttgttttttgttgtattttggaagacaggttttttaaagaaacattttcctcagattaaaagatgatgctattacaactagcattgcctcaaaaactgggaccaaccaaagtgtgtcaaccctgtttccttaaaagaggctatgaatcccaaaggccacatccaagacaggcaataatgagcagagtttacagctcctttaataaaatgtgtcagtaattttaaggtttatagttccctcaacacaattgctaatgcagaatagtgtaaaatgcgcttcaagaatgttgatgatgatgatatagaattgtggctttagtagcacagaggatgccccaacaaactcatggcgttgaaaccacacagttctcattactgttatttattagctgtagcattctctgtctcctctctctcctcctttgaccttctcctcgaccagccatcatgacatttaccatgaatttacttcctcccaagagtttggactgcccgtcagattgtttctgcacatagttgcctttgtatctctgtatgaaataaaaggtcatttgtt

SEQ ID NO: 342094 - DNA, 2303 bp, Homo sapiens
  misc_feature (19)..(19): n is a, c, g, or t
ccccgggctgcaggaattnggcacgaggttcaaatggagcgtttaatgttacattatcagacctgctgcagctacagtatgaaggagttgcagtcatgaaattatttgatagagctaaagtaaatgtcaacctcctgatcttccttctcaacaaaaagttctacgggaagtaattgatcgtttgctgccagcccagaaggatgaaggaaagaagcacctcacagctcctttctaggtccttctttcctcattggaagcaaagacctagccaacaacagcacctcaatctgatacactcccgatgccacatttttaactcctctcgctctgatgggacatttgttacccttttttcatagtgaaattgtgtttcaggcttagtctgacctttctggtttcttcattttcttccattacttaggaaagagtggaaactccactaaaatttctctgtgttgttacagtcttagaggttgcagtactatattgtaagctttggtgtttgtttaattagcaatagggatggtaggattcaaatgtgtgtcatttagaagtggaagctattagcaccaatgacataaatacatacaagacacagaactaaaatgtcatgttattaacagttattaggttgtcatttaaaaataaagttcctttatatttctgtcccatcaggaaaactgaaggatatggggaatcattggttatcttccattgtgtttttctttatggacaggagctaatggaagtgacagtcatgttcaaaggaagcatttctagaaaaaaggagataatgtttttaaatttcattatcaaacttgggcaattctgtttgtgtaactccccgactagtggatgggagagtcccattgctaaaattcagctactcagataaattcagaatgggtcaaggcacctgcctgtttttgttggtgcacagagattgacttgattcagagagacaattcactccatccctatggcagaggaatgggttagccctaatgtagaatgtcattgtttttaaaactgttttatatcttaagagtgccttattaaagtatagatgtatgtcttaaaatgtgggtgataggaattttaaagatttatataatgcatcaaaagccttagaataagaaaagctttttttaaattgctttatctgtatatctgaactcttgaaacttatagctaaaacactaggatttatctgcagtgttgcagggagataattctgccttaaattgtctaaaacaaaaacaaaaccagccaacctatgttacacgtgagattaaaaccaattttttccccattttttctccttttttctcttgctgcccacattgtgcctttattttatgagccccagttttctgggcttagtttaaaaaaaaaatcaagtctaaacattgcatttagaaagcttttgttcttggataaaaagtcatacactttaaaaaaaaaaaaaactttttccaggaaaatatattgaaatcatgctgctgagcctctattttctttctttgatgttttgattcagtattcttttatcataaatttttagcatttaaaaattcactgatgtacattaagccaataaactgctttaatgaataacaaactatgtagtgtgtccctattataaatgcattggagaagtatttttatgagactctttactcaggtgcatggttacagcccacagggaggcatggagtgccatggaaggattcgccactacccagaccttgttttttgttgtattttggaagacaggttttttaaagaaacattttcctcagattaaaagatgatgctattacaactagcattgcctcaaaaactgggaccaaccaaagtgtgtcaaccctgtttccttaaaagaggctatgaatcccaaaggccacatccaagacaggcaataatgagcagagtttacagctcctttaataaaatgtgtcagtaattttaaggtttatagttccctcaacacaattgctaatgcagaatagtgtaaaatgcgcttcaagaatgttgatgatgatgatatagaattgtggctttagtagcacagaggatgccccaacaaactcatggcgttgaaaccacacagttctcattactgttatttattagctgtagcattctctgtctcctctctctcctcctttgaccttctcctcgaccagccatcatgacatttaccatgaatttacttcctcccaagagtttggactgcccgtcagattgtttctgcacatagttgcctttgtatctctgtatgaaataaaaggtcatttgtt

SEQ ID NO: 342095 - DNA, 1912 bp, Homo sapiens
  misc_feature (19)..(19): n is a, c, g, or t
ccccgggctgcaggaattnggcacgattaggaaagagtggaaactccactaaaatttctctgtgttgttacagtcttagaggttgcagtactatattgtaagctttggtgtttgtttaattagcaatagggatggtaggattcaaatgtgtgtcatttagaagtggaagctattagcaccaatgacataaatacatacaagacacagaactaaaatgtcatgttattaacagttattaggttgtcatttaaaaataaagttcctttatatttctgtcccatcaggaaaactgaaggatatggggaatcattggttatcttccattgtgtttttctttatggacaggagctaatggaagtgacagtcatgttcaaaggaagcatttctagaaaaaaggagataatgtttttaaatttcattatcaaacttgggcaattctgtttgtgtaactccccgactagtggatgggagagtcccattgctaaaattcagctactcagataaattcagaatgggtcaaggcacctgcctgtttttgttggtgcacagagattgacttgattcagagagacaattcactccatccctatggcagaggaatgggttagccctaatgtagaatgtcattgtttttaaaactgttttatatcttaagagtgccttattaaagtatagatgtatgtcttaaaatgtgggtgataggaattttaaagatttatataatgcatcaaaagccttagaataagaaaagctttttttaaattgctttatctgtatatctgaactcttgaaacttatagctaaaacactaggatttatctgcagtgttgcagggagataattctgccttaaattgtctaaaacaaaaacaaaaccagccaacctatgttacacgtgagattaaaaccaattttttccccattttttctccttttttctcttgctgcccacattgtgcctttattttatgagccccagttttctgggcttagtttaaaaaaaaaatcaagtctaaacattgcatttagaaagcttttgttcttggataaaaagtcatacactttaaaaaaaaaaaaaactttttccaggaaaatatattgaaatcatgctgctgagcctctattttctttctttgatgttttgattcagtattcttttatcataaatttttagcatttaaaaattcactgatgtacattaagccaataaactgctttaatgaataacaaactatgtagtgtgtccctattataaatgcattggagaagtatttttatgagactctttactcaggtgcatggttacagcccacagggaggcatggagtgccatggaaggattcgccactacccagaccttgttttttgttgtattttggaagacaggttttttaaagaaacattttcctcagattaaaagatgatgctattacaactagcattgcctcaaaaactgggaccaaccaaagtgtgtcaaccctgtttccttaaaagaggctatgaatcccaaaggccacatccaagacaggcaataatgagcagagtttacagctcctttaataaaatgtgtcagtaattttaaggtttatagttccctcaacacaattgctaatgcagaatagtgtaaaatgcgcttcaagaatgttgatgatgatgatatagaattgtggctttagtagcacagaggatgccccaacaaactcatggcgttgaaaccacacagttctcattactgttatttattagctgtagcattctctgtctcctctctctcctcctttgaccttctcctcgaccagccatcatgacatttaccatgaatttacttcctcccaagagtttggactgcccgtcagattgtttctgcacatagttgcctttgtatctctgtatgaaataaaaggtcatttgtt

SEQ ID NO: 342096 - DNA, 1773 bp, Homo sapiens
accacagtgacagatagaatcgagctggtactattagcaccaatgacataaatacatacaagacacagaactaaaatgtcatgttattaacagttattaggttgtcatttaaaaataaagttcctttatatttctgtcccatcaggaaaactgaaggatatggggaatcattggttatcttccattgtgtttttctttatggacaggagctaatggaagtgacagtcatgttcaaaggaagcatttctagaaaaaaggagataatgtttttaaatttcattatcaaacttgggcaattctgtttgtgtaactccccgactagtggatgggagagtcccattgctaaaattcagctactcagataaattcagaatgggtcaaggcacctgcctgtttttgttggtgcacagagattgacttgattcagagagacaattcactccatccctatggcagaggaatgggttagccctaatgtagaatgtcattgtttttaaaactgttttatatcttaagagtgccttattaaagtatagatgtatgtcttaaaatgtgggtgataggaattttaaagatttatataatgcatcaaaagccttagaataagaaaagctttttttaaattgctttatctgtatatctgaactcttgaaacttatagctaaaacactaggatttatctgcagtgttgcagggagataattctgccttaaattgtctaaaacaaaaacaaaaccagccaacctatgttacacgtgagattaaaaccaattttttccccattttttctccttttttctcttgctgcccacattgtgcctttattttatgagccccagttttctgggcttagtttaaaaaaaaaatcaagtctaaacattgcatttagaaagcttttgttcttggataaaaagtcatacactttaaaaaaaaaaaaaactttttccaggaaaatatattgaaatcatgctgctgagcctctattttctttctttgatgttttgattcagtattcttttatcataaatttttagcatttaaaaattcactgatgtacattaagccaataaactgctttaatgaataacaaactatgtagtgtgtccctattataaatgcattggagaagtatttttatgagactctttactcaggtgcatggttacagcccacagggaggcatggagtgccatggaaggattcgccactacccagaccttgttttttgttgtattttggaagacaggttttttaaagaaacattttcctcagattaaaagatgatgctattacaactagcattgcctcaaaaactgggaccaaccaaagtgtgtcaaccctgtttccttaaaagaggctatgaatcccaaaggccacatccaagacaggcaataatgagcagagtttacagctcctttaataaaatgtgtcagtaattttaaggtttatagttccctcaacacaattgctaatgcagaatagtgtaaaatgcgcttcaagaatgttgatgatgatgatatagaattgtggctttagtagcacagaggatgccccaacaaactcatggcgttgaaaccacacagttctcattactgttatttattagctgtagcattctctgtctcctctctctcctcctttgaccttctcctcgaccagccatcatgacatttaccatgaatttacttcctcccaagagtttggactgcccgtcagattgtttctgcacatagttgcctttgtatctctgtatgaaataaaaggtcatttgtt

SEQ ID NO: 342097 - DNA, 6576 bp, Homo sapiens
  misc_feature (6499)..(6499): n is a, c, g, or t
ggtattaaaactgatcttttgacatttttgacaatgttcttataaattactttcttttttatcatatatggatgggatgaagcacagagtaagatagagtgcacagcaaaggggatctgcccctcctatctgtccaataccccacaggttttggtgataatcttgggcaatgttccagtcaaacctgcctcccacttctcactaaagttagtgaacatgtgacccacattccccaaataagagcctcttataaactccattcttggctttttcattcatagagatagctattttatgagacatagataaagcattttttagtgatgtgcacgatgccttttttcttaattattaacttctcaaaacataaacacattggaggcacttaataaagggagctgtagctaccgccgtccgcgcctccaaggtttcacggcttcctcagcagagactcgggctcgtccgccatgtccgccgcagacgaggttgacgggctgggcgtggcccggccgcactatggctctgtcctggataatgaaagacttactgcagaggagatggatgaaaggagacgtcagaacgtggcttatgagtacctttgtcatttggaagaagcgaagaggtggatggaagcatgcctaggggaagatctgcctcccaccacagaactggaggaggggcttaggaatggggtctaccttgccaaactggggaacttcttctctcccaaagtagtgtccctgaaaaaaatctatgatcgagaacagaccagatacaaggcgactggcctccactttagacacactgataatgtgattcagtggttgaatgccatggatgagattggattgcctaagattttttacccagaaactacagatatctatgatcgaaagaacatgccaagatgtatctactgtatccatgcactcagtttgtacctgttcaagctaggcctggcccctcagattcaagacctatatggaaaggttgacttcacagaagaagaaatcaacaacatgaagactgagttggagaagtatggcatccagatgcctgcctttagcaagattgggggcatcttggctaatgaactgtcagtggatgaagccgcattacatgctgctgttattgctattaatgaagctattgaccgtagaattccagccgacacatttgcagctttgaaaaatccgaatgccatgcttgtaaatcttgaagagcccttggcatccacttaccaggatatactttaccaggctaagcaggacaaaatgacaaatgctaaaaacaggacagaaaactcagagagagaaagagatgtttatgaggagctgctcacgcaagctgaaattcaaggcaatataaacaaagtcaatacattttctgcattagcaaatatcgacctggctttagaacaaggagatgcactggccttgttcagggctctgcagtcaccagccctggggcttcgaggactgcagcaacagaatagcgactggtacttgaagcagctcctgagtgataaacagcagaagagacagagtggtcagactgaccccctgcagaaggaggagctgcagtctggagtggatgctgcaaacagtgctgcccagcaatatcagagaagattggcagcagtagcactgattaatgctgcaatccagaagggtgttgctgagaagactgttttggaactgatgaatcccgaagcccagctgccccaggtgtatccatttgccgccgatctctatcagaaggagctggctaccctgcagcgacaaagtcctgaacataatctcacccacccagagctctctgtcgcagtggagatgttgtcatcggtggccctgatcaacagggcattggaatcaggagatgtgaatacagtgtggaagcaattgagcagttcagttactggtcttaccaatattgaggaagaaaactgtcagaggtatctcgatgagttgatgaaactgaaggctcaggcacatgcagagaataatgaattcattacatggaatgatatccaagcttgcgtggaccatgtgaacctggtggtgcaagaggaacatgagaggattttagccattggtttaattaatgaagccctggatgaaggtgatgcccaaaagactctgcaggccctacagattcctgcagctaaacttgagggagtccttgcagaagtggcccagcattaccaagacacgctgattagagcgaagagagagaaagcccaggaaatccaggatgagtcagctgtgttatggttggatgaaattcaaggtggaatctggcagtccaacaaagacacccaagaagcacagaagtttgccttaggaatctttgccattaatgaggcagtagaaagtggtgatgttggcaaaacactgagtgcccttcgctcccctgatgttggcttgtatggagtcatccctgagtgtggtgaaacttaccacagtgatcttgctgaagccaagaagaaaaaactggcagtaggagataataacagcaagtgggtgaagcactgggtaaaaggtggatattattattaccacaatctggagacccaggaaggaggatgggatgaacctccaaattttgtgcaaaattctatgcagctttctcgggaggagatccagagttctatctctggggtgactgccgcatataaccgagaacagctgtggctggccaatgaaggcctgatcaccaggctgcaggctcgctgccgtggatacttagttcgacaggaattccgatccaggatgaatttcctgaagaaacaaatccctgccatcacctgcattcagtcacagtggagaggatacaagcagaagaaggcatatcaagatcggttagcttacctgcgctcccacaaagatgaagttgtaaagattcagtccctggcaaggatgcaccaagctcgaaagcgctatcgagatcgcctgcagtacttccgggaccatataaatgacattatcaaaatccaggcttttattcgggcaaacaaagctcgggatgactacaagactctcatcaatgctgaggatcctcctatggttgtggtccgaaaatttgtccacctgctggaccaaagtgaccaggattttcaggaggagcttgaccttatgaagatgcgggaagaggttatcaccctcattcgttctaaccagcagctggagaatgacctcaatctcatggatatcaaaattggactgctagtgaaaaataagattacgttgcaggatgtggtttcccacagtaaaaaacttaccaaaaaaaataaggaacagttgtctgatatgatgatgataaataaacagaagggaggtctcaaggctttgagcaaggagaagagagagaagttggaagcttaccagcacctgttttatttattgcaaaccaatcccacctatctggccaagctcatttttcagatgccccagaacaagtccaccaagttcatggactctgtaatcttcacactctacaactacgcgtccaaccagcgagaggagtacctgctcctgcggctctttaagacagcactccaagaggaaatcaagtcgaaggtagatcagattcaagagattgtgacaggaaatcctacggttattaaaatggttgtaagtttcaaccgtggtgcccgtggccagaatgccctgagacagatcttggccccagtcgtgaaggaaattatggatgacaaatctctcaacatcaaaactgaccctgtggatatttacaaatcttgggttaatcagatggagtctcagacaggagaggcaagcaaactgccctatgatgtgacccctgagcaggcgctagctcatgaagaagtgaagacacggctagacagctccatcaggaacatgcgggctgtgacagacaagtttctctcagccattgtcagctctgtggacaaaatcccttatgggatgcgcttcattgccaaagtgctgaaggactcgttgcatgagaagttccctgatgctggtgaggatgagctgctgaagattattggtaacttgctttattatcgatacatgaatccagccattgttgctcctgatgcctttgacatcattgacctgtcagcaggaggccagcttaccacagaccaacgccgaaatctgggctccattgcaaaaatgcttcagcatgctgcttccaataagatgtttctgggagataatgcccacttaagcatcattaatgaatatctttcccagtcctaccagaaattcagacggtttttccaaactgcttgtgatgtcccagagcttcaggataaatttaatgtggatgagtactctgatttagtaaccctcaccaaaccagtaatctacatttccattggtgaaatcatcaacacccacactctcctgttggatcaccaggatgccattgctccggagcacaatgatccaatccacgaactgctggacgacctcggcgaggtgcccaccatcgagtccctgataggggaaagctctggcaatttaaatgacccaaataaggaggcactggctaagacggaagtgtctctcaccctgaccaacaagttcgacgtgcctggagatgagaatgcagaaatggatgctcgaaccatcttactgaatacaaaacgtttaattgtggatgtcatccggttccagccaggagagaccttgactgaaatcctagaaacaccagccaccagtgaacaggaagcagaacatcagagagccatgcagagacgtgctatccgtgatgccaaaacacctgacaagatgaaaaagtcaaaatctgtaaaggaagacagcaacctcactcttcaagagaagaaagagaagatccagacaggtttaaagaagctaacagagcttggaaccgtggacccaaagaacaaataccaggaactgatcaacgacattgccagggatattcggaatcagcggaggtaccgacagaggagaaaggccgaactagtgaaactgcaacagacatacgctgctctgaactctaaggccaccttttatggggagcaggtggattactataaaagctatatcaaaacctgcttggataacttagccagcaagggcaaagtctccaaaaagcctagggaaatgaaaggaaagaaaagcaaaaagatttctctgaaatatacagcagcaagactacatgaaaaaggagttcttctggaaattgaggacctgcaagtgaatcagtttaaaaatgttatatttgaaatcagtccaacagaagaagttggagacttcgaagtgaaagccaaattcatgggagttcaaatggagacttttatgttacattatcaggacctgctgcagctacagtatgaaggagttgcagtcatgaaattatttgatagagctaaagtaaatgtcaacctcctgatcttccttctcaacaaaaagttctacgggaagtaattgatcgtttgctgccagcccagaaggatgaaggaaagaagcacctcacagctcctttctaggtccttctttcctcattggaagcaaagacctagccaacaacagcacctcaatctgatacactcccgatgccacatttttaactcctctcgctctgatgggacatttgttacccttttttcatagtgaaattgtgtttcaggcttagtctgacctttctggtttcttcattttcttccattacttaggaaagagtggaaactccactaaaatttctctgtgttgttacagtcttagaggttgcagtactatattgtaagctttggtgtttgtttaattagcaatagggatggtaggattcaaatgtgtgtcatttagaagtggaagctattagcaccaatgacataaatacatacaagacacagaactaaaatgtcatgttattaacagttattaggttgtcatttaaaaataaagttcctttatatttctgtcccatcaggaaaactgaaggatatggggaatcattggttatcttccattgtgtttttctttatggacaggagctaatggaagtgacagtcatgttcaaaggaagcatttctagaaaaaaggagataatgtttttaaatttcattatcaaacttgggcaattctgtttgtgtaactccccgactagtggatgggagagtcccattgctaaaattcagctactcagataaattcagaatgggtcaaggcacctgcctgtttttgttggtgcacagagattgacttgattcagagagacaattcactccatccctatggcagaggaatgggttagccctaatgtagaatgtcattgtttttaaaactgttttatatcttaagagtgccttattaaagtatagatgtatgtcttaaaatgtgggtgataggaattttaaagatttatataatgcatcaaaagccttagaataggctttttaaatggtaatcggaattcgaactctgaactatgctaaactaggataacgcgggtaggggaatattgcttatgggtaaacaaacacagnccctattcggtgaataacatttgccctgttccttatatgggcacggcttttaaccgtcgggttgaaacactgttgtg

SEQ ID NO: 342098 - DNA, 852 bp, Homo sapiens
cggacgcgtgggtcgacccacgcgtcgggaaaatatattgaaatcatgctgctgagcctctattttctttctttgatgttttgattcagtattcttttatcataaatttttagcatttaaaaattcactgatgtacattaagccaataaactgctttaatgaataacaaactatgtagtgtgtccctattataaatgcattggagaagtatttttatgagactctttactcaggtgcatggttacagcccacagggaggcatggagtgccatggaaggattcgccactacccagaccttgttttttgttgtattttggaagacaggttttttaaagaaacattttcctcagattaaaagatgatgctattacaactagcattgcctcaaaaactgggaccaaccaaagtgtgtcaaccctgtttccttaaaagaggctatgaatcccaaaggccacatccaagacaggcaataatgagcagagtttacagctcctttaataaaatgtgtcagtaattttaaggtttatagttccctcaacacaattgctaatgcagaatagtgtaaaatgcgcttcaagaatgttgatgatgatgatatagaattgtggctttagtagcacagaggatgccccaacaaactcatggcgttgaaaccacacagttctcattactgttatttattagctgtagcattctctgtctcctctctctcctcctttgaccttctcctcgaccagccatcatgacatttaccatgaatttacttcctcccaagagtttggactgcccgtcagattgtttctgcacatagttgcctttgtatctctgtatgaaataaaaggtcatttgtt

SEQ ID NO: 342099 - DNA, 5687 bp, Homo sapiens
ggtattaaaactgatcttttgacatttttgacaatgttcttataaattactttcttttttatcatatatggatgggatgaagcacagagtaagatagagtgcacagcaaaggggatctgcccctcctatctgtccaataccccacaggttttggtgataatcttgggcaatgttccagtcaaacctgcctcccacttctcactaaagttagtgaacatgtgacccacattccccaaataagagcctcttataaactccattcttggctttttcattcatagagatagctattttatgagacatagataaagcattttttagtgatgtgcacgatgccttttttcttaattattaacttctcaaaacataaacacattggaggcacttaataaagggagctgtagctaccgccgtccgcgcctccaaggtttcacggcttcctcagcagagactcgggctcgtccgccatgtccgccgcagacgaggttgacgggctgggcgtggcccggccgcactatggctctgtcctggataatgaaagacttactgcagaggagatggatgaaaggagacgtcagaacgtggcttatgagtacctttgtcatttggaagaagcgaagaggtggatggaagcatgcctaggggaagatctgcctcccaccacagaactggaggaggggcttaggaatggggtctaccttgccaaactggggaacttcttctctcccaaagtagtgtccctgaaaaaaatctatgatcgagaacagaccagatacaaggcgactggcctccactttagacacactgataatgtgattcagtggttgaatgccatggatgagattggattgcctaagattttttacccagaaactacagatatctatgatcgaaagaacatgccaagatgtatctactgtatccatgcactcagtttgtacctgttcaagctaggcctggcccctcagattcaagacctatatggaaaggttgacttcacagaagaagaaatcaacaacatgaagactgagttggagaagtatggcatccagatgcctgcctttagcaagattgggggcatcttggctaatgaactgtcagtggatgaagccgcattacatgctgctgttattgctattaatgaagctattgaccgtagaattccagccgacacatttgcagctttgaaaaatccgaatgccatgcttgtaaatcttgaagagcccttggcatccacttaccaggatatactttaccaggctaagcaggacaaaatgacaaatgctaaaaacaggacagaaaactcagagagagaaagagatgtttatgaggagctgctcacgcaagctgaaattcaaggcaatataaacaaagtcaatacattttctgcattagcaaatatcgacctggctttagaacaaggagatgcactggccttgttcagggctctgcagtcaccagccctggggcttcgaggactgcagcaacagaatagcgactggtacttgaagcagctcctgagtgataaacagcagaagagacagagtggtcagactgaccccctgcagaaggaggagctgcagtctggagtggatgctgcaaacagtgctgcccagcaatatcagagaagattggcagcagtagcactgattaatgctgcaatccagaagggtgttgctgagaagactgttttggaactgatgaatcccgaagcccagctgccccaggtgtatccatttgccgccgatctctatcagaaggagctggctaccctgcagcgacaaagtcctgaacataatctcacccacccagagctctctgtcgcagtggagatgttgtcatcggtggccctgatcaacagggcattggaatcaggagatgtgaatacagtgtggaagcaattgagcagttcagttactggtcttaccaatattgaggaagaaaactgtcagaggtatctcgatgagttgatgaaactgaaggctcaggcacatgcagagaataatgaattcattacatggaatgatatccaagcttgcgtggaccatgtgaacctggtggtgcaagaggaacatgagaggattttagccattggtttaattaatgaagccctggatgaaggtgatgcccaaaagactctgcaggccctacagattcctgcagctaaacttgagggagtccttgcagaagtggcccagcattaccaagacacgctgattagagcgaagagagagaaagcccaggaaatccaggatgagtcagctgtgttatggttggatgaaattcaaggtggaatctggcagtccaacaaagacacccaagaagcacagaagtttgccttaggaatctttgccattaatgaggcagtagaaagtggtgatgttggcaaaacactgagtgcccttcgctcccctgatgttggcttgtatggagtcatccctgagtgtggtgaaacttaccacagtgatcttgctgaagccaagaagaaaaaactggcagtaggagataataacagcaagtgggtgaagcactgggtaaaaggtggatattattattaccacaatctggagacccaggaaggaggatgggatgaacctccaaattttgtgcaaaattctatgcagctttctcgggaggagatccagagttctatctctggggtgactgccgcatataaccgagaacagctgtggctggccaatgaaggcctgatcaccaggctgcaggctcgctgccgtggatacttagttcgacaggaattccgatccaggatgaatttcctgaagaaacaaatccctgccatcacctgcattcagtcacagtggagaggatacaagcagaagaaggcatatcaagatcggttagcttacctgcgctcccacaaagatgaagttgtaaagattcagtccctggcaaggatgcaccaagctcgaaagcgctatcgagatcgcctgcagtacttccgggaccatataaatgacattatcaaaatccaggcttttattcgggcaaacaaagctcgggatgactacaagactctcatcaatgctgaggatcctcctatggttgtggtccgaaaatttgtccacctgctggaccaaagtgaccaggattttcaggaggagcttgaccttatgaagatgcgggaagaggttatcaccctcattcgttctaaccagcagctggagaatgacctcaatctcatggatatcaaaattggactgctagtgaaaaataagattacgttgcaggatgtggtttcccacagtaaaaaacttaccaaaaaaaataaggaacagttgtctgatatgatgatgataaataaacagaagggaggtctcaaggctttgagcaaggagaagagagagaagttggaagcttaccagcacctgttttatttattgcaaaccaatcccacctatctggccaagctcatttttcagatgccccagaacaagtccaccaagttcatggactctgtaatcttcacactctacaactacgcgtccaaccagcgagaggagtacctgctcctgcggctctttaagacagcactccaagaggaaatcaagtcgaaggtagatcagattcaagagattgtgacaggaaatcctacggttattaaaatggttgtaagtttcaaccgtggtgcccgtggccagaatgccctgagacagatcttggccccagtcgtgaaggaaattatggatgacaaatctctcaacatcaaaactgaccctgtggatatttacaaatcttgggttaatcagatggagtctcagacaggagaggcaagcaaactgccctatgatgtgacccctgagcaggcgctagctcatgaagaagtgaagacacggctagacagctccatcaggaacatgcgggctgtgacagacaagtttctctcagccattgtcagctctgtggacaaaatcccttatgggatgcgcttcattgccaaagtgctgaaggactcgttgcatgagaagttccctgatgctggtgaggatgagctgctgaagattattggtaacttgctttattatcgatacatgaatccagccattgttgctcctgatgcctttgacatcattgacctgtcagcaggaggccagcttaccacagaccaacgccgaaatctgggctccattgcaaaaatgcttcagcatgctgcttccaataagatgtttctgggagataatgcccacttaagcatcattaatgaatatctttcccagtcctaccagaaattcagacggtttttccaaactgcttgtgatgtcccagagcttcaggataaatttaatgtggatgagtactctgatttagtaaccctcaccaaaccagtaatctacatttccattggtgaaatcatcaacacccacactctcctgttggatcaccaggatgccattgctccggagcacaatgatccaatccacgaactgctggacgacctcggcgaggtgcccaccatcgagtccctgataggggaaagctctggcaatttaaatgacccaaataaggaggcactggctaagacggaagtgtctctcaccctgaccaacaagttcgacgtgcctggagatgagaatgcagaaatggatgctcgaaccatcttactgaatacaaaacgtttaattgtggatgtcatccggttccagccaggagagaccttgactgaaatcctagaaacaccagccaccagtgaacaggaagcagaacatcagagagccatgcagagacgtgctatccgtgatgccaaaacacctgacaagatgaaaaagtcaaaatctgtaaaggaagacagcaacctcactcttcaagagaagaaagagaagatccagacaggtttaaagaagctaacagagcttggaaccgtggacccaaagaacaaataccaggaactgatcaacgacattgccagggatattcggaatcagcggaggtaccgacagaggagaaaggccgaactagtgaaactgcaacagacatacgctgctctgaactctaaggccaccttttatggggagcaggtggattactataaaagctatatcaaaacctgcttggataacttagccagcaagggcaaagtctccaaaaagcctagggaaatgaaaggaaagaaaagcaaaaagatttctctgaaatatacagcagcaagactacatgaaaaaggagttcttctggaaattgaggacctgcaagtgaatcagtttaaaaatgttatatttgaaatcagtccaacagaagaagttggagacttcgaagtgaaagccaaattcatgggagttcaaatggagacttttatgttacattatcaggacctgctgcagctacagtatgaaggagttgcagtcatgaaattatttgatagagctaaagtaaatgtcaacctcctgatcttccttctcaacaaaaagttctacgggaagtaattgatcgtttgctgccagcccagaaggatgaaggaaagaagcacctcacagctcctttctaggtccttctttcctcattggaagtactctatggacattgtaccttcttatatgaattggttcagctatctacctcctgctcgtatttcttcatactataacaatgaaactcctaaattctttgtgtacacttaaagttcagcttattgaactatactcgtaatacctaactcgagatcaattcct

SEQ ID NO: 342100 - DNA, 5073 bp, Homo sapiens
ggtattaaaactgatcttttgacatttttgacaatgttcttataaattactttcttttttatcatatatggatgggatgaagcacagagtaagatagagtgcacagcaaaggggatctgcccctcctatctgtccaataccccacaggttttggtgataatcttgggcaatgttccagtcaaacctgcctcccacttctcactaaagttagtgaacatgtgacccacattccccaaataagagcctcttataaactccattcttggctttttcattcatagagatagctattttatgagacatagataaagcattttttagtgatgtgcacgatgccttttttcttaattattaacttctcaaaacataaacacattggaggcacttaataaagggagctgtagctaccgccgtccgcgcctccaaggtttcacggcttcctcagcagagactcgggctcgtccgccatgtccgccgcagacgaggttgacgggctgggcgtggcccggccgcactatggctctgtcctggataatgaaagacttactgcagaggagatggatgaaaggagacgtcagaacgtggcttatgagtacctttgtcatttggaagaagcgaagaggtggatggaagcatgcctaggggaagatctgcctcccaccacagaactggaggaggggcttaggaatggggtctaccttgccaaactggggaacttcttctctcccaaagtagtgtccctgaaaaaaatctatgatcgagaacagaccagatacaaggcgactggcctccactttagacacactgataatgtgattcagtggttgaatgccatggatgagattggattgcctaagattttttacccagaaactacagatatctatgatcgaaagaacatgccaagatgtatctactgtatccatgcactcagtttgtacctgttcaagctaggcctggcccctcagattcaagacctatatggaaaggttgacttcacagaagaagaaatcaacaacatgaagactgagttggagaagtatggcatccagatgcctgcctttagcaagattgggggcatcttggctaatgaactgtcagtggatgaagccgcattacatgctgctgttattgctattaatgaagctattgaccgtagaattccagccgacacatttgcagctttgaaaaatccgaatgccatgcttgtaaatcttgaagagcccttggcatccacttaccaggatatactttaccaggctaagcaggacaaaatgacaaatgctaaaaacaggacagaaaactcagagagagaaagagatgtttatgaggagctgctcacgcaagctgaaattcaaggcaatataaacaaagtcaatacattttctgcattagcaaatatcgacctggctttagaacaaggagatgcactggccttgttcagggctctgcagtcaccagccctggggcttcgaggactgcagcaacagaatagcgactggtacttgaagcagctcctgagtgataaacagcagaagagacagagtggtcagactgaccccctgcagaaggaggagctgcagtctggagtggatgctgcaaacagtgctgcccagcaatatcagagaagattggcagcagtagcactgattaatgctgcaatccagaagggtgttgctgagaagactgttttggaactgatgaatcccgaagcccagctgccccaggtgtatccatttgccgccgatctctatcagaaggagctggctaccctgcagcgacaaagtcctgaacataatctcacccacccagagctctctgtcgcagtggagatgttgtcatcggtggccctgatcaacagggcattggaatcaggagatgtgaatacagtgtggaagcaattgagcagttcagttactggtcttaccaatattgaggaagaaaactgtcagaggtatctcgatgagttgatgaaactgaaggctcaggcacatgcagagaataatgaattcattacatggaatgatatccaagcttgcgtggaccatgtgaacctggtggtgcaagaggaacatgagaggattttagccattggtttaattaatgaagccctggatgaaggtgatgcccaaaagactctgcaggccctacagattcctgcagctaaacttgagggagtccttgcagaagtggcccagcattaccaagacacgctgattagagcgaagagagagaaagcccaggaaatccaggatgagtcagctgtgttatggttggatgaaattcaaggtggaatctggcagtccaacaaagacacccaagaagcacagaagtttgccttaggaatctttgccattaatgaggcagtagaaagtggtgatgttggcaaaacactgagtgcccttcgctcccctgatgttggcttgtatggagtcatccctgagtgtggtgaaacttaccacagtgatcttgctgaagccaagaagaaaaaactggcagtaggagataataacagcaagtgggtgaagcactgggtaaaaggtggatattattattaccacaatctggagacccaggaaggaggatgggatgaacctccaaattttgtgcaaaattctatgcagctttctcgggaggagatccagagttctatctctggggtgactgccgcatataaccgagaacagctgtggctggccaatgaaggcctgatcaccaggctgcaggctcgctgccgtggatacttagttcgacaggaattccgatccaggatgaatttcctgaagaaacaaatccctgccatcacctgcattcagtcacagtggagaggatacaagcagaagaaggcatatcaagatcggttagcttacctgcgctcccacaaagatgaagttgtaaagattcagtccctggcaaggatgcaccaagctcgaaagcgctatcgagatcgcctgcagtacttccgggaccatataaatgacattatcaaaatccaggcttttattcgggcaaacaaagctcgggatgactacaagactctcatcaatgctgaggatcctcctatggttgtggtccgaaaatttgtccacctgctggaccaaagtgaccaggattttcaggaggagcttgaccttatgaagatgcgggaagaggttatcaccctcattcgttctaaccagcagctggagaatgacctcaatctcatggatatcaaaattggactgctagtgaaaaataagattacgttgcaggatgtggtttcccacagtaaaaaacttaccaaaaaaaataaggaacagttgtctgatatgatgatgataaataaacagaagggaggtctcaaggctttgagcaaggagaagagagagaagttggaagcttaccagcacctgttttatttattgcaaaccaatcccacctatctggccaagctcatttttcagatgccccagaacaagtccaccaagttcatggactctgtaatcttcacactctacaactacgcgtccaaccagcgagaggagtacctgctcctgcggctctttaagacagcactccaagaggaaatcaagtcgaaggtagatcagattcaagagattgtgacaggaaatcctacggttattaaaatggttgtaagtttcaaccgtggtgcccgtggccagaatgccctgagacagatcttggccccagtcgtgaaggaaattatggatgacaaatctctcaacatcaaaactgaccctgtggatatttacaaatcttgggttaatcagatggagtctcagacaggagaggcaagcaaactgccctatgatgtgacccctgagcaggcgctagctcatgaagaagtgaagacacggctagacagctccatcaggaacatgcgggctgtgacagacaagtttctctcagccattgtcagctctgtggacaaaatcccttatgggatgcgcttcattgccaaagtgctgaaggactcgttgcatgagaagttccctgatgctggtgaggatgagctgctgaagattattggtaacttgctttattatcgatacatgaatccagccattgttgctcctgatgcctttgacatcattgacctgtcagcaggaggccagcttaccacagaccaacgccgaaatctgggctccattgcaaaaatgcttcagcatgctgcttccaataagatgtttctgggagataatgcccacttaagcatcattaatgaatatctttcccagtcctaccagaaattcagacggtttttccaaactgcttgtgatgtcccagagcttcaggataaatttaatgtggatgagtactctgatttagtaaccctcaccaaaccagtaatctacatttccattggtgaaatcatcaacacccacactctcctgttggatcaccaggatgccattgctccggagcacaatgatccaatccacgaactgctggacgacctcggcgaggtgcccaccatcgagtccctgataggggaaagctctggcaatttaaatgacccaaataaggaggcactggctaagacggaagtgtctctcaccctgaccaacaagttcgacgtgcctggagatgagaatgcagaaatggatgctcgaaccatcttactgaatacaaaacgtttaattgtggatgtcatccggttccagccaggagagaccttgactgaaatcctagaaacaccagccaccagtgaacaggaagcagaacatcagagagccatgcagagacgtgctatccgtgatgccaaaacacctgacaagatgaaaaagtcaaaatctgtaaaggaagacagcaacctcactcttcaagagaagaaagagaagatccagacaggtttaaagaagctaacagagcttggaaccgtggacccaaagaacaaataccaggaactgatcaacgacattgccagggtactgcattcgggggacagaggggacccggccttgttcaaagctgagaggctcgagagacagtagctgttcacataacagcatagcttcagttcatgggcaaattagtgccctcctctatgagaaaccatatctgactctccag

SEQ ID NO: 342101 - DNA, 3746 bp, Homo sapiens
ggtattaaaactgatcttttgacatttttgacaatgttcttataaattactttcttttttatcatatatggatgggatgaagcacagagtaagatagagtgcacagcaaaggggatctgcccctcctatctgtccaataccccacaggttttggtgataatcttgggcaatgttccagtcaaacctgcctcccacttctcactaaagttagtgaacatgtgacccacattccccaaataagagcctcttataaactccattcttggctttttcattcatagagatagctattttatgagacatagataaagcattttttagtgatgtgcacgatgccttttttcttaattattaacttctcaaaacataaacacattggaggcacttaataaagggagctgtagctaccgccgtccgcgcctccaaggtttcacggcttcctcagcagagactcgggctcgtccgccatgtccgccgcagacgaggttgacgggctgggcgtggcccggccgcactatggctctgtcctggataatgaaagacttactgcagaggagatggatgaaaggagacgtcagaacgtggcttatgagtacctttgtcatttggaagaagcgaagaggtggatggaagcatgcctaggggaagatctgcctcccaccacagaactggaggaggggcttaggaatggggtctaccttgccaaactggggaacttcttctctcccaaagtagtgtccctgaaaaaaatctatgatcgagaacagaccagatacaaggcgactggcctccactttagacacactgataatgtgattcagtggttgaatgccatggatgagattggattgcctaagattttttacccagaaactacagatatctatgatcgaaagaacatgccaagatgtatctactgtatccatgcactcagtttgtacctgttcaagctaggcctggcccctcagattcaagacctatatggaaaggttgacttcacagaagaagaaatcaacaacatgaagactgagttggagaagtatggcatccagatgcctgcctttagcaagattgggggcatcttggctaatgaactgtcagtggatgaagccgcattacatgctgctgttattgctattaatgaagctattgaccgtagaattccagccgacacatttgcagctttgaaaaatccgaatgccatgcttgtaaatcttgaagagcccttggcatccacttaccaggatatactttaccaggctaagcaggacaaaatgacaaatgctaaaaacaggacagaaaactcagagagagaaagagatgtttatgaggagctgctcacgcaagctgaaattcaaggcaatataaacaaagtcaatacattttctgcattagcaaatatcgacctggctttagaacaaggagatgcactggccttgttcagggctctgcagtcaccagccctggggcttcgaggactgcagcaacagaatagcgactggtacttgaagcagctcctgagtgataaacagcagaagagacagagtggtcagactgaccccctgcagaaggaggagctgcagtctggagtggatgctgcaaacagtgctgcccagcaatatcagagaagattggcagcagtagcactgattaatgctgcaatccagaagggtgttgctgagaagactgttttggaactgatgaatcccgaagcccagctgccccaggtgtatccatttgccgccgatctctatcagaaggagctggctaccctgcagcgacaaagtcctgaacataatctcacccacccagagctctctgtcgcagtggagatgttgtcatcggtggccctgatcaacagggcattggaatcaggagatgtgaatacagtgtggaagcaattgagcagttcagttactggtcttaccaatattgaggaagaaaactgtcagaggtatctcgatgagttgatgaaactgaaggctcaggcacatgcagagaataatgaattcattacatggaatgatatccaagcttgcgtggaccatgtgaacctggtggtgcaagaggaacatgagaggattttagccattggtttaattaatgaagccctggatgaaggtgatgcccaaaagactctgcaggccctacagattcctgcagctaaacttgagggagtccttgcagaagtggcccagcattaccaagacacgctgattagagcgaagagagagaaagcccaggaaatccaggatgagtcagctgtgttatggttggatgaaattcaaggtggaatctggcagtccaacaaagacacccaagaagcacagaagtttgccttaggaatctttgccattaatgaggcagtagaaagtggtgatgttggcaaaacactgagtgcccttcgctcccctgatgttggcttgtatggagtcatccctgagtgtggtgaaacttaccacagtgatcttgctgaagccaagaagaaaaaactggcagtaggagataataacagcaagtgggtgaagcactgggtaaaaggtggatattattattaccacaatctggagacccaggaaggaggatgggatgaacctccaaattttgtgcaaaattctatgcagctttctcgggaggagatccagagttctatctctggggtgactgccgcatataaccgagaacagctgtggctggccaatgaaggcctgatcaccaggctgcaggctcgctgccgtggatacttagttcgacaggaattccgatccaggatgaatttcctgaagaaacaaatccctgccatcacctgcattcagtcacagtggagaggatacaagcagaagaaggcatatcaagatcggttagcttacctgcgctcccacaaagatgaagttgtaaagattcagtccctggcaaggatgcaccaagctcgaaagcgctatcgagatcgcctgcagtacttccgggaccatataaatgacattatcaaaatccaggcttttattcgggcaaacaaagctcgggatgactacaagactctcatcaatgctgaggatcctcctatggttgtggtccgaaaatttgtccacctgctggaccaaagtgaccaggattttcaggaggagcttgaccttatgaagatgcgggaagaggttatcaccctcattcgttctaaccagcagctggagaatgacctcaatctcatggatatcaaaattggactgctagtgaaaaataagattacgttgcaggatgtggtttcccacagtaaaaaacttaccaaaaaaaataaggaacagttgtctgatatgatgatgataaataaacagaagggaggtctcaaggctttgagcaaggagaagagagagaagttggaagcttaccagcacctgttttatttattgcaaaccaatcccacctatctggccaagctcatttttcagatgccccagaacaagtccaccaagttcatggactctgtaatcttcacactctacaactacgcgtccaaccagcgagaggagtacctgctcctgcggctctttaagacagcactccaagaggaaatcaagtcgaaggtagatcagattcaagagattgtgacaggaaatcctacggttattaaaatggttgtaagtttcaaccgtggtgcccgtggccagaatgccctgagacagatcttggccccagtcgtggttacacattctagaatgtgtaacaacgacaacaacaaaaaacaagtgata

SEQ ID NO: 342102 - DNA, 3481 bp, Homo sapiens
ggtattaaaactgatcttttgacatttttgacaatgttcttataaattactttcttttttatcatatatggatgggatgaagcacagagtaagatagagtgcacagcaaaggggatctgcccctcctatctgtccaataccccacaggttttggtgataatcttgggcaatgttccagtcaaacctgcctcccacttctcactaaagttagtgaacatgtgacccacattccccaaataagagcctcttataaactccattcttggctttttcattcatagagatagctattttatgagacatagataaagcattttttagtgatgtgcacgatgccttttttcttaattattaacttctcaaaacataaacacattggaggcacttaataaagggagctgtagctaccgccgtccgcgcctccaaggtttcacggcttcctcagcagagactcgggctcgtccgccatgtccgccgcagacgaggttgacgggctgggcgtggcccggccgcactatggctctgtcctggataatgaaagacttactgcagaggagatggatgaaaggagacgtcagaacgtggcttatgagtacctttgtcatttggaagaagcgaagaggtggatggaagcatgcctaggggaagatctgcctcccaccacagaactggaggaggggcttaggaatggggtctaccttgccaaactggggaacttcttctctcccaaagtagtgtccctgaaaaaaatctatgatcgagaacagaccagatacaaggcgactggcctccactttagacacactgataatgtgattcagtggttgaatgccatggatgagattggattgcctaagattttttacccagaaactacagatatctatgatcgaaagaacatgccaagatgtatctactgtatccatgcactcagtttgtacctgttcaagctaggcctggcccctcagattcaagacctatatggaaaggttgacttcacagaagaagaaatcaacaacatgaagactgagttggagaagtatggcatccagatgcctgcctttagcaagattgggggcatcttggctaatgaactgtcagtggatgaagccgcattacatgctgctgttattgctattaatgaagctattgaccgtagaattccagccgacacatttgcagctttgaaaaatccgaatgccatgcttgtaaatcttgaagagcccttggcatccacttaccaggatatactttaccaggctaagcaggacaaaatgacaaatgctaaaaacaggacagaaaactcagagagagaaagagatgtttatgaggagctgctcacgcaagctgaaattcaaggcaatataaacaaagtcaatacattttctgcattagcaaatatcgacctggctttagaacaaggagatgcactggccttgttcagggctctgcagtcaccagccctggggcttcgaggactgcagcaacagaatagcgactggtacttgaagcagctcctgagtgataaacagcagaagagacagagtggtcagactgaccccctgcagaaggaggagctgcagtctggagtggatgctgcaaacagtgctgcccagcaatatcagagaagattggcagcagtagcactgattaatgctgcaatccagaagggtgttgctgagaagactgttttggaactgatgaatcccgaagcccagctgccccaggtgtatccatttgccgccgatctctatcagaaggagctggctaccctgcagcgacaaagtcctgaacataatctcacccacccagagctctctgtcgcagtggagatgttgtcatcggtggccctgatcaacagggcattggaatcaggagatgtgaatacagtgtggaagcaattgagcagttcagttactggtcttaccaatattgaggaagaaaactgtcagaggtatctcgatgagttgatgaaactgaaggctcaggcacatgcagagaataatgaattcattacatggaatgatatccaagcttgcgtggaccatgtgaacctggtggtgcaagaggaacatgagaggattttagccattggtttaattaatgaagccctggatgaaggtgatgcccaaaagactctgcaggccctacagattcctgcagctaaacttgagggagtccttgcagaagtggcccagcattaccaagacacgctgattagagcgaagagagagaaagcccaggaaatccaggatgagtcagctgtgttatggttggatgaaattcaaggtggaatctggcagtccaacaaagacacccaagaagcacagaagtttgccttaggaatctttgccattaatgaggcagtagaaagtggtgatgttggcaaaacactgagtgcccttcgctcccctgatgttggcttgtatggagtcatccctgagtgtggtgaaacttaccacagtgatcttgctgaagccaagaagaaaaaactggcagtaggagataataacagcaagtgggtgaagcactgggtaaaaggtggatattattattaccacaatctggagacccaggaaggaggatgggatgaacctccaaattttgtgcaaaattctatgcagctttctcgggaggagatccagagttctatctctggggtgactgccgcatataaccgagaacagctgtggctggccaatgaaggcctgatcaccaggctgcaggctcgctgccgtggatacttagttcgacaggaattccgatccaggatgaatttcctgaagaaacaaatccctgccatcacctgcattcagtcacagtggagaggatacaagcagaagaaggcatatcaagatcggttagcttacctgcgctcccacaaagatgaagttgtaaagattcagtccctggcaaggatgcaccaagctcgaaagcgctatcgagatcgcctgcagtacttccgggaccatataaatgacattatcaaaatccaggcttttattcgggcaaacaaagctcgggatgactacaagactctcatcaatgctgaggatcctcctatggttgtggtccgaaaatttgtccacctgctggaccaaagtgaccaggattttcaggaggagcttgaccttatgaagatgcgggaagaggttatcaccctcattcgttctaaccagcagctggagaatgacctcaatctcatggatatcaaaattggactgctagtgaaaaataagattacgttgcaggtatggcccagtgccagcgggggccttggaacggttcatcctgctttgtaacccctgcattcccctttctgactggtggggagggtggaggctgactttctcctcagctactgccataagagctttttttttttcttttgactgagtctcactctgttgcccaggttgcagtgagccgagattgcatgactgcactccggactgggtgacagagtgaaactctatctcca

SEQ ID NO: 342103 - DNA, 3600 bp, Homo sapiens
ggtattaaaactgatcttttgacatttttgacaatgttcttataaattactttcttttttatcatatatggatgggatgaagcacagagtaagatagagtgcacagcaaaggggatctgcccctcctatctgtccaataccccacaggttttggtgataatcttgggcaatgttccagtcaaacctgcctcccacttctcactaaagttagtgaacatgtgacccacattccccaaataagagcctcttataaactccattcttggctttttcattcatagagatagctattttatgagacatagataaagcattttttagtgatgtgcacgatgccttttttcttaattattaacttctcaaaacataaacacattggaggcacttaataaagggagctgtagctaccgccgtccgcgcctccaaggtttcacggcttcctcagcagagactcgggctcgtccgccatgtccgccgcagacgaggttgacgggctgggcgtggcccggccgcactatggctctgtcctggataatgaaagacttactgcagaggagatggatgaaaggagacgtcagaacgtggcttatgagtacctttgtcatttggaagaagcgaagaggtggatggaagcatgcctaggggaagatctgcctcccaccacagaactggaggaggggcttaggaatggggtctaccttgccaaactggggaacttcttctctcccaaagtagtgtccctgaaaaaaatctatgatcgagaacagaccagatacaaggcgactggcctccactttagacacactgataatgtgattcagtggttgaatgccatggatgagattggattgcctaagattttttacccagaaactacagatatctatgatcgaaagaacatgccaagatgtatctactgtatccatgcactcagtttgtacctgttcaagctaggcctggcccctcagattcaagacctatatggaaaggttgacttcacagaagaagaaatcaacaacatgaagactgagttggagaagtatggcatccagatgcctgcctttagcaagattgggggcatcttggctaatgaactgtcagtggatgaagccgcattacatgctgctgttattgctattaatgaagctattgaccgtagaattccagccgacacatttgcagctttgaaaaatccgaatgccatgcttgtaaatcttgaagagcccttggcatccacttaccaggatatactttaccaggctaagcaggacaaaatgacaaatgctaaaaacaggacagaaaactcagagagagaaagagatgtttatgaggagctgctcacgcaagctgaaattcaaggcaatataaacaaagtcaatacattttctgcattagcaaatatcgacctggctttagaacaaggagatgcactggccttgttcagggctctgcagtcaccagccctggggcttcgaggactgcagcaacagaatagcgactggtacttgaagcagctcctgagtgataaacagcagaagagacagagtggtcagactgaccccctgcagaaggaggagctgcagtctggagtggatgctgcaaacagtgctgcccagcaatatcagagaagattggcagcagtagcactgattaatgctgcaatccagaagggtgttgctgagaagactgttttggaactgatgaatcccgaagcccagctgccccaggtgtatccatttgccgccgatctctatcagaaggagctggctaccctgcagcgacaaagtcctgaacataatctcacccacccagagctctctgtcgcagtggagatgttgtcatcggtggccctgatcaacagggcattggaatcaggagatgtgaatacagtgtggaagcaattgagcagttcagttactggtcttaccaatattgaggaagaaaactgtcagaggtatctcgatgagttgatgaaactgaaggctcaggcacatgcagagaataatgaattcattacatggaatgatatccaagcttgcgtggaccatgtgaacctggtggtgcaagaggaacatgagaggattttagccattggtttaattaatgaagccctggatgaaggtgatgcccaaaagactctgcaggccctacagattcctgcagctaaacttgagggagtccttgcagaagtggcccagcattaccaagacacgctgattagagcgaagagagagaaagcccaggaaatccaggatgagtcagctgtgttatggttggatgaaattcaaggtggaatctggcagtccaacaaagacacccaagaagcacagaagtttgccttaggaatctttgccattaatgaggcagtagaaagtggtgatgttggcaaaacactgagtgcccttcgctcccctgatgttggcttgtatggagtcatccctgagtgtggtgaaacttaccacagtgatcttgctgaagccaagaagaaaaaactggcagtaggagataataacagcaagtgggtgaagcactgggtaaaaggtggatattattattaccacaatctggagacccaggaaggaggatgggatgaacctccaaattttgtgcaaaattctatgcagctttctcgggaggagatccagagttctatctctggggtgactgccgcatataaccgagaacagctgtggctggccaatgaaggcctgatcaccaggctgcaggctcgctgccgtggatacttagttcgacaggaattccgatccaggatgaatttcctgaagaaacaaatccctgccatcacctgcattcagtcacagtggagaggatacaagcagaagaaggcatatcaagatcggttagcttacctgcgctcccacaaagatgaagttgtaaagattcagtccctggcaaggatgcaccaagctcgaaagcgctatcgagatcgcctgcagtacttccgggaccatataaatgacattatcaaaatccaggcttttattcgggcaaacaaagctcgggatgactacaagactctcatcaatgctgaggatcctcctatggttgtggtccgaaaatttgtccacctgctggaccaaagtgaccaggattttcaggaggagcttgaccttatgaagatgcgggaagaggttatcaccctcattcgttctaaccagcagctggagaatgacctcaatctcatggatatcaaaattggactgctagtgaaaaataagattacgttgcaggtatggcccagtgccagcgggggccttggaacggttcatcctgctttgtaacccctgcattcccctttctgactggtggggagggtggaggctgactttctcctcagctactgccataagagctttttttttttcttttgactgagtctcactctgttgcccaggttgtagtgcgatgtgatctcagctcactgcaacctctgcctcccaggttcaagcaattctcctccctcaacctcctgtagtcccaggtactcggggctgaggcaggaagatcacttgagcccaggagttcaaggctgcagtgagccgtgatggcaccactgcatggaaaagaccaaatatcaaa

SEQ ID NO: 342104 - DNA, 2886 bp, Homo sapiens
ggtattaaaactgatcttttgacatttttgacaatgttcttataaattactttcttttttatcatatatggatgggatgaagcacagagtaagatagagtgcacagcaaaggggatctgcccctcctatctgtccaataccccacaggttttggtgataatcttgggcaatgttccagtcaaacctgcctcccacttctcactaaagttagtgaacatgtgacccacattccccaaataagagcctcttataaactccattcttggctttttcattcatagagatagctattttatgagacatagataaagcattttttagtgatgtgcacgatgccttttttcttaattattaacttctcaaaacataaacacattggaggcacttaataaagggagctgtagctaccgccgtccgcgcctccaaggtttcacggcttcctcagcagagactcgggctcgtccgccatgtccgccgcagacgaggttgacgggctgggcgtggcccggccgcactatggctctgtcctggataatgaaagacttactgcagaggagatggatgaaaggagacgtcagaacgtggcttatgagtacctttgtcatttggaagaagcgaagaggtggatggaagcatgcctaggggaagatctgcctcccaccacagaactggaggaggggcttaggaatggggtctaccttgccaaactggggaacttcttctctcccaaagtagtgtccctgaaaaaaatctatgatcgagaacagaccagatacaaggcgactggcctccactttagacacactgataatgtgattcagtggttgaatgccatggatgagattggattgcctaagattttttacccagaaactacagatatctatgatcgaaagaacatgccaagatgtatctactgtatccatgcactcagtttgtacctgttcaagctaggcctggcccctcagattcaagacctatatggaaaggttgacttcacagaagaagaaatcaacaacatgaagactgagttggagaagtatggcatccagatgcctgcctttagcaagattgggggcatcttggctaatgaactgtcagtggatgaagccgcattacatgctgctgttattgctattaatgaagctattgaccgtagaattccagccgacacatttgcagctttgaaaaatccgaatgccatgcttgtaaatcttgaagagcccttggcatccacttaccaggatatactttaccaggctaagcaggacaaaatgacaaatgctaaaaacaggacagaaaactcagagagagaaagagatgtttatgaggagctgctcacgcaagctgaaattcaaggcaatataaacaaagtcaatacattttctgcattagcaaatatcgacctggctttagaacaaggagatgcactggccttgttcagggctctgcagtcaccagccctggggcttcgaggactgcagcaacagaatagcgactggtacttgaagcagctcctgagtgataaacagcagaagagacagagtggtcagactgaccccctgcagaaggaggagctgcagtctggagtggatgctgcaaacagtgctgcccagcaatatcagagaagattggcagcagtagcactgattaatgctgcaatccagaagggtgttgctgagaagactgttttggaactgatgaatcccgaagcccagctgccccaggtgtatccatttgccgccgatctctatcagaaggagctggctaccctgcagcgacaaagtcctgaacataatctcacccacccagagctctctgtcgcagtggagatgttgtcatcggtggccctgatcaacagggcattggaatcaggagatgtgaatacagtgtggaagcaattgagcagttcagttactggtcttaccaatattgaggaagaaaactgtcagaggtatctcgatgagttgatgaaactgaaggctcaggcacatgcagagaataatgaattcattacatggaatgatatccaagcttgcgtggaccatgtgaacctggtggtgcaagaggaacatgagaggattttagccattggtttaattaatgaagccctggatgaaggtgatgcccaaaagactctgcaggccctacagattcctgcagctaaacttgagggagtccttgcagaagtggcccagcattaccaagacacgctgattagagcgaagagagagaaagcccaggaaatccaggatgagtcagctgtgttatggttggatgaaattcaaggtggaatctggcagtccaacaaagacacccaagaagcacagaagtttgccttaggaatctttgccattaatgaggcagtagaaagtggtgatgttggcaaaacactgagtgcccttcgctcccctgatgttggcttgtatggagtcatccctgagtgtggtgaaacttaccacagtgatcttgctgaagccaagaagaaaaaactggcagtaggagataataacagcaagtgggtgaagcactgggtaaaaggtggatattattattaccacaatctggagacccaggaaggaggatgggatgaacctccaaattttgtgcaaaattctatgcagctttctcgggaggagatccagagttctatctctggggtgactgccgcatataaccgagaacagctgtggctggccaatgaaggcctgatcaccaggctgcaggctcgctgccgtggatacttagttcgacaggaattccgatccaggatgaatttcctgaagaaacaaatccctgccatcacctgcattcaggtatttcagaacctatcacacagacagcaagcgggcatctagagcaggggtaataaacggtcagctgtca

SEQ ID NO: 342105 - DNA, 2131 bp, Homo sapiens
ggtattaaaactgatcttttgacatttttgacaatgttcttataaattactttcttttttatcatatatggatgggatgaagcacagagtaagatagagtgcacagcaaaggggatctgcccctcctatctgtccaataccccacaggttttggtgataatcttgggcaatgttccagtcaaacctgcctcccacttctcactaaagttagtgaacatgtgacccacattccccaaataagagcctcttataaactccattcttggctttttcattcatagagatagctattttatgagacatagataaagcattttttagtgatgtgcacgatgccttttttcttaattattaacttctcaaaacataaacacattggaggcacttaataaagggagctgtagctaccgccgtccgcgcctccaaggtttcacggcttcctcagcagagactcgggctcgtccgccatgtccgccgcagacgaggttgacgggctgggcgtggcccggccgcactatggctctgtcctggataatgaaagacttactgcagaggagatggatgaaaggagacgtcagaacgtggcttatgagtacctttgtcatttggaagaagcgaagaggtggatggaagcatgcctaggggaagatctgcctcccaccacagaactggaggaggggcttaggaatggggtctaccttgccaaactggggaacttcttctctcccaaagtagtgtccctgaaaaaaatctatgatcgagaacagaccagatacaaggcgactggcctccactttagacacactgataatgtgattcagtggttgaatgccatggatgagattggattgcctaagattttttacccagaaactacagatatctatgatcgaaagaacatgccaagatgtatctactgtatccatgcactcagtttgtacctgttcaagctaggcctggcccctcagattcaagacctatatggaaaggttgacttcacagaagaagaaatcaacaacatgaagactgagttggagaagtatggcatccagatgcctgcctttagcaagattgggggcatcttggctaatgaactgtcagtggatgaagccgcattacatgctgctgttattgctattaatgaagctattgaccgtagaattccagccgacacatttgcagctttgaaaaatccgaatgccatgcttgtaaatcttgaagagcccttggcatccacttaccaggatatactttaccaggctaagcaggacaaaatgacaaatgctaaaaacaggacagaaaactcagagagagaaagagatgtttatgaggagctgctcacgcaagctgaaattcaaggcaatataaacaaagtcaatacattttctgcattagcaaatatcgacctggctttagaacaaggagatgcactggccttgttcagggctctgcagtcaccagccctggggcttcgaggactgcagcaacagaatagcgactggtacttgaagcagctcctgagtgataaacagcagaagagacagagtggtcagactgaccccctgcagaaggaggagctgcagtctggagtggatgctgcaaacagtgctgcccagcaatatcagagaagtaagagtccattgaaattgtatgggaggaaagttgtggctttgtgttattgaagggtctgaggttagcttctgtcatcgtcatcacccactctgagcctactagccataaccaactgccaggtacttttggtggcaggagggttcctccagtttgttgttgtggtggttttaattgctgtgtaatagttgtacatattttgagggtacatgtgttttgttttttaaaccaaccaagaagcactgacaccaaccaagaagcactgacgtatgatattttgatacatgcatacaatgtattatgatcaaatcagggtaattggaatatttgtcacctaacgcatttatcttttgttgatgttgggaacattccagttcttctgttttgaactatacattattgttaactatcatcatcctactgtgctatctaacactagacctattccttgtatctaatggtaattttgtacccgttagccaacctctctatgtcctcctcc

SEQ ID NO: 342106 - DNA, 2149 bp, Homo sapiens
ggtattaaaactgatcttttgacatttttgacaatgttcttataaattactttcttttttatcatatatggatgggatgaagcacagagtaagatagagtgcacagcaaaggggatctgcccctcctatctgtccaataccccacaggttttggtgataatcttgggcaatgttccagtcaaacctgcctcccacttctcactaaagttagtgaacatgtgacccacattccccaaataagagcctcttataaactccattcttggctttttcattcatagagatagctattttatgagacatagataaagcattttttagtgatgtgcacgatgccttttttcttaattattaacttctcaaaacataaacacattggaggcacttaataaagggagctgtagctaccgccgtccgcgcctccaaggtttcacggcttcctcagcagagactcgggctcgtccgccatgtccgccgcagacgaggttgacgggctgggcgtggcccggccgcactatggctctgtcctggataatgaaagacttactgcagaggagatggatgaaaggagacgtcagaacgtggcttatgagtacctttgtcatttggaagaagcgaagaggtggatggaagcatgcctaggggaagatctgcctcccaccacagaactggaggaggggcttaggaatggggtctaccttgccaaactggggaacttcttctctcccaaagtagtgtccctgaaaaaaatctatgatcgagaacagaccagatacaaggcgactggcctccactttagacacactgataatgtgattcagtggttgaatgccatggatgagattggattgcctaagattttttacccagaaactacagatatctatgatcgaaagaacatgccaagatgtatctactgtatccatgcactcagtttgtacctgttcaagctaggcctggcccctcagattcaagacctatatggaaaggttgacttcacagaagaagaaatcaacaacatgaagactgagttggagaagtatggcatccagatgcctgcctttagcaagattgggggcatcttggctaatgaactgtcagtggatgaagccgcattacatgctgctgttattgctattaatgaagctattgaccgtagaattccagccgacacatttgcagctttgaaaaatccgaatgccatgcttgtaaatcttgaagagcccttggcatccacttaccaggatatactttaccaggctaagcaggacaaaatgacaaatgctaaaaacaggacagaaaactcagagagagaaagagatgtttatgaggagctgctcacgcaagctgaaattcaaggcaatataaacaaagtcaataatgccgacaaaaggatcaaggtggcgattgcccgtggtggagatggcatggtgatgagatgacccgtattatctggcagttcatcaaggagaagctacatcctgcacccacgtggacatccagctaaagtattatcgaccctcgagagacatcccaaaccgtgaccagactgatgaccaggtcaccattgactctgacactggccacccagaagtacacgtgtggctgtcaacgtgtgccaacaataaacacctgatgaggcccgtgtggaagagtacaagctgaagaagatgtggaaaagtcccacataggaactaatccggaaacatacctgggggagggacaagatcaataaccgcgagaaacacaaatacaataatagaaacaaaacaatcaccaacagaccattagttacccactggatagacaacaaaagacacaatcagcacatgagagagacaaagcacaataggaaaacaaatacaaaacgacccacaaacctttagaggaaagaaccagaacccggacacatatccaaaaatggataattaaaccccaaaccagatcggcagcaggctgtcacacaggagatggtaaaggtggacaaaaagtccgccggagttgcaagacagagagacaggaacaaatgaacaaagagacaagaaaagaacagactacagagtatagagcacaaggagcagaacagctaggcgacacagaatgaaaagacacgctgcacactacgcagaaatgaaacccgagagaaaac

SEQ ID NO: 342107 - DNA, 1000 bp, Homo sapiens
ggtattaaaactgatcttttgacatttttgacaatgttcttataaattactttcttttttatcatatatggatgggatgaagcacagagtaagatagagtgcacagcaaaggggatctgcccctcctatctgtccaataccccacaggttttggtgataatcttgggcaatgttccagtcaaacctgcctcccacttctcactaaagttagtgaacatgtgacccacattccccaaataagagcctcttataaactccattcttggctttttcattcatagagatagctattttatgagacatagataaagcattttttagtgatgtgcacgatgccttttttcttaattattaacttctcaaaacataaacacattggaggcacttaataaagggagctgtagctaccgccgtccgcgcctccaaggtttcacggcttcctcagcagagactcgggctcgtccgccatgtccgccgcagacgaggttgacgggctgggcgtggcccggccgcactatggctctgtcctggataatgaaagacttactgcagaggagatggatgaaaggagacgtcagaacgtggcttatgagtacctttgtcatttggaagaagcgaagaggtaaagattggctggctggagagaagattaagagaagggaactgataatagtgtgaatacaaataaagattgctttgaggctgaacacagtggtccatgcctgtaatcccaacacgttgggaggccgaggtgggggggaatcacttgaacccagctgtttgagaccagattgggcaacatagtgacaccccatctctacaaaaaaattttaaaaattagccaggcatggtggtgcatgccagtagtcctagctactcgggagcctgaggagggaggatcacttgagtccgggaggtcgaggcagcagtgagccgtgctctcaccactgtgctctagcctgggtgacaaaactcctgtttttggtggggggaaaaaaaa

SEQ ID NO: 342108 - DNA, 478 bp, Homo sapiens
gtccaacaaagacacccaagaagcacagaagtgtatgtatcacctgttttatttctgttttggtggaggctggggtgacaaggtgctccgtacagcttgaccaagataggtatgggggaacaatttgccagtagatatagttaggtgaagcagtatgtgaatttagacactctctaaactattctggtaacagttctttcccgaaatagttgccttaggaatctttgccattaatgaggcagtagaaagtggtgatgttggcaaaacactgagtgcccttcgctcccctgatgttggcttgtatggagtcatccctgagtgtggtgaaacttaccacagtgatcttgctgaagccaagaagaaaaaactggcagtaggtgagttctgggataatacatatgtgccctgaagctaacccttgagtatatgaggggacagatgtagaggaaagggataagctatagggaaagacctttta

SEQ ID NO: 342109 - DNA, 497 bp, Homo sapiens
agtgtctaaaaaaaaaaaaaaaaaaaaaagtaggtagtcatatttaaggcagagttaagcattgctgggttgtagtgtgaaatgataatgataactgtcgttatttttctaactttaataattatgtctcaggatattcggaatcagcggaggtaccgacagaggagaaaggccgaactagtgaaactgcaacagacatacgctgctctgaactctaaggccaccttttatggggagcaggtggattactataaaagctatatcaaaacctgcttggataacttagccagcaagggcaagtgagtattttttctttttaaagaatcaatgtcagaattagagtgaggaaaaagcagaggcaactgaaatgacactggaaatttttacttaaaatacactggatctatttattgcattagtcttttattttacctctaatcatttgtgtaattgcctaattccatttgtaagtgtatgatgtgaatagtgggtggggg

SEQ ID NO: 342110 - DNA, 7228 bp, Homo sapiens
  misc_feature (8)..(8): n is a, c, g, or t
gacggcanggggcggggcctcggggaccccggcaagcccgcgcacttggcaggagctgtagctaccgccgtccgcgcctccaaggtttcacggcttcctcagcagagactcgggctcgtccgccatgtccgccgcagacgaggttgacgggctgggcgtggcccggccgcactatggctctgtcctggataatgaaagacttactgcagaggagatggatgaaaggagacgtcagaacgtggcttatgagtacctttgtcatttggaagaagcgaagaggtggatggaagcatgcctaggggaagatctgcctcccaccacagaactggaggaggggcttaggaatggggtctaccttgccaaactggggaacttcttctctcccaaagtagtgtccctgaaaaaaatctatgatcgagaacagaccagatacaaggcgactggcctccactttagacacactgataatgtgattcagtggttgaatgccatggatgagattggattgcctaagattttttacccagaaactacagatatctatgatcgaaagaacatgccaagatgtatctactgtatccatgcactcagtttgtacctgttcaagctaggcctggcccctcagattcaagacctatatggaaaggttgacttcacagaagaagaaatcaacaacatgaagactgagttggagaagtatggcatccagatgcctgcctttagcaagattgggggcatcttggctaatgaactgtcagtggatgaagccgcattacatgctgctgttattgctattaatgaagctattgaccgtagaattccagccgacacatttgcagctttgaaaaatccgaatgccatgcttgtaaatcttgaagagcccttggcatccacttaccaggatatactttaccaggctaagcaggacaaaatgacaaatgctaaaaacaggacagaaaactcagagagagaaagagatgtttatgaggagctgctcacgcaagctgaaattcaaggcaatataaacaaagtcaatacattttctgcattagcaaatatcgacctggctttagaacaaggagatgcactggccttgttcagggctctgcagtcaccagccctggggcttcgaggactgcagcaacagaatagcgactggtacttgaagcagctcctgagtgataaacagcagaagagacagagtggtcagactgaccccctgcagaaggaggagctgcagtctggagtggatgctgcaaacagtgctgcccagcaatatcagagaagattggcagcagtagcactgattaatgctgcaatccagaagggtgttgctgagaagactgttttggaactgatgaatcccgaagcccagctgccccaggtgtatccatttgccgccgatctctatcagaaggagctggctaccctgcagcgacaaagtcctgaacataatctcacccacccagagctctctgtcgcagtggagatgttgtcatcggtggccctgatcaacagggcattggaatcaggagatgtgaatacagtgtggaagcaattgagcagttcagttactggtcttaccaatattgaggaagaaaactgtcagaggtatctcgatgagttgatgaaactgaaggctcaggcacatgcagagaataatgaattcattacatggaatgatatccaagcttgcgtggaccatgtgaacctggtggtgcaagaggaacatgagaggattttagccattggtttaattaatgaagccctggatgaaggtgatgcccaaaagactctgcaggccctacagattcctgcagctaaacttgagggagtccttgcagaagtggcccagcattaccaagacacgctgattagagcgaagagagagaaagcccaggaaatccaggatgagtcagctgtgttatggttggatgaaattcaaggtggaatctggcagtccaacaaagacacccaagaagcacagaagtttgccttaggaatctttgccattaatgaggcagtagaaagtggtgatgttggcaaaacactgagtgcccttcgctcccctgatgttggcttgtatggagtcatccctgagtgtggtgaaacttaccacagtgatcttgctgaagccaagaagaaaaaactggcagtaggagataataacagcaagtgggtgaagcactgggtaaaaggtggatattattattaccacaatctggagacccaggaaggaggatgggatgaacctccaaattttgtgcaaaattctatgcagctttctcgggaggagatccagagttctatctctggggtgactgccgcatataaccgagaacagctgtggctggccaatgaaggcctgatcaccaggctgcaggctcgctgccgtggatacttagttcgacaggaattccgatccaggatgaatttcctgaagaaacaaatccctgccatcacctgcattcagtcacagtggagaggatacaagcagaagaaggcatatcaagatcggttagcttacctgcgctcccacaaagatgaagttgtaaagattcagtccctggcaaggatgcaccaagctcgaaagcgctatcgagatcgcctgcagtacttccgggaccatataaatgacattatcaaaatccaggcttttattcgggcaaacaaagctcgggatgactacaagactctcatcaatgctgaggatcctcctatggttgtggtccgaaaatttgtccacctgctggaccaaagtgaccaggattttcaggaggagcttgaccttatgaagatgcgggaagaggttatcaccctcattcgttctaaccagcagctggagaatgacctcaatctcatggatatcaaaattggactgctagtgaaaaataagattacgttgcaggatgtggtttcccacagtaaaaaacttaccaaaaaaaataaggaacagttgtctgatatgatgatgataaataaacagaagggaggtctcaaggctttgagcaaggagaagagagagaagttggaagcttaccagcacctgttttatttattgcaaaccaatcccacctatctggccaagctcatttttcagatgccccagaacaagtccaccaagttcatggactctgtaatcttcacactctacaactacgcgtccaaccagcgagaggagtacctgctcctgcggctctttaagacagcactccaagaggaaatcaagtcgaaggtagatcagattcaagagattgtgacaggaaatcctacggttattaaaatggttgtaagtttcaaccgtggtgcccgtggccagaatgccctgagacagatcttggccccagtcgtgaaggaaattatggatgacaaatctctcaacatcaaaactgaccctgtggatatttacaaatcttgggttaatcagatggagtctcagacaggagaggcaagcaaactgccctatgatgtgacccctgagcaggcgctagctcatgaagaagtgaagacacggctagacagctccatcaggaacatgcgggctgtgacagacaagtttctctcagccattgtcagctctgtggacaaaatcccttatgggatgcgcttcattgccaaagtgctgaaggactcgttgcatgagaagttccctgatgctggtgaggatgagctgctgaagattattggtaacttgctttattatcgatacatgaatccagccattgttgctcctgatgcctttgacatcattgacctgtcagcaggaggccagcttaccacagaccaacgccgaaatctgggctccattgcaaaaatgcttcagcatgctgcttccaataagatgtttctgggagataatgcccacttaagcatcattaatgaatatctttcccagtcctaccagaaattcagacggtttttccaaactgcttgtgatgtcccagagcttcaggataaatttaatgtggatgagtactctgatttagtaaccctcaccaaaccagtaatctacatttccattggtgaaatcatcaacacccacactctcctgttggatcaccaggatgccattgctccggagcacaatgatccaatccacgaactgctggacgacctcggcgaggtgcccaccatcgagtccctgataggggaaagctctggcaatttaaatgacccaaataaggaggcactggctaagacggaagtgtctctcaccctgaccaacaagttcgacgtgcctggagatgagaatgcagaaatggatgctcgaaccatcttactgaatacaaaacgtttaattgtggatgtcatccggttccagccaggagagaccttgactgaaatcctagaaacaccagccaccagtgaacaggaagcagaacatcagagagccatgcagagacgtgctatccgtgatgccaaaacacctgacaagatgaaaaagtcaaaatctgtaaaggaagacagcaacctcactcttcaagagaagaaagagaagatccagacaggtttaaagaagctaacagagcttggaaccgtggacccaaagaacaaataccaggaactgatcaacgacattgccagggatattcggaatcagcggaggtaccgacagaggagaaaggccgaactagtgaaactgcaacagacatacgctgctctgaactctaaggccaccttttatggggagcaggtggattactataaaagctatatcaaaacctgcttggataacttagccagcaagggcaaagtctccaaaaagcctagggaaatgaaaggaaagaaaagcaaaaagatttctctgaaatatacagcagcaagactacatgaaaaaggagttcttctggaaattgaggacctgcaagtgaatcagtttaaaaatgttatatttgaaatcagtccaacagaagaagttggagacttcgaagtgaaagccaaattcatgggagttcaaatggagacttttatgttacattatcaggacctgctgcagctacagtatgaaggagttgcagtcatgaaattatttgatagagctaaagtaaatgtcaacctcctgatcttccttctcaacaaaaagttctacgggaagtaattgatcgtttgctgccagcccagaaggatgaaggaaagaagcacctcacagctcctttctaggtccttctttcctcattggaagcaaagacctagccaacaacagcacctcaatctgatacactcccgatgccacatttttaactcctctcgctctgatgggacatttgttacccttttttcatagtgaaattgtgtttcaggcttagtctgacctttctggtttcttcattttcttccattacttaggaaagagtggaaactccactaaaatttctctgtgttgttacagtcttagaggttgcagtactatattgtaagctttggtgtttgtttaattagcaatagggatggtaggattcaaatgtgtgtcatttagaagtggaagctattagcaccaatgacataaatacatacaagacacagaactaaaatgtcatgttattaacagttattaggttgtcatttaaaaataaagttcctttatatttctgtcccatcaggaaaactgaaggatatggggaatcattggttatcttccattgtgtttttctttatggacaggagctaatggaagtgacagtcatgttcaaaggaagcatttctagaaaaaaggagataatgtttttaaatttcattatcaaacttgggcaattctgtttgtgtaactccccgactagtggatgggagagtcccattgctaaaattcagctactcagataaattcagaatgggtcaaggcacctgcctgtttttgttggtgcacagagattgacttgattcagagagacaattcactccatccctatggcagaggaatgggttagccctaatgtagaatgtcattgtttttaaaactgttttatatcttaagagtgccttattaaagtatagatgtatgtcttaaaatgtgggtgataggaattttaaagatttatataatgcatcaaaagccttagaataagaaaagctttttttaaattgctttatctgtatatctgaactcttgaaacttatagctaaaacactaggatttatctgcagtgttgcagggagataattctgccttaaattgtctaaaacaaaaacaaaaccagccaacctatgttacacgtgagattaaaaccaattttttccccattttttctccttttttctcttgctgcccacattgtgcctttattttatgagccccagttttctgggcttagtttaaaaaaaaaatcaagtctaaacattgcatttagaaagcttttgttcttggataaaaagtcatacactttaaaaaaaaaaaaaactttttccaggaaaatatattgaaatcatgctgctgagcctctattttctttctttgatgttttgattcagtattcttttatcataaatttttagcatttaaaaattcactgatgtacattaagccaataaactgctttaatgaataacaaactatgtagtgtgtccctattataaatgcattggagaagtatttttatgagactctttactcaggtgcatggttacagcccacagggaggcatggagtgccatggaaggattcgccactacccagaccttgttttttgttgtattttggaagacaggttttttaaagaaacattttcctcagattaaaagatgatgctattacaactagcattgcctcaaaaactgggaccaaccaaagtgtgtcaaccctgtttccttaaaagaggctatgaatcccaaaggccacatccaagacaggcaataatgagcagagtttacagctcctttaataaaatgtgtcagtaattttaaggtttatagttccctcaacacaattgctaatgcagaatagtgtaaaatgcgcttcaagaatgttgatgatgatgatatagaattgtggctttagtagcacagaggatgccccaacaaactcatggcgttgaaaccacacagttctcattactgttatttattagctgtagcattctctgtctcctctctctcctcctttgaccttctcctcgaccagccatcatgacatttaccatgaatttacttcctcccaagagtttggactgcccgtcagattgtttctgcacatagttgcctttgtatctctgtatgaaataaaaggtcatttgtt

SEQ ID NO: 342111 - DNA, 7331 bp, Homo sapiens
  misc_feature (8)..(8): n is a, c, g, or t
gacggcanggggcggggcctcggggaccccggcaagcccgcgcacttggcaggagctgtagctaccgccgtccgcgcctccaaggtttcacggcttcctcagcagagactcgggctcgtccgccatgtccgccgcagacgaggttgacgggctgggcgtggcccggccgcactatggctctgtcctggataatgaaagacttactgcagaggagatggatgaaaggagacgtcagaacgtggcttatgagtacctttgtcatttggaagaagcgaagaggtggatggaagcatgcctaggggaagatctgcctcccaccacagaactggaggaggggcttaggaatggggtctaccttgccaaactggggaacttcttctctcccaaagtagtgtccctgaaaaaaatctatgatcgagaacagaccagatacaaggcgactggcctccactttagacacactgataatgtgattcagtggttgaatgccatggatgagattggattgcctaagattttttacccagaaactacagatatctatgatcgaaagaacatgccaagatgtatctactgtatccatgcactcagtttgtacctgttcaagctaggcctggcccctcagattcaagacctatatggaaaggttgacttcacagaagaagaaatcaacaacatgaagactgagttggagaagtatggcatccagatgcctgcctttagcaagattgggggcatcttggctaatgaactgtcagtggatgaagccgcattacatgctgctgttattgctattaatgaagctattgaccgtagaattccagccgacacatttgcagctttgaaaaatccgaatgccatgcttgtaaatcttgaagagcccttggcatccacttaccaggatatactttaccaggctaagcaggacaaaatgacaaatgctaaaaacaggacagaaaactcagagagagaaagagatgtttatgaggagctgctcacgcaagctgaaattcaaggcaatataaacaaagtcaatacattttctgcattagcaaatatcgacctggctttagaacaaggagatgcactggccttgttcagggctctgcagtcaccagccctggggcttcgaggactgcagcaacagaatagcgactggtacttgaagcagctcctgagtgataaacagcagaagagacagagtggtcagactgaccccctgcagaaggaggagctgcagtctggagtggatgctgcaaacagtgctgcccagcaatatcagagaagattggcagcagtagcactgattaatgctgcaatccagaagggtgttgctgagaagactgttttggaactgatgaatcccgaagcccagctgccccaggtgtatccatttgccgccgatctctatcagaaggagctggctaccctgcagcgacaaagtcctgaacataatctcacccacccagagctctctgtcgcagtggagatgttgtcatcggtggccctgatcaacagggcattggaatcaggagatgtgaatacagtgtggaagcaattgagcagttcagttactggtcttaccaatattgaggaagaaaactgtcagaggtatctcgatgagttgatgaaactgaaggctcaggcacatgcagagaataatgaattcattacatggaatgatatccaagcttgcgtggaccatgtgaacctggtggtgcaagaggaacatgagaggattttagccattggtttaattaatgaagccctggatgaaggtgatgcccaaaagactctgcaggccctacagattcctgcagctaaacttgagggagtccttgcagaagtggcccagcattaccaagacacgctgattagagcgaagagagagaaagcccaggaaatccaggatgagtcagctgtgttatggttggatgaaattcaaggtggaatctggcagtccaacaaagacacccaagaagcacagaagtttgccttaggaatctttgccattaatgaggcagtagaaagtggtgatgttggcaaaacactgagtgcccttcgctcccctgatgttggcttgtatggagtcatccctgagtgtggtgaaacttaccacagtgatcttgctgaagccaagaagaaaaaactggcagtaggagataataacagcaagtgggtgaagcactgggtaaaaggtggatattattattaccacaatctggagacccaggaaggaggatgggatgaacctccaaattttgtgcaaaattctatgcagctttctcgggaggagatccagagttctatctctggggtgactgccgcatataaccgagaacagctgtggctggccaatgaaggcctgatcaccaggctgcaggctcgctgccgtggatacttagttcgacaggaattccgatccaggatgaatttcctgaagaaacaaatccctgccatcacctgcattcagtcacagtggagaggatacaagcagaagaaggcatatcaagatcggttagcttacctgcgctcccacaaagatgaagttgtaaagattcagtccctggcaaggatgcaccaagctcgaaagcgctatcgagatcgcctgcagtacttccgggaccatataaatgacattatcaaaatccaggcttttattcgggcaaacaaagctcgggatgactacaagactctcatcaatgctgaggatcctcctatggttgtggtccgaaaatttgtccacctgctggaccaaagtgaccaggattttcaggaggagcttgaccttatgaagatgcgggaagaggttatcaccctcattcgttctaaccagcagctggagaatgacctcaatctcatggatatcaaaattggactgctagtgaaaaataagattacgttgcaggatgtggtttcccacagtaaaaaacttaccaaaaaaaataaggaacagttgtctgatatgatgatgataaataaacagaagggaggtctcaaggctttgagcaaggagaagagagagaagttggaagcttaccagcacctgttttatttattgcaaaccaatcccacctatctggccaagctcatttttcagatgccccagaacaagtccaccaagttcatggactctgtaatcttcacactctacaactacgcgtccaaccagcgagaggagtacctgctcctgcggctctttaagacagcactccaagaggaaatcaagtcgaaggtagatcagattcaagagattgtgacaggaaatcctacggttattaaaatggttgtaagtttcaaccgtggtgcccgtggccagaatgccctgagacagatcttggccccagtcgtgaaggaaattatggatgacaaatctctcaacatcaaaactgaccctgtggatatttacaaatcttgggttaatcagatggagtctcagacaggagaggcaagcaaactgccctatgatgtgacccctgagcaggcgctagctcatgaagaagtgaagacacggctagacagctccatcaggaacatgcgggctgtgacagacaagtttctctcagccattgtcagctctgtggacaaaatcccttatgggatgcgcttcattgccaaagtgctgaaggactcgttgcatgagaagttccctgatgctggtgaggatgagctgctgaagattattggtaacttgctttattatcgatacatgaatccagccattgttgctcctgatgcctttgacatcattgacctgtcagcaggaggccagcttaccacagaccaacgccgaaatctgggctccattgcaaaaatgcttcagcatgctgcttccaataagatgtttctgggagataatgcccacttaagcatcattaatgaatatctttcccagtcctaccagaaattcagacggtttttccaaactgcttgtgatgtcccagagcttcaggataaatttaatgtggatgagtactctgatttagtaaccctcaccaaaccagtaatctacatttccattggtgaaatcatcaacacccacactctcctgttggatcaccaggatgccattgctccggagcacaatgatccaatccacgaactgctggacgacctcggcgaggtgcccaccatcgagtccctgataggggaaagctctggcaatttaaatgacccaaataaggaggcactggctaagacggaagtgtctctcaccctgaccaacaagttcgacgtgcctggagatgagaatgcagaaatggatgctcgaaccatcttactgaatacaaaacgtttaattgtggatgtcatccggttccagccaggagagaccttgactgaaatcctagaaacaccagccaccagtgaacaggaagcagaacatcagagagccatgcagagacgtgctatccgtgatgccaaaacacctgacaagatgaaaaagtcaaaatctgtaaaggaagacagcaacctcactcttcaagagaagaaagagaagatccagacaggtttaaagaagctaacagagcttggaaccgtggacccaaagaacaaataccaggaactgatcaacgacattgccagggatattcggaatcagcggaggtaccgacagaggagaaaggccgaactagtgaaactgcaacagacatacgctgctctgaactctaaggccaccttttatggggagcaggtggattactataaaagctatatcaaaacctgcttggataacttagccagcaagggcaaagtctccaaaaagcctagggaaatgaaaggaaagaaaagcaaaaagatttctctgaaatatacagcagcaagactacatgaaaaaggagttcttctggaaattgaggacctgcaagtgaatcagtttaaaaatgttatatttgaaatcagtccaacagaagaagttggagacttcgaagtgaaagccaaattcatgggagttcaaatggagacttttatgttacattatcaggacctgctgcagctacagtatgaaggagttgcagtcatgaaattatttgatagagctaaagtaaatgtcaacctcctgatcttccttctcaacaaaaagttctacgggaagtaattgatcgtttgctgccagcccagaaggatgaaggaaagaagcacctcacagctcctttctaggtccttctttcctcattggaagcaaagacctagccaacaacagcacctcaatctgatacactcccgatgccacatttttaactcctctcgctctgatgggacatttgttacccttttttcatagtgaaattgtgtttcaggcttagtctgacctttctggtttcttcattttcttccattacttaggaaagagtggaaactccactaaaatttctctgtgttgttacagtcttagaggttgcagtactatattgtaagctttggtgtttgtttaattagcaatagggatggtaggattcaaatgtgtgtcatttagaagtggaagctattagcaccaatgacataaatacatacaagacacagaactaaaatgtcatgttattaacagttattaggttgtcatttaaaaataaagttcctttatatttctgtcccatcaggaaaactgaaggatatggggaatcattggttatcttccattgtgtttttctttatggacaggagctaatggaagtgacagtcatgttcaaaggaagcatttctagaaaaaaggagataatgtttttaaatttcattatcaaacttgggcaattctgtttgtgtaactccccgactagtggatgggagagtcccattgctaaaattcagctactcagataaattcagaatgggtcaaggcacctgcctgtttttgttggtgcacagagattgacttgattcagagagacaattcactccatccctatggcagaggaatgggttagccctaatgtagaatgtcattgtttttaaaactgttttatatcttaagagtgccttattaaagtatagatgtatgtcttaaaatgtgggtgataggaattttaaagatttatataatgcatcaaaagccttagaataagaaaagctttttttaaattgctttatctgtatatctgaactcttgaaacttatagctaaaacactaggatttatctgcagtgttgcagggagataattctgccttaaattgtctaaaacaaaaacaaaaccagccaacctatgttacacgtgagattaaaaccaattttttccccattttttctccttttttctcttgctgcccacattgtgcctttattttatgagccccagttttctgggcttagtttaaaaaaaaaatcaagtctaaacattgcatttagaaagcttttgttcttggataaaaagtcatacactttaaaaaaaaaaaaaactttttccaggaaaatatattgaaatcatgctgctgagcctctattttctttctttgatgttttgattcagtattcttttatcataaatttttagcatttaaaaattcactgatgtacattaagccaataaactgctttaatgaataacaaactatgtagtgtgtccctattataaatgcattggagaagtatttttatgagactctttactcaggtgcatggttacagcccacagggaggcatggagtgccatggaaggattcgccactacccagaccttgttttttgttgtattttggaagacaggttttttaaagaaacattttcctcagattaaaagatgatgctattacaactagcattgcctcaaaaactgggaccaaccaaagtgtgtcaaccctgtttccttaaaagaggctatgaatcccaaaggccacatccaagacaggcaataatgagcagagtttacagctcctttaataaaatgtgtcagtaattttaaggtttatagttccctcaacacaattgctaatgcagaatagtgtaaaatgcgcttcaagaatgttgatgatgatgatatagaattgtggctttagtagcacagaggatgccccaacaaactcatggcgttgaaaccacacagttctcattactgttatttattagctgtagcattctctgtctcctctctctcctcctttgaccttctcctcgaccagtcgaagtgtgcacacttcgatcgcggagaatcacagtggtgttcaagaaccttttgaggccatccaagtttttgtccttcagtaccttgaaatctgataatctcaacatccagaaatagcctttgatttgttctttctctgatgtcttgtgtccttgggatcaaagcctctttcactggcaccaaataatgcccagtgaggagttctggccatataa

SEQ ID NO: 342112 - DNA, 4662 bp, Homo sapiens
gggtcggaagtcgcaggcgatctcgatagcgctttcgagcttggtgcatcctgccaggaccatataaatgacattatcaaaatccaggcttttattcgggcaaacaaagctcgggatgactacaagactctcatcaatgctgaggatcctcctatggttgtggtccgaaaatttgtccacctgctggaccaaagtgaccaggattttcaggaggagcttgaccttatgaagatgcgggaagaggttatcaccctcattcgttctaaccagcagctggagaatgacctcaatctcatggatatcaaaattggactgctagtgaaaaataagattacgttgcaggatgtggtttcccacagtaaaaaacttaccaaaaaaaataaggaacagttgtctgatatgatgatgataaataaacagaagggaggtctcaaggctttgagcaaggagaagagagagaagttggaagcttaccagcacctgttttatttattgcaaaccaatcccacctatctggccaagctcatttttcagatgccccagaacaagtccaccaagttcatggactctgtaatcttcacactctacaactacgcgtccaaccagcgagaggagtacctgctcctgcggctctttaagacagcactccaagaggaaatcaagtcgaaggtagatcagattcaagagattgtgacaggaaatcctacggttattaaaatggttgtaagtttcaaccgtggtgcccgtggccagaatgccctgagacagatcttggccccagtcgtgaaggaaattatggatgacaaatctctcaacatcaaaactgaccctgtggatatttacaaatcttgggttaatcagatggagtctcagacaggagaggcaagcaaactgccctatgatgtgacccctgagcaggcgctagctcatgaagaagtgaagacacggctagacagctccatcaggaacatgcgggctgtgacagacaagtttctctcagccattgtcagctctgtggacaaaatcccttatgggatgcgcttcattgccaaagtgctgaaggactcgttgcatgagaagttccctgatgctggtgaggatgagctgctgaagattattggtaacttgctttattatcgatacatgaatccagccattgttgctcctgatgcctttgacatcattgacctgtcagcaggaggccagcttaccacagaccaacgccgaaatctgggctccattgcaaaaatgcttcagcatgctgcttccaataagatgtttctgggagataatgcccacttaagcatcattaatgaatatctttcccagtcctaccagaaattcagacggtttttccaaactgcttgtgatgtcccagagcttcaggataaatttaatgtggatgagtactctgatttagtaaccctcaccaaaccagtaatctacatttccattggtgaaatcatcaacacccacactctcctgttggatcaccaggatgccattgctccggagcacaatgatccaatccacgaactgctggacgacctcggcgaggtgcccaccatcgagtccctgataggggaaagctctggcaatttaaatgacccaaataaggaggcactggctaagacggaagtgtctctcaccctgaccaacaagttcgacgtgcctggagatgagaatgcagaaatggatgctcgaaccatcttactgaatacaaaacgtttaattgtggatgtcatccggttccagccaggagagaccttgactgaaatcctagaaacaccagccaccagtgaacaggaagcagaacatcagagagccatgcagagacgtgctatccgtgatgccaaaacacctgacaagatgaaaaagtcaaaatctgtaaaggaagacagcaacctcactcttcaagagaagaaagagaagatccagacaggtttaaagaagctaacagagcttggaaccgtggacccaaagaacaaataccaggaactgatcaacgacattgccagggatattcggaatcagcggaggtaccgacagaggagaaaggccgaactagtgaaactgcaacagacatacgctgctctgaactctaaggccaccttttatggggagcaggtggattactataaaagctatatcaaaacctgcttggataacttagccagcaagggcaaagtctccaaaaagcctagggaaatgaaaggaaagaaaagcaaaaagatttctctgaaatatacagcagcaagactacatgaaaaaggagttcttctggaaattgaggacctgcaagtgaatcagtttaaaaatgttatatttgaaatcagtccaacagaagaagttggagacttcgaagtgaaagccaaattcatgggagttcaaatggagacttttatgttacattatcaggacctgctgcagctacagtatgaaggagttgcagtcatgaaattatttgatagagctaaagtaaatgtcaacctcctgatcttccttctcaacaaaaagttctacgggaagtaattgatcgtttgctgccagcccagaaggatgaaggaaagaagcacctcacagctcctttctaggtccttctttcctcattggaagcaaagacctagccaacaacagcacctcaatctgatacactcccgatgccacatttttaactcctctcgctctgatgggacatttgttacccttttttcatagtgaaattgtgtttcaggcttagtctgacctttctggtttcttcattttcttccattacttaggaaagagtggaaactccactaaaatttctctgtgttgttacagtcttagaggttgcagtactatattgtaagctttggtgtttgtttaattagcaatagggatggtaggattcaaatgtgtgtcatttagaagtggaagctattagcaccaatgacataaatacatacaagacacagaactaaaatgtcatgttattaacagttattaggttgtcatttaaaaataaagttcctttatatttctgtcccatcaggaaaactgaaggatatggggaatcattggttatcttccattgtgtttttctttatggacaggagctaatggaagtgacagtcatgttcaaaggaagcatttctagaaaaaaggagataatgtttttaaatttcattatcaaacttgggcaattctgtttgtgtaactccccgactagtggatgggagagtcccattgctaaaattcagctactcagataaattcagaatgggtcaaggcacctgcctgtttttgttggtgcacagagattgacttgattcagagagacaattcactccatccctatggcagaggaatgggttagccctaatgtagaatgtcattgtttttaaaactgttttatatcttaagagtgccttattaaagtatagatgtatgtcttaaaatgtgggtgataggaattttaaagatttatataatgcatcaaaagccttagaataagaaaagctttttttaaattgctttatctgtatatctgaactcttgaaacttatagctaaaacactaggatttatctgcagtgttgcagggagataattctgccttaaattgtctaaaacaaaaacaaaaccagccaacctatgttacacgtgagattaaaaccaattttttccccattttttctccttttttctcttgctgcccacattgtgcctttattttatgagccccagttttctgggcttagtttaaaaaaaaaatcaagtctaaacattgcatttagaaagcttttgttcttggataaaaagtcatacactttaaaaaaaaaaaaaactttttccaggaaaatatattgaaatcatgctgctgagcctctattttctttctttgatgttttgattcagtattcttttatcataaatttttagcatttaaaaattcactgatgtacattaagccaataaactgctttaatgaataacaaactatgtagtgtgtccctattataaatgcattggagaagtatttttatgagactctttactcaggtgcatggttacagcccacagggaggcatggagtgccatggaaggattcgccactacccagaccttgttttttgttgtattttggaagacaggttttttaaagaaacattttcctcagattaaaagatgatgctattacaactagcattgcctcaaaaactgggaccaaccaaagtgtgtcaaccctgtttccttaaaagaggctatgaatcccaaaggccacatccaagacaggcaataatgagcagagtttacagctcctttaataaaatgtgtcagtaattttaaggtttatagttccctcaacacaattgctaatgcagaatagtgtaaaatgcgcttcaagaatgttgatgatgatgatatagaattgtggctttagtagcacagaggatgccccaacaaactcatggcgttgaaaccacacagttctcattactgttatttattagctgtagcattctctgtctcctctctctcctcctttgaccttctcctcgaccagccatcatgacatttaccatgaatttacttcctcccaagagtttggactgcccgtcagattgtttctgcacatagttgcctttgtatctctgtatgaaataaaaggtcatttgtt

SEQ ID NO: 342113 - DNA, 3595 bp, Homo sapiens
tctagaggatcccggaaagactcgtggtggtgatgagctgctgaagattattggtaacttgctttattatcgatacatgaatccagccattgttgctcctgatgcctttgacatcattgacctgtcagcaggaggccagcttaccacagaccaacgccgaaatctgggctccattgcaaaaatgcttcagcatgctgcttccaataagatgtttctgggagataatgcccacttaagcatcattaatgaatatctttcccagtcctaccagaaattcagacggtttttccaaactgcttgtgatgtcccagagcttcaggataaatttaatgtggatgagtactctgatttagtaaccctcaccaaaccagtaatctacatttccattggtgaaatcatcaacacccacactctcctgttggatcaccaggatgccattgctccggagcacaatgatccaatccacgaactgctggacgacctcggcgaggtgcccaccatcgagtccctgataggggaaagctctggcaatttaaatgacccaaataaggaggcactggctaagacggaagtgtctctcaccctgaccaacaagttcgacgtgcctggagatgagaatgcagaaatggatgctcgaaccatcttactgaatacaaaacgtttaattgtggatgtcatccggttccagccaggagagaccttgactgaaatcctagaaacaccagccaccagtgaacaggaagcagaacatcagagagccatgcagagacgtgctatccgtgatgccaaaacacctgacaagatgaaaaagtcaaaatctgtaaaggaagacagcaacctcactcttcaagagaagaaagagaagatccagacaggtttaaagaagctaacagagcttggaaccgtggacccaaagaacaaataccaggaactgatcaacgacattgccagggatattcggaatcagcggaggtaccgacagaggagaaaggccgaactagtgaaactgcaacagacatacgctgctctgaactctaaggccaccttttatggggagcaggtggattactataaaagctatatcaaaacctgcttggataacttagccagcaagggcaaagtctccaaaaagcctagggaaatgaaaggaaagaaaagcaaaaagatttctctgaaatatacagcagcaagactacatgaaaaaggagttcttctggaaattgaggacctgcaagtgaatcagtttaaaaatgttatatttgaaatcagtccaacagaagaagttggagacttcgaagtgaaagccaaattcatgggagttcaaatggagacttttatgttacattatcaggacctgctgcagctacagtatgaaggagttgcagtcatgaaattatttgatagagctaaagtaaatgtcaacctcctgatcttccttctcaacaaaaagttctacgggaagtaattgatcgtttgctgccagcccagaaggatgaaggaaagaagcacctcacagctcctttctaggtccttctttcctcattggaagcaaagacctagccaacaacagcacctcaatctgatacactcccgatgccacatttttaactcctctcgctctgatgggacatttgttacccttttttcatagtgaaattgtgtttcaggcttagtctgacctttctggtttcttcattttcttccattacttaggaaagagtggaaactccactaaaatttctctgtgttgttacagtcttagaggttgcagtactatattgtaagctttggtgtttgtttaattagcaatagggatggtaggattcaaatgtgtgtcatttagaagtggaagctattagcaccaatgacataaatacatacaagacacagaactaaaatgtcatgttattaacagttattaggttgtcatttaaaaataaagttcctttatatttctgtcccatcaggaaaactgaaggatatggggaatcattggttatcttccattgtgtttttctttatggacaggagctaatggaagtgacagtcatgttcaaaggaagcatttctagaaaaaaggagataatgtttttaaatttcattatcaaacttgggcaattctgtttgtgtaactccccgactagtggatgggagagtcccattgctaaaattcagctactcagataaattcagaatgggtcaaggcacctgcctgtttttgttggtgcacagagattgacttgattcagagagacaattcactccatccctatggcagaggaatgggttagccctaatgtagaatgtcattgtttttaaaactgttttatatcttaagagtgccttattaaagtatagatgtatgtcttaaaatgtgggtgataggaattttaaagatttatataatgcatcaaaagccttagaataagaaaagctttttttaaattgctttatctgtatatctgaactcttgaaacttatagctaaaacactaggatttatctgcagtgttgcagggagataattctgccttaaattgtctaaaacaaaaacaaaaccagccaacctatgttacacgtgagattaaaaccaattttttccccattttttctccttttttctcttgctgcccacattgtgcctttattttatgagccccagttttctgggcttagtttaaaaaaaaaatcaagtctaaacattgcatttagaaagcttttgttcttggataaaaagtcatacactttaaaaaaaaaaaaaactttttccaggaaaatatattgaaatcatgctgctgagcctctattttctttctttgatgttttgattcagtattcttttatcataaatttttagcatttaaaaattcactgatgtacattaagccaataaactgctttaatgaataacaaactatgtagtgtgtccctattataaatgcattggagaagtatttttatgagactctttactcaggtgcatggttacagcccacagggaggcatggagtgccatggaaggattcgccactacccagaccttgttttttgttgtattttggaagacaggttttttaaagaaacattttcctcagattaaaagatgatgctattacaactagcattgcctcaaaaactgggaccaaccaaagtgtgtcaaccctgtttccttaaaagaggctatgaatcccaaaggccacatccaagacaggcaataatgagcagagtttacagctcctttaataaaatgtgtcagtaattttaaggtttatagttccctcaacacaattgctaatgcagaatagtgtaaaatgcgcttcaagaatgttgatgatgatgatatagaattgtggctttagtagcacagaggatgccccaacaaactcatggcgttgaaaccacacagttctcattactgttatttattagctgtagcattctctgtctcctctctctcctcctttgaccttctcctcgaccagccatcatgacatttaccatgaatttacttcctcccaagagtttggactgcccgtcagattgtttctgcacatagttgcctttgtatctctgtatgaaataaaaggtcatttgtt

SEQ ID NO: 342114 - DNA, 3259 bp, Homo sapiens
atcagcaaaatattccttagcttctttagctgtgctagaacccaatcctttatagtactttattttccaggctttctggttttctatatggtggctccattcgacaaattcaggaatactgtagaaggagaagtatagaagatagaaaaatataaagccaaaaattggataaaatagcactgatgggagcaagatgcgcgcatcttgctcccatcaggcactggctaagacggaagtgtctctcaccctgaccaacaagttcgacgtgcctggagatgagaatgcagaaatggatgctcgaaccatcttactgaatacaaaacgtttaattgtggatgtcatccggttccagccaggagagaccttgactgaaatcctagaaacaccagccaccagtgaacaggaagcagaacatcagagagccatgcagagacgtgctatccgtgatgccaaaacacctgacaagatgaaaaagtcaaaatctgtaaaggaagacagcaacctcactcttcaagagaagaaagagaagatccagacaggtttaaagaagctaacagagcttggaaccgtggacccaaagaacaaataccaggaactgatcaacgacattgccagggatattcggaatcagcggaggtaccgacagaggagaaaggccgaactagtgaaactgcaacagacatacgctgctctgaactctaaggccaccttttatggggagcaggtggattactataaaagctatatcaaaacctgcttggataacttagccagcaagggcaaagtctccaaaaagcctagggaaatgaaaggaaagaaaagcaaaaagatttctctgaaatatacagcagcaagactacatgaaaaaggagttcttctggaaattgaggacctgcaagtgaatcagtttaaaaatgttatatttgaaatcagtccaacagaagaagttggagacttcgaagtgaaagccaaattcatgggagttcaaatggagacttttatgttacattatcaggacctgctgcagctacagtatgaaggagttgcagtcatgaaattatttgatagagctaaagtaaatgtcaacctcctgatcttccttctcaacaaaaagttctacgggaagtaattgatcgtttgctgccagcccagaaggatgaaggaaagaagcacctcacagctcctttctaggtccttctttcctcattggaagcaaagacctagccaacaacagcacctcaatctgatacactcccgatgccacatttttaactcctctcgctctgatgggacatttgttacccttttttcatagtgaaattgtgtttcaggcttagtctgacctttctggtttcttcattttcttccattacttaggaaagagtggaaactccactaaaatttctctgtgttgttacagtcttagaggttgcagtactatattgtaagctttggtgtttgtttaattagcaatagggatggtaggattcaaatgtgtgtcatttagaagtggaagctattagcaccaatgacataaatacatacaagacacagaactaaaatgtcatgttattaacagttattaggttgtcatttaaaaataaagttcctttatatttctgtcccatcaggaaaactgaaggatatggggaatcattggttatcttccattgtgtttttctttatggacaggagctaatggaagtgacagtcatgttcaaaggaagcatttctagaaaaaaggagataatgtttttaaatttcattatcaaacttgggcaattctgtttgtgtaactccccgactagtggatgggagagtcccattgctaaaattcagctactcagataaattcagaatgggtcaaggcacctgcctgtttttgttggtgcacagagattgacttgattcagagagacaattcactccatccctatggcagaggaatgggttagccctaatgtagaatgtcattgtttttaaaactgttttatatcttaagagtgccttattaaagtatagatgtatgtcttaaaatgtgggtgataggaattttaaagatttatataatgcatcaaaagccttagaataagaaaagctttttttaaattgctttatctgtatatctgaactcttgaaacttatagctaaaacactaggatttatctgcagtgttgcagggagataattctgccttaaattgtctaaaacaaaaacaaaaccagccaacctatgttacacgtgagattaaaaccaattttttccccattttttctccttttttctcttgctgcccacattgtgcctttattttatgagccccagttttctgggcttagtttaaaaaaaaaatcaagtctaaacattgcatttagaaagcttttgttcttggataaaaagtcatacactttaaaaaaaaaaaaaactttttccaggaaaatatattgaaatcatgctgctgagcctctattttctttctttgatgttttgattcagtattcttttatcataaatttttagcatttaaaaattcactgatgtacattaagccaataaactgctttaatgaataacaaactatgtagtgtgtccctattataaatgcattggagaagtatttttatgagactctttactcaggtgcatggttacagcccacagggaggcatggagtgccatggaaggattcgccactacccagaccttgttttttgttgtattttggaagacaggttttttaaagaaacattttcctcagattaaaagatgatgctattacaactagcattgcctcaaaaactgggaccaaccaaagtgtgtcaaccctgtttccttaaaagaggctatgaatcccaaaggccacatccaagacaggcaataatgagcagagtttacagctcctttaataaaatgtgtcagtaattttaaggtttatagttccctcaacacaattgctaatgcagaatagtgtaaaatgcgcttcaagaatgttgatgatgatgatatagaattgtggctttagtagcacagaggatgccccaacaaactcatggcgttgaaaccacacagttctcattactgttatttattagctgtagcattctctgtctcctctctctcctcctttgaccttctcctcgaccagccatcatgacatttaccatgaatttacttcctcccaagagtttggactgcccgtcagattgtttctgcacatagttgcctttgtatctctgtatgaaataaaaggtcatttgtt

SEQ ID NO: 342115 - DNA, 6192 bp, Homo sapiens
ggtattaaaactgatcttttgacatttttgacaatgttcttataaattactttcttttttatcatatatggatgggatgaagcacagagtaagatagagtgcacagcaaaggggatctgcccctcctatctgtccaataccccacaggttttggtgataatcttgggcaatgttccagtcaaacctgcctcccacttctcactaaagttagtgaacatgtgacccacattccccaaataagagcctcttataaactccattcttggctttttcattcatagagatagctattttatgagacatagataaagcattttttagtgatgtgcacgatgccttttttcttaattattaacttctcaaaacataaacacattggaggcacttaataaagggagctgtagctaccgccgtccgcgcctccaaggtttcacggcttcctcagcagagactcgggctcgtccgccatgtccgccgcagacgaggttgacgggctgggcgtggcccggccgcactatggctctgtcctggataatgaaagacttactgcagaggagatggatgaaaggagacgtcagaacgtggcttatgagtacctttgtcatttggaagaagcgaagaggtggatggaagcatgcctaggggaagatctgcctcccaccacagaactggaggaggggcttaggaatggggtctaccttgccaaactggggaacttcttctctcccaaagtagtgtccctgaaaaaaatctatgatcgagaacagaccagatacaaggcgactggcctccactttagacacactgataatgtgattcagtggttgaatgccatggatgagattggattgcctaagattttttacccagaaactacagatatctatgatcgaaagaacatgccaagatgtatctactgtatccatgcactcagtttgtacctgttcaagctaggcctggcccctcagattcaagacctatatggaaaggttgacttcacagaagaagaaatcaacaacatgaagactgagttggagaagtatggcatccagatgcctgcctttagcaagattgggggcatcttggctaatgaactgtcagtggatgaagccgcattacatgctgctgttattgctattaatgaagctattgaccgtagaattccagccgacacatttgcagctttgaaaaatccgaatgccatgcttgtaaatcttgaagagcccttggcatccacttaccaggatatactttaccaggctaagcaggacaaaatgacaaatgctaaaaacaggacagaaaactcagagagagaaagagatgtttatgaggagctgctcacgcaagctgaaattcaaggcaatataaacaaagtcaatacattttctgcattagcaaatatcgacctggctttagaacaaggagatgcactggccttgttcagggctctgcagtcaccagccctggggcttcgaggactgcagcaacagaatagcgactggtacttgaagcagctcctgagtgataaacagcagaagagacagagtggtcagactgaccccctgcagaaggaggagctgcagtctggagtggatgctgcaaacagtgctgcccagcaatatcagagaagattggcagcagtagcactgattaatgctgcaatccagaagggtgttgctgagaagactgttttggaactgatgaatcccgaagcccagctgccccaggtgtatccatttgccgccgatctctatcagaaggagctggctaccctgcagcgacaaagtcctgaacataatctcacccacccagagctctctgtcgcagtggagatgttgtcatcggtggccctgatcaacagggcattggaatcaggagatgtgaatacagtgtggaagcaattgagcagttcagttactggtcttaccaatattgaggaagaaaactgtcagaggtatctcgatgagttgatgaaactgaaggctcaggcacatgcagagaataatgaattcattacatggaatgatatccaagcttgcgtggaccatgtgaacctggtggtgcaagaggaacatgagaggattttagccattggtttaattaatgaagccctggatgaaggtgatgcccaaaagactctgcaggccctacagattcctgcagctaaacttgagggagtccttgcagaagtggcccagcattaccaagacacgctgattagagcgaagagagagaaagcccaggaaatccaggatgagtcagctgtgttatggttggatgaaattcaaggtggaatctggcagtccaacaaagacacccaagaagcacagaagtttgccttaggaatctttgccattaatgaggcagtagaaagtggtgatgttggcaaaacactgagtgcccttcgctcccctgatgttggcttgtatggagtcatccctgagtgtggtgaaacttaccacagtgatcttgctgaagccaagaagaaaaaactggcagtaggagataataacagcaagtgggtgaagcactgggtaaaaggtggatattattattaccacaatctggagacccaggaaggaggatgggatgaacctccaaattttgtgcaaaattctatgcagctttctcgggaggagatccagagttctatctctggggtgactgccgcatataaccgagaacagctgtggctggccaatgaaggcctgatcaccaggctgcaggctcgctgccgtggatacttagttcgacaggaattccgatccaggatgaatttcctgaagaaacaaatccctgccatcacctgcattcagtcacagtggagaggatacaagcagaagaaggcatatcaagatcggttagcttacctgcgctcccacaaagatgaagttgtaaagattcagtccctggcaaggatgcaccaagctcgaaagcgctatcgagatcgcctgcagtacttccgggaccatataaatgacattatcaaaatccaggcttttattcgggcaaacaaagctcgggatgactacaagactctcatcaatgctgaggatcctcctatggttgtggtccgaaaatttgtccacctgctggaccaaagtgaccaggattttcaggaggagcttgaccttatgaagatgcgggaagaggttatcaccctcattcgttctaaccagcagctggagaatgacctcaatctcatggatatcaaaattggactgctagtgaaaaataagattacgttgcaggatgtggtttcccacagtaaaaaacttaccaaaaaaaataaggaacagttgtctgatatgatgatgataaataaacagaagggaggtctcaaggctttgagcaaggagaagagagagaagttggaagcttaccagcacctgttttatttattgcaaaccaatcccacctatctggccaagctcatttttcagatgccccagaacaagtccaccaagttcatggactctgtaatcttcacactctacaactacgcgtccaaccagcgagaggagtacctgctcctgcggctctttaagacagcactccaagaggaaatcaagtcgaaggtagatcagattcaagagattgtgacaggaaatcctacggttattaaaatggttgtaagtttcaaccgtggtgcccgtggccagaatgccctgagacagatcttggccccagtcgtgaaggaaattatggatgacaaatctctcaacatcaaaactgaccctgtggatatttacaaatcttgggttaatcagatggagtctcagacaggagaggcaagcaaactgccctatgatgtgacccctgagcaggcgctagctcatgaagaagtgaagacacggctagacagctccatcaggaacatgcgggctgtgacagacaagtttctctcagccattgtcagctctgtggacaaaatcccttatgggatgcgcttcattgccaaagtgctgaaggactcgttgcatgagaagttccctgatgctggtgaggatgagctgctgaagattattggtaacttgctttattatcgatacatgaatccagccattgttgctcctgatgcctttgacatcattgacctgtcagcaggaggccagcttaccacagaccaacgccgaaatctgggctccattgcaaaaatgcttcagcatgctgcttccaataagatgtttctgggagataatgcccacttaagcatcattaatgaatatctttcccagtcctaccagaaattcagacggtttttccaaactgcttgtgatgtcccagagcttcaggataaatttaatgtggatgagtactctgatttagtaaccctcaccaaaccagtaatctacatttccattggtgaaatcatcaacacccacactctcctgttggatcaccaggatgccattgctccggagcacaatgatccaatccacgaactgctggacgacctcggcgaggtgcccaccatcgagtccctgataggggaaagctctggcaatttaaatgacccaaataaggaggcactggctaagacggaagtgtctctcaccctgaccaacaagttcgacgtgcctggagatgagaatgcagaaatggatgctcgaaccatcttactgaatacaaaacgtttaattgtggatgtcatccggttccagccaggagagaccttgactgaaatcctagaaacaccagccaccagtgaacaggaagcagaacatcagagagccatgcagagacgtgctatccgtgatgccaaaacacctgacaagatgaaaaagtcaaaatctgtaaaggaagacagcaacctcactcttcaagagaagaaagagaagatccagacaggtttaaagaagctaacagagcttggaaccgtggacccaaagaacaaataccaggaactgatcaacgacattgccagggatattcggaatcagcggaggtaccgacagaggagaaaggccgaactagtgaaactgcaacagacatacgctgctctgaactctaaggccaccttttatggggagcaggtggattactataaaagctatatcaaaacctgcttggataacttagccagcaagggcaaagtctccaaaaagcctagggaaatgaaaggaaagaaaagcaaaaagatttctctgaaatatacagcagcaagactacatgaaaaaggagttcttctggaaattgaggacctgcaagtgaatcagtttaaaaatgttatatttgaaatcagtccaacagaagaagttggagacttcgaagtgaaagccaaattcatgggagttcaaatggagacttttatgttacattatcaggacctgctgcagctacagtatgaaggagttgcagtcatgaaattatttgatagagctaaagtaaatgtcaacctcctgatcttccttctcaacaaaaagttctacgggaagtaattgatcgtttgctgccagcccagaaggatgaaggaaagaagcacctcacagctcctttctaggtccttctttcctcattggaagcaaagacctagccaacaacagcacctcaatctgatacactcccgatgccacatttttaactcctctcgctctgatgggacatttgttacccttttttcatagtgaaattgtgtttcaggcttagtctgacctttctggtttcttcattttcttccattacttaggaaagagtggaaactccactaaaatttctctgtgttgttacagtcttagaggttgcagtactatattgtaagctttggtgtttgtttaattagcaatagggatggtaggattcaaatgtgtgtcatttagaagtggaagctattagcaccaatgacataaatacatacaagacacagaactaaaatgtcatgttattaacagttattaggttgtcatttaaaaataaagttcctttatatttctgtcccatcaggaaaactgaaggatatggggaatcattggttatcttccattgtgtttttctttatggacaggagctaatggaagtgacagtcatgttcaaaggaagcatttctagaaaaaaggagataatgtttttaaatttcattatcaaacttgggcaattctgtttgtgtaactccccgactagtggatgggagagtcccatagggttttttcagtacgacagtgcaatacacagtgagtgatcgagctcgcatga

SEQ ID NO: 342116 - DNA, 4383 bp, Homo sapiens
ggtattaaaactgatcttttgacatttttgacaatgttcttataaattactttcttttttatcatatatggatgggatgaagcacagagtaagatagagtgcacagcaaaggggatctgcccctcctatctgtccaataccccacaggttttggtgataatcttgggcaatgttccagtcaaacctgcctcccacttctcactaaagttagtgaacatgtgacccacattccccaaataagagcctcttataaactccattcttggctttttcattcatagagatagctattttatgagacatagataaagcattttttagtgatgtgcacgatgccttttttcttaattattaacttctcaaaacataaacacattggaggcacttaataaagggagctgtagctaccgccgtccgcgcctccaaggtttcacggcttcctcagcagagactcgggctcgtccgccatgtccgccgcagacgaggttgacgggctgggcgtggcccggccgcactatggctctgtcctggataatgaaagacttactgcagaggagatggatgaaaggagacgtcagaacgtggcttatgagtacctttgtcatttggaagaagcgaagaggtggatggaagcatgcctaggggaagatctgcctcccaccacagaactggaggaggggcttaggaatggggtctaccttgccaaactggggaacttcttctctcccaaagtagtgtccctgaaaaaaatctatgatcgagaacagaccagatacaaggcgactggcctccactttagacacactgataatgtgattcagtggttgaatgccatggatgagattggattgcctaagattttttacccagaaactacagatatctatgatcgaaagaacatgccaagatgtatctactgtatccatgcactcagtttgtacctgttcaagctaggcctggcccctcagattcaagacctatatggaaaggttgacttcacagaagaagaaatcaacaacatgaagactgagttggagaagtatggcatccagatgcctgcctttagcaagattgggggcatcttggctaatgaactgtcagtggatgaagccgcattacatgctgctgttattgctattaatgaagctattgaccgtagaattccagccgacacatttgcagctttgaaaaatccgaatgccatgcttgtaaatcttgaagagcccttggcatccacttaccaggatatactttaccaggctaagcaggacaaaatgacaaatgctaaaaacaggacagaaaactcagagagagaaagagatgtttatgaggagctgctcacgcaagctgaaattcaaggcaatataaacaaagtcaatacattttctgcattagcaaatatcgacctggctttagaacaaggagatgcactggccttgttcagggctctgcagtcaccagccctggggcttcgaggactgcagcaacagaatagcgactggtacttgaagcagctcctgagtgataaacagcagaagagacagagtggtcagactgaccccctgcagaaggaggagctgcagtctggagtggatgctgcaaacagtgctgcccagcaatatcagagaagattggcagcagtagcactgattaatgctgcaatccagaagggtgttgctgagaagactgttttggaactgatgaatcccgaagcccagctgccccaggtgtatccatttgccgccgatctctatcagaaggagctggctaccctgcagcgacaaagtcctgaacataatctcacccacccagagctctctgtcgcagtggagatgttgtcatcggtggccctgatcaacagggcattggaatcaggagatgtgaatacagtgtggaagcaattgagcagttcagttactggtcttaccaatattgaggaagaaaactgtcagaggtatctcgatgagttgatgaaactgaaggctcaggcacatgcagagaataatgaattcattacatggaatgatatccaagcttgcgtggaccatgtgaacctggtggtgcaagaggaacatgagaggattttagccattggtttaattaatgaagccctggatgaaggtgatgcccaaaagactctgcaggccctacagattcctgcagctaaacttgagggagtccttgcagaagtggcccagcattaccaagacacgctgattagagcgaagagagagaaagcccaggaaatccaggatgagtcagctgtgttatggttggatgaaattcaaggtggaatctggcagtccaacaaagacacccaagaagcacagaagtttgccttaggaatctttgccattaatgaggcagtagaaagtggtgatgttggcaaaacactgagtgcccttcgctcccctgatgttggcttgtatggagtcatccctgagtgtggtgaaacttaccacagtgatcttgctgaagccaagaagaaaaaactggcagtaggagataataacagcaagtgggtgaagcactgggtaaaaggtggatattattattaccacaatctggagacccaggaaggaggatgggatgaacctccaaattttgtgcaaaattctatgcagctttctcgggaggagatccagagttctatctctggggtgactgccgcatataaccgagaacagctgtggctggccaatgaaggcctgatcaccaggctgcaggctcgctgccgtggatacttagttcgacaggaattccgatccaggatgaatttcctgaagaaacaaatccctgccatcacctgcattcagtcacagtggagaggatacaagcagaagaaggcatatcaagatcggttagcttacctgcgctcccacaaagatgaagttgtaaagattcagtccctggcaaggatgcaccaagctcgaaagcgctatcgagatcgcctgcagtacttccgggaccatataaatgacattatcaaaatccaggcttttattcgggcaaacaaagctcgggatgactacaagactctcatcaatgctgaggatcctcctatggttgtggtccgaaaatttgtccacctgctggaccaaagtgaccaggattttcaggaggagcttgaccttatgaagatgcgggaagaggttatcaccctcattcgttctaaccagcagctggagaatgacctcaatctcatggatatcaaaattggactgctagtgaaaaataagattacgttgcaggatgtggtttcccacagtaaaaaacttaccaaaaaaaataaggaacagttgtctgatatgatgatgataaataaacagaagggaggtctcaaggctttgagcaaggagaagagagagaagttggaagcttaccagcacctgttttatttattgcaaaccaatcccacctatctggccaagctcatttttcagatgccccagaacaagtccaccaagttcatggactctgtaatcttcacactctacaactacgcgtccaaccagcgagaggagtacctgctcctgcggctctttaagacagcactccaagaggaaatcaagtcgaaggtagatcagattcaagagattgtgacaggaaatcctacggttattaaaatggttgtaagtttcaaccgtggtgcccgtggccagaatgccctgagacagatcttggccccagtcgtgaaggaaattatggatgacaaatctctcaacatcaaaactgaccctgtggatatttacaaatcttgggttaatcagatggagtctcagacaggagaggcaagcaaactgccctatgatgtgacccctgagcaggcgctagctcatgaagaagtgaagacacggctagacagctccatcaggaacatgcgggctgtgacagacaagtttctctcagccattgtcagctctgtggacaaaatcccttatgggatgcgcttcattgccaaagtgctgaaggactcgttgcatgagaagttccctgatgctggtgaggatgagctgctgaagattattggtaacttgctttattatcgatacatgaatccagccattgttgctcctgatgcctttgacatcattgacctgtcagcaggaggccagcttaccacagaccaacgccgaaatctgggctccattgcaaaaatgcttcagcatgctgcttccaataagatgtttctgggagataatgcccacttaagcatcattaatgaatatctttcccagtcctaccagaaattcagacggtttttccaaactgcttgtgatgtcccagagcttcaggataaatttaatgtggatgagtactctgatttagtaaccctcaccaaacctgacccaggcaaatagtattcctacccggtgccggctc

SEQ ID NO: 342117 - DNA, 3282 bp, Homo sapiens
ggtattaaaactgatcttttgacatttttgacaatgttcttataaattactttcttttttatcatatatggatgggatgaagcacagagtaagatagagtgcacagcaaaggggatctgcccctcctatctgtccaataccccacaggttttggtgataatcttgggcaatgttccagtcaaacctgcctcccacttctcactaaagttagtgaacatgtgacccacattccccaaataagagcctcttataaactccattcttggctttttcattcatagagatagctattttatgagacatagataaagcattttttagtgatgtgcacgatgccttttttcttaattattaacttctcaaaacataaacacattggaggcacttaataaagggagctgtagctaccgccgtccgcgcctccaaggtttcacggcttcctcagcagagactcgggctcgtccgccatgtccgccgcagacgaggttgacgggctgggcgtggcccggccgcactatggctctgtcctggataatgaaagacttactgcagaggagatggatgaaaggagacgtcagaacgtggcttatgagtacctttgtcatttggaagaagcgaagaggtggatggaagcatgcctaggggaagatctgcctcccaccacagaactggaggaggggcttaggaatggggtctaccttgccaaactggggaacttcttctctcccaaagtagtgtccctgaaaaaaatctatgatcgagaacagaccagatacaaggcgactggcctccactttagacacactgataatgtgattcagtggttgaatgccatggatgagattggattgcctaagattttttacccagaaactacagatatctatgatcgaaagaacatgccaagatgtatctactgtatccatgcactcagtttgtacctgttcaagctaggcctggcccctcagattcaagacctatatggaaaggttgacttcacagaagaagaaatcaacaacatgaagactgagttggagaagtatggcatccagatgcctgcctttagcaagattgggggcatcttggctaatgaactgtcagtggatgaagccgcattacatgctgctgttattgctattaatgaagctattgaccgtagaattccagccgacacatttgcagctttgaaaaatccgaatgccatgcttgtaaatcttgaagagcccttggcatccacttaccaggatatactttaccaggctaagcaggacaaaatgacaaatgctaaaaacaggacagaaaactcagagagagaaagagatgtttatgaggagctgctcacgcaagctgaaattcaaggcaatataaacaaagtcaatacattttctgcattagcaaatatcgacctggctttagaacaaggagatgcactggccttgttcagggctctgcagtcaccagccctggggcttcgaggactgcagcaacagaatagcgactggtacttgaagcagctcctgagtgataaacagcagaagagacagagtggtcagactgaccccctgcagaaggaggagctgcagtctggagtggatgctgcaaacagtgctgcccagcaatatcagagaagattggcagcagtagcactgattaatgctgcaatccagaagggtgttgctgagaagactgttttggaactgatgaatcccgaagcccagctgccccaggtgtatccatttgccgccgatctctatcagaaggagctggctaccctgcagcgacaaagtcctgaacataatctcacccacccagagctctctgtcgcagtggagatgttgtcatcggtggccctgatcaacagggcattggaatcaggagatgtgaatacagtgtggaagcaattgagcagttcagttactggtcttaccaatattgaggaagaaaactgtcagaggtatctcgatgagttgatgaaactgaaggctcaggcacatgcagagaataatgaattcattacatggaatgatatccaagcttgcgtggaccatgtgaacctggtggtgcaagaggaacatgagaggattttagccattggtttaattaatgaagccctggatgaaggtgatgcccaaaagactctgcaggccctacagattcctgcagctaaacttgagggagtccttgcagaagtggcccagcattaccaagacacgctgattagagcgaagagagagaaagcccaggaaatccaggatgagtcagctgtgttatggttggatgaaattcaaggtggaatctggcagtccaacaaagacacccaagaagcacagaagtttgccttaggaatctttgccattaatgaggcagtagaaagtggtgatgttggcaaaacactgagtgcccttcgctcccctgatgttggcttgtatggagtcatccctgagtgtggtgaaacttaccacagtgatcttgctgaagccaagaagaaaaaactggcagtaggagataataacagcaagtgggtgaagcactgggtaaaaggtggatattattattaccacaatctggagacccaggaaggaggatgggatgaacctccaaattttgtgcaaaattctatgcagctttctcgggaggagatccagagttctatctctggggtgactgccgcatataaccgagaacagctgtggctggccaatgaaggcctgatcaccaggctgcaggctcgctgccgtggatacttagttcgacaggaattccgatccaggatgaatttcctgaagaaacaaatccctgccatcacctgcattcagtcacagtggagaggatacaagcagaagaaggcatatcaagatcggttagcttacctgcgctcccacaaagatgaagttgtaaagattcagtccctggcaaggatgcaccaagctcgaaagcgctatcgagatcgcctgcagtacttccgggaccatataaatgacattatcaaaatccaggcttttattcgggcaaacaaagctcgggatgactacaagactctcatcaatgctgaggatcctcctatggttgtggtccgaaaatttgtccacctgctggaccaaagtgaccaggattttcaggaggagcttgaccttatgaagatgcgggaagaggttatcaccctcattcgttctaaccagcagctggagaatgacctcaatctcatggatatcaaaattggactgctagtgaaaaataagattacgttgcaggatgtggtttcccacagtaaaaaacttacca

SEQ ID NO: 342118 - DNA, 1047 bp, Homo sapiens
ggtattaaaactgatcttttgacatttttgacaatgttcttataaattactttcttttttatcatatatggatgggatgaagcacagagtaagatagagtgcacagcaaaggggatctgcccctcctatctgtccaataccccacaggttttggtgataatcttgggcaatgttccagtcaaacctgcctcccacttctcactaaagttagtgaacatgtgacccacattccccaaataagagcctcttataaactccattcttggctttttcattcatagagatagctattttatgagacatagataaagcattttttagtgatgtgcacgatgccttttttcttaattattaacttctcaaaacataaacacattggaggcacttaataaagggagctgtagctaccgccgtccgcgcctccaaggtttcacggcttcctcagcagagactcgggctcgtccgccatgtccgccgcagacgaggttgacgggctgggcgtggcccggccgcactatggctctgtcctggataatgaaagacttactgcagaggagatggatgaaaggagacgtcagaacgtggcttatgagtacctttgtcatttggaagaagcgaagaggtggatggaagcatgcctaggggaagatctgcctcccaccacagaactggaggaggggcttaggaatggggtctaccttgccaaactggggaacttcttctctcccaaagtagtgtccctgaaaaaaatctatgatcgagaacagaccagatacaaggcgactggcctccactttagacacactgataatgtgattcagtggttgaatgccatggatgagattggattgcctaaggtaacttacctgagataatagtttaggctttgttccagctgttgtggcataaccctcaaacaacctgttctcattctacctgtaaaattattctcagaatctttggtgtttttttaaatactaaaagatgtctttctttttgacttaggaaatagttttgttctttttcttttataatcctcatacctgt

SEQ ID NO: 342119 - DNA, 832 bp, Homo sapiens
tgtagtggctcatatctgtaatctcagtactttgggagatgaaggtgagaggattgcttgaggccaggagttcaggaccaacatgggcaataccacaagaccccatctctacaaaaaaccttaaaaattagcttggcgtggtgtgcacctgtactatctactcaagaggctgtggagacagcatcacttgagtccgggagtttgaggctgcagtgagccatgaccatatcactatattccagtccaggtaacagtgacaatctgtctcttaaaaaataaaataaattgaaaaagaaaagggacattaagaagagcaggaggtgaaatagagggagagagagggccaggagagggaggaagaggaggaagaagaggagaaagaggagaagaaagaaaacctaaattcgaggaaactccagaattacctaaaactgaataatgtgctaagctatcacagaaactattttggcataattctgaatgaacctacataaggaataaagaaattgcaaaacaaattctcaatgcattaaataaattagctggtctaaacagcaaacagatgtgaaacctggaaactactattaaacattaaagaatgcagtagtctcgatgctgctcacccccagagccagcagccattgcatgcagttctttgccactttcagcttccactaagtttcaccatctaggttatcagttctaataaacatgaaccttggaagtagggaacaaaaatttaccactcttgaattgtgttagagaaggtttttcctgagctacaggtgctattaaagcataattccaaggcacagtgggacaaagaaataac

SEQ ID NO: 342120 - DNA, 406 bp, Homo sapiens
ccccactcccagcattacaggagatacattttaagattgtgagctcggtgggctatgactcgtctagtcatcctggtctctaactctgacccccaaacagcccttgacccacaccgtttgcgttcagtgaacgcgacagatttcctgccccctccgtaaccagatccccaccccaccccgcggcctccgcgttccacaatcaggacgcatttgttaaaaaatgtgccggataattaaaaaaaaaaaaaagaaagaaaaaagaaaggaaaagaaagaaacgtgccggagaggcgcggaacgggcgagggccaggaggccccagcaaagcctgcagaggtttatcccgcccgttacgaggcccaaggccatcgcccggtgaagcggggtgggccctgggcgcggccgc

SEQ ID NO: 342121 - DNA, 1439 bp, Homo sapiens
cagatgcaaggtgggcgtttggttaacgtgatggggacgtggggacacagtccaaagagctggctgcctggcgtccacgcagagttggaagccctatgccactgggtagacgcgggtgaaagggaagccggatcgtgatggtgggcaaaccaggatccgggaagtgttggggtgcgcggatgagggggcgcgacggccagggtggccagaagagtaggtttgggagctgcccagcccggcctctaaccctgctctcttgcagaccgtacgcgtccagggcaatgacatctcacaccggcttcggctgtctgccgtgcggctgcaggacgagggcgtgtacgagtgccgcgtgtcggactacagcgacgacgacacgcaggagcacaaggcccaggcgatgctgcgcgtgctctcgcgcttcgcgccgcccaacatgcaggccgccgaggccgtgtcccacatccagagcagcggcccgcgtcgccacggcccagccagcgccgccaacgccaacaacgcgggcgccgcgagccgtaccacctccgagcccggccgcggcgacaagagcccgccgcccgggagccctcccgccgccatcgatcccgcagtccccgaggccgcggcagcctcggcggcccacacgcccaccaccacagtcgcggcagctgctgctgcctcgtcagcgtcgccgccatcgggacaggcggtcctgctgcgccagaggcacggctcgggcaccggccgtagctacaccacagacccactcttgtccctgctcctgttagctctgcataagttcctgcgcctgctcttgggacattgacagacaagaccaacccgagcatctcagaggccgcacatgacctgcccggggccctcggtgaggaccatgtcgctggatggacacagagagactgagagacgcatgaaaaagtccacatggaacaatcaataaatcatatttttgggaaagttacacaaatgtagaacacctaaaataatgcatctagtttccaaataatttggagtttggcccatgcagtctgcatgggaatcaatgatttctctacttcaatgtagttttcttttctacactttccctccaagtcttcattttgcacgaactgttgagcagttatctttaggataatatgtacaaatgttggggtcaaagccttttgacaaagcaaaatatttttagtagattattgtgtttaggatttttttttaatttactttttttctttgggggcttttcttttttattaaattatttcttttgaggcattttgattaaaaaagacacatcttatcataattaaaattcactgtcaataatatttatttttaaataaagattggaaacaaggtcagacacttgtttataaactgtattgtatattgctgaagaacagttgaataaaaaacaactttgaaat

SEQ ID NO: 342122 - DNA, 698 bp, Homo sapiens
gaatgcctatcctgccagatcatcaagaaattcaatctcagcctttctcagagctctctgaccaaggtgaagcaaaggtcctgtgtcttacacagtgctcaagcaccagggaggcccccccagcagacatcagcatcagcccactgtggtcactatggtgatgcccacttgccatcctggcccatatggttcccttaccatgcttggagcagagtcttggtgaggctgggaacctaggagcccagcctccctaagtcagcctgcatcctgccacttggaggtgaattgcttccgtgggccctatctcagagggtacgtggctcctcgctgctcatggaacccacagactgctctgtctctgccccatcctcttttccaggctttattttagggaagatggtattcttttcctctcatcctcagagcctcccccctctactcacacccaccacaacacccagcagaatcttctcaagggactcaagctctggagacaaaagacaggaagggaaatcttgcaatccattactgttttctgccatgccacaaacatcccctgaggacaggaaacctagagcctgctccctgctggaatgaaagaagaaagaagaaagggaaaaaaagtccaagggaacacacacatgaattaatatttgaatgaatcgtcctgctgggacaggccagccttgagccagcca

SEQ ID NO: 342123 - DNA, 389 bp, Homo sapiens
gtttggctgaatgcaatccccacagaagccttcagtatggagccagttcttaaaaccagttgttgcctatttgattgattcattgattgcaccagtcactgacctgtgcatggcagtgggggagttgctctttggcagtcaagggaaataataataggaaagctgccaagataaggcatctggcagaacttgttgaaactctatttctagaacttggaatgcacgctgacctcaaaggcaccaattcctcttcgtgcccttaagtggaattgtttgtaatctttgacccagtatgacctatgcaggtactacactccggcatattccagatatttgctttccacatgtggagacttcatttccacctccacctccctcccctccccatg

SEQ ID NO: 342124 - DNA, 3171 bp, Homo sapiens
ggccccggggcctccatgatggaggagcgagcggccgccgcggtcgccgccgccgcctcctcctgccgtccgctcggctcaggcgcgggccctggccccactggggcggccccggtctccgcccctgcccccgggccgggcccggcaggtaagggaggcggcggcggaggcagccccgggcccacggcgggcccggagcccctgagcctgccggggatcctgcactttatccagcacgagtgggcgcgcttcgaagccgagaaagcccgctgggaggccgagcgcgccgagttacaggctcaggtggccttccttcagggagagaggaaagggcaggagaatctaaagacggacctggtgcggcggatcaagatgctagagtatgcgctgaagcaggaaagggccaaatatcataaactgaagtttgggacagacctgaaccagggggagaagaaagcagatgtgtcagaacaagtctccaatggccccgtggaatcggtcaccctggagaacagcccgttggtgtggaaggaggggcggcagcttctccgacagtacctggaagaggtgggctacacagacaccatcctcgacatgcggtccaagcgcgtccgttccctgctgggccgctcgctggagctcaacggggcagtggagccgagtgaaggggcccccagggctccaccaggccctgcagggctcagtggtggggagtcgctgctggtgaaacagatcgaggagcagataaagaggaacgcggcaggcaaagatggcaaagagcgcttgggcggctcagtgctggggcagatccccttcctgcagaactgcgaggacgaagacagcgacgaggacgatgagctggacagcgtgcagcacaagaagcagcgtgtgaagctcccatccaaggctctggtgcccgaaatggaagacgaggatgaggaagacgactctgaggatgctatcaatgagtttgatttcctgggctcaggagaggatggggaaggggctccagaccctcggcggtgcactgtggatgggagcccccatgagctggaaagccgtcgggtcaaactccaaggcattctggctgacctgcgggatgtggatgggctgcccccaaaagtgactggcccgcctcctggcacaccccagccccggccacatgaagacgtcttcatcatggacactatcgggggcggggaggtgagcctgggggacttggcagatctcaccgtcaccaacgacaacgacctcagctgcgatctgtctgacagcaaagatgcttttaagaagacgtggaaccccaagttcaccctgcgctcgcactacgacggcattcgttccctggccttccaccacagccagtcggctctgctcaccgcctccgaggacggcacgctcaagctctggaacctgcagaaggcggtcacggccaagaagaatgcggcgctagatgtggaacctatacatgctttccgggctcacaggggcccagtgttggctgtggctatgggcagcaacagtgaatactgctacagtggcggggcagatgcctgcatccatagttggaagattccagacctcagcatggatccctatgatggctacgacccaagcgtgctgagccacgtcctggagggccacggggacgccgtgtggggcctggccttcagtcccacctcccagcgcctggcctcctgttctgctgatggcaccgtccgcatctgggaccccagcagcagcagcccggcctgcctctgcaccttccccacagccagcgagcacggggtccccacctcagtggccttcaccagcaccgagcctgcccacatcgtggcctccttccgctctggcgacaccgtcttgtatgacatggaggttggcagtgccctcctcacgctggagtcccggggcagcagcggtccaacccagatcaaccaagtggtgagtcatccaaaccagcctctcaccatcaccgcccacgacgacaggggcatccgcttcctggacaatcggacaggtaagccggtgcactccatggttgcacacctggacgcagtcacctgcctagccgtggaccccaacggcgcattcctgatgtcaggaagccatgactgctccctgcgtctctggagcctggacaacaaaacgtgcgtgcaggagatcacggcccaccgcaagaagcacgaggaggccatccacgctgttgcctgccaccccagcaaggccctcattgccagtgctggcgctgatgccctggccaaggtcttcgtatgatgcccacctggccctgccctggccgccacgctggctggggtgtagggccgggcaggtggggctgaggggactcccagcctcgctggaggtgcagaggcctggcctctgtctgtttgccgtggagcctggtggtgctaacggccctttccccaggaatccctccccaacggctgccttccccaagcatccagcctggggatgggcccctttcaggaatcacccccgaggatggcctcggggtttccccctgtgccctgacagccgctcctggtatcagagctgctttccagagggcagcacagccagggccgggtgtctttagggatcagtttttccaagactccagaaggtgccaggttctccccttgagctcctgctcccccatcccccatcctcccagacctgggcaggagctgtgctgggagaaagggtggcagccgggagcctcagagctgagccccggcctggctgcccctcccctccggccctctccactgctttccagacactaaccaaggcttccaggccagggattgcccaacactcctagggcagccctcccagcgccccatggggtcgcccatgggtagagacggctttcttgtgcccctccctggggcatggagggtggagtgggcctcgggtccccctgaactccctgtatatctgtataaataacgggattttcatggcgccgccccacccgcattatcactgtgtgatggtctcagtcagtctcctccctgtctccactctttccctctatttatttcactctcttgtttggttctaccctgcaccctcggtccccttccaggttcctgtttataagccccaacccctctgtccccatcttgtatgtgaaaacttgtctcaataaaccctttggagtaa

SEQ ID NO: 342125 - DNA, 201 bp, Homo sapiens
ctgggggaggctggtctgggcgggaatgaccgtggtgaccatagggggcagcacagtccgctggggccctcctctgggtcactggagctgcatcgtctcattcggcctctaagcagcctgtgcggttggtactttgatccccagtttacagatgtgggccctgatgcccagacgctttgtaacttggccattgaagctctg

SEQ ID NO: 342126 - DNA, 2830 bp, Homo sapiens
agcaccctcacacatagcattgtgtgtgtgtacaagggcttccactggaaatagccttgacggggaactgctggagcgagggtgtgcttatgtcagattttggtgtatgctcttaagtggccccttaagaggttgtctcggtttgcattggcccctgtggtacatgaagaagcccaggggatgtctgacccacgtggctctgcacccctgcaggtacctggaagaggtgggctacacagacaccatcctcgacatgcggtccaagcgcgtccgttccctgctgggccgctcgctggagctcaacggggcagtggagccgagtgaaggggcccccagggctccaccaggccctgcagggctcagtggtggggagtcgctgctggtgaaacagatcgaggagcagataaagaggaacgcggcaggcaaagatggcaaagagcgcttgggcggctcagtgctggggcagatccccttcctgcagaactgcgaggacgaagacagcgacgaggacgatgagctggacagcgtgcagcacaagaagcagcgtgtgaagctcccatccaaggctctggtgcccgaaatggaagacgaggatgaggaagacgactctgaggatgctatcaatgagtttgatttcctgggctcaggagaggatggggaaggggctccagaccctcggcggtgcactgtggatgggagcccccatgagctggaaagccgtcgggtcaaactccaaggcattctggctgacctgcgggatgtggatgggctgcccccaaaagtgactggcccgcctcctggcacaccccagccccggccacatgaagacgtcttcatcatggacactatcgggggcggggaggtgagcctgggggacttggcagatctcaccgtcaccaacgacaacgacctcagctgcgatctgtctgacagcaaagatgcttttaagaagacgtggaaccccaagttcaccctgcgctcgcactacgacggcattcgttccctggccttccaccacagccagtcggctctgctcaccgcctccgaggacggcacgctcaagctctggaacctgcagaaggcggtcacggccaagaagaatgcggcgctagatgtggaacctatacatgctttccgggctcacaggggcccagtgttggctgtggctatgggcagcaacagtgaatactgctacagtggcggggcagatgcctgcatccatagttggaagattccagacctcagcatggatccctatgatggctacgacccaagcgtgctgagccacgtcctggagggccacggggacgccgtgtggggcctggccttcagtcccacctcccagcgcctggcctcctgttctgctgatggcaccgtccgcatctgggaccccagcagcagcagcccggcctgcctctgcaccttccccacagccagcgagcacggggtccccacctcagtggccttcaccagcaccgagcctgcccacatcgtggcctccttccgctctggcgacaccgtcttgtatgacatggaggttggcagtgccctcctcacgctggagtcccggggcagcagcggtccaacccagatcaaccaagtggtgagtcatccaaaccagcctctcaccatcaccgcccacgacgacaggggcatccgcttcctggacaatcggacaggtaagccggtgcactccatggttgcacacctggacgcagtcacctgcctagccgtggaccccaacggcgcattcctgatgtcaggaagccatgactgctccctgcgtctctggagcctggacaacaaaacgtgcgtgcaggagatcacggcccaccgcaagaagcacgaggaggccatccacgctgttgcctgccaccccagcaaggccctcattgccagtgctggcgctgatgccctggccaaggtcttcgtatgatgcccacctggccctgccctggccgccacgctggctggggtgtagggccgggcaggtggggctgaggggactcccagcctcgctggaggtgcagaggcctggcctctgtctgtttgccgtggagcctggtggtgctaacggccctttccccaggaatccctccccaacggctgccttccccaagcatccagcctggggatgggcccctttcaggaatcacccccgaggatggcctcggggtttccccctgtgccctgacagccgctcctggtatcagagctgctttccagagggcagcacagccagggccgggtgtctttagggatcagtttttccaagactccagaaggtgccaggttctccccttgagctcctgctcccccatcccccatcctcccagacctgggcaggagctgtgctgggagaaagggtggcagccgggagcctcagagctgagccccggcctggctgcccctcccctccggccctctccactgctttccagacactaaccaaggcttccaggccagggattgcccaacactcctagggcagccctcccagcgccccatggggtcgcccatgggtagagacggctttcttgtgcccctccctggggcatggagggtggagtgggcctcgggtccccctgaactccctgtatatctgtataaataacgggattttcatggcgccgccccacccgcattatcactgtgtgatggtctcagtcagtctcctccctgtctccactctttccctctatttatttcactctcttgtttggttctaccctgcaccctcggtccccttccaggttcctgtttataagccccaacccctctgtccccatcttgtatgtgaaaacttgtctcaataaaccctttggagtaa

SEQ ID NO: 342127 - DNA, 2181 bp, Homo sapiens
gtcacctatgccagactgggttggaactgctgggtgactccggccctatgcctcgaccctgcagaaagccgtcgggtcaaactccaaggcattctggctgacctgcgggatgtggatgggctgcccccaaaagtgactggcccgcctcctggcacaccccagccccggccacatgaagacgtcttcatcatggacactatcgggggcggggaggtgagcctgggggacttggcagatctcaccgtcaccaacgacaacgacctcagctgcgatctgtctgacagcaaagatgcttttaagaagacgtggaaccccaagttcaccctgcgctcgcactacgacggcattcgttccctggccttccaccacagccagtcggctctgctcaccgcctccgaggacggcacgctcaagctctggaacctgcagaaggcggtcacggccaagaagaatgcggcgctagatgtggaacctatacatgctttccgggctcacaggggcccagtgttggctgtggctatgggcagcaacagtgaatactgctacagtggcggggcagatgcctgcatccatagttggaagattccagacctcagcatggatccctatgatggctacgacccaagcgtgctgagccacgtcctggagggccacggggacgccgtgtggggcctggccttcagtcccacctcccagcgcctggcctcctgttctgctgatggcaccgtccgcatctgggaccccagcagcagcagcccggcctgcctctgcaccttccccacagccagcgagcacggggtccccacctcagtggccttcaccagcaccgagcctgcccacatcgtggcctccttccgctctggcgacaccgtcttgtatgacatggaggttggcagtgccctcctcacgctggagtcccggggcagcagcggtccaacccagatcaaccaagtggtgagtcatccaaaccagcctctcaccatcaccgcccacgacgacaggggcatccgcttcctggacaatcggacaggtaagccggtgcactccatggttgcacacctggacgcagtcacctgcctagccgtggaccccaacggcgcattcctgatgtcaggaagccatgactgctccctgcgtctctggagcctggacaacaaaacgtgcgtgcaggagatcacggcccaccgcaagaagcacgaggaggccatccacgctgttgcctgccaccccagcaaggccctcattgccagtgctggcgctgatgccctggccaaggtcttcgtatgatgcccacctggccctgccctggccgccacgctggctggggtgtagggccgggcaggtggggctgaggggactcccagcctcgctggaggtgcagaggcctggcctctgtctgtttgccgtggagcctggtggtgctaacggccctttccccaggaatccctccccaacggctgccttccccaagcatccagcctggggatgggcccctttcaggaatcacccccgaggatggcctcggggtttccccctgtgccctgacagccgctcctggtatcagagctgctttccagagggcagcacagccagggccgggtgtctttagggatcagtttttccaagactccagaaggtgccaggttctccccttgagctcctgctcccccatcccccatcctcccagacctgggcaggagctgtgctgggagaaagggtggcagccgggagcctcagagctgagccccggcctggctgcccctcccctccggccctctccactgctttccagacactaaccaaggcttccaggccagggattgcccaacactcctagggcagccctcccagcgccccatggggtcgcccatgggtagagacggctttcttgtgcccctccctggggcatggagggtggagtgggcctcgggtccccctgaactccctgtatatctgtataaataacgggattttcatggcgccgccccacccgcattatcactgtgtgatggtctcagtcagtctcctccctgtctccactctttccctctatttatttcactctcttgtttggttctaccctgcaccctcggtccccttccaggttcctgtttataagccccaacccctctgtccccatcttgtatgtgaaaacttgtctcaataaaccctttggagtaa

SEQ ID NO: 342128 - DNA, 3858 bp, Homo sapiens
ggccccggggcctccatgatggaggagcgagcggccgccgcggtcgccgccgccgcctcctcctgccgtccgctcggctcaggcgcgggccctggccccactggggcggccccggtctccgcccctgcccccgggccgggcccggcaggtaagggaggcggcggcggaggcagccccgggcccacggcgggcccggagcccctgagcctgccggggatcctgcactttatccagcacgagtgggcgcgcttcgaagccgagaaagcccgctgggaggccgagcgcgccgagttacaggctcaggtggccttccttcagggagagaggaaagggcaggagaatctaaagacggacctggtgcggcggatcaagatgctagagtatgcgctgaagcaggaaagggccaaatatcataaactgaagtttgggacagacctgaaccagggggagaagaaagcagatgtgtcagaacaagtctccaatggccccgtggaatcggtcaccctggagaacagcccgttggtgtggaaggaggggcggcagcttctccgacagtacctggaagaggtgggctacacagacaccatcctcgacatgcggtccaagcgcgtccgttccctgctgggccgctcgctggagctcaacggggcagtggagccgagtgaaggggcccccagggctccaccaggccctgcagggctcagtggtggggagtcgctgctggtgaaacagatcgaggagcagataaagaggaacgcggcaggcaaagatggcaaagagcgcttgggcggctcagtgctggggcagatccccttcctgcagaactgcgaggacgaagacagcgacgaggacgatgagctggacagcgtgcagcacaagaagcagcgtgtgaagctcccatccaaggctctggtgcccgaaatggaagacgaggatgaggaagacgactctgaggatgctatcaatgagtttgatttcctgggctcaggagaggatggggaaggggctccagaccctcggcggtgcactgtggatgggagcccccatgagctggaaagccgtcgggtcaaactccaaggcattctggctgacctgcgggatgtggatgggctgcccccaaaagtgactggcccgcctcctggcacaccccagccccggccacatgaagacgtcttcatcatggacactatcgggggcggggaggtgagcctgggggacttggcagatctcaccgtcaccaacgacaacgacctcagctgcgatctgtctgacagcaaagatgcttttaagaagacgtggaaccccaagttcaccctgcgctcgcactacgacggcattcgttccctggccttccaccacagccagtcggctctgctcaccgcctccgaggacggcacgctcaagctctggaacctgcagaaggcggtcacggccaagaagaatgcggcgctagatgtggaacctatacatgctttccgggctcacaggggcccagtgttggctgtggctatgggcagcaacagtgaatactgctacagtggcggggcagatgcctgcatccatagttggaagattccagacctcagcatggatccctatgatggctacgacccaagcgtgctgagccacgtcctggagggccacggggacgccgtgtggggcctggccttcagtcccacctcccagcgcctggcctcctgttctgctgatggcaccgtccgcatctgggaccccagcagcagcagcccggcctgcctctgcaccttccccacagccagcgagcacggggtccccacctcagtggccttcaccagcaccgagcctgcccacatcgtggcctccttccgctctggcgacaccgtcttgtatgacatggaggttggcagtgccctcctcacgctggagtcccggggcagcagcggtccaacccagatcaaccaagtggtgagtcatccaaaccagcctctcaccatcaccgcccacgacgacaggggcatccgcttcctggacaatcggacaggtaagccggtgcactccatggttgcacacctggacgcagtcacctgcctagccgtggaccccaacggcgcattcctgatgtcaggaagccatgactgctccctgcgtctctggagcctggacaacaaaacgtgcgtgcaggagatcacggcccaccgcaagaagcacgaggaggccatccacgctgttgcctgccaccccagcaaggccctcattgccagtgctggcgctgatgccctggccaaggtcttcgtatgatgcccacctggccctgccctggccgccacgctggctggggtgtagggccgggcaggtggggctgaggggactcccagcctcgctggaggtgcagaggcctggcctctgtctgtttgccgtggagcctggtggtgctaacggccctttccccaggaatccctccccaacggctgccttccccaagcatccagcctggggatgggcccctttcaggaatcacccccgaggatggcctcggggtttccccctgtgccctgacagccgctcctggtatcagagctgctttccagagggcagcacagccagggccgggtgtctttagggatcagtttttccaagactccagaaggtgccaggttctccccttgagctcctgctcccccatcccccatcctcccagacctgggcaggagctgtgctgggagaaagggtggcagccgggagcctcagagctgagccccggcctggctgcccctcccctccggccctctccactgctttccagacactaaccaaggcttccaggccagggattgcccaacactcctagggcagccctcccagcgccccatggggtcgcccatgggtagagacggctttcttgtgcccctccctggggcatggagggtggagtgggcctcgggtccccctgaactccctgtatatctgtataaataacgggattttcatggcgccgccccacccgcattatcactgtgtgatggtctcagtcagtctcctccctgtctccactctttccctctatttatttcactctcttgtttggttctaccctgcaccctcggtccccttccaggttcctgtttataagccccaacccctctgtccccatcttgtatgtgaaaacttgtctcaataaaccctttggagtaaaaaaaaaaaaaaagaaaaaaaaaacacaaaaaaaagaaagaagaaagaaacaatgcaacatcacgacccacaacacaatctgatacacagcgagtatcatgccactctgacccaatgagagcacagttggcacgccccacatgcatccccacagctagttccaccagtgtctcatccttactgtaactgactcgcttcacctcccactcatcccattagaatcgcccatatcaagcagcaacacaataccccgtccacacggccaccctacccccctctaccaaccctccatctactatcctacctcttacccctcttcagtcgctcactcttccctactctcatcatcattctcactacatcctaccacactataacaccaaccacaatcgccacattcatccctcacacattctcacactatacttacacgacatcctatccttcccatccacatcaagtcacacatcatccataccacactctttcttatctcttcacgatatacccttccttctctgtctaccctcatacaactagccacccaactcgaactcaatttacacccatccactcacaccccgaaccttccagcctccaccagtacgcctagcaacatcacaaccagcctcatacaacccccaccatcaatttcattacacatcaccaaacaaaccaccccaccct

SEQ ID NO: 342129 - DNA, 3904 bp, Homo sapiens
ggccccggggcctccatgatggaggagcgagcggccgccgcggtcgccgccgccgcctcctcctgccgtccgctcggctcaggcgcgggccctggccccactggggcggccccggtctccgcccctgcccccgggccgggcccggcaggtaagggaggcggcggcggaggcagccccgggcccacggcgggcccggagcccctgagcctgccggggatcctgcactttatccagcacgagtgggcgcgcttcgaagccgagaaagcccgctgggaggccgagcgcgccgagttacaggctcaggtggccttccttcagggagagaggaaagggcaggagaatctaaagacggacctggtgcggcggatcaagatgctagagtatgcgctgaagcaggaaagggccaaatatcataaactgaagtttgggacagacctgaaccagggggagaagaaagcagatgtgtcagaacaagtctccaatggccccgtggaatcggtcaccctggagaacagcccgttggtgtggaaggaggggcggcagcttctccgacagtacctggaagaggtgggctacacagacaccatcctcgacatgcggtccaagcgcgtccgttccctgctgggccgctcgctggagctcaacggggcagtggagccgagtgaaggggcccccagggctccaccaggccctgcagggctcagtggtggggagtcgctgctggtgaaacagatcgaggagcagataaagaggaacgcggcaggcaaagatggcaaagagcgcttgggcggctcagtgctggggcagatccccttcctgcagaactgcgaggacgaagacagcgacgaggacgatgagctggacagcgtgcagcacaagaagcagcgtgtgaagctcccatccaaggctctggtgcccgaaatggaagacgaggatgaggaagacgactctgaggatgctatcaatgagtttgatttcctgggctcaggagaggatggggaaggggctccagaccctcggcggtgcactgtggatgggagcccccatgagctggaaagccgtcgggtcaaactccaaggcattctggctgacctgcgggatgtggatgggctgcccccaaaagtgactggcccgcctcctggcacaccccagccccggccacatgaagacgtcttcatcatggacactatcgggggcggggaggtgagcctgggggacttggcagatctcaccgtcaccaacgacaacgacctcagctgcgatctgtctgacagcaaagatgcttttaagaagacgtggaaccccaagttcaccctgcgctcgcactacgacggcattcgttccctggccttccaccacagccagtcggctctgctcaccgcctccgaggacggcacgctcaagctctggaacctgcagaaggcggtcacggccaagaagaatgcggcgctagatgtggaacctatacatgctttccgggctcacaggggcccagtgttggctgtggctatgggcagcaacagtgaatactgctacagtggcggggcagatgcctgcatccatagttggaagattccagacctcagcatggatccctatgatggctacgacccaagcgtgctgagccacgtcctggagggccacggggacgccgtgtggggcctggccttcagtcccacctcccagcgcctggcctcctgttctgctgatggcaccgtccgcatctgggaccccagcagcagcagcccggcctgcctctgcaccttccccacagccagcgagcacggggtccccacctcagtggccttcaccagcaccgagcctgcccacatcgtggcctccttccgctctggcgacaccgtcttgtatgacatggaggttggcagtgccctcctcacgctggagtcccggggcagcagcggtccaacccagatcaaccaagtggtgagtcatccaaaccagcctctcaccatcaccgcccacgacgacaggggcatccgcttcctggacaatcggacaggtaagccggtgcactccatggttgcacacctggacgcagtcacctgcctagccgtggaccccaacggcgcattcctgatgtcaggaagccatgactgctccctgcgtctctggagcctggacaacaaaacgtgcgtgcaggagatcacggcccaccgcaagaagcacgaggaggccatccacgctgttgcctgccaccccagcaaggccctcattgccagtgctggcgctgatgccctggccaaggtcttcgtatgatgcccacctggccctgccctggccgccacgctggctggggtgtagggccgggcaggtggggctgaggggactcccagcctcgctggaggtgcagaggcctggcctctgtctgtttgccgtggagcctggtggtgctaacggccctttccccaggaatccctccccaacggctgccttccccaagcatccagcctggggatgggcccctttcaggaatcacccccgaggatggcctcggggtttccccctgtgccctgacagccgctcctggtatcagagctgctttccagagggcagcacagccagggccgggtgtctttagggatcagtttttccaagactccagaaggtgccaggttctccccttgagctcctgctcccccatcccccatcctcccagacctgggcaggagctgtgctgggagaaagggtggcagccgggagcctcagagctgagccccggcctggctgcccctcccctccggccctctccactgctttccagacactaaccaaggcttccaggccagggattgcccaacactcctagggcagccctcccagcgccccatggggtcgcccatgggtagagacggctttcttgtgcccctccctggggcatggagggtggagtgggcctcgggtccccctgaactccctgtatatctgtataaataacgggattttcatggcgccgccccacccgcattatcactgtgtgatggtctcagtcagtctcctccctgtctccactctttccctctatttatttcactctcttgtttggttctaccctgcaccctcggtccccttccaggttcctgtttataagccccaacccctctgtccccatcttgtatgtgaaaacttgtctcaataaaccctttggagtaaaaaaaaaaaaaaaaaaaaaaaacaaacaaaaacagacaaaacaacaaaaaaaaaaaaaagaaaaaaaaaacacaaaaaaaagaaagaagaaagaaacaatgcaacatcacgacccacaacacaatctgatacacagcgagtatcatgccactctgacccaatgagagcacagttggcacgccccacatgcatccccacagctagttccaccagtgtctcatccttactgtaactgactcgcttcacctcccactcatcccattagaatcgcccatatcaagcagcaacacaataccccgtccacacggccaccctacccccctctaccaaccctccatctactatcctacctcttacccctcttcagtcgctcactcttccctactctcatcatcattctcactacatcctaccacactataacaccaaccacaatcgccacattcatccctcacacattctcacactatacttacacgacatcctatccttcccatccacatcaagtcacacatcatccataccacactctttcttatctcttcacgatatacccttccttctctgtctaccctcatacaactagccacccaactcgaactcaatttacacccatccactcacaccccgaaccttccagcctccaccagtacgcctagcaacatcacaaccagcctcatacaacccccaccatcaatttcattacacatcaccaaacaaaccaccccaccct

SEQ ID NO: 342130 - DNA, 1948 bp, Homo sapiens
  misc_feature (3)..(3): n is a, c, g, or t
agnataggctagtacgaggccgggtgttaatcggccgaggctgtctgacagcaaagatgcttttaagaagacgtggaaccccaagttcaccctgcgctcgcactacgacggcattcgttccctggccttccaccacagccagtcggctctgctcaccgcctccgaggacggcacgctcaagctctggaacctgcagaaggcggtcacggccaagaagaatgcggcgctagatgtggaacctatacatgctttccgggctcacaggggcccagtgttggctgtggctatgggcagcaacagtgaatactgctacagtggcggggcagatgcctgcatccatagttggaagattccagacctcagcatggatccctatgatggctacgacccaagcgtgctgagccacgtcctggagggccacggggacgccgtgtggggcctggccttcagtcccacctcccagcgcctggcctcctgttctgctgatggcaccgtccgcatctgggaccccagcagcagcagcccggcctgcctctgcaccttccccacagccagcgagcacggggtccccacctcagtggccttcaccagcaccgagcctgcccacatcgtggcctccttccgctctggcgacaccgtcttgtatgacatggaggttggcagtgccctcctcacgctggagtcccggggcagcagcggtccaacccagatcaaccaagtggtgagtcatccaaaccagcctctcaccatcaccgcccacgacgacaggggcatccgcttcctggacaatcggacaggtaagccggtgcactccatggttgcacacctggacgcagtcacctgcctagccgtggaccccaacggcgcattcctgatgtcaggaagccatgactgctccctgcgtctctggagcctggacaacaaaacgtgcgtgcaggagatcacggcccaccgcaagaagcacgaggaggccatccacgctgttgcctgccaccccagcaaggccctcattgccagtgctggcgctgatgccctggccaaggtcttcgtatgatgcccacctggccctgccctggccgccacgctggctggggtgtagggccgggcaggtggggctgaggggactcccagcctcgctggaggtgcagaggcctggcctctgtctgtttgccgtggagcctggtggtgctaacggccctttccccaggaatccctccccaacggctgccttccccaagcatccagcctggggatgggcccctttcaggaatcacccccgaggatggcctcggggtttccccctgtgccctgacagccgctcctggtatcagagctgctttccagagggcagcacagccagggccgggtgtctttagggatcagtttttccaagactccagaaggtgccaggttctccccttgagctcctgctcccccatcccccatcctcccagacctgggcaggagctgtgctgggagaaagggtggcagccgggagcctcagagctgagccccggcctggctgcccctcccctccggccctctccactgctttccagacactaaccaaggcttccaggccagggattgcccaacactcctagggcagccctcccagcgccccatggggtcgcccatgggtagagacggctttcttgtgcccctccctggggcatggagggtggagtgggcctcgggtccccctgaactccctgtatatctgtataaataacgggattttcatggcgccgccccacccgcattatcactgtgtgatggtctcagtcagtctcctccctgtctccactctttccctctatttatttcactctcttgtttggttctaccctgcaccctcggtccccttccaggttcctgtttataagccccaacccctctgtccccatcttgtatgtgaaaacttgtctcaataaaccctttggagtaa

SEQ ID NO: 342131 - DNA, 3427 bp, Homo sapiens
ggccccggggcctccatgatggaggagcgagcggccgccgcggtcgccgccgccgcctcctcctgccgtccgctcggctcaggcgcgggccctggccccactggggcggccccggtctccgcccctgcccccgggccgggcccggcaggtaagggaggcggcggcggaggcagccccgggcccacggcgggcccggagcccctgagcctgccggggatcctgcactttatccagcacgagtgggcgcgcttcgaagccgagaaagcccgctgggaggccgagcgcgccgagttacaggctcaggtggccttccttcagggagagaggaaagggcaggagaatctaaagacggacctggtgcggcggatcaagatgctagagtatgcgctgaagcaggaaagggccaaatatcataaactgaagtttgggacagacctgaaccagggggagaagaaagcagatgtgtcagaacaagtctccaatggccccgtggaatcggtcaccctggagaacagcccgttggtgtggaaggaggggcggcagcttctccgacagtacctggaagaggtgggctacacagacaccatcctcgacatgcggtccaagcgcgtccgttccctgctgggccgctcgctggagctcaacggggcagtggagccgagtgaaggggcccccagggctccaccaggccctgcagggctcagtggtggggagtcgctgctggtgaaacagatcgaggagcagataaagaggaacgcggcaggcaaagatggcaaagagcgcttgggcggctcagtgctggggcagatccccttcctgcagaactgcgaggacgaagacagcgacgaggacgatgagctggacagcgtgcagcacaagaagcagcgtgtgaagctcccatccaaggctctggtgcccgaaatggaagacgaggatgaggaagacgactctgaggatgctatcaatgagtttgatttcctgggctcaggagaggatggggaaggggctccagaccctcggcggtgcactgtggatgggagcccccatgagctggaaagccgtcgggtcaaactccaaggcattctggctgacctgcgggatgtggatgggctgcccccaaaagtgactggcccgcctcctggcacaccccagccccggccacatgaagacgtcttcatcatggacactatcgggggcggggaggtgagcctgggggacttggcagatctcaccgtcaccaacgacaacgacctcagctgcgatctgtctgacagcaaagatgcttttaagaagacgtggaaccccaagttcaccctgcgctcgcactacgacggcattcgttccctggccttccaccacagccagtcggctctgctcaccgcctccgaggacggcacgctcaagctctggaacctgcagaaggcggtcacggccaagaagaatgcggcgctagatgtggaacctatacatgctttccgggctcacaggggcccagtgttggctgtggctatgggcagcaacagtgaatactgctacagtggcggggcagatgcctgcatccatagttggaagattccagacctcagcatggatccctatgatggctacgacccaagcgtgctgagccacgtcctggagggccacggggacgccgtgtggggcctggccttcagtcccacctcccagcgcctggcctcctgttctgctgatggcaccgtccgcatctgggaccccagcagcagcagcccggcctgcctctgcaccttccccacagccagcgagcacggggtccccacctcagtggccttcaccagcaccgagcctgcccacatcgtggcctccttccgctctggcgacaccgtcttgtatgacatggaggttggcagtgccctcctcacgctggagtcccggggcagcagcggtccaacccagatcaaccaagtggtgagtcatccaaaccagcctctcaccatcaccgcccacgacgacaggggcatccgcttcctggacaatcggacaggtaagccggtgcactccatggttgcacacctggacgcagtcacctgcctagccgtggaccccaacggcgcattcctgatgtcaggaagccatgactgctccctgcgtctctggagcctggacaacaaaacgtgcgtgcaggagatcacggcccaccgcaagaagcacgaggaggccatccacgctgttgcctgccaccccagcaaggccctcattgccagtgctggcgctgatgccctggccaaggtcttcgtatgatgcccacctggccctgccctggccgccacgctggctggggtgtagggccgggcaggtggggctgaggggactcccagcctcgctggaggtgcagaggcctggcctctgtctgtttgccgtggagcctggtggtgctaacggccatggagggtggagtgggcctcgggtccccctgaactccctgtatatctgtataaataacgggattttcatggcgccgccccacccgcattatcactgtgtgatggtctcagtcagtctcctccctgtctccactctttccctctatttatttcactctcttgtttggttctaccctgcaccctcggtccccttccaggttcctgtttataagccccaacccctctgtccccatcttgtatgtgaaaacttgtctcaataaaccctttggagtaaaaaaaaaaaaaaaaaaaaaaaacaaacaaaaacagacaaaacaacaaaaaaaaaaaaaagaaaaaaaaaacacaaaaaaaagaaagaagaaagaaacaatgcaacatcacgacccacaacacaatctgatacacagcgagtatcatgccactctgacccaatgagagcacagttggcacgccccacatgcatccccacagctagttccaccagtgtctcatccttactgtaactgactcgcttcacctcccactcatcccattagaatcgcccatatcaagcagcaacacaataccccgtccacacggccaccctacccccctctaccaaccctccatctactatcctacctcttacccctcttcagtcgctcactcttccctactctcatcatcattctcactacatcctaccacactataacaccaaccacaatcgccacattcatccctcacacattctcacactatacttacacgacatcctatccttcccatccacatcaagtcacacatcatccataccacactctttcttatctcttcacgatatacccttccttctctgtctaccctcatacaactagccacccaactcgaactcaatttacacccatccactcacaccccgaaccttccagcctccaccagtacgcctagcaacatcacaaccagcctcatacaacccccaccatcaatttcattacacatcaccaaacaaaccaccccaccct

SEQ ID NO: 342132 - DNA, 2145 bp, Homo sapiens
ggccccggggcctccatgatggaggagcgagcggccgccgcggtcgccgccgccgcctcctcctgccgtccgctcggctcaggcgcgggccctggccccactggggcggccccggtctccgcccctgcccccgggccgggcccggcaggtaagggaggcggcggcggaggcagccccgggcccacggcgggcccggagcccctgagcctgccggggatcctgcactttatccagcacgagtgggcgcgcttcgaagccgagaaagcccgctgggaggccgagcgcgccgagttacaggctcaggtggccttccttcagggagagaggaaagggcaggagaatctaaagacggacctggtgcggcggatcaagatgctagagtatgcgctgaagcaggaaagggccaaatatcataaactgaagtttgggacagacctgaaccagggggagaagaaagcagatgtgtcagaacaagtctccaatggccccgtggaatcggtcaccctggagaacagcccgttggtgtggaaggaggggcggcagcttctccgacagtacctggaagaggtgggctacacagacaccatcctcgacatgcggtccaagcgcgtccgttccctgctgggccgctcgctggagctcaacggggcagtggagccgagtgaaggggcccccagggctccaccaggccctgcagggctcagtggtggggagtcgctgctggtgaaacagatcgaggagcagataaagaggaacgcggcaggcaaagatggcaaagagcgcttgggcggctcagtgctggggcagatccccttcctgcagaactgcgaggacgaagacagcgacgaggacgatgagctggacagcgtgcagcacaagaagcagcgtgtgaagctcccatccaaggctctggtgcccgaaatggaagacgaggatgaggaagacgactctgaggatgctatcaatgagtttgatttcctgggctcaggagaggatggggaaggggctccagaccctcggcggtgcactgtggatgggagcccccatgagctggaaagccgtcgggtcaaactccaaggcattctggctgacctgcgggatgtggatgggctgcccccaaaagtgactggcccgcctcctggcacaccccagccccggccacatgaagacgtcttcatcatggacactatcgggggcggggaggtgagcctgggggacttggcagatctcaccgtcaccaacgacaacgacctcagctgcgatctgtctgacagcaaagatgcttttaagaagacgtggaaccccaagttcaccctgcgctcgcactacgacggcattcgttccctggccttccaccacagccagtcggctctgctcaccgcctccgaggacggcacgctcaagctctggaacctgcagaaggcggtcacggccaagaagaatgcggcgctagatgtggaacctatacatgctttccgggctcacaggggcccagtgttggctgtggctatgggcagcaacagtgaatactgctacagtggcggggcagatgcctgcatccatagttggaagattccagacctcagcatggatccctatgatggctacgacccaagcgtgctgagccacgtcctggagggccacggggacgccgtgtggggcctggccttcagtcccacctcccagcgcctggcctcctgttctgctgatggcaccgtccgcatctgggaccccagcagcagcagcccggcctgcctctgcaccttccccacagccagcgagcacggggtccccacctcagtggccttcaccagcaccgagcctgcccacatcgtggcctccttccgctctggcgacaccgtcttgtatgacatggaggttggcagtgccctcctcacgctggagtcccggggcagcagcgcaacccagatcaacaagtggtgagtcatcaaacaggctctcacattacgccagagaaggggtccgttctgggcaacggcaggagccgggcccagggggccctggcgggtctgcgaaggggccagcgtctgtggtgagccgaggccgcgttcgggcgcacaacgggtggaaagcccgaaaagaggccttgggccccagcctcggggcgcaactacaatccctggg

SEQ ID NO: 342133 - DNA, 791 bp, Homo sapiens
ggccccggggcctccatgatggaggagcgagcggccgccgcggtcgccgccgccgcctcctcctgccgtccgctcggctcaggcgcgggccctggccccactggggcggccccggtctccgcccctgcccccgggccgggcccggcaggtaagggaggcggcggcggaggcagccccgggcccacggcgggcccggagcccctgagcctgccggggatcctgcactttatccagcacgagtgggcgcgcttcgaagccgagaaagcccgctgggaggccgagcgcgccgagttacaggctcaggtggccttccttcagggagagaggaaagggcaggagaatctaaagacggacctggtgcggcggatcaagatgctagagtatgcgctgaagcaggaaagggccaaatatcataaactgaagtttgggattgcccaacactcctagggcagccctcccagcgccccatggggtcgcccatgggtagagacggctttcttgtgcccctccctggggcatggagggtggagtgggcctcgggtccccctgaactccctgtatatctgtataaataacgggattttcatggcgccgccccacccgcattatcactgtgtgatggtctcagtcagtctcctccctgtctccactctttccctctatttatttcactctcttgtttggttctaccctgcaccctcggtccccttccaggttcctgtttataagccccaacccctctgtccccatcttgtatgtgaaaacttgtctcaataaaccctttggagtaa

SEQ ID NO: 342134 - DNA, 313 bp, Homo sapiens
ttatctccctttgcctcctgtctgccctcccaggctcaggtggccttccttcagggagagaggaaagggcaggagaatctaaagacggacctggtgcggcggatcaagatgctagagtatgcgctgaagcaggaaaggtgagccttcatcctgccctgggcctgccttctgggtccgtctcaagcacagtgtcaggaggccaccagccacgcctccttccagctaagggagatttggggtcgacattcttttccatcattccagtaccataagattctaggggagaaacaggacagagtaggtgggatttggg

SEQ ID NO: 342135 - DNA, 543 bp, Homo sapiens
ctgggtctgggctctggccaccaagcctgggagggcaccttcctatctgagctttgacacctgccaggactcatgcctcctctgctctgctgtctttggcaggaacgcggcaggcaaagatggcaaagagcgcttgggcggctcagtgctggggcagatccccttcctgcagaactgcgaggacgaagacagcgacgaggacgatgagctggacagcgtgcagcacaagaagcagcgtgtgaaggtgagcccttcctccatgccctgcacagcctggcctgggtgtgacctgatcgaagcccttccgagtcagcctgggccttcaggggctgcggtgtgtgctggcagcagggatatggagacacacaggccctggcctggaggagcttgtggccagcagcggccttgtaaatagtcatgtgcagaaggacgcgttgtggtggaggcaggggcatgtgcctatgaaggaggcacctgtggcagatggcctcggagctttccctgagccccgggcttcccattagcgggtccctttgcctaggt

SEQ ID NO: 342136 - DNA, 3192 bp, Homo sapiens
ggccccggggcctccatgatggaggagcgagcggccgccgcggtcgccgccgccgcctcctcctgccgtccgctcggctcaggcgcgggccctggccccactggggcggccccggtctccgcccctgcccccgggccgggcccggcaggtaagggaggcggcggcggaggcagccccgggcccacggcgggcccggagcccctgagcctgccggggatcctgcactttatccagcacgagtgggcgcgcttcgaagccgagaaagcccgctgggaggccgagcgcgccgagttacaggctcaggtggccttccttcagggagagaggaaagggcaggagaatctaaagacggacctggtgcggcggatcaagatgctagagtatgcgctgaagcaggaaagggccaaatatcataaactgaagtttgggacagacctgaaccagggggagaagaaagcagatgtgtcagaacaagtctccaatggccccgtggaatcggtcaccctggagaacagcccgttggtgtggaaggaggggcggcagcttctccgacagtacctggaagaggtgggctacacagacaccatcctcgacatgcggtccaagcgcgtccgttccctgctgggccgctcgctggagctcaacggggcagtggagccgagtgaaggggcccccagggctccaccaggccctgcagggctcagtggtggggagtcgctgctggtgaaacagatcgaggagcagataaagaggaacgcggcaggcaaagatggcaaagagcgcttgggcggctcagtgctggggcagatccccttcctgcagaactgcgaggacgaagacagcgacgaggacgatgagctggacagcgtgcagcacaagaagcagcgtgtgaagctcccatccaaggctctggtgcccgaaatggaagacgaggatgaggaagacgactctgaggatgctatcaatgagtttgatttcctgggctcaggagaggatggggaaggggctccagaccctcggcggtgcactgtggatgggagcccccatgagctggaaagccgtcgggtcaaactccaaggcattctggctgacctgcgggatgtggatgggctgcccccaaaagtgactggcccgcctcctggcacaccccagccccggccacatgaaggttcctttggcttctcctcagacgtcttcatcatggacactatcgggggcggggaggtgagcctgggggacttggcagatctcaccgtcaccaacgacaacgacctcagctgcgatctgtctgacagcaaagatgcttttaagaagacgtggaaccccaagttcaccctgcgctcgcactacgacggcattcgttccctggccttccaccacagccagtcggctctgctcaccgcctccgaggacggcacgctcaagctctggaacctgcagaaggcggtcacggccaagaagaatgcggcgctagatgtggaacctatacatgctttccgggctcacaggggcccagtgttggctgtggctatgggcagcaacagtgaatactgctacagtggcggggcagatgcctgcatccatagttggaagattccagacctcagcatggatccctatgatggctacgacccaagcgtgctgagccacgtcctggagggccacggggacgccgtgtggggcctggccttcagtcccacctcccagcgcctggcctcctgttctgctgatggcaccgtccgcatctgggaccccagcagcagcagcccggcctgcctctgcaccttccccacagccagcgagcacggggtccccacctcagtggccttcaccagcaccgagcctgcccacatcgtggcctccttccgctctggcgacaccgtcttgtatgacatggaggttggcagtgccctcctcacgctggagtcccggggcagcagcggtccaacccagatcaaccaagtggtgagtcatccaaaccagcctctcaccatcaccgcccacgacgacaggggcatccgcttcctggacaatcggacaggtaagccggtgcactccatggttgcacacctggacgcagtcacctgcctagccgtggaccccaacggcgcattcctgatgtcaggaagccatgactgctccctgcgtctctggagcctggacaacaaaacgtgcgtgcaggagatcacggcccaccgcaagaagcacgaggaggccatccacgctgttgcctgccaccccagcaaggccctcattgccagtgctggcgctgatgccctggccaaggtcttcgtatgatgcccacctggccctgccctggccgccacgctggctggggtgtagggccgggcaggtggggctgaggggactcccagcctcgctggaggtgcagaggcctggcctctgtctgtttgccgtggagcctggtggtgctaacggccctttccccaggaatccctccccaacggctgccttccccaagcatccagcctggggatgggcccctttcaggaatcacccccgaggatggcctcggggtttccccctgtgccctgacagccgctcctggtatcagagctgctttccagagggcagcacagccagggccgggtgtctttagggatcagtttttccaagactccagaaggtgccaggttctccccttgagctcctgctcccccatcccccatcctcccagacctgggcaggagctgtgctgggagaaagggtggcagccgggagcctcagagctgagccccggcctggctgcccctcccctccggccctctccactgctttccagacactaaccaaggcttccaggccagggattgcccaacactcctagggcagccctcccagcgccccatggggtcgcccatgggtagagacggctttcttgtgcccctccctggggcatggagggtggagtgggcctcgggtccccctgaactccctgtatatctgtataaataacgggattttcatggcgccgccccacccgcattatcactgtgtgatggtctcagtcagtctcctccctgtctccactctttccctctatttatttcactctcttgtttggttctaccctgcaccctcggtccccttccaggttcctgtttataagccccaacccctctgtccccatcttgtatgtgaaaacttgtctcaataaaccctttggagtaa

SEQ ID NO: 342137 - DNA, 2638 bp, Homo sapiens
  misc_feature (3)..(3): n is a, c, g, or t
agnataggctagtacgaggccgggtgttaatcggccgaggatgcggtccaagcgcgtccgttccctgctgggccgctcgctggagctcaacggggcagtggagccgagtgaaggggcccccagggctccaccaggccctgcagggctcagtggtggggagtcgctgctggtgaaacagatcgaggagcagataaagaggaacgcggcaggcaaagatggcaaagagcgcttgggcggctcagtgctggggcagatccccttcctgcagaactgcgaggacgaagacagcgacgaggacgatgagctggacagcgtgcagcacaagaagcagcgtgtgaagctcccatccaaggctctggtgcccgaaatggaagacgaggatgaggaagacgactctgaggatgctatcaatgagtttgatttcctgggctcaggagaggatggggaaggggctccagaccctcggcggtgcactgtggatgggagcccccatgagctggaaagccgtcgggtcaaactccaaggcattctggctgacctgcgggatgtggatgggctgcccccaaaagtgactggcccgcctcctggcacaccccagccccggccacatgaaggttcctttggcttctcctcagacgtcttcatcatggacactatcgggggcggggaggtgagcctgggggacttggcagatctcaccgtcaccaacgacaacgacctcagctgcgatctgtctgacagcaaagatgcttttaagaagacgtggaaccccaagttcaccctgcgctcgcactacgacggcattcgttccctggccttccaccacagccagtcggctctgctcaccgcctccgaggacggcacgctcaagctctggaacctgcagaaggcggtcacggccaagaagaatgcggcgctagatgtggaacctatacatgctttccgggctcacaggggcccagtgttggctgtggctatgggcagcaacagtgaatactgctacagtggcggggcagatgcctgcatccatagttggaagattccagacctcagcatggatccctatgatggctacgacccaagcgtgctgagccacgtcctggagggccacggggacgccgtgtggggcctggccttcagtcccacctcccagcgcctggcctcctgttctgctgatggcaccgtccgcatctgggaccccagcagcagcagcccggcctgcctctgcaccttccccacagccagcgagcacggggtccccacctcagtggccttcaccagcaccgagcctgcccacatcgtggcctccttccgctctggcgacaccgtcttgtatgacatggaggttggcagtgccctcctcacgctggagtcccggggcagcagcggtccaacccagatcaaccaagtggtgagtcatccaaaccagcctctcaccatcaccgcccacgacgacaggggcatccgcttcctggacaatcggacaggtaagccggtgcactccatggttgcacacctggacgcagtcacctgcctagccgtggaccccaacggcgcattcctgatgtcaggaagccatgactgctccctgcgtctctggagcctggacaacaaaacgtgcgtgcaggagatcacggcccaccgcaagaagcacgaggaggccatccacgctgttgcctgccaccccagcaaggccctcattgccagtgctggcgctgatgccctggccaaggtcttcgtatgatgcccacctggccctgccctggccgccacgctggctggggtgtagggccgggcaggtggggctgaggggactcccagcctcgctggaggtgcagaggcctggcctctgtctgtttgccgtggagcctggtggtgctaacggccctttccccaggaatccctccccaacggctgccttccccaagcatccagcctggggatgggcccctttcaggaatcacccccgaggatggcctcggggtttccccctgtgccctgacagccgctcctggtatcagagctgctttccagagggcagcacagccagggccgggtgtctttagggatcagtttttccaagactccagaaggtgccaggttctccccttgagctcctgctcccccatcccccatcctcccagacctgggcaggagctgtgctgggagaaagggtggcagccgggagcctcagagctgagccccggcctggctgcccctcccctccggccctctccactgctttccagacactaaccaaggcttccaggccagggattgcccaacactcctagggcagccctcccagcgccccatggggtcgcccatgggtagagacggctttcttgtgcccctccctggggcatggagggtggagtgggcctcgggtccccctgaactccctgtatatctgtataaataacgggattttcatggcgccgccccacccgcattatcactgtgtgatggtctcagtcagtctcctccctgtctccactctttccctctatttatttcactctcttgtttggttctaccctgcaccctcggtccccttccaggttcctgtttataagccccaacccctctgtccccatcttgtatgtgaaaacttgtctcaataaaccctttggagtaa

SEQ ID NO: 342138 - DNA, 2142 bp, Homo sapiens
tgaggacccagtcggggagaggcagaaagccgtcgggtcaaactccaaggcattctggctgacctgcgggatgtggatgggctgcccccaaaagtgactggcccgcctcctggcacaccccagccccggccacatgaagacgtcttcatcatggacactatcgggggcggggaggtgagcctgggggacttggcagatctcaccgtcaccaacgacaacgacctcagctgcgatctgtctgacagcaaagatgcttttaagaagacgtggaaccccaagttcaccctgcgctcgcactacgacggcattcgttccctggccttccaccacagccagtcggctctgctcaccgcctccgaggacggcacgctcaagctctggaacctgcagaaggcggtcacggccaagaagaatgcggcgctagatgtggaacctatacatgctttccgggctcacaggggcccagtgttggctgtggctatgggcagcaacagtgaatactgctacagtggcggggcagatgcctgcatccatagttggaagattccagacctcagcatggatccctatgatggctacgacccaagcgtgctgagccacgtcctggagggccacggggacgccgtgtggggcctggccttcagtcccacctcccagcgcctggcctcctgttctgctgatggcaccgtccgcatctgggaccccagcagcagcagcccggcctgcctctgcaccttccccacagccagcgagcacggggtccccacctcagtggccttcaccagcaccgagcctgcccacatcgtggcctccttccgctctggcgacaccgtcttgtatgacatggaggttggcagtgccctcctcacgctggagtcccggggcagcagcggtccaacccagatcaaccaagtggtgagtcatccaaaccagcctctcaccatcaccgcccacgacgacaggggcatccgcttcctggacaatcggacaggtaagccggtgcactccatggttgcacacctggacgcagtcacctgcctagccgtggaccccaacggcgcattcctgatgtcaggaagccatgactgctccctgcgtctctggagcctggacaacaaaacgtgcgtgcaggagatcacggcccaccgcaagaagcacgaggaggccatccacgctgttgcctgccaccccagcaaggccctcattgccagtgctggcgctgatgccctggccaaggtcttcgtatgatgcccacctggccctgccctggccgccacgctggctggggtgtagggccgggcaggtggggctgaggggactcccagcctcgctggaggtgcagaggcctggcctctgtctgtttgccgtggagcctggtggtgctaacggccctttccccaggaatccctccccaacggctgccttccccaagcatccagcctggggatgggcccctttcaggaatcacccccgaggatggcctcggggtttccccctgtgccctgacagccgctcctggtatcagagctgctttccagagggcagcacagccagggccgggtgtctttagggatcagtttttccaagactccagaaggtgccaggttctccccttgagctcctgctcccccatcccccatcctcccagacctgggcaggagctgtgctgggagaaagggtggcagccgggagcctcagagctgagccccggcctggctgcccctcccctccggccctctccactgctttccagacactaaccaaggcttccaggccagggattgcccaacactcctagggcagccctcccagcgccccatggggtcgcccatgggtagagacggctttcttgtgcccctccctggggcatggagggtggagtgggcctcgggtccccctgaactccctgtatatctgtataaataacgggattttcatggcgccgccccacccgcattatcactgtgtgatggtctcagtcagtctcctccctgtctccactctttccctctatttatttcactctcttgtttggttctaccctgcaccctcggtccccttccaggttcctgtttataagccccaacccctctgtccccatcttgtatgtgaaaacttgtctcaataaaccctttggagtaa

SEQ ID NO: 342139 - DNA, 3368 bp, Homo sapiens
ggccccggggcctccatgatggaggagcgagcggccgccgcggtcgccgccgccgcctcctcctgccgtccgctcggctcaggcgcgggccctggccccactggggcggccccggtctccgcccctgcccccgggccgggcccggcaggtaagggaggcggcggcggaggcagccccgggcccacggcgggcccggagcccctgagcctgccggggatcctgcactttatccagcacgagtgggcgcgcttcgaagccgagaaagcccgctgggaggccgagcgcgccgagttacaggctcaggtggccttccttcagggagagaggaaagggcaggagaatctaaagacggacctggtgcggcggatcaagatgctagagtatgcgctgaagcaggaaagggccaaatatcataaactgaagtttgggacagacctgaaccagggggagaagaaagcagatgtgtcagaacaagtctccaatggccccgtggaatcggtcaccctggagaacagcccgttggtgtggaaggaggggcggcagcttctccgacagtacctggaagaggtgggctacacagacaccatcctcgacatgcggtccaagcgcgtccgttccctgctgggccgctcgctggagctcaacggggcagtggagccgagtgaaggggcccccagggctccaccaggccctgcagggctcagtggtggggagtcgctgctggtgaaacagatcgaggagcagataaagaggaacgcggcaggcaaagatggcaaagagcgcttgggcggctcagtgctggggcagatccccttcctgcagaactgcgaggacgaagacagcgacgaggacgatgagctggacagcgtgcagcacaagaagcagcgtgtgaagctcccatccaaggctctggtgcccgaaatggaagacgaggatgaggaagacgactctgaggatgctatcaatgagtttgatttcctgggctcaggagaggatggggaaggggctccagaccctcggcggtgcactgtggatgggagcccccatgagctggaaagccgtcgggtcaaactccaaggcattctggctgacctgcgggatgtggatgggctgcccccaaaagtgactggcccgcctcctggcacaccccagccccggccacatgaagacgtcttcatcatggacactatcgggggcggggaggtgagcctgggggacttggcagatctcaccgtcaccaacgacaacgacctcagctgcgatctgtctgacagcaaagatgcttttaagaagacgtggaaccccaagttcaccctgcgctcgcactacgacggcattcgttccctggccttccaccacagccagtcggctctgctcaccgcctccgaggacggcacgctcaagctctggaacctgcagaaggcggtcacggccaagaagaatgcggcgctagatgtggaacctatacatgctttccgggctcacaggggcccagtgttggctgtggctatgggcagcaacagtgaatactgctacagtggcggggcagatgcctgcatccatagttggaagattccagacctcagcatggatccctatgatggctacgacccaagcgtgctgagccacgtcctggagggccacggggacgccgtgtggggcctggccttcagtcccacctcccagcgcctggcctcctgttctgctgatggcaccgtccgcatctgggaccccagcagcagcagcccggcctgcctctgcaccttccccacagccagcgagcacggggtccccacctcagtggccttcaccagcaccgagcctgcccacatcgtggcctccttccgctctggcgacaccgtcttgtatgacatggaggttggcagtgccctcctcacgctggagtcccggggcagcagcggtccaacccagatcaaccaagtggtgagtcatccaaaccagcctctcaccatcaccgcccacgacgacaggggcatccgcttcctggacaatcggacaggtaagccggtgcactccatggttgcacacctggacgcagtcacctgcctagccgtggaccccaacggcgcattcctgatgtcaggaagccatgactgctccctgcgtctctggagcctggacaacaaaacgtgcgtgcaggagatcacggcccaccgcaagaagcacgaggaggccatccacgctgttgcctgccaccccagcaaggccctcattgccagtgctggcgctgatgccctggccaaggtcttcgtatgatgcccacctggccctgccctggccgccacgctggctggggtgtagggccgggcaggtggggctgaggtgagggcagaaaccccgcattctgagtctctgcacgcccatgcctagtactgccaggtgtgctgagccccgcagtccagtcaggggcgtcctgtgagaatcactgggggagccctgggcatgcaggggaggggttgaggccttagaggcgccctagaggcggcggctcagtctcccctcccttctctttcccgcaggggactcccagcctcgctggaggtgcagaggcctggcctctgtctgtttgccgtggagcctggtggtgctaacggccctttccccaggaatccctccccaacggctgccttccccaagcatccagcctggggatgggcccctttcaggaatcacccccgaggatggcctcggggtttccccctgtgccctgacagccgctcctggtatcagagctgctttccagagggcagcacagccagggccgggtgtctttagggatcagtttttccaagactccagaaggtgccaggttctccccttgagctcctgctcccccatcccccatcctcccagacctgggcaggagctgtgctgggagaaagggtggcagccgggagcctcagagctgagccccggcctggctgcccctcccctccggccctctccactgctttccagacactaaccaaggcttccaggccagggattgcccaacactcctagggcagccctcccagcgccccatggggtcgcccatgggtagagacggctttcttgtgcccctccctggggcatggagggtggagtgggcctcgggtccccctgaactccctgtatatctgtataaataacgggattttcatggcgccgccccacccgcattatcactgtgtgatggtctcagtcagtctcctccctgtctccactctttccctctatttatttcactctcttgtttggttctaccctgcaccctcggtccccttccaggttcctgtttataagccccaacccctctgtccccatcttgtatgtgaaaacttgtctcaataaaccctttggagtaa

SEQ ID NO: 342140 - DNA, 2694 bp, Homo sapiens
ggccccggggcctccatgatggaggagcgagcggccgccgcggtcgccgccgccgcctcctcctgccgtccgctcggctcaggcgcgggccctggccccactggggcggccccggtctccgcccctgcccccgggccgggcccggcaggtaagggaggcggcggcggaggcagccccgggcccacggcgggcccggagcccctgagcctgccggggatcctgcactttatccagcacgagtgggcgcgcttcgaagccgagaaagcccgctgggaggccgagcgcgccgagttacaggctcaggtggccttccttcagggagagaggaaagggcaggagaatctaaagacggacctggtgcggcggatcaagatgctagagtatgcgctgaagcaggaaagggccaaatatcataaactgaagtttgggacagacctgaaccagggggagaagaaagcagatgtgtcagaacaagtctccaatggccccgtggaatcggtcaccctggagaacagcccgttggtgtggaaggaggggcggcagcttctccgacagtacctggaagaggtgggctacacagacaccatcctcgacatgcggtccaagcgcgtccgttccctgctgggccgctcgctggagctcaacggggcagtggagccgagtgaaggggcccccagggctccaccaggccctgcagggctcagtggtggggagtcgctgctggtgaaacagatcgaggagcagataaagaggaacgcggcaggcaaagatggcaaagagcgcttgggcggctcagtgctggggcagatccccttcctgcagaactgcgaggacgaagacagcgacgaggacgatgagctggacagcgtgcagcacaagaagcagcgtgtgaagctcccatccaaggctctggtgcccgaaatggaagacgaggatgaggaagacgactctgaggatgctatcaatgagtttgatttcctgggctcaggagaggatggggaaggggctccagaccctcggcggtgcactgtggatgggagcccccatgagctggaaagccgtcgggtcaaactccaaggcattctggctgacctgcgggatgtggatgggctgcccccaaaagtgactggcccgcctcctggcacaccccagccccggccacatgaagacgtcttcatcatggacactatcgggggcggggaggtgagcctgggggacttggcagatctcaccgtcaccaacgacaacgacctcagctgcgatctgtctgacagcaaagatgcttttaagaagacgtggaaccccaagttcaccctgcgctcgcactacgacggcattcgttccctggccttccaccacagccagtcggctctgctcaccgcctccgaggacggcacgctcaagctctggaacctgcagaaggcggtcacggccaagaagaatgcggcgctagatgtggaacctatacatgctttccgggctcacaggggcccagtgttggctgtggctatgggcagcaacagtgaatactgctacagtggcggggcagatgcctgcatccatagttggaagattccagacctcagcatggatccctatgatggctacgacccaagcgtgctgagccacgtcctggagggccacggggacgccgtgtggggcctggccttcagtcccacctcccagcgcctggcctcctgttctgctgatggcaccgtccgcatctgggaccccagcagcagcagcccggcctgcctctgcaccttccccacagccagcgagcacggggtccccacctcagtggccttcaccagcaccgagcctgcccacatcgtggcctccttccgctctggcgacaccgtcttgtatgacatggaggttggcagtgccctcctcacgctggagtcccggggcagcagcggtccaacccagatcaaccaagtggtgagtcatccaaaccagcctctcaccatcaccgcccacgacgacaggggcatccgcttcctggacaatcggacaggtaagccggtgcactccatggttgcacacctggacgcagtcacctgcctagccgtggaccccaacggcgcattcctgatgtcaggaagccatgactgctccctgcgtctctggagcctggacaacaaaacgtgcgtgcaggagatcacggcccaccgcaagaagcacgaggaggccatccacgctgttgcctgccaccccagcaaggccctcattgccagtgctggcgctgatgccctggccaaggtcttcgtatgatgcccacctggccctgccctggccgccacgctggctggggtgtagggccgggcaggtggggctgaggggactcccagcctcgctggaggtgcagaggcctggcctctgtctgtttgccgtggagcctggtggtgctaacggccatggagggtggagtgggcctcgggtccccctgaactccctgtatatctgtataaataacgggattttcatggcgccgccccacccgcattatcactgtgtgatggtctcagtcagtctcctccctgtctccactctttccctctatttatttcactctcttgtttggttctaccctgcaccctcggtccccttccaggttcctgtttataagccccaacccctctgtccccatcttgtatgtgaaaacttgtctcaataaaccctttggagtaa

SEQ ID NO: 342141 - DNA, 1313 bp, Homo sapiens
taaggatcctgtttcactgcggttgagtgcctctacgctcagtcgggagcaggtcaccagatagtccaacccagatcaaccaagtggtgagtcatccaaaccagcctctcaccatcaccgcccacgacgacaggggcatccgcttcctggacaatcggacaggtaagccggtgcactccatggttgcacacctggacgcagtcacctgcctagccgtggaccccaacggcgcattcctgatgtcaggaagccatgactgctccctgcgtctctggagcctggacaacaaaacgtgcgtgcaggagatcacggcccaccgcaagaagcacgaggaggccatccacgctgttgcctgccaccccagcaaggccctcattgccagtgctggcgctgatgccctggccaaggtcttcgtatgatgcccacctggccctgccctggccgccacgctggctggggtgtagggccgggcaggtggggctgaggggactcccagcctcgctggaggtgcagaggcctggcctctgtctgtttgccgtggagcctggtggtgctaacggccctttccccaggaatccctccccaacggctgccttccccaagcatccagcctggggatgggcccctttcaggaatcacccccgaggatggcctcggggtttccccctgtgccctgacagccgctcctggtatcagagctgctttccagagggcagcacagccagggccgggtgtctttagggatcagtttttccaagactccagaaggtgccaggttctccccttgagctcctgctcccccatcccccatcctcccagacctgggcaggagctgtgctgggagaaagggtggcagccgggagcctcagagctgagccccggcctggctgcccctcccctccggccctctccactgctttccagacactaaccaaggcttccaggccagggattgcccaacactcctagggcagccctcccagcgccccatggggtcgcccatgggtagagacggctttcttgtgcccctccctggggcatggagggtggagtgggcctcgggtccccctgaactccctgtatatctgtataaataacgggattttcatggcgccgccccacccgcattatcactgtgtgatggtctcagtcagtctcctccctgtctccactctttccctctatttatttcactctcttgtttggttctaccctgcaccctcggtccccttccaggttcctgtttataagccccaacccctctgtccccatcttgtatgtgaaaacttgtctcaataaaccctttggagtaa

SEQ ID NO: 342142 - DNA, 410 bp, Homo sapiens
tgtgggaggctctgggagtctctcgtccagtcctttcactctctcaggcgaggcccagagtgggaggggaacctgccacccgcccttctcgcctcaggtaagccggtgcactccatggttgcacacctggacgcagtcacctgcctagccgtggaccccaacggcgcattcctgatgtcaggaagtaagttgagcacactagtcccaccagggttggggagaaggggaggaagaggcctgggcactggctccaggcaagtgctcagggggccccgggggccagggctgggggaggctggtctgggcgggaatgaccgtggtgaccatagggggcagcacagtccgctggggccctcctctgggtcactggagctgcatcgtctcattcggcctctaagcagcctgtgcgg

SEQ ID NO: 342143 - DNA, 263 bp, Homo sapiens
cgaccctgatgactccccactggaatccaccccagagtccaccaggaccaaagaccccgccccggtctctgtccctcactcaggacctgctgcggggcgggccatgagaccagactcgggcttagggaacaccactgtggccccaacctcgaccaggccacaggcccttccttcctgccctgcggcagcacagactttggggtctgtgcagagaggaatcacagaggccccaggctgaggtggtgggggtggaagacccccag

SEQ ID NO: 342144 - DNA, 150 bp, Homo sapiens
gagacggagtctggcattaaattatcttaagagcatgaaccttattgtgaaccacgcatgtgaggatccaggttgtgtactcatgagaatctaactaatgcctgatgatatgaagtggtgcagttttatccacaaatcattccccttctg

SEQ ID NO: 342145 - DNA, 175 bp, Homo sapiens
ccttcttcttaaagtacaggttttactgcagctttgactggggagggtaaagagattggagtaaaagagacttccttggaagtttctttaataattcagaaatttgtgttgacatcacagtagagtagtaagggtggattggagaaacatgtgataggaacagacaggccttaga

SEQ ID NO: 342146 - DNA, 1303 bp, Homo sapiens
ggggagcggcagggatcaccatccaaagggagcggcccccacggcgagctgaccccgacgttctgactgcaggagccctcatccaggctgggctcctgccgggcacggctgtgaccatttctcagggccaggttctcgtccccacacccactgcacagggcaggccaggctggtcttcccactgtggggatgaaggatcctccacaggaggaggagagcagagtccacagacatcccaacagcctcagcctccctgtgcctggccggcccccacagcttccccgtctcctccaggccccacagacactgatgaatggacagagacccccaaaaccagctgccccttgcatgtctgtctccatatgtttggtgacagcagtgaaaatgttattagttttgagggggtttgggaagcccagcggtacctgaggagtttctggacatttaagccggttcctaggtgtggccttaacagggaggctgcccttcctttcactgaatgagctgcgtcactcataagctcactgagggaaccccatctgccagctcgtgcgtgctcagacgacgtccatgtctcaagcgttctgtgaaggctgcggtgcagcgtgaggtcaccctgctgtgttcagagctttgctcactgcctgcggggctggaccgttgcacctccagggcccccagaaaccgagtttcgggtcagggtcctctgtgtgcattcctgggggtccatgtaccagctgtgacgacgtccaggggttgggctgagaagcagacacccttggggaaactggctctgtccctcccctcccccatcccaggagctgaggtcttggtgaggccacagggccaggtccacgcaaggactgtccgtgtcctgtcctgtggtctctggccccacgtgacacccacacgtgtggtaggcagcctggcctgggttgtggctatggccaggcccccaagctgtccccgatgcccagggctggtgaccacccaggcaggtgggggccccacttggtaacagagtcatagggcagaacccacctgggctgccacagaaggtctggctgcccctgtgcccactgctccccaccatggccaatcagaagagtcaggggctcctggtctttccgggagggacgtggcccagccagctctaggtgttctgagcagctctgggacccagcgattgaggggtcaggctgggggtgtcagagccagggtcctccttaagtacctcccacactacacagacagcccctgagctctggagcaagccctgacccaataaaggctttgaacccaa

SEQ ID NO: 342147 - DNA, 1217 bp, Homo sapiens
ggggagcggcagggatcaccatccaaagggagcggcccccacggcgagctgaccccgacgttctgactgcaggagccctcatccaggctgggctcctgccgggcacggctgtgaccatttctcagggccaggttctcgtccccacacccactgcacagggcaggccaggctggtcttcccactgtggggatgaaggatcctccacaggaggaggagagcagagtccacagacatcccaacagcctcagcctccctgtgcctggccggcccccacagcttccccgtctcctccaggccccacagacactgatgaatggacagagacccccaaaaccagctgccccttgcatgtctgtctccatatgtttggtgacagcagtgaaaatgttattagttttgagggggtttgggaagcccagcggtacctgaggagtttctggacatttaagccggttcctaggtgtggccttaacagggaggctgcccttcctttcactgaatgagctgcgtcactcataagctcactgagggaaccccatctgccagctcgtgcgtgctcagacgacgtccatgtctcaagcgttctgtgaaggctgcggtgcagcgtgaggtcaccctgctgtgttcagagctttgctcactgcctgcggggctggaccgttgcacctccagggcccccagaaaccgagtttcgggtcagggtcctctgtgtgcattcctgggggtccatgtaccagctgtgacgacgtccaggggttgggctgagaagcagacacccttggggaaactggctctgtccctcccctcccccatcccaggagctgaggtcttggtgaggccacagggccaggtccacgcaaggactgtccgtgtcctgtcctgtggtctctggccccacgtgacacccacacgtgtggtaggcagcctggcctgggttgtggctatggccaggcccccaagctgtccccgatgcccagggctggtgaccacccaggcaggtgggggccccacttggtaacagagtcatagggcagaacccacctgggctgccacagaaggtctggctgcccctgtgcccactgctccccaccatggccaatcagaagagtcaggggctcctggtctttccgggagggacgtggcccagccagctctaggtgttctgaggcccctgagctctggagcaagccctgacccaataaaggctttgaacccaa

SEQ ID NO: 342148 - DNA, 1077 bp, Homo sapiens
  misc_feature (888)..(888): n is a, c, g, or t
  misc_feature (890)..(890): n is a, c, g, or t
  misc_feature (894)..(894): n is a, c, g, or t
  misc_feature (947)..(947): n is a, c, g, or t
  misc_feature (955)..(955): n is a, c, g, or t
  misc_feature (977)..(977): n is a, c, g, or t
  misc_feature (1075)..(1075): n is a, c, g, or t
ctgagcgaccgcggacctcctcgggacaggacttcagggccacaggtgctgccaagatgctccagggcacctgctccgtgctcctgctctggggaatcctgggggccatccaggcccagcagcaggaggtcatctcgccggacactaccgagagaaacaacaactgcccagagaagaccgactgccccatccacgtgtacttcgtgctggacacctcggagagcgtcaccatgcagtcccccacggacatcctgctcttccacatgaagcagttcgtgccgcagttcatcagccagctgcagaacgagttctacctggaccaggtggcgctgagctggcgctacggcggcctgcacttctctgaccaggtggaggtgttcagcccaccgggcagcgaccgggcctccttcatcaagaacctgcagggcatcagctccttccgccgcggcaccttcaccgactgcgcgctggccaacatgacggagcagatccggcaggaccgcagcaagggcaccgtccacttcgccgtggtcatcaccgacggccacgtcaccggcagcccctgcgggggcatcaagctgcaggccgagcgggcccgcgaggagggcatccggctcttcgccgtggcccccaaccagaacctgaaggagcagggcctgcgggacatcgccagcacgccgcacgagctctaccgcaacgactacgccaccatgctgcccgactccaccgagatcgaccaggacaccatcaaccgcatcatcaaggtcatgaaacacgaagcctacggagagtgctacaaggtgagctgcctggaatccctgggcctctggcccaaggctacgtggacagaaggtgcaagggcacatgggtgagcgggagagctggcanangganacaggagaccgggcatcgaagcccattggattccaggaccaaggcgttctggntcaaaganaaaggtgatttgagcgacgtcncaggtggcctgcttgctgcaaacggacgatgaaaaggcactgggcatgactctgttcaggaacttgaacgggccgaggtacggggagaggatcagganag

SEQ ID NO: 342149 - DNA, 3090 bp, Homo sapiens
acaggatcttatgatgcctgcaggtcttgatgaaggatgccggtcgctgccggtggctgaacacctccacctggtcagagaagtgcaggcccgcgtagcgccagctcagcgccacctggtccaggtagaactcgttctgcagctggctgatgaactgcggcaccttcaccgactgcgcgctggccaacatgacggagcagatccggcaggaccgcagcaagggcaccgtccacttcgccgtggtcatcaccgacggccacgtcaccggcagcccctgcggggggcatccggctcttcgccgtggcccccaaccagaacctgaaggagcagggcctgcgggacatcgccagcacgccgcacgagctctaccgcaacgactacgccaccatgctgcccgactccaccgagatcgaccaggacaccatcaaccgcatcatcaaggtcatgaaacacgaagcctacggagagtgctacaaggtgagctgcctggaaatccctgggccctctggccccaagggctaccgtggacagaagggtgccaagggcaacatgggtgagccgggagagcctggccagaagggaagacagggagacccgggcatcgaaggccccattggattcccaggacccaagggcgttcctggcttcaaaggagagaagggtgaatttggagccgacggtcgcaagggggcccctggcctggctggcaagaacgggaccgatggacagaagggcaagctggggcgcatcggacctcctggctgcaagggagaccctggaaaccggggccccgacggttacccgggggaagcagggagtccaggggagcgaggagaccaaggcggcaagggggaccctggccgcccaggacgcagagggcccccgggagaaatcggggccaagggaagcaaggggtatcaaggcaacaatggagccccaggaagtcctggtgtgaaaggagccaagggcgggcctgggccccgcggacccaaaggcgagccggggcgcaggggagaccccggcaccaagggcagcccaggcagcgatggccccaagggggagaagggggaccctggccctgaggggccccgcggcctggctggagaggttggcaacaaaggagccaagggagaccgaggcttgcctggacccagaggcccccagggagctcttggggagcccggaaagcagggatctcggggagaccccggtgatgcaggaccccgtggagactcaggacagccaggccccaagggagaccccggcaggcctggattcagctacccaggaccccgaggagcacccggagaaaaaggcgagcccggcccacgcggccccgagggaggccgaggcgactttggcttgaaaggagaacctgggaggaaaggagagaaaggagagcctgcggatcctggtccccctggtgagccaggccctcgggggccaagaggagtcccaggacccgagggtgagcccggcccccctggagaccccggtctcacggagtgtgacgtcatgacctacgtgagggagacctgcgggtgctgcgactgtgagaagcgctgtggcgccctggacgtggtcttcgtcatcgacagctccgagagcattgggtacaccaacttcacactggagaagaacttcgtcatcaacgtggtcaacaggctgggtgccatcgctaaggaccccaagtccgagacagggacgcgtgtgggcgtggtgcagtacagccacgagggcacctttgaggccatccagctggacgacgaacgtatcgactccctgtcgagcttcaaggaggctgtcaagaacctcgagtggattgcgggcggcacctggacaccctcagccctcaagtttgcctacgaccgcctcatcaaggagagccggcgccagaagacacgtgtgtttgcggtggtcatcacggacgggcgccacgaccctcgggacgatgacctcaacttgcgggcgctgtgcgaccgcgacgtcacagtgacggccatcggcatcggggacatgttccacgagaagcacgagagtgaaaacctctactccatcgcctgcgacaagccacagcaggtgcgcaacatgacgctgttctccgacctggtcgctgagaagttcatcgatgacatggaggacgtcctctgcccggaccctcagatcgtgtgcccagaccttccctgccaaacagagctgtccgtggcacagtgcacgcagcggcccgtggacatcgtcttcctgctggacggctccgagcggctgggtgagcagaacttccacaaggcccggcgcttcgtggagcaggtggcgcggcggctgacgctggcccggagggacgacgaccctctcaacgcacgcgtggcgctgctgcagtttggtggccccggcgagcagcaggtggccttcccgctgagccacaacctcacggccatccacgaggcgctggagaccacacaatacctgaactccttctcgcacgtgggcgcaggcgtggtgcacgccatcaatgccatcgtgcgcagcccgcgtggcggggcccggaggcacgcagagctgtccttcgtgttcctcacggacggcgtcacgggcaacgacagtctgcacgagtcggcgcactccatgcgcaagcagaacgtggtacccaccgtgctggccttgggcagcgacgtggacatggacgtgctcaccacgctcagcctgggtgaccgcgccgccgtgttccacgagaaggactatgacagcctggcgcaacccggcttcttcgaccgcttcatccgctggatctgctagcgccgccgcccgggccccgcagtcgagggtcgtgagcccaccccgtccatggtgctaagcgggcccgggtcccacacggccagcaccgctgctcactcggacgacgccctgggcctgcacctctccagctcctcccacggggtccccgtagccccggcccccgcccagccccaggtctccccaggccctccgcaggctgcccggcctccctccccctgcagccatcccaaggctcctgacctacctggcccctgagctctggagcaagccctgacccaataaaggctttgaacccaa

SEQ ID NO: 342150 - DNA, 3546 bp, Homo sapiens
  misc_feature (2033)..(2033): n is a, c, g, or t
  misc_feature (2037)..(2037): n is a, c, g, or t
ccatgttgccgcaacatgctcgggagcggagcctcctcgggaccaggacttcagggccacaggtgctgccaagatgctccagggcacctgctccgtgctcctgctctggggaatcctgggggccatccaggcccagcagcaggaggtcatctcgccggacactaccgagagaaacaacaactgcccagagaagaccgactgccccatccacgtgtacttcgtgctggacacctcggagagcgtcaccatgcagtcccccacggacatcctgctcttccacatgaagcagttcgtgccgcagttcatcagccagctgcagaacgagttctacctggaccaggtggcgctgagctggcgctacggcggcctgcacttctctgaccaggtggaggtgttcagcccaccgggcagcgaccgggcctccttcatcaagaacctgcagggcatcagctccttccgccgcggcaccttcaccgactgcgcgctggccaacatgacggagcagatccggcaggaccgcagcaagggcaccgtccacttcgccgtggtcatcaccgacggccacgtcaccggcagcccctgcgggggcatcaagctgcaggccgagcgggcccgcgaggagggcatccggctcttcgccgtggcccccaaccagaacctgaaggagcagggcctgcgggacatcgccagcacgccgcacgagctctaccgcaacgactacgccaccatgctgcccgactccaccgagatcgaccaggacaccatcaaccgcatcatcaaggtcatgaaacacgaagcctacggagagtgctacaaggtgagctgcctggaaatccctgggccctctggccccaagggctaccgtggacagaagggtgccaagggcaacatgggtgagccgggagagcctggccagaagggaagacagggagacccgggcatcgaaggccccattggattcccaggacccaagggcgttcctggcttcaaaggagagaagggtgaatttggagccgacggtcgcaagggggcccctggcctggctggcaagaacgggaccgatggacagaagggcaagctggggcgcatcggacctcctggctgcaagggagaccctggaaaccggggccccgacggttacccgggggaagcagggagtccaggggagcgaggagaccaaggcggcaagggggaccctggccgcccaggacgcagagggcccccgggagaaatcggggccaagggaagcaaggggtatcaaggcaacaatggagccccaggaagtcctggtgtgaaaggagccaagggcgggcctgggccccgcggacccaaaggcgagccggggcgcaggggagaccccggcaccaagggcagcccaggcagcgatggccccaagggggagaagggggaccctggccctgaggggccccgcggcctggctggagaggttggcaacaaaggagccaagggagaccgaggcttgcctggacccagaggcccccagggagctcttggggagcccggaaagcagggatctcggggagaccccggtgatgcaggaccccgtggagactcaggacagccaggccccaagggagaccccggcaggcctggattcagctacccaggaccccgaggagcacccggagaaaaaggcgagcccggcccacgcggccccgagggaggccgaggcgactttggcttgaaaggagaacctgggaggaaaggagagaaaggagagcctgcggatcctggtccccctggtgagccaggccctcgggggccaagaggagtcccaggacccgagggtgagcccggcccccctggagaccccggtctcacggagtgtgacgtcatgacctacgtgagggagacctgcgggtgctgcgctccgagagcattgggtacaccaacttcacactggagaagaacttcgtcatcaacgtggtcaacaggctgggtgccatcgctaaggaccccaagtccgagacaggtcagcggggcagggcgggtgcagcattgcggggggccgngggngcgtgggaggcgatgagatgggagaagtccagacgcgtccctccaacgagggcctctgcatggctggggatgccccagaccccgaggcctctggcaacgacctcacgcgtgcggcttgcagggacgcgtgtgggcgtggtgcagtacagccacgagggcacctttgaggccatccagctggacgacgaacgtatcgactccctgtcgagcttcaaggaggctgtcaagaacctcgagtggattgcgggcggcacctggacaccctcagccctcaagtttgcctacgaccgcctcatcaaggagagccggcgccagaagacacgtgtgtttgcggtggtcatcacggacgggcgccacgaccctcgggacgatgacctcaacttgcgggcgctgtgcgaccgcgacgtcacagtgacggccatcggcatcggggacatgttccacgagaagcacgagagtgaaaacctctactccatcgcctgcgacaagccacagcaggtgcgcaacatgacgctgttctccgacctggtcgctgagaagttcatcgatgacatggaggacgtcctctgcccggaccctcagatcgtgtgcccagaccttccctgccaaacagagctgtccgtggcacagtgcacgcagcggcccgtggacatcgtcttcctgctggacggctccgagcggctgggtgagcagaacttccacaaggcccggcgcttcgtggagcaggtggcgcggcggctgacgctggcccggagggacgacgaccctctcaacgcacgcgtggcgctgctgcagtttggtggccccggcgagcagcaggtggccttcccgctgagccacaacctcacggccatccacgaggcgctggagaccacacaatacctgaactccttctcgcacgtgggcgcaggcgtggtgcacgccatcaatgccatcgtgcgcagcccgcgtggcggggcccggaggcacgcagagctgtccttcgtgttcctcacggacggcgtcacgggcaacgacagtctgcacgagtcggcgcactccatgcgcaagcagaacgtggtacccaccgtgctggccttgggcagcgacgtggacatggacgtgctcaccacgctcagcctgggtgaccgcgccgccgtgttccacgagaaggactatgacagcctggcgcaacccggcttcttcgaccgcttcatccgctggatctgctagcgccgccgcccgggccccgcagtcgagggtcgtgagcccaccccgtccatggtgctaagcgggcccgggtcccacacggccagcaccgctgctcactcggacgacgccctgggcctgcacctctccagctcctcccacggggtccccgtagccccggcccccgcccagccccaggtctccccaggccctccgcaggctgcccggcctccctccccctgcagccatcccaaggctcctgacctacctggcccctgagctctggagcaagccctgacccaataaaggctttgaacccaa

SEQ ID NO: 342151 - DNA, 1651 bp, Homo sapiens
gtgacgcgtgggcggactgctgtggggtggtgagcccggaccccctggagaccccggtctcacggagtgtgacgtcatgacctacgtgagggagacctgcgggtgctgcgactgtgagaagcgctgtggcgccctggacgtggtcttcgtcatcgacagctccgagagcattgggtacaccaacttcacactggagaagaacttcgtcatcaacgtggtcaacaggctgggtgccatcgctaaggaccccaagtccgagacagggacgcgtgtgggcgtggtgcagtacagccacgagggcacctttgaggccatccagctggacgacgaacgtatcgactccctgtcgagcttcaaggaggctgtcaagaacctcgagtggattgcgggcggcacctggacaccctcagccctcaagtttgcctacgaccgcctcatcaaggagagccggcgccagaagacacgtgtgtttgcggtggtcatcacggacgggcgccacgaccctcgggacgatgacctcaacttgcgggcgctgtgcgaccgcgacgtcacagtgacggccatcggcatcggggacatgttccacgagaagcacgagagtgaaaacctctactccatcgcctgcgacaagccacagcaggtgcgcaacatgacgctgttctccgacctggtcgctgagaagttcatcgatgacatggaggacgtcctctgcccggaccctcagatcgtgtgcccagaccttccctgccaaacagagctgtccgtggcacagtgcacgcagcggcccgtggacatcgtcttcctgctggacggctccgagcggctgggtgagcagaacttccacaaggcccggcgcttcgtggagcaggtggcgcggcggctgacgctggcccggagggacgacgaccctctcaacgcacgcgtggcgctgctgcagtttggtggccccggcgagcagcaggtggccttcccgctgagccacaacctcacggccatccacgaggcgctggagaccacacaatacctgaactccttctcgcacgtgggcgcaggcgtggtgcacgccatcaatgccatcgtgcgcagcccgcgtggcggggcccggaggcacgcagagctgtccttcgtgttcctcacggacggcgtcacgggcaacgacagtctgcacgagtcggcgcactccatgcgcaagcagaacgtggtacccaccgtgctggccttgggcagcgacgtggacatggacgtgctcaccacgctcagcctgggtgaccgcgccgccgtgttccacgagaaggactatgacagcctggcgcaacccggcttcttcgaccgcttcatccgctggatctgctagcgccgccgcccgggccccgcagtcgagggtcgtgagcccaccccgtccatggtgctaagcgggcccgggtcccacacggccagcaccgctgctcactcggacgacgccctgggcctgcacctctccagctcctcccacggggtccccgtagccccggcccccgcccagccccaggtctccccaggccctccgcaggctgcccggcctccctccccctgcagccatcccaaggctcctgacctacctggcccctgagctctggagcaagccctgacccaataaaggctttgaacccaa

SEQ ID NO: 342152 - DNA, 3455 bp, Homo sapiens
  misc_feature (3437)..(3437): n is a, c, g, or t
ccatgttgccgcaacatgctcgggagcggagcctcctcgggaccaggacttcagggccacaggtgctgccaagatgctccagggcacctgctccgtgctcctgctctggggaatcctgggggccatccaggcccagcagcaggaggtcatctcgccggacactaccgagagaaacaacaactgcccagagaagaccgactgccccatccacgtgtacttcgtgctggacacctcggagagcgtcaccatgcagtcccccacggacatcctgctcttccacatgaagcagttcgtgccgcagttcatcagccagctgcagaacgagttctacctggaccaggtggcgctgagctggcgctacggcggcctgcacttctctgaccaggtggaggtgttcagcccaccgggcagcgaccgggcctccttcatcaagaacctgcagggcatcagctccttccgccgcggcaccttcaccgactgcgcgctggccaacatgacggagcagatccggcaggaccgcagcaagggcaccgtccacttcgccgtggtcatcaccgacggccacgtcaccggcagcccctgcgggggcatcaagctgcaggccgagcgggcccgcgaggagggcatccggctcttcgccgtggcccccaaccagaacctgaaggagcagggcctgcgggacatcgccagcacgccgcacgagctctaccgcaacgactacgccaccatgctgcccgactccaccgagatcgaccaggacaccatcaaccgcatcatcaaggtcatgaaacacgaagcctacggagagtgctacaaggtgagctgcctggaaatccctgggccctctggccccaagggctaccgtggacagaagggtgccaagggcaacatgggtgagccgggagagcctggccagaagggaagacagggagacccgggcatcgaaggccccattggattcccaggacccaagggcgttcctggcttcaaaggagagaagggtgaatttggagccgacggtcgcaagggggcccctggcctggctggcaagaacgggaccgatggacagaagggcaagctggggcgcatcggacctcctggctgcaagggagaccctggaaaccggggccccgacggttacccgggggaagcagggagtccaggggagcgaggagaccaaggcggcaagggggaccctggccgcccaggacgcagagggcccccgggagaaatcggggccaagggaagcaaggggtatcaaggcaacaatggagccccaggaagtcctggtgtgaaaggagccaagggcgggcctgggccccgcggacccaaaggcgagccggggcgcaggggagaccccggcaccaagggcagcccaggcagcgatggccccaagggggagaagggggaccctggccctgaggggccccgcggcctggctggagaggttggcaacaaaggagccaagggagaccgaggcttgcctggacccagaggcccccagggagctcttggggagcccggaaagcagggatctcggggagaccccggtgatgcaggaccccgtggagactcaggacagccaggccccaagggagaccccggcaggcctggattcagctacccaggaccccgaggagcacccggagaaaaaggcgagcccggcccacgcggccccgagggaggccgaggcgactttggcttgaaaggagaacctgggaggaaaggagagaaaggagagcctgcggatcctggtccccctggtgagccaggccctcgggggccaagaggagtcccaggacccgagggtgagcccggcccccctggagaccccggtctcacggagtgtgacgtcatgacctacgtgagggagacctgcgggtgctgcgactgtgagaagcgctgtggcgccctggacgtggtcttcgtcatcgacagctccgagagcattgggtacaccaacttcacactggagaagaacttcgtcatcaacgtggtcaacaggctgggtgccatcgctaaggaccccaagtccgagacagggacgcgtgtgggcgtggtgcagtacagccacgagggcacctttgaggccatccagctggacgacgaacgtatcgactccctgtcgagcttcaaggaggctgtcaagaacctcgagtggattgcgggcggcacctggacaccctcagccctcaagtttgcctacgaccgcctcatcaaggagagccggcgccagaagacacgtgtgtttgcggtggtcatcacggacgggcgccacgaccctcgggacgatgacctcaacttgcgggcgctgtgcgaccgcgacgtcacagtgacggccatcggcatcggggacatgttccacgagaagcacgagagtgaaaacctctactccatcgcctgcgacaagccacagcaggtgcgcaacatgacgctgttctccgacctggtcgctgagaagttcatcgatgacatggaggacgtcctctgcccggaccctcagatcgtgtgcccagaccttccctgccaaacagagctgtccgtggcacagtgcacgcagcggcccgtggacatcgtcttcctgctggacggctccgagcggctgggtgagcagaacttccacaaggcccggcgcttcgtggagcaggtggcgcggcggctgacgctggcccggagggacgacgaccctctcaacgcacgcgtggcgctgctgcagtttggtggccccggcgagcagcaggtggccttcccgctgagccacaacctcacggccatccacgaggcgctggagaccacacaatacctgaactccttctcgcacgtgggcgcaggcgtggtgcacgccatcaatgccatcgtgcgcagcccgcgtggcggggcccggaggcacgcagagctgtccttcgtgttcctcacggacggcgtcacgggcaacgacagtctgcacgagtcggcgcactccatgcgcaagcagaacgtggtacccaccgtgctggccttgggcagcgacgtggacatggacgtgctcaccacgctcagcctgggtgaccgcgccgccgtgttccacgagaaggactatgacagcctggcgcaacccggcttcttcgaccgcttcatccgctggatctgctagcgccgccgcccgggccccgcagtcgagggtcgtgagcccaccccgtccatggtgctaagcgggcccgggtcccacacggccagcaccgctgctcactcggacgacgccctgggcctgcacctctccagctcctcccacggggtccccgtagccccggcccccgcccagccccaggtctccccaggccctccgcaggctgcccggcctccctccccctgcagccatcccaaggctcctgacctacctggcccctgagctctggagcaagccctgacccaataaaggctttgaacccaaaaaaaanaacaaaaaagggcggccg

SEQ ID NO: 342153 - DNA, 865 bp, Homo sapiens
  misc_feature (4)..(4): n is a, c, g, or t
  misc_feature (9)..(9): n is a, c, g, or t
  misc_feature (21)..(21): n is a, c, g, or t
gaangtaantctagaggatcncgaacgggtgatgcggctgggtgagcagaacttccacaaggcccggcgcttcgtggagcaggtggcgcggcggctgacgctggcccggagggacgacgaccctctcaacgcacgcgtggcgctgctgcagtttggtggccccggcgagcagcaggtggccttcccgctgagccacaacctcacggccatccacgaggcgctggagaccacacaatacctgaactccttctcgcacgtgggcgcaggcgtggtgcacgccatcaatgccatcgtgcgcagcccgcgtggcggggcccggaggcacgcagagctgtccttcgtgttcctcacggacggcgtcacgggcaacgacagtctgcacgagtcggcgcactccatgcgcaagcagaacgtggtacccaccgtgctggccttgggcagcgacgtggacatggacgtgctcaccacgctcagcctgggtgaccgcgccgccgtgttccacgagaaggactatgacagcctggcgcaacccggcttcttcgaccgcttcatccgctggatctgctagcgccgccgcccgggccccgcagtcgagggtcgtgagcccaccccgtccatggtgctaagcgggcccgggtcccacacggccagcaccgctgctcactcggacgacgccctgggcctgcacctctccagctcctcccacggggtccccgtagccccggcccccgcccagccccaggtctccccaggccctccgcaggctgcccggcctccctccccctgcagccatcccaaggctcctgacctacctggcccctgagctctggagcaagccctgacccaataaaggctttgaacccaa

SEQ ID NO: 342154 - DNA, 3798 bp, Homo sapiens
ccatgttgccgcaacatgctcgggagcggagcctcctcgggaccaggacttcagggccacaggtgctgccaagatgctccagggcacctgctccgtgctcctgctctggggaatcctgggggccatccaggcccagcagcaggaggtcatctcgccggacactaccgagagaaacaacaactgcccagagaagaccgactgccccatccacgtgtacttcgtgctggacacctcggagagcgtcaccatgcagtcccccacggacatcctgctcttccacatgaagcagttcgtgccgcagttcatcagccagctgcagaacgagttctacctggaccaggtggcgctgagctggcgctacggcggcctgcacttctctgaccaggtggaggtgttcagcccaccgggcagcgaccgggcctccttcatcaagaacctgcagggcatcagctccttccgccgcggcaccttcaccgactgcgcgctggccaacatgacggagcagatccggcaggaccgcagcaagggcaccgtccacttcgccgtggtcatcaccgacggccacgtcaccggcagcccctgcgggggcatcaagctgcaggccgagcgggcccgcgaggagggcatccggctcttcgccgtggcccccaaccagaacctgaaggagcagggcctgcgggacatcgccagcacgccgcacgagctctaccgcaacgactacgccaccatgctgcccgactccaccgagatcgaccaggacaccatcaaccgcatcatcaaggtcatgaaacacgaagcctacggagagtgctacaaggtgagctgcctggaaatccctgggccctctggccccaagggctaccgtggacagaagggtgccaagggcaacatgggtgagccgggagagcctggccagaagggaagacagggagacccgggcatcgaaggccccattggattcccaggacccaagggcgttcctggcttcaaaggagagaagggtgaatttggagccgacggtcgcaagggggcccctggcctggctggcaagaacgggaccgatggacagaagggcaagctggggcgcatcggacctcctggctgcaagggagaccctggaaaccggggccccgacggttacccgggggaagcagggagtccaggggagcgaggagaccaaggcggcaagggggaccctggccgcccaggacgcagagggcccccgggagaaatcggggccaagggaagcaaggggtatcaaggcaacaatggagccccaggaagtcctggtgtgaaaggagccaagggcgggcctgggccccgcggacccaaaggcgagccggggcgcaggggagaccccggcaccaagggcagcccaggcagcgatggccccaagggggagaagggggaccctggccctgaggggccccgcggcctggctggagaggttggcaacaaaggagccaagggagaccgaggcttgcctggacccagaggcccccagggagctcttggggagcccggaaagcagggatctcggggagaccccggtgatgcaggaccccgtggagactcaggacagccaggccccaagggagaccccggcaggcctggattcagctacccaggaccccgaggagcacccggagaaaaaggcgagcccggcccacgcggccccgagggaggccgaggcgactttggcttgaaaggagaacctgggaggaaaggagagaaaggagagcctgcggatcctggtccccctggtgagccaggccctcgggggccaagaggagtcccaggacccgagggtgagcccggcccccctggagaccccggtctcacggagtgtgacgtcatgacctacgtgagggagacctgcgggtgctgcgactgtgagaagcgctgtggcgccctggacgtggtcttcgtcatcgacagctccgagagcattgggtacaccaacttcacactggagaagaacttcgtcatcaacgtggtcaacaggctgggtgccatcgctaaggaccccaagtccgagacagggacgcgtgtgggcgtggtgcagtacagccacgagggcacctttgaggccatccagctggacgacgaacgtatcgactccctgtcgagcttcaaggaggctgtcaagaacctcgagtggattgcgggcggcacctggacaccctcagccctcaagtttgcctacgaccgcctcatcaaggagagccggcgccagaagacacgtgtgtttgcggtggtcatcacggacgggcgccacgaccctcgggacgatgacctcaacttgcgggcgctgtgcgaccgcgacgtcacagtgacggccatcggcatcggggacatgttccacgagaagcacgagagtgaaaacctctactccatcgcctgcgacaagccacagcaggtgcgcaacatgacgctgttctccgacctggtcgctgagaagttcatcgatgacatggaggacgtcctctgcccggaccctcagatcgtgtgcccagaccttccctgccaaacagagctgtccgtggcacagtgcacgcagcggcccgtggacatcgtcttcctgctggacggctccgagcggctgggtgagcagaacttccacaaggcccggcgcttcgtggagcaggtggcgcggcggctgacgctggcccggagggacgacgaccctctcaacgcacgcgtggcgctgctgcagtttggtggccccggcgagcagcaggtggccttcccgctgagccacaacctcacggccatccacgaggcgctggagaccacacaatacctgaactccttctcgcacgtgggcgcaggcgtggtgcacgccatcaatgccatcgtgcgcagcccgcgtggcggggcccggaggcacgcagagctgtccttcgtgttcctcacggacggcgtcacgggcaacgacagtctgcacgagtcggcgcactccatgcgcaagcagaacgtggtacccaccgtgctggccttgggcagcgacgtggacatggacgtgctcaccacgctcagcctgggtgaccgcgccgccgtgttccacgagaaggactatgacagcctggcgcaacccggcttcttcgaccgcttcatccgctggatctgctagcgccgccgcccgggccccgcagtcgagggtcgtgagcccaccccgtccatggtgctaagcgggcccgggtcccacacggccagcaccgctgctcactcggacgacgccctgggcctgcacctctccagctcctcccacggggtccccgtagccccggcccccgcccagccccaggtctccccaggccctccgcaggctgcccggcctccctccccctgcagccatcccaaggctcctgacctacctggcccctgagctctggagcaagccctgacccaataaaggctttgaacccaaaaacacaaaacaaacaaaaaacaaacaaaaaacaaaaaacaaaacaaaaaacaaaaaaacaaaacaaacaaaacaaaaaagaaggggggccccaccaaacaacccccccaaggggccaccacacacaataagcaaccagacacacacaaagattattatatagaagaacagcaagggtgctccccacaaagagagaggcacacacaaatataatatataacaaaccagaagcatacggaggcccgctactcataatacaaaataacagcagacgaagacaaactgagaacaaaacagacccagcgacgacaagtagaaggaataataatttggaaaacagcaaaaaccacaacaaaaaccaatagaaa

SEQ ID NO: 342155 - DNA, 3579 bp, Homo sapiens
ccatgttgccgcaacatgctcgggagcggagcctcctcgggaccaggacttcagggccacaggtgctgccaagatgctccagggcacctgctccgtgctcctgctctggggaatcctgggggccatccaggcccagcagcaggaggtcatctcgccggacactaccgagagaaacaacaactgcccagagaagaccgactgccccatccacgtgtacttcgtgctggacacctcggagagcgtcaccatgcagtcccccacggacatcctgctcttccacatgaagcagttcgtgccgcagttcatcagccagctgcagaacgagttctacctggaccaggtggcgctgagctggcgctacggcggcctgcacttctctgaccaggtggaggtgttcagcccaccgggcagcgaccgggcctccttcatcaagaacctgcagggcatcagctccttccgccgcggcaccttcaccgactgcgcgctggccaacatgacggagcagatccggcaggaccgcagcaagggcaccgtccacttcgccgtggtcatcaccgacggccacgtcaccggcagcccctgcgggggcatcaagctgcaggccgagcgggcccgcgaggagggcatccggctcttcgccgtggcccccaaccagaacctgaaggagcagggcctgcgggacatcgccagcacgccgcacgagctctaccgcaacgactacgccaccatgctgcccgactccaccgagatcgaccaggacaccatcaaccgcatcatcaaggtcatgaaacacgaagcctacggagagtgctacaaggtgagctgcctggaaatccctgggccctctggccccaagggctaccgtggacagaagggtgccaagggcaacatgggtgagccgggagagcctggccagaagggaagacagggagacccgggcatcgaaggccccattggattcccaggacccaagggcgttcctggcttcaaaggagagaagggtgaatttggagccgacggtcgcaagggggcccctggcctggctggcaagaacgggaccgatggacagaagggcaagctggggcgcatcggacctcctggctgcaagggagaccctggaaaccggggccccgacggttacccgggggaagcagggagtccaggggagcgaggagaccaaggcggcaagggggaccctggccgcccaggacgcagagggcccccgggagaaatcggggccaagggaagcaaggggtatcaaggcaacaatggagccccaggaagtcctggtgtgaaaggagccaagggcgggcctgggccccgcggacccaaaggcgagccggggcgcaggggagaccccggcaccaagggcagcccaggcagcgatggccccaagggggagaagggggaccctggccctgaggggccccgcggcctggctggagaggttggcaacaaaggagccaagggagaccgaggcttgcctggacccagaggcccccagggagctcttggggagcccggaaagcagggatctcggggagaccccggtgatgcaggaccccgtggagactcaggacagccaggccccaagggagaccccggcaggcctggattcagctacccaggaccccgaggagcacccggagaaaaaggcgagcccggcccacgcggccccgagggaggccgaggcgactttggcttgaaaggagaacctgggaggaaaggagagaaaggagagcctgcggatcctggtccccctggtgagccaggccctcgggggccaagaggagtcccaggacccgagggtgagcccggcccccctggagaccccggtctcacggagtgtgacgtcatgacctacgtgagggagacctgcgggtgctgcgactgtgagaagcgctgtggcgccctggacgtggtcttcgtcatcgacagctccgagagcattgggtacaccaacttcacactggagaagaacttcgtcatcaacgtggtcaacaggctgggtgccatcgctaaggaccccaagtccgagacagggacgcgtgtgggcgtggtgcagtacagccacgagggcacctttgaggccatccagctggacgacgaacgtatcgactccctgtcgagcttcaaggaggctgtcaagaacctcgagtggattgcgggcggcacctggacaccctcagccctcaagtttgcctacgaccgcctcatcaaggagagccggcgccagaagacacgtgtgtttgcggtggtcatcacggacgggcgccacgaccctcgggacgatgacctcaacttgcgggcgctgtgcgaccgcgacgtcacagtgacggccatcggcatcggggacatgttccacgagaagcacgagagtgaaaacctctactccatcgcctgcgacaagccacagcaggtgcgcaacatgacgctgttctccgacctggtcgctgagaagttcatcgatgacatggaggacgtcctctgcccggaccctcagatcgtgtgcccagaccttccctgccaaacagagctgtccgtggcacagtgcacgcagcggcccgtggacatcgtcttcctgctggacggctccgagcggctgggtgagcagaacttccacaaggcccggcgcttcgtggagcaggtggcgcggcggctgacgctggcccggagggacgacgaccctctcaacgcacgcgtggcgctgctgcagtttggtggccccggcgagcagcaggtggccttcccgctgagccacaacctcacggccatccacgaggcgctggagaccacacaatacctgaactccttctcgcacgtgggcgcaggcgtggtgcacgccatcaatgccatcgtgcgcagcccgcgtggcggggcccggaggcacgcagagctgtccttcgtgttcctcacggacggcgtcacgggcaacgacagtctgcacgagtcggcgcactccatgcgcaagcagaacgtggtacccaccgtgctggccttgggcagcgacgtggacatggacgtgctcaccacgctcagcctgggtgaccgcgccgccgtgttccacgagaaggactatgacagcctggcgcaacccggcttcttcgaccgcttcatccgctggatctgctagcgccgccgcccgggccccgcagtcgagggtcgtgagcccaccccgtccatggtgctaagcgggcccgggtcccacacggccagcaccgctgctcactcggacgacgccctgggcctgcacctctccagctcctcccacggggtccccgtagccccggcccccgcccagccccaggtctccccaggccctccgcaggctgcccggcctccctccccctgcagccatcccaaggctcctgacctacctggcccctgagctctggagcaagccctgacccaataaaggctttgaacccaattgcgtgccgcttgcgagcttctgtgcgcaggagagacctcaaaggtgtcttgtggccaggagggaaacactgcagctgtcgctcgcccaccagggtcaatggctcccccgggcccagcctgacctcctaggacatcaactgcaggtgc

SEQ ID NO: 342156 - DNA, 3439 bp, Homo sapiens
  misc_feature (3414)..(3414): n is a, c, g, or t
  misc_feature (3421)..(3421): n is a, c, g, or t
  misc_feature (3427)..(3427): n is a, c, g, or t
  misc_feature (3435)..(3435): n is a, c, g, or t
ccatgttgccgcaacatgctcgggagcggagcctcctcgggaccaggacttcagggccacaggtgctgccaagatgctccagggcacctgctccgtgctcctgctctggggaatcctgggggccatccaggcccagcagcaggaggtcatctcgccggacactaccgagagaaacaacaactgcccagagaagaccgactgccccatccacgtgtacttcgtgctggacacctcggagagcgtcaccatgcagtcccccacggacatcctgctcttccacatgaagcagttcgtgccgcagttcatcagccagctgcagaacgagttctacctggaccaggtggcgctgagctggcgctacggcggcctgcacttctctgaccaggtggaggtgttcagcccaccgggcagcgaccgggcctccttcatcaagaacctgcagggcatcagctccttccgccgcggcaccttcaccgactgcgcgctggccaacatgacggagcagatccggcaggaccgcagcaagggcaccgtccacttcgccgtggtcatcaccgacggccacgtcaccggcagcccctgcgggggcatcaagctgcaggccgagcgggcccgcgaggagggcatccggctcttcgccgtggcccccaaccagaacctgaaggagcagggcctgcgggacatcgccagcacgccgcacgagctctaccgcaacgactacgccaccatgctgcccgactccaccgagatcgaccaggacaccatcaaccgcatcatcaaggtcatgaaacacgaagcctacggagagtgctacaaggtgagctgcctggaaatccctgggccctctggccccaagggctaccgtggacagaagggtgccaagggcaacatgggtgagccgggagagcctggccagaagggaagacagggagacccgggcatcgaaggccccattggattcccaggacccaagggcgttcctggcttcaaaggagagaagggtgaatttggagccgacggtcgcaagggggcccctggcctggctggcaagaacgggaccgatggacagaagggcaagctggggcgcatcggacctcctggctgcaagggagaccctggaaaccggggccccgacggttacccgggggaagcagggagtccaggggagcgaggagaccaaggcggcaagggggaccctggccgcccaggacgcagagggcccccgggagaaatcggggccaagggaagcaaggggtatcaaggcaacaatggagccccaggaagtcctggtgtgaaaggagccaagggcgggcctgggccccgcggacccaaaggcgagccggggcgcaggggagaccccggcaccaagggcagcccaggcagcgatggccccaagggggagaagggggaccctggccctgaggggccccgcggcctggctggagaggttggcaacaaaggagccaagggagaccgaggcttgcctggacccagaggcccccagggagctcttggggagcccggaaagcagggatctcggggagaccccggtgatgcaggaccccgtggagactcaggacagccaggccccaagggagaccccggcaggcctggattcagctacccaggaccccgaggagcacccggagaaaaaggcgagcccggcccacgcggccccgagggaggccgaggcgactttggcttgaaaggagaacctgggaggaaaggagagaaaggagagcctgcggatcctggtccccctggtgagccaggccctcgggggccaagaggagtcccaggacccgagggtgagcccggcccccctggagaccccggtctcacggagtgtgacgtcatgacctacgtgagggagacctgcgggtgctgcgactgtgagaagcgctgtggcgccctggacgtggtcttcgtcatcgacagctccgagagcattgggtacaccaacttcacactggagaagaacttcgtcatcaacgtggtcaacaggctgggtgccatcgctaaggaccccaagtccgagacagggacgcgtgtgggcgtggtgcagtacagccacgagggcacctttgaggccatccagctggacgacgaacgtatcgactccctgtcgagcttcaaggaggctgtcaagaacctcgagtggattgcgggcggcacctggacaccctcagccctcaagtttgcctacgaccgcctcatcaaggagagccggcgccagaagacacgtgtgtttgcggtggtcatcacggacgggcgccacgaccctcgggacgatgacctcaacttgcgggcgctgtgcgaccgcgacgtcacagtgacggccatcggcatcggggacatgttccacgagaagcacgagagtgaaaacctctactccatcgcctgcgacaagccacagcaggtgcgcaacatgacgctgttctccgacctggtcgctgagaagttcatcgatgacatggaggacgtcctctgcccggaccctcagatcgtgtgcccagaccttccctgccaaacagagctgtccgtggcacagtgcacgcagcggcccgtggacatcgtcttcctgctggacggctccgagcggctgggtgagcagaacttccacaaggcccggcgcttcgtggagcaggtggcgcggcggctgacgctggcccggagggacgacgaccctctcaacgcacgcgtggcgctgctgcagtttggtggccccggcgagcagcaggtggccttcccgctgagccacaacctcacggccatccacgaggcgctggagaccacacaatacctgaactccttctcgcacgtgggcgcaggcgtggtgcacgccatcaatgccatcgtgcgcagcccgcgtggcggggcccggaggcacgcagagctgtccttcgtgttcctcacggacggcgtcacgggcaacgacagtctgcacgagtcggcgcactccatgcgcaagcagaacgtggtacccaccgtgctggccttgggcagcgacgtggacatggacgtgctcaccacgctcagcctgggtgaccgcgccgccgtgttccacgagaaggactatgacagcctggcgcaacccggcttcttcgaccgcttcatccgctggatctgctagcgccgccgcccgggccccgcagtcgagggtcgtgagcccaccccgtccatggtgctaagcgggcccgggtcccacacggccagcaccgctgctcactcggacgacgccctgggcctgcacctctccagctcctcccacggggtccccgtagccccggcccccgcccagccccaggtctccccaggccctccgcaggctgcccggcctccctccccctgcagccatcccaaggctcctgacctacctgttagtctggctcgtgcgaattcgaatcagcttangaaccgngacctnaggggggncggt

SEQ ID NO: 342157 - DNA, 3392 bp, Homo sapiens
ccatgttgccgcaacatgctcgggagcggagcctcctcgggaccaggacttcagggccacaggtgctgccaagatgctccagggcacctgctccgtgctcctgctctggggaatcctgggggccatccaggcccagcagcaggaggtcatctcgccggacactaccgagagaaacaacaactgcccagagaagaccgactgccccatccacgtgtacttcgtgctggacacctcggagagcgtcaccatgcagtcccccacggacatcctgctcttccacatgaagcagttcgtgccgcagttcatcagccagctgcagaacgagttctacctggaccaggtggcgctgagctggcgctacggcggcctgcacttctctgaccaggtggaggtgttcagcccaccgggcagcgaccgggcctccttcatcaagaacctgcagggcatcagctccttccgccgcggcaccttcaccgactgcgcgctggccaacatgacggagcagatccggcaggaccgcagcaagggcaccgtccacttcgccgtggtcatcaccgacggccacgtcaccggcagcccctgcgggggcatcaagctgcaggccgagcgggcccgcgaggagggcatccggctcttcgccgtggcccccaaccagaacctgaaggagcagggcctgcgggacatcgccagcacgccgcacgagctctaccgcaacgactacgccaccatgctgcccgactccaccgagatcgaccaggacaccatcaaccgcatcatcaaggtcatgaaacacgaagcctacggagagtgctacaaggtgagctgcctggaaatccctgggccctctggccccaagggctaccgtggacagaagggtgccaagggcaacatgggtgagccgggagagcctggccagaagggaagacagggagacccgggcatcgaaggccccattggattcccaggacccaagggcgttcctggcttcaaaggagagaagggtgaatttggagccgacggtcgcaagggggcccctggcctggctggcaagaacgggaccgatggacagaagggcaagctggggcgcatcggacctcctggctgcaagggagaccctggaaaccggggccccgacggttacccgggggaagcagggagtccaggggagcgaggagaccaaggcggcaagggggaccctggccgcccaggacgcagagggcccccgggagaaatcggggccaagggaagcaaggggtatcaaggcaacaatggagccccaggaagtcctggtgtgaaaggagccaagggcgggcctgggccccgcggacccaaaggcgagccggggcgcaggggagaccccggcaccaagggcagcccaggcagcgatggccccaagggggagaagggggaccctggccctgaggggccccgcggcctggctggagaggttggcaacaaaggagccaagggagaccgaggcttgcctggacccagaggcccccagggagctcttggggagcccggaaagcagggatctcggggagaccccggtgatgcaggaccccgtggagactcaggacagccaggccccaagggagaccccggcaggcctggattcagctacccaggaccccgaggagcacccggagaaaaaggcgagcccggcccacgcggccccgagggaggccgaggcgactttggcttgaaaggagaacctgggaggaaaggagagaaaggagagcctgcggatcctggtccccctggtgagccaggccctcgggggccaagaggagtcccaggacccgagggtgagcccggcccccctggagaccccggtctcacggagtgtgacgtcatgacctacgtgagggagacctgcgggtgctgcgactgtgagaagcgctgtggcgccctggacgtggtcttcgtcatcgacagctccgagagcattgggtacaccaacttcacactggagaagaacttcgtcatcaacgtggtcaacaggctgggtgccatcgctaaggaccccaagtccgagacagggacgcgtgtgggcgtggtgcagtacagccacgagggcacctttgaggccatccagctggacgacgaacgtatcgactccctgtcgagcttcaaggaggctgtcaagaacctcgagtggattgcgggcggcacctggacaccctcagccctcaagtttgcctacgaccgcctcatcaaggagagccggcgccagaagacacgtgtgtttgcggtggtcatcacggacgggcgccacgaccctcgggacgatgacctcaacttgcgggcgctgtgcgaccgcgacgtcacagtgacggccatcggcatcggggacatgttccacgagaagcacgagagtgaaaacctctactccatcgcctgcgacaagccacagcaggtgcgcaacatgacgctgttctccgacctggtcgctgagaagttcatcgatgacatggaggacgtcctctgcccggaccctcagatcgtgtgcccagaccttccctgccaaacagagctgtccgtggcacagtgcacgcagcggcccgtggacatcgtcttcctgctggacggctccgagcggctgggtgagcagaacttccacaaggcccggcgcttcgtggagcaggtggcgcggcggctgacgctggcccggagggacgacgaccctctcaacgcacgcgtggcgctgctgcagtttggtggccccggcgagcagcaggtggccttcccgctgagccacaacctcacggccatccacgaggcgctggagaccacacaatacctgaactccttctcgcacgtgggcgcaggcgtggtgcacgccatcaatgccatcgtgcgcagcccgcgtggcggggcccggaggcacgcagagctgtccttcgtgttcctcacggacggcgtcacgggcaacgacagtctgcacgagtcggcgcactccatgcgcaagcagaacgtggtacccaccgtgctggccttgggcagcgacgtggacatggacgtgctcaccacgctcagcctgggtgaccgcgccgccgtgttccacgagaaggactatgacagcctggcgcaacccggcttcttcgaccgcttcatccgagggtcgtgagcccaccccgtccatggtgctaagcgggcccgggtcccacacggccagcaccgctgctcactcggacgacgccctgggcctgcacctctccagctcctcccacggggtccccgtagccccggcccccgcccagccccaggtctccccaggccctccgcaggctgcccggcctccctccccctgcagccatcccaaggctcctgacctacctggcccctgagctctggagcaagccctgacccaataaaggctttgaacccaa

SEQ ID NO: 342158 - DNA, 3261 bp, Homo sapiens
ccatgttgccgcaacatgctcgggagcggagcctcctcgggaccaggacttcagggccacaggtgctgccaagatgctccagggcacctgctccgtgctcctgctctggggaatcctgggggccatccaggcccagcagcaggaggtcatctcgccggacactaccgagagaaacaacaactgcccagagaagaccgactgccccatccacgtgtacttcgtgctggacacctcggagagcgtcaccatgcagtcccccacggacatcctgctcttccacatgaagcagttcgtgccgcagttcatcagccagctgcagaacgagttctacctggaccaggtggcgctgagctggcgctacggcggcctgcacttctctgaccaggtggaggtgttcagcccaccgggcagcgaccgggcctccttcatcaagaacctgcagggcatcagctccttccgccgcggcaccttcaccgactgcgcgctggccaacatgacggagcagatccggcaggaccgcagcaagggcaccgtccacttcgccgtggtcatcaccgacggccacgtcaccggcagcccctgcgggggcatcaagctgcaggccgagcgggcccgcgaggagggcatccggctcttcgccgtggcccccaaccagaacctgaaggagcagggcctgcgggacatcgccagcacgccgcacgagctctaccgcaacgactacgccaccatgctgcccgactccaccgagatcgaccaggacaccatcaaccgcatcatcaaggtcatgaaacacgaagcctacggagagtgctacaaggtgagctgcctggaaatccctgggccctctggccccaagggctaccgtggacagaagggtgccaagggcaacatgggtgagccgggagagcctggccagaagggaagacagggagacccgggcatcgaaggccccattggattcccaggacccaagggcgttcctggcttcaaaggagagaagggtgaatttggagccgacggtcgcaagggggcccctggcctggctggcaagaacgggaccgatggacagaagggcaagctggggcgcatcggacctcctggctgcaagggagaccctggaaaccggggccccgacggttacccgggggaagcagggagtccaggggagcgaggagaccaaggcggcaagggggaccctggccgcccaggacgcagagggcccccgggagaaatcggggccaagggaagcaaggggtatcaaggcaacaatggagccccaggaagtcctggtgtgaaaggagccaagggcgggcctgggccccgcggacccaaaggcgagccggggcgcaggggagaccccggcaccaagggcagcccaggcagcgatggccccaagggggagaagggggaccctggccctgaggggccccgcggcctggctggagaggttggcaacaaaggagccaagggagaccgaggcttgcctggacccagaggcccccagggagctcttggggagcccggaaagcagggatctcggggagaccccggtgatgcaggaccccgtggagactcaggacagccaggccccaagggagaccccggcaggcctggattcagctacccaggaccccgaggagcacccggagaaaaaggcgagcccggcccacgcggccccgagggaggccgaggcgactttggcttgaaaggagaacctgggaggaaaggagagaaaggagagcctgcggatcctggtccccctggtgagccaggccctcgggggccaagaggagtcccaggacccgagggtgagcccggcccccctggagaccccggtctcacggagtgtgacgtcatgacctacgtgagggagacctgcgggtgctgcgactgtgagaagcgctgtggcgccctggacgtggtcttcgtcatcgacagctccgagagcattgggtacaccaacttcacactggagaagaacttcgtcatcaacgtggtcaacaggctgggtgccatcgctaaggaccccaagtccgagacagggacgcgtgtgggcgtggtgcagtacagccacgagggcacctttgaggccatccagctggacgacgaacgtatcgactccctgtcgagcttcaaggaggctgtcaagaacctcgagtggattgcgggcggcacctggacaccctcagccctcaagtttgcctacgaccgcctcatcaaggagagccggcgccagaagacacgtgtgtttgcggtggtcatcacggacgggcgccacgaccctcgggacgatgacctcaacttgcgggcgctgtgcgaccgcgacgtcacagtgacggccatcggcatcggggacatgttccacgagaagcacgagagtgaaaacctctactccatcgcctgcgacaagccacagcaggtgcgcaacatgacgctgttctccgacctggtcgctgagaagttcatcgatgacatggaggacgtcctctgcccggaccctcagatcgtgtgcccagaccttccctgccaaacagagctgtccgtggcacagtgcacgcagcggcccgtggacatcgtcttcctgctggacggctccgagcggctgggtgagcagaacttccacaaggcccggcgcttcgtggagcaggtggcgcggcggctgacgctggcccggagggacgacgaccctctcaacgcacgcgtggcgctgctgcagtttggtggccccggcgagcagcaggtggccttcccgctgagccacaacctcacggccatccacgaggcgctggagaccacacaatacctgaactccttctcgcacgtgggcgcaggcgtggtgcacgccatcaatgccatcgtgcgcagcccgcgtggcggggcccggaggcacgcagagctgtccttcgtgttcctcacggacggcaacccggcttcttcgaccgcttcatccgctggatctgctagcgccgccgcccgggccccgcagtcgagggtcgtgagcccaccccgtccatggtgctaagcgggcccgggtcccacacggccagcaccgctgctcactcggacgacgccctgggcctgcacctctccagctcctcccacggggtccccgtagccccggcccccgcccagccccaggtctccccaggccctccgcaggctgcccggcctccctccccctgcagccatcccaaggctcctgacctacctggcccctgagctctggagcaagccctgacccaataaaggctttgaacccaa

SEQ ID NO: 342159 - DNA, 3189 bp, Homo sapiens
ccatgttgccgcaacatgctcgggagcggagcctcctcgggaccaggacttcagggccacaggtgctgccaagatgctccagggcacctgctccgtgctcctgctctggggaatcctgggggccatccaggcccagcagcaggaggtcatctcgccggacactaccgagagaaacaacaactgcccagagaagaccgactgccccatccacgtgtacttcgtgctggacacctcggagagcgtcaccatgcagtcccccacggacatcctgctcttccacatgaagcagttcgtgccgcagttcatcagccagctgcagaacgagttctacctggaccaggtggcgctgagctggcgctacggcggcctgcacttctctgaccaggtggaggtgttcagcccaccgggcagcgaccgggcctccttcatcaagaacctgcagggcatcagctccttccgccgcggcaccttcaccgactgcgcgctggccaacatgacggagcagatccggcaggaccgcagcaagggcaccgtccacttcgccgtggtcatcaccgacggccacgtcaccggcagcccctgcgggggcatcaagctgcaggccgagcgggcccgcgaggagggcatccggctcttcgccgtggcccccaaccagaacctgaaggagcagggcctgcgggacatcgccagcacgccgcacgagctctaccgcaacgactacgccaccatgctgcccgactccaccgagatcgaccaggacaccatcaaccgcatcatcaaggtcatgaaacacgaagcctacggagagtgctacaaggtgagctgcctggaaatccctgggccctctggccccaagggctaccgtggacagaagggtgccaagggcaacatgggtgagccgggagagcctggccagaagggaagacagggagacccgggcatcgaaggccccattggattcccaggacccaagggcgttcctggcttcaaaggagagaagggtgaatttggagccgacggtcgcaagggggcccctggcctggctggcaagaacgggaccgatggacagaagggcaagctggggcgcatcggacctcctggctgcaagggagaccctggaaaccggggccccgacggttacccgggggaagcagggagtccaggggagcgaggagaccaaggcggcaagggggaccctggccgcccaggacgcagagggcccccgggagaaatcggggccaagggaagcaaggggtatcaaggcaacaatggagccccaggaagtcctggtgtgaaaggagccaagggcgggcctgggccccgcggacccaaaggcgagccggggcgcaggggagaccccggcaccaagggcagcccaggcagcgatggccccaagggggagaagggggaccctggccctgaggggccccgcggcctggctggagaggttggcaacaaaggagccaagggagaccgaggcttgcctggacccagaggcccccagggagctcttggggagcccggaaagcagggatctcggggagaccccggtgatgcaggaccccgtggagactcaggacagccaggccccaagggagaccccggcaggcctggattcagctacccaggaccccgaggagcacccggagaaaaaggcgagcccggcccacgcggccccgagggaggccgaggcgactttggcttgaaaggagaacctgggaggaaaggagagaaaggagagcctgcggatcctggtccccctggtgagccaggccctcgggggccaagaggagtcccaggacccgagggtgagcccggcccccctggagaccccggtctcacggagtgtgacgtcatgacctacgtgagggagacctgcgggtgctgcgactgtgagaagcgctgtggcgccctggacgtggtcttcgtcatcgacagctccgagagcattgggtacaccaacttcacactggagaagaacttcgtcatcaacgtggtcaacaggctgggtgccatcgctaaggaccccaagtccgagacagggacgcgtgtgggcgtggtgcagtacagccacgagggcacctttgaggccatccagctggacgacgaacgtatcgactccctgtcgagcttcaaggaggctgtcaagaacctcgagtggattgcgggcggcacctggacaccctcagccctcaagtttgcctacgaccgcctcatcaaggagagccggcgccagaagacacgtgtgtttgcggtggtcatcacggacgggcgccacgaccctcgggacgatgacctcaacttgcgggcgctgtgcgaccgcgacgtcacagtgacggccatcggcatcggggacatgttccacgagaagcacgagagtgaaaacctctactccatcgcctgcgacaagccacagcaggtgcgcaacatgacgctgttctccgacctggtcgctgagaagttcatcgatgacatggaggacgtcctctgcccggaccctcagatcgtgtgcccagaccttccctgccaaacagagctgtccgtggcacagtgcacgcagcggcccgtggacatcgtcttcctgctggacggctccgagcggctgggtgagcagaacttccacaaggcccggcgcttcgtggagcaggtggcgcggcggctgacgctggcccggagggacgacgaccctctcaacgcacgcgtggcgctgctgcagtttggtggccccggcgagcagcaggtggccttcccgctgagccacaacctcacggccatccacgaggcgctggagaccacacaatacctgaactccttctcgcacgtgggcgcaggcgtggtgcacgccatcaatgccatcgtgcgcagcccgcgtggcggggcccggaggcacgcagagctgtccttcgtgttcctcacggacggcgtcacgggcaacgacagtctgcacgagtcggcgcactccatgcgcaagcagaacgtggtacccaccgtgctggccttgggcagcgacgtggacatggacgtgctcaccacgctcagcctgggtgaccgcgccgccgtgttccacgagaaggactatgacagcctggcgcccggcctccctccccctgcagccatcccaaggctcctgacctacctggcccctgagctctggagcaagccctgacccaataaaggctttgaacccaa

SEQ ID NO: 342160 - DNA, 3154 bp, Homo sapiens
ccatgttgccgcaacatgctcgggagcggagcctcctcgggaccaggacttcagggccacaggtgctgccaagatgctccagggcacctgctccgtgctcctgctctggggaatcctgggggccatccaggcccagcagcaggaggtcatctcgccggacactaccgagagaaacaacaactgcccagagaagaccgactgccccatccacgtgtacttcgtgctggacacctcggagagcgtcaccatgcagtcccccacggacatcctgctcttccacatgaagcagttcgtgccgcagttcatcagccagctgcagaacgagttctacctggaccaggtggcgctgagctggcgctacggcggcctgcacttctctgaccaggtggaggtgttcagcccaccgggcagcgaccgggcctccttcatcaagaacctgcagggcatcagctccttccgccgcggcaccttcaccgactgcgcgctggccaacatgacggagcagatccggcaggaccgcagcaagggcaccgtccacttcgccgtggtcatcaccgacggccacgtcaccggcagcccctgcgggggcatcaagctgcaggccgagcgggcccgcgaggagggcatccggctcttcgccgtggcccccaaccagaacctgaaggagcagggcctgcgggacatcgccagcacgccgcacgagctctaccgcaacgactacgccaccatgctgcccgactccaccgagatcgaccaggacaccatcaaccgcatcatcaaggtcatgaaacacgaagcctacggagagtgctacaaggtgagctgcctggaaatccctgggccctctggccccaagggctaccgtggacagaagggtgccaagggcaacatgggtgagccgggagagcctggccagaagggaagacagggagacccgggcatcgaaggccccattggattcccaggacccaagggcgttcctggcttcaaaggagagaagggtgaatttggagccgacggtcgcaagggggcccctggcctggctggcaagaacgggaccgatggacagaagggcaagctggggcgcatcggacctcctggctgcaagggagaccctggaaaccggggccccgacggttacccgggggaagcagggagtccaggggagcgaggagaccaaggcggcaagggggaccctggccgcccaggacgcagagggcccccgggagaaatcggggccaagggaagcaaggggtatcaaggcaacaatggagccccaggaagtcctggtgtgaaaggagccaagggcgggcctgggccccgcggacccaaaggcgagccggggcgcaggggagaccccggcaccaagggcagcccaggcagcgatggccccaagggggagaagggggaccctggccctgaggggccccgcggcctggctggagaggttggcaacaaaggagccaagggagaccgaggcttgcctggacccagaggcccccagggagctcttggggagcccggaaagcagggatctcggggagaccccggtgatgcaggaccccgtggagactcaggacagccaggccccaagggagaccccggcaggcctggattcagctacccaggaccccgaggagcacccggagaaaaaggcgagcccggcccacgcggccccgagggaggccgaggcgactttggcttgaaaggagaacctgggaggaaaggagagaaaggagagcctgcggatcctggtccccctggtgagccaggccctcgggggccaagaggagtcccaggacccgagggtgagcccggcccccctggagaccccggtctcacggagtgtgacgtcatgacctacgtgagggagacctgcgggtgctgcgactgtgagaagcgctgtggcgccctggacgtggtcttcgtcatcgacagctccgagagcattgggtacaccaacttcacactggagaagaacttcgtcatcaacgtggtcaacaggctgggtgccatcgctaaggaccccaagtccgagacagggacgcgtgtgggcgtggtgcagtacagccacgagggcacctttgaggccatccagctggacgacgaacgtatcgactccctgtcgagcttcaaggaggctgtcaagaacctcgagtggattgcgggcggcacctggacaccctcagccctcaagtttgcctacgaccgcctcatcaaggagagccggcgccagaagacacgtgtgtttgcggtggtcatcacggacgggcgccacgaccctcgggacgatgacctcaacttgcgggcgctgtgcgaccgcgacgtcacagtgacggccatcggcatcggggacatgttccacgagaagcacgagagtgaaaacctctactccatcgcctgcgacaagccacagcaggtgcgcaacatgacgctgttctccgacctggtcgctgagaagttcatcgatgacatggaggacgtcctctgcccggaccctcagatcgtgtgcccagaccttccctgccaaacagagctgtccgtggcacagtgcacgcagcggcccgtggacatcgtcttcctgctggacggctccgagcggctgggtgagcagaacttccacaaggcccggcgcttcgtggagcaggtggcgcggcggctgacgctggcccggagggacgacgaccctctcaacgcacgcgtggcgctgctgcagtttggtggccccggcgagcagcaggtggccttcccgctgagccacaacctcacggccatccacgaggcgctggagaccacacaatacctgaactccttctcgcacgtgggcgcaggcgtggtgcacgccatcaatgccatcgtgcgcagcccgcgtggcggggcccagggtcgtgagcccaccccgtccatggtgctaagcgggcccgggtcccacacggccagcaccgctgctcactcggacgacgccctgggcctgcacctctccagctcctcccacggggtccccgtagccccggcccccgcccagccccaggtctccccaggccctccgcaggctgcccggcctccctccccctgcagccatcccaaggctcctgacctacctggcccctgagctctggagcaagccctgacccaataaaggctttgaacccaa

SEQ ID NO: 342161 - DNA, 3432 bp, Homo sapiens
ccatgttgccgcaacatgctcgggagcggagcctcctcgggaccaggacttcagggccacaggtgctgccaagatgctccagggcacctgctccgtgctcctgctctggggaatcctgggggccatccaggcccagcagcaggaggtcatctcgccggacactaccgagagaaacaacaactgcccagagaagaccgactgccccatccacgtgtacttcgtgctggacacctcggagagcgtcaccatgcagtcccccacggacatcctgctcttccacatgaagcagttcgtgccgcagttcatcagccagctgcagaacgagttctacctggaccaggtggcgctgagctggcgctacggcggcctgcacttctctgaccaggtggaggtgttcagcccaccgggcagcgaccgggcctccttcatcaagaacctgcagggcatcagctccttccgccgcggcaccttcaccgactgcgcgctggccaacatgacggagcagatccggcaggaccgcagcaagggcaccgtccacttcgccgtggtcatcaccgacggccacgtcaccggcagcccctgcgggggcatcaagctgcaggccgagcgggcccgcgaggagggcatccggctcttcgccgtggcccccaaccagaacctgaaggagcagggcctgcgggacatcgccagcacgccgcacgagctctaccgcaacgactacgccaccatgctgcccgactccaccgagatcgaccaggacaccatcaaccgcatcatcaaggtcatgaaacacgaagcctacggagagtgctacaaggtgagctgcctggaaatccctgggccctctggccccaagggctaccgtggacagaagggtgccaagggcaacatgggtgagccgggagagcctggccagaagggaagacagggagacccgggcatcgaaggccccattggattcccaggacccaagggcgttcctggcttcaaaggagagaagggtgaatttggagccgacggtcgcaagggggcccctggcctggctggcaagaacgggaccgatggacagaagggcaagctggggcgcatcggacctcctggctgcaagggagaccctggaaaccggggccccgacggttacccgggggaagcagggagtccaggggagcgaggagaccaaggcggcaagggggaccctggccgcccaggacgcagagggcccccgggagaaatcggggccaagggaagcaaggggtatcaaggcaacaatggagccccaggaagtcctggtgtgaaaggagccaagggcgggcctgggccccgcggacccaaaggcgagccggggcgcaggggagaccccggcaccaagggcagcccaggcagcgatggccccaagggggagaagggggaccctggccctgaggggccccgcggcctggctggagaggttggcaacaaaggagccaagggagaccgaggcttgcctggacccagaggcccccagggagctcttggggagcccggaaagcagggatctcggggagaccccggtgatgcaggaccccgtggagactcaggacagccaggccccaagggagaccccggcaggcctggattcagctacccaggaccccgaggagcacccggagaaaaaggcgagcccggcccacgcggccccgagggaggccgaggcgactttggcttgaaaggagaacctgggaggaaaggagagaaaggagagcctgcggatcctggtccccctggtgagccaggccctcgggggccaagaggagtcccaggacccgagggtgagcccggcccccctggagaccccggtctcacggagtgtgacgtcatgacctacgtgagggagacctgcgggtgctgcgactgtgagaagcgctgtggcgccctggacgtggtcttcgtcatcgacagctccgagagcattgggtacaccaacttcacactggagaagaacttcgtcatcaacgtggtcaacaggctgggtgccatcgctaaggaccccaagtccgagacagggacgcgtgtgggcgtggtgcagtacagccacgagggcacctttgaggccatccagctggacgacgaacgtatcgactccctgtcgagcttcaaggaggctgtcaagaacctcgagtggattgcgggcggcacctggacaccctcagccctcaagtttgcctacgaccgcctcatcaaggagagccggcgccagaagacacgtgtgtttgcggtggtcatcacggacgggcgccacgaccctcgggacgatgacctcaacttgcgggcgctgtgcgaccgcgacgtcacagtgacggccatcggcatcggggacatgttccacgagaagcacgagagtgaaaacctctactccatcgcctgcgacaagccacagcaggtgcgcaacatgacgctgttctccgacctggtcgctgagaagttcatcgatgacatggaggacgtcctctgcccggaccctcagatcgtgtgcccagaccttccctgccaaacaggtttggacggagctgttttgtgctgaaaggttttctcggggtccgtggtgtcccccaaaggtgccaccgtgcgggtctcctagctccctgccagcttcctgtccctgtgctcactgcccccacgcctcctgccaaggccgagccacacacccgctccacctgcatttcctctaccgactcgccagcccaaatgccgctcttcactctggcctcgctgagcggctgcccgaggaggagctctaggccgacgcccaccgcaggccttacagtcttctctggacgctcccttgcagatgcaccgtggcctggcggcgagcccccggtcaccttcctccgcacggaagaggggccggacgccaccttccccaggaccattcccctgatccaacagttgctaaacgccacggagctcacgcaggacccggccgcctactcccagctggtggccgtgctggtctacaccgccgagcgggccaagttcgccaccggggtagagcggcaggactggatggagctgttcattgacacctttaagctggtgcacagggacatcgtgggggaccccgagaccgcgctggccctctgctaaagcccgggcacccgcccagccgggctgggccctccctgccacactagcttcccagggctgcccccgacaggctggctctcagtggaggccagagatctggaatcggggtcagcggggctacagtccttccaggggctctggggcagctcccagcctcttcccatgctggtggccaccgtgtcccttgctgcggctgcatcttccagtctctcctccgtcttcctgtggccgctctctttataagaaccctggtcattgaatttaaggcccaccccaagtccagaatgacctcgcaagacccttaactca

SEQ ID NO: 342162 - DNA, 3152 bp, Homo sapiens
ccatgttgccgcaacatgctcgggagcggagcctcctcgggaccaggacttcagggccacaggtgctgccaagatgctccagggcacctgctccgtgctcctgctctggggaatcctgggggccatccaggcccagcagcaggaggtcatctcgccggacactaccgagagaaacaacaactgcccagagaagaccgactgccccatccacgtgtacttcgtgctggacacctcggagagcgtcaccatgcagtcccccacggacatcctgctcttccacatgaagcagttcgtgccgcagttcatcagccagctgcagaacgagttctacctggaccaggtggcgctgagctggcgctacggcggcctgcacttctctgaccaggtggaggtgttcagcccaccgggcagcgaccgggcctccttcatcaagaacctgcagggcatcagctccttccgccgcggcaccttcaccgactgcgcgctggccaacatgacggagcagatccggcaggaccgcagcaagggcaccgtccacttcgccgtggtcatcaccgacggccacgtcaccggcagcccctgcgggggcatcaagctgcaggccgagcgggcccgcgaggagggcatccggctcttcgccgtggcccccaaccagaacctgaaggagcagggcctgcgggacatcgccagcacgccgcacgagctctaccgcaacgactacgccaccatgctgcccgactccaccgagatcgaccaggacaccatcaaccgcatcatcaaggtcatgaaacacgaagcctacggagagtgctacaaggtgagctgcctggaaatccctgggccctctggccccaagggctaccgtggacagaagggtgccaagggcaacatgggtgagccgggagagcctggccagaagggaagacagggagacccgggcatcgaaggccccattggattcccaggacccaagggcgttcctggcttcaaaggagagaagggtgaatttggagccgacggtcgcaagggggcccctggcctggctggcaagaacgggaccgatggacagaagggcaagctggggcgcatcggacctcctggctgcaagggagaccctggaaaccggggccccgacggttacccgggggaagcagggagtccaggggagcgaggagaccaaggcggcaagggggaccctggccgcccaggacgcagagggcccccgggagaaatcggggccaagggaagcaaggggtatcaaggcaacaatggagccccaggaagtcctggtgtgaaaggagccaagggcgggcctgggccccgcggacccaaaggcgagccggggcgcaggggagaccccggcaccaagggcagcccaggcagcgatggccccaagggggagaagggggaccctggccctgaggggccccgcggcctggctggagaggttggcaacaaaggagccaagggagaccgaggcttgcctggacccagaggcccccagggagctcttggggagcccggaaagcagggatctcggggagaccccggtgatgcaggaccccgtggagactcaggacagccaggccccaagggagaccccggcaggcctggattcagctacccaggaccccgaggagcacccggagaaaaaggcgagcccggcccacgcggccccgagggaggccgaggcgactttggcttgaaaggagaacctgggaggaaaggagagaaaggagagcctgcggatcctggtccccctggtgagccaggccctcgggggccaagaggagtcccaggacccgagggtgagcccggcccccctggagaccccggtctcacggagtgtgacgtcatgacctacgtgagggagacctgcgggtgctgcgactgtgagaagcgctgtggcgccctggacgtggtcttcgtcatcgacagctccgagagcattgggtacaccaacttcacactggagaagaacttcgtcatcaacgtggtcaacaggctgggtgccatcgctaaggaccccaagtccgagacagggacgcgtgtgggcgtggtgcagtacagccacgagggcacctttgaggccatccagctggacgacgaacgtatcgactccctgtcgagcttcaaggaggctgtcaagaacctcgagtggattgcgggcggcacctggacaccctcagccctcaagtttgcctacgaccgcctcatcaaggagagccggcgccagaagacacgtgtgtttgcggtggtcatcacggacgggcgccacgaccctcgggacgatgacctcaacttgcgggcgctgtgcgaccgcgacgtcacagtgacggccatcggcatcggggacatgttccacgagaagcacgagagtgaaaacctctactccatcgcctgcgacaagccacagcaggtgcgcaacatgacgctgttctccgacctggtcgctgagaagttcatcgatgacatggaggacgtcctctgcccggaccctcagatcgtgtgcccagaccttccctgccaaacagatgcaccgtggcctggcggcgagcccccggtcaccttcctccgcacggaagaggggccggacgccaccttccccaggaccattcccctgatccaacagttgctaaacgccacggagctcacgcaggacccggccgcctactcccagctggtggccgtgctggtctacaccgccgagcgggccaagttcgccaccggggtagagcggcaggactggatggagctgttcattgacacctttaagctggtgcacagggacatcgtgggggaccccgagaccgcgctggccctctgctaaagcccgggcacccgcccagccgggctgggccctccctgccacactagcttcccagggctgcccccgacaggctggctctcagtggaggccagagatctggaatcggggtcagcggggctacagtccttccaggggctctggggcagctcccagcctcttcccatgctggtggccaccgtgtcccttgctgcggctgcatcttccagtctctcctccgtcttcctgtggccgctctctttataagaaccctggtcattgaatttctggagctaacgcagcacgagtctgtggccggcggtggtttctctacagtctgcctgca

SEQ ID NO: 342163 - DNA, 2628 bp, Homo sapiens
ccatgttgccgcaacatgctcgggagcggagcctcctcgggaccaggacttcagggccacaggtgctgccaagatgctccagggcacctgctccgtgctcctgctctggggaatcctgggggccatccaggcccagcagcaggaggtcatctcgccggacactaccgagagaaacaacaactgcccagagaagaccgactgccccatccacgtgtacttcgtgctggacacctcggagagcgtcaccatgcagtcccccacggacatcctgctcttccacatgaagcagttcgtgccgcagttcatcagccagctgcagaacgagttctacctggaccaggtggcgctgagctggcgctacggcggcctgcacttctctgaccaggtggaggtgttcagcccaccgggcagcgaccgggcctccttcatcaagaacctgcagggcatcagctccttccgccgcggcaccttcaccgactgcgcgctggccaacatgacggagcagatccggcaggaccgcagcaagggcaccgtccacttcgccgtggtcatcaccgacggccacgtcaccggcagcccctgcgggggcatcaagctgcaggccgagcgggcccgcgaggagggcatccggctcttcgccgtggcccccaaccagaacctgaaggagcagggcctgcgggacatcgccagcacgccgcacgagctctaccgcaacgactacgccaccatgctgcccgactccaccgagatcgaccaggacaccatcaaccgcatcatcaaggtcatgaaacacgaagcctacggagagtgctacaaggtgagctgcctggaaatccctgggccctctggccccaagggctaccgtggacagaagggtgccaagggcaacatgggtgagccgggagagcctggccagaagggaagacagggagacccgggcatcgaaggccccattggattcccaggacccaagggcgttcctggcttcaaaggagagaagggtgaatttggagccgacggtcgcaagggggcccctggcctggctggcaagaacgggaccgatggacagaagggcaagctggggcgcatcggacctcctggctgcaagggagaccctggaaaccggggccccgacggttacccgggggaagcagggagtccaggggagcgaggagaccaaggcggcaagggggaccctggccgcccaggacgcagagggcccccgggagaaatcggggccaagggaagcaaggggtatcaaggcaacaatggagccccaggaagtcctggtgtgaaaggagccaagggcgggcctgggccccgcggacccaaaggcgagccggggcgcaggggagaccccggcaccaagggcagcccaggcagcgatggccccaagggggagaagggggaccctggccctgaggggccccgcggcctggctggagaggttggcaacaaaggagccaagggagaccgaggcttgcctggacccagaggcccccagggagctcttggggagcccggaaagcagggatctcggggagaccccggtgatgcaggaccccgtggagactcaggacagccaggccccaagggagaccccggcaggcctggattcagctacccaggaccccgaggagcacccggagaaaaaggcgagcccggcccacgcggccccgagggaggccgaggcgactttggcttgaaaggagaacctgggaggaaaggagagaaaggagagcctgcggatcctggtccccctggtgagccaggccctcgggggccaagaggagtcccaggacccgagggtgagcccggcccccctggagaccccggtctcacggagtgtgacgtcatgacctacgtgagggagacctgcgggtgctgcgactgtgagaagcgctgtggcgccctggacgtggtcttcgtcatcgacagctccgagagcattgggtacaccaacttcacactggagaagaacttcgtcatcaacgtggtcaacaggctgggtgccatcgctaaggaccccaagtccgagacagggacgcgtgtgggcgtggtgcagtacagccacgagggcacctttgaggccatccagctggacgacgaacgtatcgactccctgtcgagcttcaaggaggctgtcaagaacctcgagtggattgcgggcggcacctggacaccctcagccctcaagtttgcctacgaccgcctcatcaaggagagccggcgccagaagacacgtgtgtttgcggtggtcatcacggacgggcgccacgaccctcgggacgatgacctcaacttgcgggcgctgtgcgaccgcgacgtcacagtgacggccatcggcatcggggacatgttccacgagaagcacgagagtgaaaacctctactccatcgcctgcgacaagccacagcaggtgcgcaacatgacgctgttctccgacctggtcgctgagaagttcatcgatgacatggaggacgtcctctgcccggcgtgtcccttgctgcggctgcatcttccagtctctcctccgtcttcctgtggccgctctctttataagaaccctggtcattgaatttaaggcccaccccaagtccagaatgacctcgcaagacccttaactca

SEQ ID NO: 342164 - DNA, 1475 bp, Homo sapiens
ccatgttgccgcaacatgctcgggagcggagcctcctcgggaccaggacttcagggccacaggtgctgccaagatgctccagggcacctgctccgtgctcctgctctggggaatcctgggggccatccaggcccagcagcaggaggtcatctcgccggacactaccgagagaaacaacaactgcccagagaagaccgactgccccatccacgtgtacttcgtgctggacacctcggagagcgtcaccatgcagtcccccacggacatcctgctcttccacatgaagcagttcgtgccgcagttcatcagccagctgcagaacgagttctacctggaccaggtggcgctgagctggcgctacggcggcctgcacttctctgaccaggtggaggtgttcagcccaccgggcagcgaccgggcctccttcatcaagaacctgcagggcatcagctccttccgccgcggcaccttcaccgactgcgcgctggccaacatgacggagcagatccggcaggaccgcagcaagggcaccgtccacttcgccgtggtcatcaccgacggccacgtcaccggcagcccctgcgggggcatcaagctgcaggccgagcgggcccgcgaggagggcatccggctcttcgccgtggcccccaaccagaacctgaaggagcagggcctgcgggacatcgccagcacgccgcacgagctctaccgcaacgactacgccaccatgctgcccgactccaccgagatcgaccaggacaccatcaaccgcatcatcaaggtcatgaaacacgaagcctacggagagtgctacaaggtgagctgcctggaaatccctgggccctctggccccaagggctaccgtggacagaagggtgccaagggcaacatgggtgagccgggagagcctggccagaagggaagacagggagacccgggcatcgaaggccccattggattcccaggacccaagggcgttcctggcttcaaaggagagaagggtgaatttggagccgacggtcgcaagggggcccctggcctggctggcaagaacgggaccgatggacagaagggcaagctggggcgcatcggacctcctggctgcaagggagaccctggaaaccggggccccgacggttacccgggggaagcagggagtccaggggagcgaggagaccaaggcggcaagggggaccctggccgcccaggacgcagagggcccccgggagaaatcggggccaagggaagcaaggggtatcaaggcaacaatggagccccaggaagtcctggtgtgaaaggagccaagggcgggcctgggcctccccgtagccccggcccccgcccagccccaggtctccccaggccctccgcaggctgcccggcctccctccccctgcagccatcccaaggctcctgacctacctggcccctgagctctggagcaagccctgacccaataaaggctttgaacccaa

SEQ ID NO: 342165 - DNA, 1541 bp, Homo sapiens
ccatgttgccgcaacatgctcgggagcggagcctcctcgggaccaggacttcagggccacaggtgctgccaagatgctccagggcacctgctccgtgctcctgctctggggaatcctgggggccatccaggcccagcagcaggaggtcatctcgccggacactaccgagagaaacaacaactgcccagagaagaccgactgccccatccacgtgtacttcgtgctggacacctcggagagcgtcaccatgcagtcccccacggacatcctgctcttccacatgaagcagttcgtgccgcagttcatcagccagctgcagaacgagttctacctggaccaggtggcgctgagctggcgctacggcggcctgcacttctctgaccaggtggaggtgttcagcccaccgggcagcgaccgggcctccttcatcaagaacctgcagggcatcagctccttccgccgcggcaccttcaccgactgcgcgctggccaacatgacggagcagatccggcaggaccgcagcaagggcaccgtccacttcgccgtggtcatcaccgacggccacgtcaccggcagcccctgcgggggcatcaagctgcaggccgagcgggcccgcgaggagggcatccggctcttcgccgtggcccccaaccagaacctgaaggagcagggcctgcgggacatcgccagcacgccgcacgagctctaccgcaacgactacgccaccatgctgcccgactccaccgagatcgaccaggacaccatcaaccgcatcatcaaggtcatgaaacacgaagcctacggagagtgctacaaggtgagctgcctggaaatccctgggccctctggccccaagggctaccgtggacagaagggtgccaagggcaacatgggtgagccgggagagcctggccagaagggaagacagggagacccgggcatcgaaggccccattggattcccaggacccaagggcgttcctggcttcaaaggagagaaggtgagattggagccgacggtcgcaagggggcccctggcctggcctggcaagaacgggaccgactggcacagaagggccagctggggcgcatcgcgacctcctggctgccagggagaccctggaaaccggggccccgacagggatacccgcgcggaagcagtgcgaagcttccaggggacgcgagcgacgaccaaactgcggcaacaggggacccctggccgcccaggacgcagacggccccccgggatgcaagtcggggccacgggacgcaaggcgctatcaacggcccacccttggctcccccaggcaagatcctggctgtggcaaggagcccaatggccgggcctggggccccgcgggaccccaacaggcagagccgcagcagcccggggaacaccccggcacccaaaggccaagccaggccgacgatgggccccacacggcgacaaggccggtccttggcctcacgcgccccgcgcactgccaggaaaagcggcacctcggaccccgcgccacccggcctgccccgaccacagccccg

SEQ ID NO: 342166 - DNA, 933 bp, Homo sapiens
ccatgttgccgcaacatgctcgggagcggagcctcctcgggaccaggacttcagggccacaggtgctgccaagatgctccagggcacctgctccgtgctcctgctctggggaatcctgggggccatccaggcccagcagcaggaggtcatctcgccggacactaccgagagaaacaacaactgcccagagaagaccgactgccccatccacgtgtacttcgtgctggacacctcggagagcgtcaccatgcagtcccccacggacatcctgctcttccacatgaagcagttcgtgccgcagttcatcagccagctgcagaacgagttctacctggaccaggtggcgctgagctggcgctacggcggcctgcacttctctgaccaggtggaggtgttcagcccaccgggcagcgaccgggcctccttcatcaagaacctgcagggcatcagctccttccgccgcggcaccttcaccgactgcgcgctggccaacatgacggagcagatccggcaggaccgcagcaagggcaccgtccacttcgccgtggtcatcaccgacggccacgtcaccggcagcccctgcgggggcatcaagctgcaggccgagcgggcccgcgaggagggcatccggctcttcgccgtggcccccaaccagaacctgaaggagcagggcctgcgggacatcgccagcacgccgcacgagctctaccgcaacgactacgccaccatgctgcccgactccaccgagatcgaccaggacaccatcaaccgcatcatcaaggtcatgaaacacgaagcctacggagaggtgagtggcgcttcccttcctgccagtgctggccggcagctgacccagcagagatgaccgcgccaggctgccgactcctggcgcctccaggctggaacagatgagaggagagggagtcacctgct

SEQ ID NO: 342167 - DNA, 506 bp, Homo sapiens
acacggggagggacaggaagaacaggccatgtgccctgagccaccagcccctctgacctgtgccctcctcacgaggctgaacaagttccaggggaccctgcagggcccccatgtgcctggcaagcagattccgctggaagataataggggctccacaccacacaccgcacaggcgtgaccatgcctcagggcccctgcctctgggtgactgtgctgtcctctccttcttcaggggtatcaaggcaacaatggagccccaggaagtcctggtgtgaaaggagccaagggcgggcctgggccccgcggacccaaaggcgagccggtgagtccctcctgcccctgcctcagggccccgctctgggcatcctccttgcagcttgaggaggaccatgggggaagggcacctgggctgtaggcaggatcccctgctggcaaggcacagccaggcccccatcctcccaagaagtggacccggaccaccccacgggaccccccagagctggact

SEQ ID NO: 342168 - DNA, 1765 bp, Homo sapiens
ggcacgagggtcccaggacccgagggtgagcccggcccccctggagaaaaaggcgagcccggcccacgcggccccgagggaggccgaggcgactttggcttgaaaggagaacctgggaggaaaggagagaaaggagagcctgcggatcctggtccccctggtgagccaggccctcggggagtgtgacgtcatgacctacgtgagggagacctgcgggtgctgcgactgtgagaagcgctgtggcgccctggacgtggtcttcgtcatcgacagctccgagagcattgggtacaccaacttcacactggagaagaacttcgtcatcaacgtggtcaacaggctgggtgccatcgctaaggaccccaagtccgagacagggacgcgtgtgggcgtggtgcagtacagccacgagggcacctttgaggccatccagctggacgacgaacgtatcgactccctgtcgagcttcaaggaggctgtcaagaacctcgagtggattgcgggcggcacctggacaccctcagccctcaagtttgcctacgaccgcctcatcaaggagagccggcgccagaagacacgtgtgtttgcggtggtcatcacggacgggcgccacgaccctcgggacgatgacctcaacttgcgggcgctgtgcgaccgcgacgtcacagtgacggccatcggcatcggggacatgttccacgagaagcacgagagtgaaaacctctactccatcgcctgcgacaagccacagcaggtgcgcaacatgacgctgttctccgacctggtcgctgagaagttcatcgatgacatggaggacgtcctctgcccggaccctcagatcgtgtgcccagaccttccctgccaaacagagctgtccgtggcacagtgcacgcagcggcccgtggacatcgtcttcctgctggacggctccgagcggctgggtgagcagaacttccacaaggcccggcgcttcgtggagcaggtggcgcggcggctgacgctggcccggagggacgacgaccctctcaacgcacgcgtggcgctgctgcagtttggtggccccggcgagcagcaggtggccttcccgctgagccacaacctcacggccatccacgaggcgctggagaccacacaatacctgaactccttctcgcacgtgggcgcaggcgtggtgcacgccatcaatgccatcgtgcgcagcccgcgtggcggggcccggaggcacgcagagctgtccttcgtgttcctcacggacggcgtcacgggcaacgacagtctgcacgagtcggcgcactccatgcgcaagcagaacgtggtacccaccgtgctggccttgggcagcgacgtggacatggacgtgctcaccacgctcagcctgggtgaccgcgccgccgtgttccacgagaaggactatgacagcctggcgcaacccggcttcttcgaccgcttcatccgctggatctgctagcgccgccgcccgggccccgcagtcgagggtcgtgagcccaccccgtccatggtgctaagcgggcccgggtcccacacggccagcaccgctgctcactcggacgacgccctgggcctgcacctctccagctcctcccacggggtccccgtagccccggcccccgcccagccccaggtctccccaggccctccgcaggctgcccggcctccctccccctgcagccatcccaaggctcctgacctacctggcccctgagctctggagcaagccctgacccaataaaggctttgaacccaa

SEQ ID NO: 342169 - DNA, 535 bp, Homo sapiens
  misc_feature (41)..(41): n is a, c, g, or t
gcaagcgacgtgaacatgaacgtgctcaccacgctcagccntgggtgaccgtcccgccgtgttccacgaaaaggactatgacagcctggcgcaacccggcttcttcgaccgcttcatccgggaggcacgcagagctgtccttcgtgttcctcacggacggcgtcacgggcaacgacagtctgcacgagtcggcgcactccatgcgcaagcagaacgtggtacccaccgtgctggccttgggcagcgacgtggacatggacgtgagggtcgtgagcccaccccgtccatggtgctaagcgggcccgggtcccacacggccagcaccgctgctcactcggacgacgccctgggcctgcacctctccagctcctcccacggggtccccgtagccccggcccccgcccagccccaggtctccccaggccctccgcaggctgcccggcctccctccccctgcagccatcccaaggctcctgacctacctggcccctgagctctggagcaagccctgacccaataaaggctttgaacccaa

SEQ ID NO: 342170 - DNA, 2146 bp, Homo sapiens
  misc_feature (50)..(50): n is a, c, g, or t
  misc_feature (465)..(465): n is a, c, g, or t
  misc_feature (469)..(469): n is a, c, g, or t
  misc_feature (1461)..(1461): n is a, c, g, or t
  misc_feature (1885)..(1885): n is a, c, g, or t
  misc_feature (1933)..(1934): n is a, c, g, or t
  misc_feature (1967)..(1967): n is a, c, g, or t
  misc_feature (1984)..(1984): n is a, c, g, or t
  misc_feature (2014)..(2014): n is a, c, g, or t
  misc_feature (2074)..(2076): n is a, c, g, or t
  misc_feature (2078)..(2079): n is a, c, g, or t
  misc_feature (2081)..(2082): n is a, c, g, or t
  misc_feature (2084)..(2084): n is a, c, g, or t
  misc_feature (2086)..(2088): n is a, c, g, or t
  misc_feature (2090)..(2095): n is a, c, g, or t
  misc_feature (2097)..(2100): n is a, c, g, or t
  misc_feature (2102)..(2102): n is a, c, g, or t
  misc_feature (2105)..(2108): n is a, c, g, or t
  misc_feature (2110)..(2110): n is a, c, g, or t
  misc_feature (2112)..(2113): n is a, c, g, or t
  misc_feature (2115)..(2119): n is a, c, g, or t
  misc_feature (2121)..(2121): n is a, c, g, or t
  misc_feature (2125)..(2125): n is a, c, g, or t
  misc_feature (2127)..(2131): n is a, c, g, or t
  misc_feature (2133)..(2133): n is a, c, g, or t
  misc_feature (2135)..(2135): n is a, c, g, or t
tgtccggaccccagccagactgctgtgaactcttctgggcccggggactnccctgcctgccgtgtgcattgcaggagtgtgacgtcatgacctacgtgagggagacctgcgggtgctgcggtgaggcactgcccacggcagggtcggggcccatgcaccgggtggagggcgggagtgcagcagggctgggtcatcgctgggtcctgcatgtgcacgtgaccctagggtctgaggtctcccggtaccccccgatgaccctgccacccccccagactgtgagaagcgctgtggcgccctggacgtggtcttcgtcatcgacagctccgagagcattgggtacaccaacttcacactggagaagaacttcgtcatcaacgtggtcaacaggctgggtgccatcgctaaggaccccaagtccgagacaggtcagcggggcagggcgggtgcagcattgcggggggccgngggngcgtgggaggcgatgagatgggagaagtccagacgcgtccctccaacgagggcctctgcatggctggggatgccccagaccccgaggcctctggcaacgacctcacgcgtgcggcttgcagggacgcgtgtgggcgtggtgcagtacagccacgagggcacctttgaggccatccagctggacgacgaacgtatcgactccctgtcgagcttcaaggaggctgtcaagaacctcgagtggattgcgggcggcacctggacaccctcagccctcaagtttgcctacgaccgcctcatcaaggagagccggcgccagaagacacgtgtgtttgcggtggtcatcacggacgggcgccacgaccctcgggacgatgacctcaacttgcgggcgctgtgcgaccgcgacgtcacagtgacggccatcggcatcggggacatgttccacgagaagcacgagagtgaaaacctctactccatcgcctgcgacaagccacagcaggtgcgcaacatgacgctgttctccgacctggtcgctgagaagttcatcgatgacatggaggacgtcctctgcccggggtgagcgtgtgggcgcggggcagtcggccgaggagcagcaggccccagccgctgtctagcgtgagccccagggacacccctcacctgagggacgaatgtgcagcccaggatcttgggctgtgggtgggaaggggtcgggccctctcggggctgcagggcagaggccagctgcaccctgagcctgtctaggcagatcagtgaacggccgctgagggttcgctagggactgaccctggcctggcccggcctctctcctctcttccagaccctcagatcgtgtgcccagaccttccctgccaaacaggtaatgcagggacctgagccaccaccccagactagcaaagcagccctggtgtccttcctcctcgagggccgggctgggggaggggccgtgcagggacccgggggcggcggacnactgcggaggctgctccttagggagatggccccaggatggcagcacaggggaggaggggcttggggaaggcaggctcccaggaacgcaggaacagcatcacgaggccatgaggtgggtgctgctagcctggcgctgtgctcggcatgtggccactggtcttgaaggcccaccatgggcttgcagtctccctcagctgccgcccagctcccatgggctggccgtgcatgtgccaccggaggaagccctggatcagtgagtgaaaccatcccggggtggaagcactgacaccccccagcaccagcaggtcttgctccaaccctggcctgcctcggagctgcagctgcggctctcatctctgggagtgggggagcccatgtccggatgtggcccacgtggtgtgaagctggagctgggggtgccgtncagctctgctggactggtgctgcccccatggtgcactgctgcaccgtnnctgggcccacaggaggtccccgggggcgttagnagctgagtccccctcantgagccgtcccctccaggagtgtgagggtngggatgccatggagacagggtgggagggtccgactggaggaccacagggaggaaacctcnnngnntnngntnnnannnnnncnnnncntcnnnncncnngnnnnngngtgngnnnnngngntccatggggag

SEQ ID NO: 342171 - DNA, 2510 bp, Homo sapiens
ggggagcggcagggatcaccatccaaagggagcggcccccacggcgagctgaccccgacgttctgactgcaggagccctcatccaggctgggctcctgccgggcacggctgtgaccatttctcagggccaggttctcgtccccacacccactgcacagggcaggccaggctggtcttcccactgtggggatgaaggatcctccacaggaggaggagagcagagtccacagacatcccaacagcctcagcctccctgtgcctggccggcccccacagcttccccgtctcctccaggccccacagacactgatgaatggacagagacccccaaaaccagctgccccttgcatgtctgtctccatatgtttggtgacagcagtgaaaatgttattagttttgagggggtttgggaagcccagcggtacctgaggagtttctggacatttaagccggttcctaggtgtggccttaacagggaggctgcccttcctttcactgaatgagctgcgtcactcataagctcactgagggaaccccatctgccagctcgtgcgtgctcagacgacgtccatgtctcaagcgttctgtgaaggctgcggtgcagcgtgaggtcaccctgctgtgttcagagctttgctcactgcctgcggggctggaccgttgcacctccagggcccccagaaaccgagtttcgggtcagggtcctctgtgtgcattcctgggggtccatgtaccagctgtgacgacgtccaggggttgggctgagaagcagacacccttggggaaactggctctgtccctcccctcccccatcccaggagctgaggtcttggtgaggccacagggccaggtccacgcaaggactgtccgtgtcctgtcctgtggtctctggccccacgtgacacccacacgtgtggtaggcagcctggcctgggttgtggctatggccaggcccccaagctgtccccgatgcccagggctggtgaccacccaggcaggtgggggccccacttggtaacagagtcatagggcagaacccacctgggctgccacagaaggtctggctgcccctgtgcccactgctccccaccatggccaatcagaagagtcaggggctcctggtctttccgggagggacgtggcccagccagctctaggtgttctgagcagctctgggacccagcgattgaggggtcaggctgggggtgtcagagccagggtcctccttaagtacctcccacactacacagacagtggcccttttgtgggcagcaaattcttgagccatgaaaggatgctttgggccccttccctcccaggagggcagcctgtgcagggatggtgctcagcaggtggacagggcctggggcctgtgtcagggtctcaggcctgggagcaccagcagaggagatggcggctcccagcagtgccgcctgaaagtgtcttgggctaaggacccacacccagggctgccctgcagaaacgcccccgcagagcccagtggtctgtgaggttgcaggcagggtgcgaatggaagggcacaggtgcggggctggcacctgcccggtcctgcccacctcccctccgcccagcccgcacctgcgtctccccacaagctgtccgtggcacagtgcacgcagcggcccgtggacatcgtcttcctgctggacggctccgagcggctgggtgagcagaacttccacaaggcccggcgcttcgtggagcaggtggcgcggcggctgacgctggcccggagggacgacgaccctctcaacgcacgcgtggcgctgctgcagtttggtggccccggcgagcagcaggtggccttcccgctgagccacaacctcacggccatccacgaggcgctggagaccacacaatacctgaactccttctcgcacgtgggcgcaggcgtggtgcacgccatcaatgccatcgtgcgcagcccgcgtggcggggcccggaggcacgcagagctgtccttcgtgttcctcacggacggcgtcacgggcaacgacagtctgcacgagtcggcgcactccatgcgcaagcagaacgtggtacccaccgtgctggccttgggcagcgacgtggacatggacgtgctcaccacgctcagcctgggtgaccgcgccgccgtgttccacgagaaggactatgacagcctggcgcaacccggcttcttcgaccgcttcatccgctggatctgctagcgccgccgcccgggccccgcagtcgagggtcgtgagcccaccccgtccatggtgctaagcgggcccgggtcccacacggccagcaccgctgctcactcggacgacgccctgggcctgcacctctccagctcctcccacggggtccccgtagccccggcccccgcccagccccaggtctccccaggccctccgcaggctgcccggcctccctccccctgcagccatcccaaggctcctgacctacctggcccctgagctctggagcaagccctgacccaataaaggctttgaacccaa

SEQ ID NO: 342172 - DNA, 1893 bp, Homo sapiens
  misc_feature (908)..(909): n is a, c, g, or t
agccagccctgcgtgcccgggataaacccacctggccgtggtgtgtggccctgttatgcacgtgggccctgattcgctgatgcctgcctgagggtttgcgcttatcggcgacatcagcctgcacttttcttttctcgtgatctctctggttctggcctcagggtgacgtgggcctcgtagggtcccgtggtggctcctccccagacggtgacatggagtgagcccattctccctcctgggagtgggtcactcaggccaccagagcaccacagggaaagcagccagggaggacacggaggcccttgaagctctggcctcttctgaggcctccaggacctgacagtgagtgggagcagccctggcagaacccctcccctcctctcggccgccctgacacctcatccccgacactcagagctcatcctccttcccagctgtttccaatttcaaagtgaactcgaccttgtggctccaggagatgcagcagggacagtgttaaatcggctttcaccagcccacacagccaggcatcctcctcggccctcctgggcactgggtggacaccactggctgtggcctgctggcctggccctggccttctccagacagccctgtccaccccaaagcccagccaccctgggcctgcagcaggcctgtggagttctcagttgcgtggggaccagagggtgctggagaaacaaaccagacgcagctgaaggcagtcagggcagggcgcaatcagcgataagagctgcataggggccacagcgtaacctgagctccagtcggtggaaagaaaaggcagagacgttgcagaggccaggtctgctcaggggaagacagttctgggtgtagaggactcacatcccagagaggctgaggaagggtttaccacgcaagcttctcanncgggctcttgaggggtggctggggtcttcctggcgacgggctgcggcactgaagccctactggagtttggcctgtctccggcacaggtttggacggagctgttttgtgctgaaaggttttctcggggtccgtggtgtcccccaaaggtgccaccgtgcgggtctcctagctccctgccagcttcctgtccctgtgctcactgcccccacgcctcctgccaaggccgagccacacacccgctccacctgcatttcctctaccgactcgccagcccaaatgccgctcttcactctggcctcgctgagcggctgcccgaggaggagctctaggccgacgcccaccgcaggccttacagtcttctctggacgctcccttgcagatgcaccgtggcctggcggcgagcccccggtcaccttcctccgcacggaagaggggccggacgccaccttccccaggaccattcccctgatccaacagttgctaaacgccacggagctcacgcaggacccggccgcctactcccagctggtggccgtgctggtctacaccgccgagcgggccaagttcgccaccggggtagagcggcaggactggatggagctgttcattgacacctttaagctggtgcacagggacatcgtgggggaccccgagaccgcgctggccctctgctaaagcccgggcacccgcccagccgggctgggccctccctgccacactagcttcccagggctgcccccgacaggctggctctcagtggaggccagagatctggaatcggggtcagcggggctacagtccttccaggggctctggggcagctcccagcctcttcccatgctggtggccaccgtgtcccttgctgcggctgcatcttccagtctctcctccgtcttcctgtggccgctctctttataagaaccctggtcattgaatttaaggcccaccccaagtccagaatgacctcgcaagacccttaactca

SEQ ID NO: 342173 - DNA, 3430 bp, Homo sapiens
ccatgttgccgcaacatgctcgggagcggagcctcctcgggaccaggacttcagggccacaggtgctgccaagatgctccagggcacctgctccgtgctcctgctctggggaatcctgggggccatccaggcccagcagcaggaggtcatctcgccggacactaccgagagaaacaacaactgcccagagaagaccgactgccccatccacgtgtacttcgtgctggacacctcggagagcgtcaccatgcagtcccccacggacatcctgctcttccacatgaagcagttcgtgccgcagttcatcagccagctgcagaacgagttctacctggaccaggtggcgctgagctggcgctacggcggcctgcacttctctgaccaggtggaggtgttcagcccaccgggcagcgaccgggcctccttcatcaagaacctgcagggcatcagctccttccgccgcggcaccttcaccgactgcgcgctggccaacatgacggagcagatccggcaggaccgcagcaagggcaccgtccacttcgccgtggtcatcaccgacggccacgtcaccggcagcccctgcgggggcatcaagctgcaggccgagcgggcccgcgaggagggcatccggctcttcgccgtggcccccaaccagaacctgaaggagcagggcctgcgggacatcgccagcacgccgcacgagctctaccgcaacgactacgccaccatgctgcccgactccaccgagatcgaccaggacaccatcaaccgcatcatcaaggtcatgaaacacgaagcctacggagagtgctacaaggtgagctgcctggaaatccctgggccctctggccccaagggctaccgtggacagaagggtgccaagggcaacatgggtgagccgggagagcctggccagaagggaagacagggagacccgggcatcgaaggccccattggattcccaggacccaagggcgttcctggcttcaaaggagagaagggtgaatttggagccgacggtcgcaagggggcccctggcctggctggcaagaacgggaccgatggacagaagggcaagctggggcgcatcggacctcctggctgcaagggagaccctggaaaccggggccccgacggttacccgggggaagcagggagtccaggggagcgaggagaccaaggcggcaagggggaccctggccgcccaggacgcagagggcccccgggagaaatcggggccaagggaagcaaggggtatcaaggcaacaatggagccccaggaagtcctggtgtgaaaggagccaagggcgggcctgggccccgcggacccaaaggcgagccggggcgcaggggagaccccggcaccaagggcagcccaggcagcgatggccccaagggggagaagggggaccctggccctgaggggccccgcggcctggctggagaggttggcaacaaaggagccaagggagaccgaggcttgcctggacccagaggcccccagggagctcttggggagcccggaaagcagggatctcggggagaccccggtgatgcaggaccccgtggagactcaggacagccaggccccaagggagaccccggcaggcctggattcagctacccaggaccccgaggagcacccggagaaaaaggcgagcccggcccacgcggccccgagggaggccgaggcgactttggcttgaaaggagaacctgggaggaaaggagagaaaggagagcctgcggatcctggtccccctggtgagccaggccctcgggggccaagaggagtcccaggacccgagggtgagcccggcccccctggagaccccggtctcacggagtgtgacgtcatgacctacgtgagggagacctgcgggtgctgcgactgtgagaagcgctgtggcgccctggacgtggtcttcgtcatcgacagctccgagagcattgggtacaccaacttcacactggagaagaacttcgtcatcaacgtggtcaacaggctgggtgccatcgctaaggaccccaagtccgagacagggacgcgtgtgggcgtggtgcagtacagccacgagggcacctttgaggccatccagctggacgacgaacgtatcgactccctgtcgagcttcaaggaggctgtcaagaacctcgagtggattgcgggcggcacctggacaccctcagccctcaagtttgcctacgaccgcctcatcaaggagagccggcgccagaagacacgtgtgtttgcggtggtcatcacggacgggcgccacgaccctcgggacgatgacctcaacttgcgggcgctgtgcgaccgcgacgtcacagtgacggccatcggcatcggggacatgttccacgagaagcacgagagtgaaaacctctactccatcgcctgcgacaagccacagcaggtgcgcaacatgacgctgttctccgacctggtcgctgagaagttcatcgatgacatggaggacgtcctctgcccggaccctcagatcgtgtgcccagaccttccctgccaaacagagctgtccgtggcacagtgcacgcagcggcccgtggacatcgtcttcctgctggacggctccgagcggctgggtgagcagaacttccacaaggcccggcgcttcgtggagcaggtggcgcggcggctgacgctggcccggagggacgacgaccctctcaacgcacgcgtggcgctgctgcagtttggtggccccggcgagcagcaggtggccttcccgctgagccacaacctcacggccatccacgaggcgctggagaccacacaatacctgaactccttctcgcacgtgggcgcaggcgtggtgcacgccatcaatgccatcgtgcgcagcccgcgtggcggggcccggaggcacgcagagctgtccttcgtgttcctcacggacggcgtcacgggcaacgacagtctgcacgagtcggcgcactccatgcgcaagcagaacgtggtacccaccgtgctggccttgggcagcgacgtggacatggacgtgctcaccacgctcagcctgggtgaccgcgccgccgtgttccacgagaaggactatgacagcctggcgcaacccggcttcttcgaccgcttcatccgctggatctgctagcgccgccgcccgggccccgcagtcgagggtcgtgagcccaccccgtccatggtgctaagcgggcccgggtcccacacggccagcaccgctgctcactcggacgacgccctgggcctgcacctctccagctcctcccacggggtccccgtagccccggcccccgcccagccccaggtctccccaggccctccgcaggctgcccggcctccctccccctgcagccatcccaaggctcctgacctacctggcccctgagctctggagcaagccctgacccaataaaggctttgaacccaa

SEQ ID NO: 342174 - DNA, 3331 bp, Homo sapiens
ccatgttgccgcaacatgctcgggagcggagcctcctcgggaccaggacttcagggccacaggtgctgccaagatgctccagggcacctgctccgtgctcctgctctggggaatcctgggggccatccaggcccagcagcaggaggtcatctcgccggacactaccgagagaaacaacaactgcccagagaagaccgactgccccatccacgtgtacttcgtgctggacacctcggagagcgtcaccatgcagtcccccacggacatcctgctcttccacatgaagcagttcgtgccgcagttcatcagccagctgcagaacgagttctacctggaccaggtggcgctgagctggcgctacggcggcctgcacttctctgaccaggtggaggtgttcagcccaccgggcagcgaccgggcctccttcatcaagaacctgcagggcatcagctccttccgccgcggcaccttcaccgactgcgcgctggccaacatgacggagcagatccggcaggaccgcagcaagggcaccgtccacttcgccgtggtcatcaccgacggccacgtcaccggcagcccctgcgggggcatcaagctgcaggccgagcgggcccgcgaggagggcatccggctcttcgccgtggcccccaaccagaacctgaaggagcagggcctgcgggacatcgccagcacgccgcacgagctctaccgcaacgactacgccaccatgctgcccgactccaccgagatcgaccaggacaccatcaaccgcatcatcaaggtcatgaaacacgaagcctacggagagtgctacaaggtgagctgcctggaaatccctgggccctctggccccaagggctaccgtggacagaagggtgccaagggcaacatgggtgagccgggagagcctggccagaagggaagacagggagacccgggcatcgaaggccccattggattcccaggacccaagggcgttcctggcttcaaaggagagaagggtgaatttggagccgacggtcgcaagggggcccctggcctggctggcaagaacgggaccgatggacagaagggcaagctggggcgcatcggacctcctggctgcaagggagaccctggaaaccggggccccgacggttacccgggggaagcagggagtccaggggagcgaggagaccaaggcggcaagggggaccctggccgcccaggacgcagagggcccccgggagaaatcggggccaagggaagcaaggggtatcaaggcaacaatggagccccaggaagtcctggtgtgaaaggagccaagggcgggcctgggccccgcggacccaaaggcgagccggggcgcaggggagaccccggcaccaagggcagcccaggcagcgatggccccaagggggagaagggggaccctggccctgaggggccccgcggcctggctggagaggttggcaacaaaggagccaagggagaccgaggcttgcctggacccagaggcccccagggagctcttggggagcccggaaagcagggatctcggggagaccccggtgatgcaggaccccgtggagactcaggacagccaggccccaagggagaccccggcaggcctggattcagctacccaggaccccgaggagcacccggagaaaaaggcgagcccggcccacgcggccccgagggaggccgaggcgactttggcttgaaaggagaacctgggaggaaaggagagaaaggagagcctgcggatcctggtccccctggtgagccaggccctcgggggccaagaggagtcccaggacccgagggtgagcccggcccccctggagaccccggtctcacggagtgtgacgtcatgacctacgtgagggagacctgcgggtgctgcgactgtgagaagcgctgtggcgccctggacgtggtcttcgtcatcgacagctccgagagcattgggtacaccaacttcacactggagaagaacttcgtcatcaacgtggtcaacaggctgggtgccatcgactccctgtcgagcttcaaggaggctgtcaagaacctcgagtggattgcgggcggcacctggacaccctcagccctcaagtttgcctacgaccgcctcatcaaggagagccggcgccagaagacacgtgtgtttgcggtggtcatcacggacgggcgccacgaccctcgggacgatgacctcaacttgcgggcgctgtgcgaccgcgacgtcacagtgacggccatcggcatcggggacatgttccacgagaagcacgagagtgaaaacctctactccatcgcctgcgacaagccacagcaggtgcgcaacatgacgctgttctccgacctggtcgctgagaagttcatcgatgacatggaggacgtcctctgcccggaccctcagatcgtgtgcccagaccttccctgccaaacagagctgtccgtggcacagtgcacgcagcggcccgtggacatcgtcttcctgctggacggctccgagcggctgggtgagcagaacttccacaaggcccggcgcttcgtggagcaggtggcgcggcggctgacgctggcccggagggacgacgaccctctcaacgcacgcgtggcgctgctgcagtttggtggccccggcgagcagcaggtggccttcccgctgagccacaacctcacggccatccacgaggcgctggagaccacacaatacctgaactccttctcgcacgtgggcgcaggcgtggtgcacgccatcaatgccatcgtgcgcagcccgcgtggcggggcccggaggcacgcagagctgtccttcgtgttcctcacggacggcgtcacgggcaacgacagtctgcacgagtcggcgcactccatgcgcaagcagaacgtggtacccaccgtgctggccttgggcagcgacgtggacatggacgtgctcaccacgctcagcctgggtgaccgcgccgccgtgttccacgagaaggactatgacagcctggcgcaacccggcttcttcgaccgcttcatccgctggatctgctagcgccgccgcccgggccccgcagtcgagggtcgtgagcccaccccgtccatggtgctaagcgggcccgggtcccacacggccagcaccgctgctcactcggacgacgccctgggcctgcacctctccagctcctcccacggggtccccgtagccccggcccccgcccagccccaggtctccccaggccctccgcaggctgcccggcctccctccccctgcagccatcccaaggctcctgacctacctggcccctgagctctggagcaagccctgacccaataaaggctttgaacccaa

SEQ ID NO: 342175 - DNA, 1014 bp, Homo sapiens
ttatctagagatcccccatgttggccgcatctggtcgctgagaagttcatcgatgacatggaggacgtcctctgcccggaccctcagatcgtgtgcccagaccttccctgccaaacagagctgtccgtggcacagtgcacgcagcggcccgtggacatcgtcttcctgctggacggctccgagcggctgggtgagcagaacttccacaaggcccggcgcttcgtggagcaggtggcgcggcggctgacgctggcccggagggacgacgaccctctcaacgcacgcgtggcgctgctgcagtttggtggccccggcgagcagcaggtggccttcccgctgagccacaacctcacggccatccacgaggcgctggagaccacacaatacctgaactccttctcgcacgtgggcgcaggcgtggtgcacgccatcaatgccatcgtgcgcagcccgcgtggcggggcccggaggcacgcagagctgtccttcgtgttcctcacggacggcgtcacgggcaacgacagtctgcacgagtcggcgcactccatgcgcaagcagaacgtggtacccaccgtgctggccttgggcagcgacgtggacatggacgtgctcaccacgctcagcctgggtgaccgcgccgccgtgttccacgagaaggactatgacagcctggcgcaacccggcttcttcgaccgcttcatccgctggatctgctagcgccgccgcccgggccccgcagtcgagggtcgtgagcccaccccgtccatggtgctaagcgggcccgggtcccacacggccagcaccgctgctcactcggacgacgccctgggcctgcacctctccagctcctcccacggggtccccgtagccccggcccccgcccagccccaggtctccccaggccctccgcaggctgcccggcctccctccccctgcagccatcccaaggctcctgacctacctggcccctgagctctggagcaagccctgacccaataaaggctttgaacccaa

SEQ ID NO: 342176 - DNA, 948 bp, Homo sapiens
  misc_feature (4)..(4): n is a, c, g, or t
  misc_feature (9)..(9): n is a, c, g, or t
  misc_feature (21)..(21): n is a, c, g, or t
gaangtaantctagaggatcncgaacgggtgatgcggttggggactgggcaggaggctccctgtaaacatttggacttgggctggggcagggtgctggtgttggggaacgggtgatgcggctgggtgagcagaacttccacaaggcccggcgcttcgtggagcaggtggcgcggcggctgacgctggcccggagggacgacgaccctctcaacgcacgcgtggcgctgctgcagtttggtggccccggcgagcagcaggtggccttcccgctgagccacaacctcacggccatccacgaggcgctggagaccacacaatacctgaactccttctcgcacgtgggcgcaggcgtggtgcacgccatcaatgccatcgtgcgcagcccgcgtggcggggcccggaggcacgcagagctgtccttcgtgttcctcacggacggcgtcacgggcaacgacagtctgcacgagtcggcgcactccatgcgcaagcagaacgtggtacccaccgtgctggccttgggcagcgacgtggacatggacgtgctcaccacgctcagcctgggtgaccgcgccgccgtgttccacgagaaggactatgacagcctggcgcaacccggcttcttcgaccgcttcatccgctggatctgctagcgccgccgcccgggccccgcagtcgagggtcgtgagcccaccccgtccatggtgctaagcgggcccgggtcccacacggccagcaccgctgctcactcggacgacgccctgggcctgcacctctccagctcctcccacggggtccccgtagccccggcccccgcccagccccaggtctccccaggccctccgcaggctgcccggcctccctccccctgcagccatcccaaggctcctgacctacctggcccctgagctctggagcaagccctgacccaataaaggctttgaacccaa

SEQ ID NO: 342177 - DNA, 3453 bp, Homo sapiens
ccatgttgccgcaacatgctcgggagcggagcctcctcgggaccaggacttcagggccacaggtgctgccaagatgctccagggcacctgctccgtgctcctgctctggggaatcctgggggccatccaggcccagcagcaggaggtcatctcgccggacactaccgagagaaacaacaactgcccagagaagaccgactgccccatccacgtgtacttcgtgctggacacctcggagagcgtcaccatgcagtcccccacggacatcctgctcttccacatgaagcagttcgtgccgcagttcatcagccagctgcagaacgagttctacctggaccaggtggcgctgagctggcgctacggcggcctgcacttctctgaccaggtggaggtgttcagcccaccgggcagcgaccgggcctccttcatcaagaacctgcagggcatcagctccttccgccgcggcaccttcaccgactgcgcgctggccaacatgacggagcagatccggcaggaccgcagcaagggcaccgtccacttcgccgtggtcatcaccgacggccacgtcaccggcagcccctgcgggggcatcaagctgcaggccgagcgggcccgcgaggagggcatccggctcttcgccgtggcccccaaccagaacctgaaggagcagggcctgcgggacatcgccagcacgccgcacgagctctaccgcaacgactacgccaccatgctgcccgactccaccgagatcgaccaggacaccatcaaccgcatcatcaaggtcatgaaacacgaagcctacggagagtgctacaaggtgagctgcctggaaatccctgggccctctggccccaagggctaccgtggacagaagggtgccaagggcaacatgggtgagccgggagagcctggccagaagggaagacagggagacccgggcatcgaaggccccattggattcccaggacccaagggcgttcctggcttcaaaggagagaagggtgaatttggagccgacggtcgcaagggggcccctggcctggctggcaagaacgggaccgatggacagaagggcaagctggggcgcatcggacctcctggctgcaagggagaccctggaaaccggggccccgacggttacccgggggaagcagggagtccaggggagcgaggagaccaaggcggcaagggggaccctggccgcccaggacgcagagggcccccgggagaaatcggggccaagggaagcaaggggtatcaaggcaacaatggagccccaggaagtcctggtgtgaaaggagccaagggcgggcctgggccccgcggacccaaaggcgagccggggcgcaggggagaccccggcaccaagggcagcccaggcagcgatggccccaagggggagaagggggaccctggccctgaggggccccgcggcctggctggagaggttggcaacaaaggagccaagggagaccgaggcttgcctggacccagaggcccccagggagctcttggggagcccggaaagcagggatctcggggagaccccggtgatgcaggaccccgtggagactcaggacagccaggccccaagggagaccccggcaggcctggattcagctacccaggaccccgaggagcacccggagaaaaaggcgagcccggcccacgcggccccgagggaggccgaggcgactttggcttgaaaggagaacctgggaggaaaggagagaaaggagagcctgcggatcctggtccccctggtgagccaggccctcgggggccaagaggagtcccaggacccgagggtgagcccggcccccctggagaccccggtctcacggagtgtgacgtcatgacctacgtgagggagacctgcgggtgctgcgactgtgagaagcgctgtggcgccctggacgtggtcttcgtcatcgacagctccgagagcattgggtacaccaacttcacactggagaagaacttcgtcatcaacgtggtcaacaggctgggtgccatcgctaaggaccccaagtccgagacagggacgcgtgtgggcgtggtgcagtacagccacgagggcacctttgaggccatccagctggacgacgaacgtatcgactccctgtcgagcttcaaggaggctgtcaagaacctcgagtggattgcgggcggcacctggacaccctcagccctcaagtttgcctacgaccgcctcatcaaggagagccggcgccagaagacacgtgtgtttgcggtggtcatcacggacgggcgccacgaccctcgggacgatgacctcaacttgcgggcgctgtgcgaccgcgacgtcacagtgacggccatcggcatcggggacatgttccacgagaagcacgagagtgaaaacctctactccatcgcctgcgacaagccacagcaggtgcgcaacatgacgctgttctccgacctggtcgctgagaagttcatcgatgacatggaggacgtcctctgcccggaccctcagatcgtgtgcccagaccttccctgccaaacagagctgtccgtggcacagtgcacgcagcggcccgtggacatcgtcttcctgctggacggctccgagcggctgggtgagcagaacttccacaaggcccggcgcttcgtggagcaggtggcgcggcggctgacgctggcccggagggacgacgaccctctcaacgcacgcgtggcgctgctgcagtttggtggccccggcgagcagcaggtggccttcccgctgagccacaacctcacggccatccacgaggcgctggagaccacacaatacctgaactccttctcgcacgtgggcgcaggcgtggtgcacgccatcaatgccatcgtgcgcagcccgcgtggcggggcccggaggcacgcagagctgtccttcgtgttcctcacggacggcgtcacgggcaacgacagtctgcacgagtcggcgcactccatgcgcaagcagaacgtggtacccaccgtgctggccttgggcagcgacgtggacatggacgtgctcaccacgctcagcctgggtgaccgcgccgccgtgttccacgagaaggactatgacagcctggcgcaacccggcttcttcgaccgcttcatccgctggatctgctagcgccgccgcccgggccccgcagtcgagggtcgtgagcccaccccgtccatggtgctaagcgggcccgggtcccacacggccagcaccgctgctcactcggacgacgccctgggcctgcacctctccagctcctcccacggggtccccgtagccccggcccccgcccagccccaggtctccccaggccctccgcaggctgcccggcctccctccccctgcagccatcccaaggctcctgacctacctgtaactcgcacctctgtgagattttaaaagacccggcgaaggccctttgatcccacaataaaacggcctaagtc

SEQ ID NO: 342178 - DNA, 3139 bp, Homo sapiens
ccatgttgccgcaacatgctcgggagcggagcctcctcgggaccaggacttcagggccacaggtgctgccaagatgctccagggcacctgctccgtgctcctgctctggggaatcctgggggccatccaggcccagcagcaggaggtcatctcgccggacactaccgagagaaacaacaactgcccagagaagaccgactgccccatccacgtgtacttcgtgctggacacctcggagagcgtcaccatgcagtcccccacggacatcctgctcttccacatgaagcagttcgtgccgcagttcatcagccagctgcagaacgagttctacctggaccaggtggcgctgagctggcgctacggcggcctgcacttctctgaccaggtggaggtgttcagcccaccgggcagcgaccgggcctccttcatcaagaacctgcagggcatcagctccttccgccgcggcaccttcaccgactgcgcgctggccaacatgacggagcagatccggcaggaccgcagcaagggcaccgtccacttcgccgtggtcatcaccgacggccacgtcaccggcagcccctgcgggggcatcaagctgcaggccgagcgggcccgcgaggagggcatccggctcttcgccgtggcccccaaccagaacctgaaggagcagggcctgcgggacatcgccagcacgccgcacgagctctaccgcaacgactacgccaccatgctgcccgactccaccgagatcgaccaggacaccatcaaccgcatcatcaaggtcatgaaacacgaagcctacggagagtgctacaaggtgagctgcctggaaatccctgggccctctggccccaagggctaccgtggacagaagggtgccaagggcaacatgggtgagccgggagagcctggccagaagggaagacagggagacccgggcatcgaaggccccattggattcccaggacccaagggcgttcctggcttcaaaggagagaagggtgaatttggagccgacggtcgcaagggggcccctggcctggctggcaagaacgggaccgatggacagaagggcaagctggggcgcatcggacctcctggctgcaagggagaccctggaaaccggggccccgacggttacccgggggaagcagggagtccaggggagcgaggagaccaaggcggcaagggggaccctggccgcccaggacgcagagggcccccgggagaaatcggggccaagggaagcaaggggtatcaaggcaacaatggagccccaggaagtcctggtgtgaaaggagccaagggcgggcctgggccccgcggacccaaaggcgagccggggcgcaggggagaccccggcaccaagggcagcccaggcagcgatggccccaagggggagaagggggaccctggccctgaggggccccgcggcctggctggagaggttggcaacaaaggagccaagggagaccgaggcttgcctggacccagaggcccccagggagctcttggggagcccggaaagcagggatctcggggagaccccggtgatgcaggaccccgtggagactcaggacagccaggccccaagggagaccccggcaggcctggattcagctacccaggaccccgaggagcacccggagaaaaaggcgagcccggcccacgcggccccgagggaggccgaggcgactttggcttgaaaggagaacctgggaggaaaggagagaaaggagagcctgcggatcctggtccccctggtgagccaggccctcgggggccaagaggagtcccaggacccgagggtgagcccggcccccctggagaccccggtctcacggagtgtgacgtcatgacctacgtgagggagacctgcgggtgctgcgactgtgagaagcgctgtggcgccctggacgtggtcttcgtcatcgacagctccgagagcattgggtacaccaacttcacactggagaagaacttcgtcatcaacgtggtcaacaggctgggtgccatcgctaaggaccccaagtccgagacagggacgcgtgtgggcgtggtgcagtacagccacgagggcacctttgaggccatccagctggacgacgaacgtatcgactccctgtcgagcttcaaggaggctgtcaagaacctcgagtggattgcgggcggcacctggacaccctcagccctcaagtttgcctacgaccgcctcatcaaggagagccggcgccagaagacacgtgtgtttgcggtggtcatcacggacgggcgccacgaccctcgggacgatgacctcaacttgcgggcgctgtgcgaccgcgacgtcacagtgacggccatcggcatcggggacatgttccacgagaagcacgagagtgaaaacctctactccatcgcctgcgacaagccacagcaggtgcgcaacatgacgctgttctccgacctggtcgctgagaagttcatcgatgacatggaggacgtcctctgcccggaccctcagatcgtgtgcccagaccttccctgccaaacagatgcaccgtggcctggcggcgagcccccggtcaccttcctccgcacggaagaggggccggacgccaccttccccaggaccattcccctgatccaacagttgctaaacgccacggagctcacgcaggacccggccgcctactcccagctggtggccgtgctggtctacaccgccgagcgggccaagttcgccaccggggtagagcggcaggactggatggagctgttcattgacacctttaagctggtgcacagggacatcgtgggggaccccgagaccgcgctggccctctgctaaagcccgggcacccgcccagccgggctgggccctccctgccacactagcttcccagggctgcccccgacaggctggctctcagtggaggccagagatctggaatcggggtcagcggggctacagtccttccaggggctctggggcagctcccagcctcttcccatgctggtggccaccgtgtcccttgctgcggctgcatcttccagtctctcctccgtcttcctgtggccgctctctttataagaaccctggtcattgaatttaaggcccaccccaagtccagaatgacctcgcaagacccttaactca

SEQ ID NO: 342179 - DNA, 2832 bp, Homo sapiens
ccatgttgccgcaacatgctcgggagcggagcctcctcgggaccaggacttcagggccacaggtgctgccaagatgctccagggcacctgctccgtgctcctgctctggggaatcctgggggccatccaggcccagcagcaggaggtcatctcgccggacactaccgagagaaacaacaactgcccagagaagaccgactgccccatccacgtgtacttcgtgctggacacctcggagagcgtcaccatgcagtcccccacggacatcctgctcttccacatgaagcagttcgtgccgcagttcatcagccagctgcagaacgagttctacctggaccaggtggcgctgagctggcgctacggcggcctgcacttctctgaccaggtggaggtgttcagcccaccgggcagcgaccgggcctccttcatcaagaacctgcagggcatcagctccttccgccgcggcaccttcaccgactgcgcgctggccaacatgacggagcagatccggcaggaccgcagcaagggcaccgtccacttcgccgtggtcatcaccgacggccacgtcaccggcagcccctgcgggggcatcaagctgcaggccgagcgggcccgcgaggagggcatccggctcttcgccgtggcccccaaccagaacctgaaggagcagggcctgcgggacatcgccagcacgccgcacgagctctaccgcaacgactacgccaccatgctgcccgactccaccgagatcgaccaggacaccatcaaccgcatcatcaaggtcatgaaacacgaagcctacggagagtgctacaaggtgagctgcctggaaatccctgggccctctggccccaagggctaccgtggacagaagggtgccaagggcaacatgggtgagccgggagagcctggccagaagggaagacagggagacccgggcatcgaaggccccattggattcccaggacccaagggcgttcctggcttcaaaggagagaagggtgaatttggagccgacggtcgcaagggggcccctggcctggctggcaagaacgggaccgatggacagaagggcaagctggggcgcatcggacctcctggctgcaagggagaccctggaaaccggggccccgacggttacccgggggaagcagggagtccaggggagcgaggagaccaaggcggcaagggggaccctggccgcccaggacgcagagggcccccgggagaaatcggggccaagggaagcaaggggtatcaaggcaacaatggagccccaggaagtcctggtgtgaaaggagccaagggcgggcctgggccccgcggacccaaaggcgagccggggcgcaggggagaccccggcaccaagggcagcccaggcagcgatggccccaagggggagaagggggaccctggccctgaggggccccgcggcctggctggagaggttggcaacaaaggagccaagggagaccgaggcttgcctggacccagaggcccccagggagctcttggggagcccggaaagcagggatctcggggagaccccggtgatgcaggaccccgtggagactcaggacagccaggccccaagggagaccccggcaggcctggattcagctacccaggaccccgaggagcacccggagaaaaaggcgagcccggcccacgcggccccgagggaggccgaggcgactttggcttgaaaggagaacctgggaggaaaggagagaaaggagagcctgcggatcctggtccccctggtgagccaggccctcgggggccaagaggagtcccaggacccgagggtgagcccggcccccctggagaccccggtctcacggagtgtgacgtcatgacctacgtgagggagacctgcgggtgctgcgactgtgagaagcgctgtggcgccctggacgtggtcttcgtcatcgacagctccgagagcattgggtacaccaacttcacactggagaagaacttcgtcatcaacgtggtcaacaggctgggtgccatcgctaaggaccccaagtccgagacagggacgcgtgtgggcgtggtgcagtacagccacgagggcacctttgaggccatccagctggacgacgaacgtatcgactccctgtcgagcttcaaggaggctgtcaagaacctcgagtggattgcgggcggcacctggacaccctcagccctcaagtttgcctacgaccgcctcatcaaggagagccggcgccagaagacacgtgtgtttgcggtggtcatcacggacgggcgccacgaccctcgggacgatgacctcaacttgcgggcgctgtgcgaccgcgacgtcacagtgacggccatcggcatcggggacatgttccacgagaagcacgagagtgaaaacctctactccatcgcctgcgacaagccacagcaggtgcgcaacatgacgctgttctccgacctggtcgctgagaagttcatcgatgacatggaggacgtcctctgcccggaccctcagatcgtgtgcccagaccttccctgccaaacagagctgtccgtggcacagtgcacgcagcggcccgtggacatcgtcttcctgctggacggctccgagcggctgggtgagcagaacttccacaaggcccggcgcttcgtggagcaggtggcgcggcggctgacgctggcccggagggacgacgaccctctcaacgcacgcgtggcgctgctgcagtttggtgggccacgcggtggctcccgtgacaaactccggctccagagcttgggccgacgtgtcctcgcagggcggggtgtccaacctcgccccttggcggacaatcttcccgggcg

SEQ ID NO: 342180 - DNA, 2816 bp, Homo sapiens
ccatgttgccgcaacatgctcgggagcggagcctcctcgggaccaggacttcagggccacaggtgctgccaagatgctccagggcacctgctccgtgctcctgctctggggaatcctgggggccatccaggcccagcagcaggaggtcatctcgccggacactaccgagagaaacaacaactgcccagagaagaccgactgccccatccacgtgtacttcgtgctggacacctcggagagcgtcaccatgcagtcccccacggacatcctgctcttccacatgaagcagttcgtgccgcagttcatcagccagctgcagaacgagttctacctggaccaggtggcgctgagctggcgctacggcggcctgcacttctctgaccaggtggaggtgttcagcccaccgggcagcgaccgggcctccttcatcaagaacctgcagggcatcagctccttccgccgcggcaccttcaccgactgcgcgctggccaacatgacggagcagatccggcaggaccgcagcaagggcaccgtccacttcgccgtggtcatcaccgacggccacgtcaccggcagcccctgcgggggcatcaagctgcaggccgagcgggcccgcgaggagggcatccggctcttcgccgtggcccccaaccagaacctgaaggagcagggcctgcgggacatcgccagcacgccgcacgagctctaccgcaacgactacgccaccatgctgcccgactccaccgagatcgaccaggacaccatcaaccgcatcatcaaggtcatgaaacacgaagcctacggagagtgctacaaggtgagctgcctggaaatccctgggccctctggccccaagggctaccgtggacagaagggtgccaagggcaacatgggtgagccgggagagcctggccagaagggaagacagggagacccgggcatcgaaggccccattggattcccaggacccaagggcgttcctggcttcaaaggagagaagggtgaatttggagccgacggtcgcaagggggcccctggcctggctggcaagaacgggaccgatggacagaagggcaagctggggcgcatcggacctcctggctgcaagggagaccctggaaaccggggccccgacggttacccgggggaagcagggagtccaggggagcgaggagaccaaggcggcaagggggaccctggccgcccaggacgcagagggcccccgggagaaatcggggccaagggaagcaaggggtatcaaggcaacaatggagccccaggaagtcctggtgtgaaaggagccaagggcgggcctgggccccgcggacccaaaggcgagccggggcgcaggggagaccccggcaccaagggcagcccaggcagcgatggccccaagggggagaagggggaccctggccctgaggggccccgcggcctggctggagaggttggcaacaaaggagccaagggagaccgaggcttgcctggacccagaggcccccagggagctcttggggagcccggaaagcagggatctcggggagaccccggtgatgcaggaccccgtggagactcaggacagccaggccccaagggagaccccggcaggcctggattcagctacccaggaccccgaggagcacccggagaaaaaggcgagcccggcccacgcggccccgagggaggccgaggcgactttggcttgaaaggagaacctgggaggaaaggagagaaaggagagcctgcggatcctggtccccctggtgagccaggccctcgggggccaagaggagtcccaggacccgagggtgagcccggcccccctggagaccccggtctcacggagtgtgacgtcatgacctacgtgagggagacctgcgggtgctgcgactgtgagaagcgctgtggcgccctggacgtggtcttcgtcatcgacagctccgagagcattgggtacaccaacttcacactggagaagaacttcgtcatcaacgtggtcaacaggctgggtgccatcgctaaggaccccaagtccgagacagggacgcgtgtgggcgtggtgcagtacagccacgagggcacctttgaggccatccagctggacgacgaacgtatcgactccctgtcgagcttcaaggaggctgtcaagaacctcgagtggattgcgggcggcacctggacaccctcagccctcaagtttgcctacgaccgcctcatcaaggagagccggcgccagaagacacgtgtgtttgcggtggtcatcacggacgggcgccacgaccctcgggacgatgacctcaacttgcgggcgctgtgcgaccgcgacgtcacagtgacggccatcggcatcggggacatgttccacgagaagcacgagagtgaaaacctctactccatcgcctgcgacaagccacagcaggtgcgcaacatgacgctgttctccgacctggtcgctgagaagttcatcgatgacatggaggacgtcctctgcccgggccctctgctaaagcccgggcacccgcccagccgggctgggccctccctgccacactagcttcccagggctgcccccgacaggctggctctcagtggaggccagagatctggaatcggggtcagcggggctacagtccttccaggggctctggggcagctcccagcctcttcccatgctggtggccaccgtgtcccttgctgcggctgcatcttccagtctctcctccgtcttcctgtggccgctctctttataagaaccctggtcattgaatttaaggcccaccccaagtccagaatgacctcgcaagacccttaactca

SEQ ID NO: 342181 - DNA, 3598 bp, Homo sapiens
  misc_feature (2913)..(2913): n is a, c, g, or t
  misc_feature (3337)..(3337): n is a, c, g, or t
  misc_feature (3385)..(3386): n is a, c, g, or t
  misc_feature (3419)..(3419): n is a, c, g, or t
  misc_feature (3436)..(3436): n is a, c, g, or t
  misc_feature (3466)..(3466): n is a, c, g, or t
  misc_feature (3526)..(3528): n is a, c, g, or t
  misc_feature (3530)..(3531): n is a, c, g, or t
  misc_feature (3533)..(3534): n is a, c, g, or t
  misc_feature (3536)..(3536): n is a, c, g, or t
  misc_feature (3538)..(3540): n is a, c, g, or t
  misc_feature (3542)..(3547): n is a, c, g, or t
  misc_feature (3549)..(3552): n is a, c, g, or t
  misc_feature (3554)..(3554): n is a, c, g, or t
  misc_feature (3557)..(3560): n is a, c, g, or t
  misc_feature (3562)..(3562): n is a, c, g, or t
  misc_feature (3564)..(3565): n is a, c, g, or t
  misc_feature (3567)..(3571): n is a, c, g, or t
  misc_feature (3573)..(3573): n is a, c, g, or t
  misc_feature (3577)..(3577): n is a, c, g, or t
  misc_feature (3579)..(3583): n is a, c, g, or t
  misc_feature (3585)..(3585): n is a, c, g, or t
  misc_feature (3587)..(3587): n is a, c, g, or t
ccatgttgccgcaacatgctcgggagcggagcctcctcgggaccaggacttcagggccacaggtgctgccaagatgctccagggcacctgctccgtgctcctgctctggggaatcctgggggccatccaggcccagcagcaggaggtcatctcgccggacactaccgagagaaacaacaactgcccagagaagaccgactgccccatccacgtgtacttcgtgctggacacctcggagagcgtcaccatgcagtcccccacggacatcctgctcttccacatgaagcagttcgtgccgcagttcatcagccagctgcagaacgagttctacctggaccaggtggcgctgagctggcgctacggcggcctgcacttctctgaccaggtggaggtgttcagcccaccgggcagcgaccgggcctccttcatcaagaacctgcagggcatcagctccttccgccgcggcaccttcaccgactgcgcgctggccaacatgacggagcagatccggcaggaccgcagcaagggcaccgtccacttcgccgtggtcatcaccgacggccacgtcaccggcagcccctgcgggggcatcaagctgcaggccgagcgggcccgcgaggagggcatccggctcttcgccgtggcccccaaccagaacctgaaggagcagggcctgcgggacatcgccagcacgccgcacgagctctaccgcaacgactacgccaccatgctgcccgactccaccgagatcgaccaggacaccatcaaccgcatcatcaaggtcatgaaacacgaagcctacggagagtgctacaaggtgagctgcctggaaatccctgggccctctggccccaagggctaccgtggacagaagggtgccaagggcaacatgggtgagccgggagagcctggccagaagggaagacagggagacccgggcatcgaaggccccattggattcccaggacccaagggcgttcctggcttcaaaggagagaagggtgaatttggagccgacggtcgcaagggggcccctggcctggctggcaagaacgggaccgatggacagaagggcaagctggggcgcatcggacctcctggctgcaagggagaccctggaaaccggggccccgacggttacccgggggaagcagggagtccaggggagcgaggagaccaaggcggcaagggggaccctggccgcccaggacgcagagggcccccgggagaaatcggggccaagggaagcaaggggtatcaaggcaacaatggagccccaggaagtcctggtgtgaaaggagccaagggcgggcctgggccccgcggacccaaaggcgagccggggcgcaggggagaccccggcaccaagggcagcccaggcagcgatggccccaagggggagaagggggaccctggccctgaggggccccgcggcctggctggagaggttggcaacaaaggagccaagggagaccgaggcttgcctggacccagaggcccccagggagctcttggggagcccggaaagcagggatctcggggagaccccggtgatgcaggaccccgtggagactcaggacagccaggccccaagggagaccccggcaggcctggattcagctacccaggaccccgaggagcacccggagaaaaaggcgagcccggcccacgcggccccgagggaggccgaggcgactttggcttgaaaggagaacctgggaggaaaggagagaaaggagagcctgcggatcctggtccccctggtgagccaggccctcgggggccaagaggagtcccaggacccgagggtgagcccggcccccctggagaccccggtctcacggagtgtgacgtcatgacctacgtgagggagacctgcgggtgctgcgactgtgagaagcgctgtggcgccctggacgtggtcttcgtcatcgacagctccgagagcattgggtacaccaacttcacactggagaagaacttcgtcatcaacgtggtcaacaggctgggtgccatcgctaaggaccccaagtccgagacagggacgcgtgtgggcgtggtgcagtacagccacgagggcacctttgaggccatccagctggacgacgaacgtatcgactccctgtcgagcttcaaggaggctgtcaagaacctcgagtggattgcgggcggcacctggacaccctcagccctcaagtttgcctacgaccgcctcatcaaggagagccggcgccagaagacacgtgtgtttgcggtggtcatcacggacgggcgccacgaccctcgggacgatgacctcaacttgcgggcgctgtgcgaccgcgacgtcacagtgacggccatcggcatcggggacatgttccacgagaagcacgagagtgaaaacctctactccatcgcctgcgacaagccacagcaggtgcgcaacatgacgctgttctccgacctggtcgctgagaagttcatcgatgacatggaggacgtcctctgcccggggtgagcgtgtgggcgcggggcagtcggccgaggagcagcaggccccagccgctgtctagcgtgagccccagggacacccctcacctgagggacgaatgtgcagcccaggatcttgggctgtgggtgggaaggggtcgggccctctcggggctgcagggcagaggccagctgcaccctgagcctgtctaggcagatcagtgaacggccgctgagggttcgctagggactgaccctggcctggcccggcctctctcctctcttccagaccctcagatcgtgtgcccagaccttccctgccaaacaggtaatgcagggacctgagccaccaccccagactagcaaagcagccctggtgtccttcctcctcgagggccgggctgggggaggggccgtgcagggacccgggggcggcggacnactgcggaggctgctccttagggagatggccccaggatggcagcacaggggaggaggggcttggggaaggcaggctcccaggaacgcaggaacagcatcacgaggccatgaggtgggtgctgctagcctggcgctgtgctcggcatgtggccactggtcttgaaggcccaccatgggcttgcagtctccctcagctgccgcccagctcccatgggctggccgtgcatgtgccaccggaggaagccctggatcagtgagtgaaaccatcccggggtggaagcactgacaccccccagcaccagcaggtcttgctccaaccctggcctgcctcggagctgcagctgcggctctcatctctgggagtgggggagcccatgtccggatgtggcccacgtggtgtgaagctggagctgggggtgccgtncagctctgctggactggtgctgcccccatggtgcactgctgcaccgtnnctgggcccacaggaggtccccgggggcgttagnagctgagtccccctcantgagccgtcccctccaggagtgtgagggtngggatgccatggagacagggtgggagggtccgactggaggaccacagggaggaaacctcnnngnntnngntnnnannnnnncnnnncntcnnnncncnngnnnnngngtgngnnnnngngntccatggggag

SEQ ID NO: 342182 - DNA, 1083 bp, Homo sapiens
ccatgttgccgcaacatgctcgggagcggagcctcctcgggaccaggacttcagggccacaggtgctgccaagatgctccagggcacctgctccgtgctcctgctctggggaatcctgggggccatccaggcccagcagcaggaggtcatctcgccggacactaccgagagaaacaacaactgcccagagaagaccgactgccccatccacgtgtacttcgtgctggacacctcggagagcgtcaccatgcagtcccccacggacatcctgctcttccacatgaagcagttcgtgccgcagttcatcagccagctgcagaacgagttctacctggaccaggtggcgctgagctggcgctacggcggcctgcacttctctgaccaggtggaggtgttcagcccaccgggcagcgaccgggcctccttcatcaagaacctgcagggcatcagctccttccgccgcggcaccttcaccgactgcgcgctggccaacatgacggagcagatccggcaggaccgcagcaagggcaccgtccacttcgccgtggtcatcaccgacggccacgtcaccggcagcccctgcgggggcatcaagctgcaggccgagcgggcccgcgaggagggcatccggctcttcgccgtggcccccaaccagaacctgaaggagcagggcctgcgggacatcgccagcacgccgcacgagctctaccgcaacgactacgccaccatgctgcccgactccaccgagatcgaccaggacaccatcaaccgcatcatcaaggtcatgaaacacgaagcctacggagagtgctacaaggtgagctgcctggaaatccctgggccctctggccccaagggctaccgtggacagaagggtgccaagggcaacatgggtgagccgggagagcctggccagaagggaagacagtccccgtagccccggcccccgcccagccccaggtctccccaggccctccgcaggctgcccggcctccctccccctgcagccatcccaaggctcctgacctacctggcccctgagctctggagcaagccctgacccaataaaggctttgaacccaa

SEQ ID NO: 342183 - DNA, 528 bp, Homo sapiens
aatatatatatagttgttttaaatggtgataagaagaaatggctggtcacagtggctcatgcctttaatcccaccacgtactttgggaggcaaaggtgtgtggattgctggagatatatatatattatcagagcatggaagcacatgcctgtagtcccaactgctcaggaggctgaggtgagggctcacttgagcccaggaggttgaggctgcagtgagccaagatcataccactgcactccatcctgggtgacagtgagaccctgtctcaaaaagaaaagaaaagaaaaagatacggagaaataactcatggtaagagactaggaaggagtggactgggtcagggagggcttctccaagaaggtgacatttgaggaaggaactgagtgttccaggcatagtcaagcctctgatatttgtggcatgtgcctgtagtcccagctacttgggaggccaaggtgggaggattgcttgaggctaggagtttgagaccagcctgggcaacatagcaagatccccatctcttaa

SEQ ID NO: 342184 - DNA, 420 bp, Homo sapiens
tgtgattatccaaaaccctctgggttcttctacgttggaactgttgtcatggagacctcctgagatgcctcactgacctctcgcttccaatatgacttcagatagagatgtagaatcaatgggtgtctcttctaaatggctgcagagggtgctgacctgggcctgcctagactctgcccttctaggagcatctcaagattgtcttattttgggtgtgagtctcactctgttgtcacccaggctggagtccagtggcaggatctcaactcactgcagcctcgacccccaagactcaagtgattctcccaactgctcaggaggctgaggtgagggctcacttgagcccaggaggttgaggctgcagtgagccaagatcataccactgcactccatcctgggtgacagtgagaccctgtctca

SEQ ID NO: 342185 - DNA, 391 bp, Homo sapiens
gggctcccccaaagcatgggcctctccatttcactttgactcggacaccccactccctgtatccagcagctccaccccatgtgtcctggagactggaactggggaaaggcaggatttctcctacaaatgggaatggctgaacaccccacagcatcaagggaagaccctctcaatgcccaccaggtagcaaagccacccacgtgtcccgtgttgcgctattagtttcttcatgcaaaggactatctgtgctcacacctgcactggctccagaggctgcctgcatgacggccacccccgagagaaaggtccttcttatgggaagagcacatccctccagccacttcaactcccgggcagaagcccctggcaggagcaacgtgcagaaccaccg

SEQ ID NO: 342186 - DNA, 521 bp, Homo sapiens
ccactggtaccaatgggaggggacgggaaatgtgggatggagacagctggggactgggccatggagggagtcagtgttcacctgagggctctggatagaagccaaggagcactgagtacatgagccgatacgtggccacccatgcaccagccctcacctttgccccataggagggaagccctgaaccctctagaaggaaagtgtggtctcaggtgataccccacacagagaggagatgcaggggtgtcggcaaagaggaacagcccaggcagcaggagtcaaaaaggaaaggggaggggacacaatgccaggctgcaggcccaagctggccaccgctgagctaagtggagtctgtcctactgggatctaattctcatatctctcccacccagagacccaagaggggaatgcatttttccatctgtttctgtcctccattggtcaaggattgtccccacagagcagtaacccccctgctcttgctcttccaggctatgcatgtgagagtgccaagtgggtgc

SEQ ID NO: 342187 - DNA, 512 bp, Homo sapiens
ccagacacaaaagatcacgttgtatgcctcaagttataagaggtattcataagaggtaaattcatagagaaaaaaagcaaactggtgttactagagactgttgggagggtggaatgcgggtgactgcttagagacagttttcttttggggtgatgaaaacattctggaacttgatagaggtggaggcttgaaaacactatgaatgtactaaatgccaatgaattgtatgctttaagtgattaactttatgtgatgttatttttactttaataaaagtaagtagagtactatattataatctcttgaataaattaaaaaacataaatccagataaatataaataaatgtatgtaaatttaggaaacaggttattctataatttctaagtacctcattcccccaaaaaattaattgcagctttgcagtgaaatagcctggcaaatgcacccttaatcaacaaattaaagtgaacaacatcagtaacaggtcaaactgatattgtgtgcctgaac

SEQ ID NO: 342188 - DNA, 349 bp, Homo sapiens
tttattttttgagatgcggtctcgctgtgttggccaggttggtcttgaattcttggcctcaagcagtcctcctgtctcggcctccgaaagtgctaggattacaggcatgagccaccatgcccggcatctgaaatttttttaaaaaaaaactagaaatagggtgttactgcgttggccagagtggtctccaactcttggcctccatcaatcttctcacctaggcctcccaaagtgctgggattgcaggcatgagctaccatgcccagccaagagtttgtttagtaaatgttacaggcagcaaacatttgagtgctccccaggtgtgagacactgtgtcatagactagtaa

SEQ ID NO: 342189 - DNA, 427 bp, Homo sapiens
atgagaggcgtaagggccatctgtaccatttacgttttgtgatgtagagttacccttggtactgcttgtctctctcccaattctgaggactccatagagggcagagctacacctcctccatcagagttagaaattcccatgataggtaggaggtatacttccttcccacctctgtcattgcacctgtcttagagatagttactattgcagctaaaaccccttgtgaaacatggattacatcagaagtgatgcagtgcacaataaagatcacagcaggtggctgtgtgctcgtgagagaacaaacgtgagttaccactgtggctgatgataacccaagtagaccctaaacccaatctaagactggtgctatttgccagcttcccgagcttaaaggcagtggctaccagttgcctgagagaagactaaa

SEQ ID NO: 342190 - DNA, 467 bp, Homo sapiens
ggccgggcatggtggctcacacctgtaatcccatcactttgggaggccgaggcaggtagatcacctgaggtcaggagtttgagaccagcctggccaacatggcaaaaccctgtctgaaaaacacaaaaattagccaggcgtggtggtgcatgcctgtaatcccagctacttggaagctgaggcaggaaaattgcttgaacccaggaggcggaggttgcagtaagccgattgcacctctgcactccagcctgggcgacagaaagagactccatctcagaaaaacatttgttttatgacccaggttctggtaaatcttgctgaatcttccatgggcaaagaatgtgtaccctgctgttagtgtgtgaagtctcctgtaaatgtcagttaggttccattggtcgatgatggtgttcagttattgtattgtttgctgattttctttgctgtttttttcctgtgaatggtct

SEQ ID NO: 342191 - DNA, 690 bp, Homo sapiens
caaggcctgcacagcgaggaggccaggtcactcagtgcacctggacatcttcaagtgtgattggagcccgcagtgacgctgtttcagctagaagattgtgacccacttccatatcctctcccacatggagagctggggaggaggctttgagagccagctccaattaaggtgtttttttcaggcccgagtagcacccaagtgtctaacccacatgttttctgctgctggaatcctgtggtcaatgtccttgacctgaaccgaataaccaccccagggcagatgaagttaccacccctgaagtcctagattccaccagcaaggcttcctgcaaagatcaggatcccttgtggatcaaacacctcacataatatgggccccacccctgttcttcctgatcaatcaccaagcaaaccttggaccagtttccaaggagatacttagccttgacctccctgcccagacaggcctcacagccacctgcctcaggcagccctggcttcccagagacccatcctgaccctgacttgcacccttgccaaatatcctaaatatccttctgctgcaggaatatgaaatgagacctgtttctgaacttctaggtttctgttattctttccaggtagatgacattttaatgcttctctgtaattttacatttcttttttgtgtgttggggaggggcctggggta

SEQ ID NO: 342192 - DNA, 559 bp, Homo sapiens
ggttctttcttccccaagcaccaggccttcagctctcttcaaagaccaaggtcagggaggtctagcaatgtctaacccacatgttttctgctgctggaatcctgtggtcaatgtccttgacctgaaccgaataaccaccccagggcagatgaagttaccacccctgaagtcctagattccaccagcaaggcttcctgcaaagatcaggatcccttgtggatcaaacacctcacataatatgggccccacccctgttcttcctgatcaatcaccaagcaaaccttggaccagtttccaaggagatacttagccttgacctccctgcccagacaggcctcacagccacctgcctcaggcagccctggcttcccagagacccatcctgaccctgacttgcacccttgccaaatatcctaaatatccttctgctgcaggaatatgaaatgagacctgtttctgaacttctaggtttctgttattctttccaggtagatgacattttaatgcttctctgtaattttacatttcttttttgtgtgttggggaggggcctggggta

SEQ ID NO: 342193 - DNA, 416 bp, Homo sapiens
gaggagggagggctctagggttcaagccgccaagataaaaagatgtttcattcatcacatggtgtgcttgagagtcacttaaagttgggctgtgacagactggcagggaaggggagattgcaggaagagcatacagaaagatgtggtctgaaaaagcaaaccaaaatgttggaggtgtaattcagagcaggaattggagtaggaagaatgtccgtttgtgtatcgagtgaaagtttgagaccccatctctactatagatagaaaaattagccaggcatggtggcatgcacatgtaatccaagttactcaggaggctgagtcaggagaatctcttgaacttgggaggcggaggttgcagtgagccaagatcgtgccactgcactccagcctggacaagagtgagaccccatctcaaa

SEQ ID NO: 342194 - DNA, 639 bp, Homo sapiens
gaggagggagggctctagggttcaagccgccaagataaaaagatgtttcattcatcacatggtgtgcttgagagtcacttaaagttgggctgtgacagactggcagggaaggggagattgcaggaagagcatacagaaagatgtggtctgaaaaagcaaaccaaaatgttggaggtgtaattcagagcaggaattggagtaggaagaatgtccgtttgtgtatcgagtgaaagtttgagaccccatctcaagaaaaaaatcatcctcctttgaatgacccaggtaatggctgaaatctccataaccctggtgtgtaatatgctgtcggctgcatttctatttttagagtcaatctacagacatattgtggggtgtgatgatgggattgtggctatgttaaagggtccttacctttttcttaatgactttgagatacaatgcacgtaccatacaactcaccctcgtacacttaaaatgtacagttcagtgatttctagttgcaaagttcatgagtctccaagaccatcctcacttctgacacccactgcgagtttgggagtccccgtgaccacctttagggtaagagttcgctagaagtactacaggactcagaaaaggctttctacagcagtacccccg

SEQ ID NO: 342195 - DNA, 732 bp, Homo sapiens
gaggagggagggctctagggttcaagccgccaagataaaaagatgtttcattcatcacatggtgtgcttgagagtcacttaaagttgggctgtgacagactggcagggaaggggagattgcaggaagagcatacagaaagatgtggtctgaaaaagcaaaccaaaatgttggaggtgtaattcagagcaggaattggagtaggaagaatgtccgtttgtgtatcgagtgaaagtttgagaccccatctcaagaaaaaaatcatcctcctttgaatgacccaggtaatggctgaaatctccataaccctggtgtgtaatatgctgtcggctgcatttctatttttagagtcaatctacagacatattgtggggtgtgatgatgggattgtggctatgttaaagggtccttacctttttcttaatgactttgagatacaatgcacgtaccatacaactcaccctcgtacacttaaaatgtacagttcagtgatttctagttgcaaagttcatgagtctccaagaccatcctcacttctgacacccactgcgagtttgggagtccccgtgaccacctttagggtaagagttcgctagaagaaaaaaaaaaacacgttcaacatgaaaagcctcaaaaagtttaccgtcatgcacctttcctgaggcgtgttacacagggtcatccgtcagcagaataagtgagcacaccaagaaggaacacttgggaatccagaa

SEQ ID NO: 342196 - DNA, 372 bp, Homo sapiens
agatgatgcagatacacccagagctgcagagaaccccagacttcggctttgagatccagacttatggccttcaccaccgggaggagcagcgtgtggaaatggtgacctttgtctgccgagttcatgagtctagccctgcccagctggctgggctcacaccaggtggggcctgagcccaggacacccaggtctgggaaggggatatgaccttactcccaagcaaagggggtgagcaatctctcctgaaatcaattcctcttccttttccttctttgagaaggccagaaagaagaatggatagaatctgggctttggatctaggcaaatttgccatgtactgtgtgatcttgcacagccccatctacaaaatga

SEQ ID NO: 342197 - DNA, 1421 bp, Homo sapiens
cagagaaccatgaggagttggaggagggagttcaggagtattccctggagttactacccacccttctcccctttctggctaaggtaggaggctggtattctagcatgccccatggagcaaatctaacccccttgtctgcctggcaggggacaccatcgccagcgtcaatggcctgaatgtggaaggcatccggcatcgagagattgtggacatcattaaggcgtcaggcaatgttctcaggtatgtctgggagccgaggtgcctgaattcctgagctcagcctcttggtatttcctcagcctgtggctcactcaggctttgattctccaacctcagactggaaactctatatgggacatcaattcggaaggcagaactggaggctcgtctgcagtacctgaagcaaaccctgtatgagaagtggggagagtacaggtccctaatggtgcaggagcagcggctggtgcatggtgagtagatcccggggtgtgaggggccacttgttctgctacagacaccccatctgcgcttccccctcagaactggcgggttctagtaaagaacggtttactagtaaacctccacagtaaagcaaggtttgttgagctactactactttgggtactgccgcagccacatttctggttattctcacactagccctctgcaggtaagtaacagatagtgtcatcttcactttacagaggggaacaccagggctcaaagagtttgtgtcaattatttccgaggcccgtttgtgctaagcggcccccataaggatctgagtgataattcctgatttgcgggtgagggaagtagggtctcaggtttgtgcctggccagggccacagagatggtcagcaggacggagcggggacgccccgcccatgccctccgaccctttgcagaggccaccacggtccaggcctgacccgccccctacctctcccgtctctgcgcaggcctggtggtgaaggaccccagcatctacgacacgctggagtcggtgcgctcctgcctctacggcgcgggcctgctcccgggctcgctgcccttcgggcctctgctcgccgtgcccgggcgtccccgcggaggcgcccgacgggccaggggcgacgccgacgacgccgtctaccacacgtgcttcttcggggactccgagccgccggcgctgccgcccccgccgcccccggcccgcgccttcggcccgggccccgccgagacccctgccgtggggccgggccctgggccgcgggccgcgctgagccgcagcgccagtgtgcggtgcgcgggccctggcgggggcggaggcgggggcgcgccgggcgcgctctggactgaggctcgcgagcaggccctatgcggccccggcctgcgcaaaaccaagtaccgcagcttccgccggcggctgctcaagttca

SEQ ID NO: 342198 - DNA, 1446 bp, Homo sapiens
ggaggctccaggctgtggctgaatttcgggccttagctagtcagaaagtgctgacgttggagaaggaggataaccagaccttcggctttgagatccagacttatggccttcaccaccgggaggagcagcgtgtggaaatggtgacctttgtctgccgagttcatgagtctagccctgcccagctggctgggctcacaccaggtggggcctgagcccaggacacccaggtctgggaaggggatatgaccttactcccaagcaaagggggggacaccatcgccagcgtcaatggcctgaatgtggaaggcatccggcatcgagagattgtggacatcattaaggcgtcaggcaatgttctcagactggaaactctatatgggacatcaattcggaaggcagaactggaggctcgtctgcagtacctgaagcaaaccctgtatgagaagtggggagagtacaggtccctaatggtgcaggagcagcggctggtgcatggtgagtagatcccggggtgtgaggggccacttgttctgctacagacaccccatctgcgcttccccctcagaactggcgggttctagtaaagaacggtttactagtaaacctccacagtaaagcaaggtttgttgagctactactactttgggtactgccgcagccacatttctggttattctcacactagccctctgcaggtaagtaacagatagtgtcatcttcactttacagaggggaacaccagggctcaaagagtttgtgtcaattatttccgaggcccgtttgtgctaagcggcccccataaggatctgagtgataattcctgatttgcgggtgagggaagtagggtctcaggtttgtgcctggccagggccacagagatggtcagcaggacggagcggggacgccccgcccatgccctccgaccctttgcagaggccaccacggtccaggcctgacccgccccctacctctcccgtctctgcgcaggcctggtggtgaaggaccccagcatctacgacacgctggagtcggtgcgctcctgcctctacggcgcgggcctgctcccgggctcgctgcccttcgggcctctgctcgccgtgcccgggcgtccccgcggaggcgcccgacgggccaggggcgacgccgacgacgccgtctaccacacgtgcttcttcggggactccgagccgccggcgctgccgcccccgccgcccccggcccgcgccttcggcccgggccccgccgagacccctgccgtggggccgggccctgggccgcgggccgcgctgagccgcagcgccagtgtgcggtgcgcgggccctggcgggggcggaggcgggggcgcgccgggcgcgctctggactgaggctcgcgagcaggccctatgcggccccggcctgcgcaaaaccaagtaccgcagcttccgccggcggctgctcaagttca

SEQ ID NO: 342199 - DNA, 954 bp, Homo sapiens
ggaggctccaggctgtggctgaatttcgggccttagctagtcagaaagtgctgacgttggagaaggaggataaccagaccttcggctttgagatccagacttatggccttcaccaccgggaggagcagcgtgtggaaatggtgacctttgtctgccgagttcatgagtctagccctgcccagctggctgggctcacaccaggtggggcctgagcccaggacacccaggtctgggaaggggatatgaccttactcccaagcaaagggggggacaccatcgccagcgtcaatggcctgaatgtggaaggcatccggcatcgagagattgtggacatcattaaggcgtcaggcaatgttctcagactggaaactctatatgggacatcaattcggaaggcagaactggaggctcgtctgcagtacctgaagcaaaccctgtatgagaagtggggagagtacaggtccctaatggtgcaggagcagcggctggtgcatggcctggtggtgaaggaccccagcatctacgacacgctggagtcggtgcgctcctgcctctacggcgcgggcctgctcccgggctcgctgcccttcgggcctctgctcgccgtgcccgggcgtccccgcggaggcgcccgacgggccaggggcgacgccgacgacgccgtctaccacacgtgcttcttcggggactccgagccgccggcgctgccgcccccgccgcccccggcccgcgccttcggcccgggccccgccgagacccctgccgtggggccgggccctgggccgcgggccgcgctgagccgcagcgccagtgtgcggtgcgcgggccctggcgggggcggaggcgggggcgcgccgggcgcgctctggactgaggctcgcgagcaggccctatgcggccccggcctgcgcaaaaccaagtaccgcagcttccgccggcggctgctcaagttca

SEQ ID NO: 342200 - DNA, 1322 bp, Homo sapiens
caagaacaagaagcactgtgtctgtccgtcgaggtcaaggaatggtgctactgtgtggcccgccaccccattctggagagctgagttatgcctggatcttcaatgaatacccttcctatcaggataatcgccgctttgtttctcaagagactgggaatctgtatattgccaaagtagaaaaatcagatgttgggaattatacctgtgtggttaccaataccgtgacaaaccacaaggtcctggggccacctacaccactaatattgagaaatgatggagtgatgggtgaatatgagcccaaaatagaagtgcagttcccagaaacagttccgactgcaaaaggagcaacggtgaagctggaatgctttgctttaggaaatccagtaccaactattatctggcgaagagctgatggaaagccaatagcaaggaaagccagaagacacaagtcaaatggaattcttgagatccctaattttcagcaggaggatgctggtttatatgaatgtgtagctgaaaattccagagggaaaaatgtagcaaggggacagctaactttctatgctcaacctaattggattcaaaaaataaatgatattcacgtggccatggaagaaaatgtcttttgggaatgtaaagcaaatggaaggcctaagcctacatacaagtggctaaaaaatggcgaacctctgctaactcgggatagaattcaaattgagcaaggaacactcaacataacaatagtgaacctctcagatgctggcatgtatcagtgtttggcagagaataaacatggagttatcttttccaacgcagagcttagtgttatagctgtaggtccagatttttcaagaacactcttgaaaagagtaactcttgtcaaagtgggaggtgaagttgtcattgagtgtaagccaaaagcgtctccaaaacctgtttacacctggaagaaaggaagggatatattaaaagaaaatgaaagtgtacatcaggggtttggtagtggctctgctcctctctaaggccagcctggtggaccaagatgctctggacgttgccattgcagaaggaaaagatccaaacatgcatgggttcttaaagcctctacttagaagtgcaacacttgcactttcactcacatttcattggccaaaacaggtcacatgttcctgcaactcagcagggaaatataatcttgctatgtgcctggaagaaaagagacaacctaatattttgaacagtattaatgactgcttacaactgctacagcttaaccattgttacaagctaattaaattacctttggggaaatagtaaaaaaa

SEQ ID NO: 342201 - DNA, 1409 bp, Homo sapiens
caagaacaagaagcactgtgtctgtccgtcgaggtcaaggaatggtgctactgtgtggcccgccaccccattctggagagctgagttatgcctggatcttcaatgaatacccttcctatcaggataatcgccgctttgtttctcaagagactgggaatctgtatattgccaaagtagaaaaatcagatgttgggaattatacctgtgtggttaccaataccgtgacaaaccacaaggtcctggggccacctacaccactaatattgagaaatgatggagtgatgggtgaatatgagcccaaaatagaagtgcagttcccagaaacagttccgactgcaaaaggagcaacggtgaagctggaatgctttgctttaggaaatccagtaccaactattatctggcgaagagctgatggaaagccaatagcaaggaaagccagaagacacaagtcaaatggaattcttgagatccctaattttcagcaggaggatgctggtttatatgaatgtgtagctgaaaattccagagggaaaaatgtagcaaggggacagctaactttctatgctcaacctaattggattcaaaaaataaatgatattcacgtggccatggaagaaaatgtcttttgggaatgtaaagcaaatggaaggcctaagcctacatacaagtggctaaaaaatggcgaacctctgctaactcgggatagaattcaaattgagcaaggaacactcaacataacaatagtgaacctctcagatgctggcatgtatcagtgtttggcagagaataaacatggagttatcttttccaacgcagagcttagtgttatagctgtaggtccagatttttcaagaacactcttgaaaagagtaactcttgtcaaagtgggaggtgaagttgtcattgagtgtaagccaaaagcgtctccaaaacctgtttacacctggaagaaaggaagggatatattaaaagaaaatgaaagaattaccatttctgaagatggaaacctcagaatcatcaacgttactaaatcagacgctgggagttatacctgtatagccactaaccattttggaactgctagcagtactggaaacttggtagtgaaagatccaacaagggtaatggtacccccttccagtatggatgtcactgttggagagagtattgttttaccgtgccaggtaacgcatgatcactcgctagacatcgtgtttacttggtcatttaatggacacctgatagactttgacagagatggggaccactttgaaagagttggagggcaggattcagctggtgatttgatgatccgaaacatccaactgaagcatgctgggaaatatgtctgcatggtccaaacaagtgtggacaggctatctgctgctgcagacctgattgtaagaggt

SEQ ID NO: 342202 - DNA, 1207 bp, Homo sapiens
caagaacaagaagcactgtgtctgtccgtcgaggtcaaggaatggtgctactgtgtggcccgccaccccattctggagagctgagttatgcctggatcttcaatgaatacccttcctatcaggataatcgccgctttgtttctcaagagactgggaatctgtatattgccaaagtagaaaaatcagatgttgggaattatacctgtgtggttaccaataccgtgacaaaccacaaggtcctggggccacctacaccactaatattgagaaatgatggagtgatgggtgaatatgagcccaaaatagaagtgcagttcccagaaacagttccgactgcaaaaggagcaacggtgaagctggaatgctttgctttaggaaatccagtaccaactattatctggcgaagagctgatggaaagccaatagcaaggaaagccagaagacacaagtcaaatggaattcttgagatccctaattttcagcaggaggatgctggtttatatgaatgtgtagctgaaaattccagagggaaaaatgtagcaaggggacagctaactttctatgctcaacctaattggattcaaaaaataaatgatattcacgtggccatggaagaaaatgtcttttgggaatgtaaagcaaatggaaggcctaagcctacatacaagtggctaaaaaatggcgaacctctgctaactcgggatagaattcaaattgagcaaggaacactcaacataacaatagtgaacctctcagatgctggcatgtatcagtgtttggcagagaataaacatggagttatcttttccaacgcagagcttagtgttatagctgtaggtccagatttttcaagaacactcttgaaaagagtaactcttgtcaaagtgggaggtgaagttgtcattgagtgtaagccaaaagcgtctccaaaacctgtttacacctggaagaaaggaagggatatattaaaagaaaatgaaagaattaccatttctgaagatggaaacctcagaatcatcaacgttactaaatcagacgctgggagttatacctgtatagccactaaccattttggaactgctagcagtactggaaacttggtagtgaaagaattacatccaggctgtattcaatccatatctacatctgtatcttaactgtgtatgtatctgttctcagatctgtaaataaatatccttatcacaaa

SEQ ID NO: 342203 - DNA, 280 bp, Homo sapiens
aggaatcaacaattttgtcactatgaaaaatattttggaaaatgaattgggggcggggcatgtttggttgagattattaagggctgtggaatttttacaagtttttgagacacaatggaacactcgtctttctggaggagtatggcaatgctcacttgcatctattttagaatgtttaccaaggacctattatgtgtcaaacgtacctatgggaaaataagatgaccacatcaatcaaacatgatttttcttagaagatagtgctaaggatatggttttt

SEQ ID NO: 342204 - DNA, 337 bp, Homo sapiens
aatataaaggatggtgtgaaaagggaagacattggagacgaaagattattaaggactgttaaaatgttccaggtgggagtcttaaactttggcagtggttattggaaaggatgggttagaaccaaaggatattttagaatacagattttgaaaaactcgagaatttggaaaagaacgcagtcacaaatgaccaaggattgtagcctgagtggttgaaaagggttgtgtcggtaatggaactagagatcaaaaaaggagcagcagataagaatttggaacgggcagctgtatttgtctacaaataaagacaacactacactgagctcaagattaaaat

SEQ ID NO: 342205 - DNA, 574 bp, Homo sapiens
  misc_feature (427)..(427): n is a, c, g, or t
  misc_feature (446)..(446): n is a, c, g, or t
tctacaagccactggcaattcctccttccaaatgttctaactggtggtgatctacatatctttccagatactacaggttacccactcctgccactcacgtgggaggctatttcttttacccttctgtagagcttaggatacttcacccagccacctggagctggaaatggactctaaaaagctcaaaaagtgcaaatctgccaatttttcacttgagttccagaacaaagattttatgcgcacagtttgaccctgccagtcttagtttcactaagcattttaaacatccaaattcaacctgtccttcaaaaccacatgcaattttaaaaagcaaattgtctaatgcgcaatcccatggcaattctttcgattcctttttccatctcttgtatttgcctatttcttttttttttttttttggactgangttatgattctgcacctanaaaacccagagacagccaggcacgggggtccatgcctgtgagcccagcactttgagaggccgaggcatgcggatcacctgaggccccccaaagtgcggggatacaggcgtgaaccacagggcccaacc

SEQ ID NO: 342206 - DNA, 620 bp, Homo sapiens
tctacaagccactggcaattcctccttccaaatgttctaactggtggtgatctacatatctttccagatactacaggttacccactcctgccactcacgtgggaggctatttcttttacccttctgtagagcttaggatacttcacccagccacctggagctggaaatggactctaaaaagctcaaaaagtgcaaatctgccaatttttcacttgagttccagaacaaagattttatgcgcacagtttgaccctgccagtcttagtttcactaagcattttaaacatccaaattcaacctgtccttcaaaaccacatgcaattttaaaaagcaaattgtctaatgcgcaatcccatggcaattctttcgattcctttttccatctcttgtatttgcctatttcttttttttttgagacaggctctgactctgtcacccaggctggagtacagtggcatgatcagggctcacggcagcctcaacctgccaggatcaagcaatcttcccacctcagcctcccaagtagctggaactacaggcacacaccacgatgtctggctaattttcgtttatttttttgtagagacggggtctcacaatgttgcccaggctggtttcga

SEQ ID NO: 342207 - DNA, 328 bp, Homo sapiens
ctttgtgcctcactcttctcttacacctggggagtcaagtctggatcctctgctccatatttatttagcaaataaaacactgatctcaaacagcaacggaacctgtgtacttgaggtgttttttgaaaactaatcagaagaggaatgcttatctcccaagaaaattgaaaccatctgtaaaagaatcttggctgtgctgtgttttgattagattgaagcttggtgtaaagagaaaacacaaaagaccgcagaatatttacaacatttgaattcctgtttctccatcaaagcacattgtcatcaaagctactttgggtatagaaaaaag

SEQ ID NO: 342208 - DNA, 244 bp, Homo sapiens
ttattaaaaatttgtaactatctgaaaactgattactatggaaatgaacactgtatggcctacctaacattagctttctaagcttattgtttatgagaaaatatagtggctgaaatcatccgagtgccaggaaactcactgctgagctattatttctgagaaaaatttataagaactgacatgcttttgtcattatttgtttggtgtgagattccttgagttctgaaggagagagtgctatttt

SEQ ID NO: 342209 - DNA, 435 bp, Homo sapiens
agctgggaatacaatcttcaggcaaatgactggaaagcctccttcaggcccctaacatctcccagcagtaagtatgagcactaagtgtgtgcattcagccacactaggatacagcagagctgcatgtaccccaggactcagccagtttcctacaggagcatagaagaaagtaccactaaaggagagcaaggagaaggaagaggaagagggcagtgattggcaaggcttgaggcatgaagaaagtgcactttcactgttgcagtagtcttagaaaacaaatatttctgcatggtgacacggttcttactagaaccccagaacatctccatggtatgacctaccacatttcctccccaccaaaataataataataataaggctacacagtatctggaatttcttgctcattaaaatctgattactaccacactcaaa

SEQ ID NO: 342210 - DNA, 446 bp, Homo sapiens
tcttggtaaattcctttactgcccacaacaccagccccagctagtcacacccacaagaaagcagatgtcacaggaagtagcaagtaagctaggccaaaccagagctaaagaggtaacaaaatcataagggaaaatttggaaaatgtcacgttagccttgtgtgcccatctgaagaacttcctgaggttctcctgctctaaccagggacttttaaacctcagttttgtctttcctctcttgcagcatgaagaaagtgcactttcactgttgcagtagtcttagaaaacaaatatttctgcatggtgacacggttcttactagaaccccagaacatctccatggtatgacctaccacatttcctccccaccaaaataataataataataaggctacacagtatctggaatttcttgctcattaaaatctgattactaccacactcaaa

SEQ ID NO: 342211 - DNA, 347 bp, Homo sapiens
agctgggaatacaatcttcaggcaaatgactggaaagcctccttcaggcccctaacatctcccagcagagcatagaagaaagtaccactaaaggagagcaaggagaaggaagaggaagagggcagtgattggcaaggcttgaggcatgaagaaagtgcactttcactgttgcagtagtcttagaaaacaaatatttctgcatggtgacacggttcttactagaaccccagaacatctccatggtatgacctaccacatttcctccccaccaaaataataataataataaggctacacagtatctggaatttcttgctcattaaaatctgattactaccacactcaaa

SEQ ID NO: 342212 - DNA, 256 bp, Homo sapiens
ccttcattcattcattcattcattctaccaacacattttcactgagcatctgctccatgccaggcaacagattaggttctaaggattcagaaacaatgcaatggacatgactcttgccctcatggacataataggccctcccctctaactccagttgagctctatcaacttcaggtatgttaaccatttttttttttttttttttttttttttttttttttttttttttttttttttttttttttttttttttttt

SEQ ID NO: 342213 - DNA, 488 bp, Homo sapiens
aactagtgatgtctttgaatatgaatctactactatgtcccaaggtaacatctcaaaggttattttgtttagttttaagaaaatgacttctatattcttccccactcctcctattcacatcactggagatacaaatactgcttatccagccatgataatctataaaacatttattttttatcttccaattcatccagtttttctgaagcttattgattggggtgtaaagctggtgactaatatcaaagatatactgtaaaccattttgattacaaatagttaacatccaggatagtatatatgattgttacttaaaattaaaattatcttagcaaggatgaaaatcccttagtaaaaaataaatatgtattagttcagctaaccctattcaattagatcattaattaattttccagttgattttgaatttaatgttggaaacataaaatattggagtggagggatctctttttcatcatccagcctgg

SEQ ID NO: 342214 - DNA, 357 bp, Homo sapiens
aggcatccgccaccacgcccggctaatttttttgtatttttagtagagacggtttcaccgtcttagccaggatggtctcgatctcctgacctcgtgatccgcccgcctgggcctcccaaagtgctgggattacaggtgtgagccaccgtacccggccatagagcagcctcttccttttcctgttgggtctctgctcagatgtcatgtcagagaggcagacctctggggcggtctatctgagggaatgcacccatctcccttcctctgaccagttagttaccttgcttattctttcaaagctcttaccaccacctgaagtcatctatctggtttggttattttattgtttagtagcag

SEQ ID NO: 342215 - DNA, 425 bp, Homo sapiens
ggagagggagagggagagaagattttcttataaaaccattgcacagaagtgtaacttagcctttccttacaatttttatcaccaactaagcaataatgcaaaacataaaacaaaacaataacaaaacagtgtttggttcatttattcattcaacagactatactaagctaggcagtgtgggtttgataattaataaaacttgtattagttgtccacataatgattacaggcaatgcaggcaacagcaacatgcaattaaataaacaattaacgtcaaagaatagagcttttagaggcgtatagcagtgacatctgactcaaaatgagattgtgcaccaaatgaagcagtgcaaagaagagatcctgaggatggatctaatgtgatctagtaagctggcacatctttgattctgtcatttagtgag

SEQ ID NO: 342216 - DNA, 250 bp, Homo sapiens
agaataataatgtaaatccaaaattagtgtaaaaaattcagggtaaaatagtcaacctgtttgggctttctgtactcctgttcccattcattctaacaaatttttaactatttagccaaatgtgttcatttttgtttgataacaagttatttctctctgttatggctacttgcagttgtcttgtttcttcatcataagggcatttaatagttttctgcaaatgtgctcatctaagaacatgatgccaacc

SEQ ID NO: 342217 - DNA, 2480 bp, Homo sapiens
ctgtcctgccgtcctacctgcaggacaggtgtctcccaggcgtgctagcctcccccgagctccgttcttacccgtatgcattttctgtggcccggcctctgacttcggattccaagctggtatctctggaggtgaacaggctcccctgcacttccccatccggtagcaccaccacccagcctgcacccgatggggtccctgggcctttggcagatacctcccttgttactgcttctgccaaggtgcttccaactccacagcctctgctgccagcccccagtgggagctcagccccaccgcaccccgccaagatgcccagtggcaccgagcagcaaacagaagggacttccgttaccttctctcctcttaagtcaccgccacagctggaacgagagatggcctctccacctgagtgcagcgagatgccccttgatctgtcctccaagtccaaccgccagaagcttccattgccgaaccagcgcaagacaccccccatgcctgtgttgacccccgtgcacaccagcagcaaggccctcctctccacagtcctgtctaggtctcagcgcacaacccaggctgccggtggcaatgtcacctcctgcctgggctccacttcctcgccctttgtcatctttcccgagatcgtgaggaatggggacccgagcacctgggtgaagaactcaactgcactgatcagcaccattcctggcacctacgtgggagtggccaacccagtgcctgcatccctgctgctgaacaaagaccccaacctgggcctcaaccgtgacccccgccatctccccaagcaggagcccatctccatcattgatcaaggagagcctaagggcactggtgccacgtgtggcaaaaagggcagccaggctggtgctgagggacagccaagcacagtgaaacgatatactccagcccgcattgcccctgggctgccagggtgccaaaccaaggaactctctttgtggaaacccacggggccggcaaatatttatccccggtgttcagtcaatgggaaacctaccagcacccaggtcctgcctgttggctggtccccgtaccaccaggcgtctctgctttccattggcatttccagtgccgggcagctgacccccagtcagggggcgcccatcaggcccaccagcgttgtttcggagttttctggtgtgccatctctcagctccagcgaagccgtgcacggacttcctgaggggcaaccacggcctgggggctccttcgttccagagcaggaccctgttacaaagaacaaaacttgccggattgctgccaagccttatgaagaacaagtcaatcctgtcctcttgaccctcagccctcagactgggaccctggcactgtctgttcagcctagcggtggggacattcgaatgaatcaggggcctgaggaatcagagagccacctctgctctgacagcactcctaagatggaaggcccccagggggcttgtggcctgaagctggcaggagacacgaagcctaagaaccaagtgctggccacctacatgtcccatgagctggtcctggccaccccccagaacctgcctaagatgcctgagctgcctttgctacctcacgacagccaccccaaggaacttatattggacgtggttccgagcagcaggaggggctccagcacagagcgcccacagcttggaagccaggtggatctggggcgagtgaaaatggagaaggtggatggtgatgtggtcttcaatttagccacctgcttccgggctgatggcctcccagtggctccccagaggggccaagctgaagttcgggctaaggccgggcaggctcgagtgaaacaggaaagcgtaggggtctttgcttgcaagaacaagtggcagccagatgatgtgacggaatctctgccgcccaagaagatgaagtgcggcaaagagaaggacagtgaagagcagcagctccagccacaagccaaggccgtggtccggagttcccacagacccaagtgccggaagctgcccagtgacccccaggaatccaccaagaaaagccccaggggggcttcagattcaggaaaagagcacaatggagtcaggggaaagcacaagcaccggaagccgacaaagccggagtcccagtctccaggaaaacgagccgacagccacgaggaaggttccttggaaaagaaagcaaagagcagtttccgtgactttattcctgtggttctgagcacccgcacgcgcagtcagtctgatttaaaggcccgtaagcagaagacttcctcctcccaaagtttggagcaccgcctcaggaacaggaaccttctcttgcccaacaaagtccaggggatctcggattcaccaaacggtttcctcccaaataacctggaagagccagcctgccttgaaaattcagaaaagccatcaggaaaacgaaagtgcaagaccaagcacatggcaaccgtctcagaagaggcaaag

SEQ ID NO: 342218 - DNA, 887 bp, Homo sapiens
cacacacacacaccgctctccccctcactctttcgctcgccgcggctgctgccagtgtgtggctctgtctctcctccgctttgctgagccctcccttcttcctctcagttcctagagtccgaccgccgccgccgccgagagagaggagaaggagggggagtggccacagcaggtcctatctggtggtgagtggctgtcatgatctctacagcaccgctctacagcggcgtgcacaactggaccagttctgaccggattcgcatgtgtggcatcaacgaggagagaagagcacctctttctgatgaggagtcaacgacaggcgactgccagcactttggatctcaggagttttgtgtcagcagcagtttttccaaggtggagctcacggcagttggaagtggcagcaatgcccggggggcagacccagatggcagtgctacagaaaaacttgggcacaagtcagaagacaagcctgacgatccccagccaaaaatggactacgctgggaacgtggcagaggctgagggcctcttggtgcccctgagcagcccaggagacgggctcaagcttcccgcatctgacagcgccgaggccagcaacagcagggccgactgctcctggactccactcaacacccaaatgagcaaacaggttgactgctcacccgccggagtaaaggctttggactctcggcaaggtgttggagagaagaatactttcattttggcaactctgggaactggagtccctgtggaggggaccctgcccctggttaccactaacttcagtcctctgccagcccctatctgtccccctgctcccggttcggcctctgtgccccactctgttccagatgcattccaggttcccctctccgtccctgcccc

SEQ ID NO: 342219 - DNA, 1070 bp, Homo sapiens
gggactgagtggtaagcaactccgagtgttagacggtgatcgggcggcgattccgggaaaagcgaggaaagacacagtctgcgattgtgccgcaccccccacccacctcttagcatctggattctgctctcgtagtgggggccgcggaccctccccgccacagtccttttactctccagcactcccaccgccttcccccttcttcagccatctgactctcctagggggtcggcgtggcgaaggacggctagccttggagggaaagtagccaccagtccaactcgggtcgcccccaccattatttcggtgagggggcaacgctaagaaggggatactgggggagtggccacagcaggtcctatctggtggtgagtggctgtcatgatctctacagcaccgctctacagcggcgtgcacaactggaccagttctgaccggattcgcatgtgtggcatcaacgaggagagaagagcacctctttctgatgaggagtcaacgacaggcgactgccagcactttggatctcaggagttttgtgtcagcagcagtttttccaaggtggagctcacggcagttggaagtggcagcaatgcccggggggcagacccagatggcagtgctacagaaaaacttgggcacaagtcagaagacaagcctgacgatccccagccaaaaatggactacgctgggaacgtggcagaggctgagggcctcttggtgcccctgagcagcccaggagacgggctcaagcttcccgcatctgacagcgccgaggccagcaacagcagggccgactgctcctggactccactcaacacccaaatgagcaaacaggttgactgctcacccgccggagtaaaggctttggactctcggcaaggtgttggagagaagaatactttcattttggcaactctgggaactggagtccctgtggaggggaccctgcccctggttaccactaacttcagtcctctgccagcccctatctgtccccctgctcccggttcggcctctgtgccccactctgttccagatgcattccaggttcccctctccgtccctgcccc

SEQ ID NO: 342220 - DNA, 759 bp, Homo sapiens
ccatgttggccatgctgggctcgatctcctgacctcaggtgatccacccacctcggcctcccaaagtgctgggattacaggcgtgagccaccatgcccagcagaactttgttgaggtgcagcagcctcagagtcctatgggcagtggggcctcctactttcctactttctggcacaccatcacattgatactgtgcactgccttttctggtatcagcaaaagcgaccaaactctcagtttttaaaaaccacctggaaacactcattgtctacaagagacacatatgtgatggccacgtaaggggagtgaataaatgtaacccagattaaccacagggtaaacacaaactctttctcaatctttcccccgagcctcacaggtgggctttctggtctttaagctttgattgtaacatttctgccttctgtccccaaaccacacatcactccaggttccttggaaaagaaagcaaagagcagtttccgtgactttattcctgtggttctgagcacccgcacgcgcagtcagtctgatttaaaggcccgtaagcagaagacttcctcctcccaaagtttggagcaccgcctcaggaacaggaaccttctcttgcccaacaaagtccaggggatctcggattcaccaaacggtttcctcccaaataacctggaagagccagcctgccttgaaaattcagaaaagccatcaggaaaacgaaagtgcaagaccaagcacatggcaaccgtctcagaagaggcaaag

SEQ ID NO: 342221 - DNA, 958 bp, Homo sapiens
cacacacacacaccgctctccccctcactctttcgctcgccgcggctgctgccagtgtgtggctctgtctctcctccgctttgctgagccctcccttcttcctctcagttcctagagtccgaccgccgccgccgccgagagagaggagaaggagggggagtggccacagcaggtcctatctggtggtgagtggctgtcatgatctctacagcaccgctctacagcggcgtgcacaactggaccagttctgaccggattcgcatgtgtggcatcaacgaggagagaagagcacctctttctgatgaggagtcaacgacaggcgactgccagcactttggatctcaggagttttgtgtcagcagcagtttttccaagtgccggaagctgcccagtgacccccaggaatccaccaagaaaagccccaggggggcttcagattcaggaaaagagcacaatggagtcaggggaaagcacaagcaccggaagccgacaaagccggagtcccagtctccaggaaaacgagccgacagccacgaggaaggttccttggaaaagaaagcaaagagcagtttccgtgactttattcctgtggttctgagcacccgcacgcgcagtcagtctggaagcatctgtagctcctttgctggcatggcagacagtgacatgggaagccaggaagtcttccccacagaagaagaagaggaggtaacccccaccccagctaagcgtcgaaaggtgagaaagacccaacgggacacccagtatcgcagccaccatgcccaggacaagtctctgctgagccagggccgaaggcacctgtggcgagcccgagaaatgccctggaggacagaggctgcccggcaaatgtgggacaccaatgaggaggaggaggaagaagaggaggagggcctgctgaagaggaagaaacgaagacggcagaagagccgaaaatatcaga

SEQ ID NO: 342222 - DNA, 653 bp, Homo sapiens
ctcaaatcctgggcctcatgtcccttctctggttgtatcttccatgctagaagagcacctctttctgatgaggagtcaacgacaggcgactgccagcactttggatctcaggagttttgtgtcagcagcagtttttccaaggtggagctcacggcagttggaagtggcagcaatgcccggggggcagacccagatggcagtgctacagaaaaacttgggcacaagtcagaagacaagcctgacgatccccagccaaaaatggactacgctgggaacgtggcagaggctgagggcctcttggtgcccctgagcagcccaggagacgggctcaagcttcccgcatctgacagcgccgaggccagcaacagcagggccgactgctcctggactccactcaacacccaaatgagcaaacaggttgactgctcacccgccggagtaaaggctttggactctcggcaaggtgttggagagaagaatactttcattttggcaactctgggaactggagtccctgtggaggggaccctgcccctggttaccactaacttcagtcctctgccagcccctatctgtccccctgctcccggttcggcctctgtgccccactctgttccagatgcattccaggttcccctctccgtccctgcccc

SEQ ID NO: 342223 - DNA, 294 bp, Homo sapiens
gacacaaatacataaatatcattaattacaagatgcacaattttgttatatgccactgagaaagagaaattatccaaacaaaggagtctaatagaagcccctaacttaaaggcaggaaaggaaagagctctatctcagagtcaggttaaacaggaagtaagctcttcataaagaacaacaaggaagatttcgttcctctaccttgacaacgggagaaagaagaaaacaaattctctcctgagaatttgatcagaagctaatcatcacacagacttggggtatgaattcacacaa

SEQ ID NO: 342224 - DNA, 520 bp, Homo sapiens
ctgctcctaccagttctgggctggacacttcctgagtttctctctagagagagggcctcacccaacatccccttgtatagactacttacgggaagattttctcaaggagaaaatatatcagtcacaactaagttccctactcttgtgaaggaaaatattctacccaatgggcaaaggatattccaccctgaccacaatgcttttataagcatagggtagaggagttccttcaacacgtaatttatttattaattacaaagtagatttttatcaagggagaggggttctgctgagataccagaatggttaagagcctagctgtagagatgacttccagcccctccatttacctgctgtgtgactgcaggcaaggtacttaacattccttatctgtaaaatcatcatcatattcttattcccatctcattgggtttttgggaggatctaatgtgattcttcatctaaagagcttactacagtgtttgcacaggctaagtactcagtaagtcttagctgtcag

SEQ ID NO: 342225 - DNA, 776 bp, Homo sapiens
  misc_feature (712)..(712): n is a, c, g, or t
  misc_feature (766)..(766): n is a, c, g, or t
  misc_feature (769)..(769): n is a, c, g, or t
tggcttaaatgataaagggcttgcaaatccaaaaaggtttagagccatcaaatacagctccagcttcatttctctacttttctctcaactcagcccaattttatgtcaggctaactccctcatgataccaagatggctaccagtaaaaatggaagcaatcactcttttgtttgcctctagacggagatagctgttggtgccccctgaaccttgaaactaaagcctcagctgaggtgagactggaccattttaggaatatacttgcctttgactcaaattatgtcatgactggtttacattcatccctaagtaattatgttgctgagactcaaatctatcaaagcctacccttggagctgagtgaagattatcctacataatacccaaggcttctcaactggtggggagggaagatgagtgttgaagagaaagctcaagattttccaagctttcttggcatctgtgctacaatgcatttgttctcagatatttccttccatgatccaacttccctcttgcagtttccctgtgcaggttccagccttccatcaaatccacctcaattcttccctcccctctgaagtctgctctgacttcttgaccttcacccatcactcagtgctctgaactcatttacttattatacttaacacaaaaacttgagaaaaaaagaaagctgcagactgggattacagatgggagccactgtgancagctttacccattatttcttagtaaaattttattacagaattggatttcttanagngctggac

SEQ ID NO: 342226 - DNA, 150 bp, Homo sapiens
gttcgcagttaactccaagagaagaaatatgctgcaaagacaccctccctacttcctgtatgtggcacagaccccttctagggaattccagcagaaagggctgtgggtacttcagtttcccttctaagtgggaacggtcacgttagccca

SEQ ID NO: 342227 - DNA, 933 bp, Homo sapiens
gagatctgaatgtattcttggttccaaatcaatcttgtcactcctcggaaagcaatgcaagataataagtagtattcacctgattgctttcctgctccgagacagctggtgacgcatgtcttcctgataaccaggagtttcagatctaaggcagggataaagggaaactggaagctctcggaatctaaatgtgacagtcgatggctgaggagagggtcagaaggaatagaatctgtgacacgtatgagaaaggaacaaaatttatctgctctggttgcaatgattagatgtctctttgtctggctttccttgcagtgggtgactgatcgtacccgccagctggctaatgtcataattaacaaagttgctactacatctgcaaagtttaatcgaaaaatttgccagtgatatgatggccttgtcacagagatcacaagggacacggagttgacttttgctcaaggtggaacgacagagctgtgtaggcaagatgagaaattgcgaacttgttcggccaaaggaggctaataatgaaggggccgggaaggaggccagtgctaccagggttatctcacaacctcagatgctggataagtcgacggaggcagaatcgctttgggatgacattcagaaagcctggagtgattacttgcaagagaaaagcctacctattctttccaaggtgcaggaatattcccctgacctgctcatccagtggtccagtaatgaattactggagacctgccttagacaaagaatgcactcggagccccaacacacctaaagccatgctttgaaggatctgccaagctcacttttaatcatgagaaagaaattacccacacggagtcagcagaaaatgagaaagtagagctcgtgctgtgaataattccagcaagtgccaaggggctagttgaggaatggcttcatgag

SEQ ID NO: 342228 - DNA, 818 bp, Homo sapiens
attagaaggatgcttctgcattattaataaaatcacagggaaaatgcaacattttggatgtcacatctgataagttggcagttaaagaacagaaacagcaataagactgcgtggctacattttcccagtgccaccaactgggatttaagctgactaacattttgaaagcccagcccatttcattcacagcaggatggcagtgggtgactgatcgtacccgccagctggctaatgtcataattaacaaagttgctactacatctgcaaagtttaatcgaaaaatttgccagtgatatgatggccttgtcacagagatcacaagggacacggagttgacttttgctcaaggtggaacgacagagctgtgtaggcaagatgagaaattgcgaacttgttcggccaaaggaggctaataatgaaggggccgggaaggaggccagtgctaccagggttatctcacaacctcagatgctggataagtcgacggaggcagaatcgctttgggatgacattcagaaagcctggagtgattacttgcaagagaaaagcctacctattctttccaaggtgcaggaatattcccctgacctgctcatccagtggtccagtaatgaattactggagacctgccttagacaaagaatgcactcggagccccaacacacctaaagccatgctttgaaggatctgccaagctcacttttaatcatgagaaagaaattacccacacggagtcagcagaaaatgagaaagtagagctcgtgctgtgaataattccagcaagtgccaaggggctagttgaggaatggcttcatgag

SEQ ID NO: 342229 - DNA, 892 bp, Homo sapiens
  misc_feature (209)..(211): n is a, c, g, or t
gccactttaactagtctttgagcggcaaggatcgacaagcaaatcagtaaaaatctttagctgctgacagatacaaatcgtaaaaatgtatccggtctaatactctatacagttacgttaagaactcgcacaccaatgaacatgccatcgtacagcagaagcattatgatagtatggaattttcaacagtcatatagaccattgtttannnggaaaacttgttattggacacaatatgctcttggacgtcatgcacacagttcatcagttctactgccctctgcctgcggacttaagtgagtttaaagagatgacaacatgtgttttccccagactcttggatactaaattgatggccagcacacaaccttttaaggatatcattaacaacacatcccttgcggaattggaaaagcggttaaaagagacacctttcaaccctcctaaagttgaaagtgccgaaggttttccaagttatgacacagcctctgaacaactccacgaggcaggctacgatgcctacatcacagggctgtgcttcatctccatggccaattacctaggttcttttctcagccctccaaaaattcatgtgtctgccagatcaaaactcattgaacctttttttaacaaggttccgctggaaatctaggccttcctggaatgacactgctttatggtctttctgagctaccgatgagacaaggaatgatatgctcttggacaaatgttttctcctctgtaaaatggggataaaatgattcaccttctgtattggtccattttcatgctgctaataaagacacaactaagacagggcaatttacaaaataaagagagatcggccggttcttatattattatatgtgttgtcaaattgatactccagata

SEQ ID NO: 342230 - DNA, 450 bp, Homo sapiens
tgggtggatcacctgaggttaggagtttgagaccagcctgaccaacatggaaaaaccctgtctccactaaaaatacaaaattagctgggcatggtggcacatgtctgtgatccctggtcctcgggaggctgaggcaggacaatcacttgaatctgggaggtggaagtttcagtgaaccgagattgcgccattgcactccagcctgggcaacaagagtgaaactctgactccaaaaaaaaagaatacctttcacacttgttgaaccatgctgttaatttaaatctgttttggtctgaactttcaggcttggtctatgtgactatgaataataatacctctcttcttttcttcattaggttcttttctcagccctccaaaaattcatgtgtctgccagatcaaaactcattgaacctttttttaacaaggatagcttgccgagtcctcgaga

SEQ ID NO: 342231 - DNA, 500 bp, Homo sapiens
  misc_feature (481)..(481): n is a, c, g, or t
gtctggaaagcgagtttagtacaaagtcctcttggaatctgaactatacattctgaaaccccagtataatttcgaatgtagaagtcttttttctaaccttgactttctttagggaaaacttgttattggacacaatatgctcttggacgtcatgcacacagttcatcagttctactgccctctgcctgcggacttaagtgagtttaaagagatgacaacatgtgttttccccaggtaagctttctttgaggatttgtctttcttttaaaaaagtggtaggataacatttgtgagccaccgtgcctggcccagattttacttttaaaaaaacttttcaatcaaaattttactacttctgattcatgagggtggcataattaataaaaattcaagaaaaagatcagtgacatcaaagtcatttgtgctttcactttgctttctggatttaacattccaaaatgattctcaaatcatcctgttnttctcaggaatcagctagt

SEQ ID NO: 342232 - DNA, 3176 bp, Homo sapiens
tgcctcagctactgccgcagtcgccgcggaattcggcgagtagaaccgctgaggcgggcgcgggcccgggtggggccaaggttccggccactctgcagaatggagataatcaggagcaattttaagagtaatcttcacaaagtgtaccaggccatagaggaggccgacttcttcgccatcgatggggagttttcaggaatcagtgatggaccttcagtctctgcattaacaaatggttttgacactccagaagagaggtatcagaagcttaaaaaggtatataacgaagtcatttaacttctatgttttcccgaaacccttcaatagatcctcaccagatgtcaaatttgtttgtcagagctccagcattgactttctagcaagccagggatttgattttaataaagtttttcgaaatggaattccatatttaaatcaggaagaagaaagacagttaagagagcagtatgatgaaaaacgttcacaggcgaatggtgcaggagctctgtcctatgtatctcctaacacttcaaaatgtcctgtcacgattcctgaggatcaaaagaagtttattgaccaagtggtagagaaaatagaggatttattacaaagtgaagaaaacaagaacttggatttagagccatgtaccgggttccaaagaaaactaatttatcagactttgagctggaagtatccgaaaggcattcatgttgagactttagaaactgaaaagaaggagcgatatatagttatcagcaaagtagatgaagaagaacgcaaaagaagagagcagcagaaacatgccaaagaacaggaggagctgaatgatgctgtgggattttctagagtcattcacgccattgctaattcgggaaaacttgttattggacacaatatgctcttggacgtcatgcacacagttcatcagttctactgccctctgcctgcggacttaagtgagtttaaagagatgacaacatgtgttttccccagactcttggatactaaattgatggccagcacacaaccttttaaggatatcattaacaacacatcccttgcggaattggaaaagcggttaaaagagacacctttcaaccctcctaaagttgaaagtgccgaaggttttccaagttatgacacagcctctgaacaactccacgaggcaggctacgatgcctacatcacagggctgtgcttcatctccatggccaattacctaggttcttttctcagccctccaaaaattcatgtgtctgccagatcaaaactcattgaacctttttttaacaagctggagtgcaatggcgtgatctcggctcaccgcaacctctgcctctcgggttcaagtgattctcctgtctcagcctcccaagtagctgggattacagagtctcgctctgttgccaggctggagtccaatggcgcaatctcgactcactgcaacttctgcctcctgggttcaagtgattctcctgtctcggcctcccaagtagctgggattacaggttatttcttatgagggtcatggatatcccctatctaaacttggaaggaccagacttgcagcctaaacgtgatcatgttctccatgtgacattccccaaagaatggaaaaccagcgacctttaccagcttttcagtgcctttggtaacattcagatatcctggattgatgacacatcagcatttgtttcccttagccagcccgagcaagtaaagattgctgtcaataccagcaaatatgcagaaagctatcggatccaaacctatgctgaatatatggggagaaaacaggaagagaagcagatcaaaagaaagtggactgaagatagctggaaggaggctgacagcaaacggttaaacccccagtgcataccctacaccctgcagaatcactattaccgcaacaatagttttacagctcccagcacagtaggaaagagaaatttgagtcctagtcaagaggaagctggcctggaggacggagtgtcaggggagatttccgacactgagcttgagcagaccgattcctgtgcagagcccctctcagagggaaggaaaaaggccaagaaattaaaaagaatgaagaaggagctttctccagcaggaagcatctcgaagaacagccctgccacactctttgaagttcctgacacatggtaaccaagacctgagggcagcaaaccgctggtgctgtcgctgtgagcaagagccggctggcacatttggaagccgcactgtatttaacttaatcaaatgtggtatgggaggggttggaaaccaagttgtctcctgggggggagaaaacaggttttatttttgtggctgtggttttttcccctttttaatctaactgcctgttgacattgacactcatcacggttgtaggctgtcatgaatgtgtacgtgcttaaccagtgaattccgtgttgctcttgtgaggcctttcctgtcatgacccagtgtgcttaagaacctgcctgatggggagtgtcggctgtgaaatctgcaaaaagagctgacattccagctgctgtgatcatgaatttgggggtgtactgtcctgcctgtgcatcttctcgcactgagattttgaggcagttgcagccctcggttagtctcccagtggaaaaatcggttgtgcctccctgcttcccaccatagctgcctgaaaacatgacgctctcaagcttgtccttccttcaggaagatgtccactcatgcccacccatgagagggcttgccgtatgccctggcctttgggcatatttatgtagagttcctttctcctaagacgtgagtttctcatgggggatgtacgagtaaaaaggttaacttctgttcttatgcgtggcgctgtgttcactttccagagtctctgttcgtttgtttggatggcggtctcggggtacggcagcgtgtgtgcgtacgtgtctgtgtgtgtgtgtgtgtgtgtgtgtgtgtgtgtgtgtgtgtgaaatcgtgcaaatctacaacatgtcccagcccattctccgttgaaacagatcacagcaacgacaaacgctcatggcgctgctttgctccacccgcttcagatagatcattgttagatatttcacatttttgtatggtggaaataaaaatgaaaaatgtatttccaaaagatgaaaattaaaaacattttcatagga

SEQ ID NO: 342233 - DNA, 1587 bp, Homo sapiens
gcccaggaactctcaccatgatggctttaataacatggtggcacattgcctggtaacctgagggttggtggggtttgtttctacctactttaccgaaaagccctctatcagctgttggccaaccacatcagggtgggctgtcaataccagcaaatatgcagaaagctatcggatccaaacctatgctgaatatatggggagaaaacaggaagagaagcagatcaaaagaaagtggactgaagatagctggaaggaggctgacagcaaacggttaaacccccagtgcataccctacaccctgcagaatcactattaccgcaacaatagttttacagctcccagcacagtaggaaagagaaatttgagtcctagtcaagaggaagctggcctggaggacggagtgtcaggggagatttccgacactgagcttgagcagaccgattcctgtgcagagcccctctcagagggaaggaaaaaggccaagaaattaaaaagaatgaagaaggagctttctccagcaggaagcatctcgaagaacagccctgccacactctttgaagttcctgacacatggtaaccaagacctgagggcagcaaaccgctggtgctgtcgctgtgagcaagagccggctggcacatttggaagccgcactgtatttaacttaatcaaatgtggtatgggaggggttggaaaccaagttgtctcctgggggggagaaaacaggttttatttttgtggctgtggttttttcccctttttaatctaactgcctgttgacattgacactcatcacggttgtaggctgtcatgaatgtgtacgtgcttaaccagtgaattccgtgttgctcttgtgaggcctttcctgtcatgacccagtgtgcttaagaacctgcctgatggggagtgtcggctgtgaaatctgcaaaaagagctgacattccagctgctgtgatcatgaatttgggggtgtactgtcctgcctgtgcatcttctcgcactgagattttgaggcagttgcagccctcggttagtctcccagtggaaaaatcggttgtgcctccctgcttcccaccatagctgcctgaaaacatgacgctctcaagcttgtccttccttcaggaagatgtccactcatgcccacccatgagagggcttgccgtatgccctggcctttgggcatatttatgtagagttcctttctcctaagacgtgagtttctcatgggggatgtacgagtaaaaaggttaacttctgttcttatgcgtggcgctgtgttcactttccagagtctctgttcgtttgtttggatggcggtctcggggtacggcagcgtgtgtgcgtacgtgtctgtgtgtgtgtgtgtgtgtgtgtgtgtgtgtgtgtgtgtgtgaaatcgtgcaaatctacaacatgtcccagcccattctccgttgaaacagatcacagcaacgacaaacgctcatggcgctgctttgctccacccgcttcagatagatcattgttagatatttcacatttttgtatggtggaaataaaaatgaaaaatgtatttccaaaagatgaaaattaaaaacattttcatagga

SEQ ID NO: 342234 - DNA, 1131 bp, Homo sapiens
ggcaggctggtacggtccggaattttcgggatatcggaagtgaagaaggagctttctccagtctggaagcatctcgaagaacagccctgccacactctttgaagttcctgacacatggtaaccaagacctgagggcagcaaaccgctggtgctgtcgctgtgagcaagagccggctggcacatttggaagccgcactgtatttaacttaatcaaatgtggtatgggaggggttggaaaccaagttgtctcctgggggggagaaaacaggttttatttttgtggctgtggttttttcccctttttaatctaactgcctgttgacattgacactcatcacggttgtaggctgtcatgaatgtgtacgtgcttaaccagtgaattccgtgttgctcttgtgaggcctttcctgtcatgacccagtgtgcttaagaacctgcctgatggggagtgtcggctgtgaaatctgcaaaaagagctgacattccagctgctgtgatcatgaatttgggggtgtactgtcctgcctgtgcatcttctcgcactgagattttgaggcagttgcagccctcggttagtctcccagtggaaaaatcggttgtgcctccctgcttcccaccatagctgcctgaaaacatgacgctctcaagcttgtccttccttcaggaagatgtccactcatgcccacccatgagagggcttgccgtatgccctggcctttgggcatatttatgtagagttcctttctcctaagacgtgagtttctcatgggggatgtacgagtaaaaaggttaacttctgttcttatgcgtggcgctgtgttcactttccagagtctctgttcgtttgtttggatggcggtctcggggtacggcagcgtgtgtgcgtacgtgtctgtgtgtgtgtgtgtgtgtgtgtgtgtgtgtgtgtgtgtgtgaaatcgtgcaaatctacaacatgtcccagcccattctccgttgaaacagatcacagcaacgacaaacgctcatggcgctgctttgctccacccgcttcagatagatcattgttagatatttcacatttttgtatggtggaaataaaaatgaaaaatgtatttccaaaagatgaaaattaaaaacattttcatagga

SEQ ID NO: 342235 - DNA, 1129 bp, Homo sapiens
ctggatctccttggcaagggaatccgccctctcttttagagcctcgttcttcttctccagcaggaagcatctcgaagaacagccctgccacactctttgaagttcctgacacatggtaaccaagacctgagggcagcaaaccgctggtgctgtcgctgtgagcaagagccggctggcacatttggaagccgcactgtatttaacttaatcaaatgtggtatgggaggggttggaaaccaagttgtctcctgggggggagaaaacaggttttatttttgtggctgtggttttttcccctttttaatctaactgcctgttgacattgacactcatcacggttgtaggctgtcatgaatgtgtacgtgcttaaccagtgaattccgtgttgctcttgtgaggcctttcctgtcatgacccagtgtgcttaagaacctgcctgatggggagtgtcggctgtgaaatctgcaaaaagagctgacattccagctgctgtgatcatgaatttgggggtgtactgtcctgcctgtgcatcttctcgcactgagattttgaggcagttgcagccctcggttagtctcccagtggaaaaatcggttgtgcctccctgcttcccaccatagctgcctgaaaacatgacgctctcaagcttgtccttccttcaggaagatgtccactcatgcccacccatgagagggcttgccgtatgccctggcctttgggcatatttatgtagagttcctttctcctaagacgtgagtttctcatgggggatgtacgagtaaaaaggttaacttctgttcttatgcgtggcgctgtgttcactttccagagtctctgttcgtttgtttggatggcggtctcggggtacggcagcgtgtgtgcgtacgtgtctgtgtgtgtgtgtgtgtgtgtgtgtgtgtgtgtgtgtgtgtgaaatcgtgcaaatctacaacatgtcccagcccattctccgttgaaacagatcacagcaacgacaaacgctcatggcgctgctttgctccacccgcttcagatagatcattgttagatatttcacatttttgtatggtggaaataaaaatgaaaaatgtatttccaaaagatgaaaattaaaaacattttcatagga

SEQ ID NO: 342236 - DNA, 1552 bp, Homo sapiens
tgcctcagctactgccgcagtcgccgcggaattcggcgagtagaaccgctgaggcgggcgcgggcccgggtggggccaaggttccggccactctgcagaatggagataatcaggagcaattttaagagtaatcttcacaaagtgtaccaggccatagaggaggccgacttcttcgccatcgatggggagttttcaggaatcagtgatggaccttcagtctctgcattaacaaatggttttgacactccagaagagaggtatcagaagcttaaaaaggtatataacgaagtcatttaacttctatgttttcccgaaacccttcaatagatcctcaccagatgtcaaatttgtttgtcagagctccagcattgactttctagcaagccagggatttgattttaataaagtttttcgaaatggaattccatatttaaatcaggaagaagaaagacagttaagagagcagtatgatgaaaaacgttcacaggcgaatggtgcaggagctctgtcctatgtatctcctaacacttcaaaatgtcctgtcacgattcctgaggatcaaaagaagtttattgaccaagtggtagagaaaatagaggatttattacaaagtgaagaaaacaagaacttggatttagagccatgtaccgggttccaaagaaaactaatttatcagactttgagctggaagtatccgaaaggcattcatgttgagactttagaaactgaaaagaaggagcgatatatagttatcagcaaagtagatgaagaagaacgcaaaagaagagagcagcagaaacatgccaaagaacaggaggagctgaatgatgctgtgggattttctagagtcattcacgccattgctaattcgggaaaacttgttattggacacaatatgctcttggacgtcatgcacacagttcatcagttctactgccctctgcctgcggacttaagtgagtttaaagagatgacaacatgtgttttccccagactcttggatactaaattgatggccagcacacaaccttttaaggatatcattaacaacacatcccttgcggaattggaaaagcggttaaaagagacacctttcaaccctcctaaagttgaaagtgccgaaggttttccaagttatgacacagcctctgaacaactccacgaggcaggctacgatgcctacatcacagggctgtgcttcatctccatggccaattacctaggttcttttctcagccctccaaaaattcatgtgtctgccagatcaaaactcattgaacctttttttaacaaggttccgctggaaatctaggccttcctggaatgacactgctttatggtctttctgagctaccgatgagacaaggaatgatatgctcttggacaaatgttttctcctctgtaaaatggggataaaatgattcaccttctgtattggtccattttcatgctgctaataaagacacaactaagacagggcaatttacaaaataaagagagatcggccggttcttatattattatatgtgttgtcaaattgatactccagata

SEQ ID NO: 342237 - DNA, 469 bp, Homo sapiens
ggatatcccctatctaaacttggaaggaccagactgtaagtaaatttttattttcttattgcatctgtgcatttaagtgtgtggtctggaagggataacaggaaaatattactaaagaaaaagcttttttcactcaaaattgggctgtgattttgtggttgatatgaatagtatgcttaagttaatgggactcttgggcattcattagtcatttcttcatttatgttttccagtttatgcatgaaatgaattttagaagcatgtatcttctctatatatttcattttcactcagaattctgatttcatcattttctataagtatttataatagatttttaagatatgctagctgtcagttatcttggtaaaatttctgttttccagttacttgagtatgtgtatatttgaatttagtaggttgatttctgttttgttttgttttgttttatttaaaaaacgtggaaggt

SEQ ID NO: 342238 - DNA, 3029 bp, Homo sapiens
tgcctcagctactgccgcagtcgccgcggaattcggcgagtagaaccgctgaggcgggcgcgggcccgggtggggccaaggttccggccactctgcagaatggagataatcaggagcaattttaagagtaatcttcacaaagtgtaccaggccatagaggaggccgacttcttcgccatcgatggggagttttcaggaatcagtgatggaccttcagtctctgcattaacaaatggttttgacactccagaagagaggtatcagaagcttaaaaagcattccatggactttttgctatttcagtttggcctttgcacttttaagtatgactacacagattcaaagtatataacgaagtcatttaacttctatgttttcccgaaacccttcaatagatcctcaccagatgtcaaatttgtttgtcagagctccagcattgactttctagcaagccagggatttgattttaataaagtttttcgaaatggaattccatatttaaatcaggaagaagaaagacagttaagagagcagtatgatgaaaaacgttcacaggcgaatggtgcaggagctctgtcctatgtatctcctaacacttcaaaatgtcctgtcacgattcctgaggatcaaaagaagtttattgaccaagtggtagagaaaatagaggatttattacaaagtgaagaaaacaagaacttggatttagagccatgtaccgggttccaaagaaaactaatttatcagactttgagctggaagtatccgaaaggcattcatgttgagactttagaaactgaaaagaaggagcgatatatagttatcagcaaagtagatgaagaagaacgcaaaagaagagagcagcagaaacatgccaaagaacaggaggagctgaatgatgctgtgggattttctagagtcattcacgccattgctaattcgggaaaacttgttattggacacaatatgctcttggacgtcatgcacacagttcatcagttctactgccctctgcctgcggacttaagtgagtttaaagagatgacaacatgtgttttccccagactcttggatactaaattgatggccagcacacaaccttttaaggatatcattaacaacacatcccttgcggaattggaaaagcggttaaaagagacacctttcaaccctcctaaagttgaaagtgccgaaggttttccaagttatgacacagcctctgaacaactccacgaggcaggctacgatgcctacatcacagggctgtgcttcatctccatggccaattacctaggttcttttctcagccctccaaaaattcatgtgtctgccagatcaaaactcattgaacctttttttaacaagttatttcttatgagggtcatggatatcccctatctaaacttggaaggaccagacttgcagcctaaacgtgatcatgttctccatgtgacattccccaaagaatggaaaaccagcgacctttaccagcttttcagtgcctttggtaacattcagatatcctggattgatgacacatcagcatttgtttcccttagccagcccgagcaagtaaagattgctgtcaataccagcaaatatgcagaaagctatcggatccaaacctatgctgaatatatggggagaaaacaggaagagaagcagatcaaaagaaagtggactgaagatagctggaaggaggctgacagcaaacggttaaacccccagtgcataccctacaccctgcagaatcactattaccgcaacaatagttttacagctcccagcacagtaggaaagagaaatttgagtcctagtcaagaggaagctggcctggaggacggagtgtcaggggagatttccgacactgagcttgagcagaccgattcctgtgcagagcccctctcagagggaaggaaaaaggccaagaaattaaaaagaatgaagaaggagctttctccagcaggaagcatctcgaagaacagccctgccacactctttgaagttcctgacacatggtaaccaagacctgagggcagcaaaccgctggtgctgtcgctgtgagcaagagccggctggcacatttggaagccgcactgtatttaacttaatcaaatgtggtatgggaggggttggaaaccaagttgtctcctgggggggagaaaacaggttttatttttgtggctgtggttttttcccctttttaatctaactgcctgttgacattgacactcatcacggttgtaggctgtcatgaatgtgtacgtgcttaaccagtgaattccgtgttgctcttgtgaggcctttcctgtcatgacccagtgtgcttaagaacctgcctgatggggagtgtcggctgtgaaatctgcaaaaagagctgacattccagctgctgtgatcatgaatttgggggtgtactgtcctgcctgtgcatcttctcgcactgagattttgaggcagttgcagccctcggttagtctcccagtggaaaaatcggttgtgcctccctgcttcccaccatagctgcctgaaaacatgacgctctcaagcttgtccttccttcaggaagatgtccactcatgcccacccatgagagggcttgccgtatgccctggcctttgggcatatttatgtagagttcctttctcctaagacgtgagtttctcatgggggatgtacgagtaaaaaggttaacttctgttcttatgcgtggcgctgtgttcactttccagagtctctgttcgtttgtttggatggcggtctcggggtacggcagcgtgtgtgcgtacgtgtctgtgtgtgtgtgtgtgtgtgtgtgtgtgtgtgtgtgtgtgtgaaatcgtgcaaatctacaacatgtcccagcccattctccgttgaaacagatcacagcaacgacaaacgctcatggcgctgctttgctccacccgcttcagatagatcattgttagatatttcacatttttgtatggtggaaataaaaatgaaaaatgtatttccaaaagatgaaaattaaaaacattttcatagga

SEQ ID NO: 342239 - DNA, 2961 bp, Homo sapiens
tgcctcagctactgccgcagtcgccgcggaattcggcgagtagaaccgctgaggcgggcgcgggcccgggtggggccaaggttccggccactctgcagaatggagataatcaggagcaattttaagagtaatcttcacaaagtgtaccaggccatagaggaggccgacttcttcgccatcgatggggagttttcaggaatcagtgatggaccttcagtctctgcattaacaaatggttttgacactccagaagagaggtatcagaagcttaaaaaggtatataacgaagtcatttaacttctatgttttcccgaaacccttcaatagatcctcaccagatgtcaaatttgtttgtcagagctccagcattgactttctagcaagccagggatttgattttaataaagtttttcgaaatggaattccatatttaaatcaggaagaagaaagacagttaagagagcagtatgatgaaaaacgttcacaggcgaatggtgcaggagctctgtcctatgtatctcctaacacttcaaaatgtcctgtcacgattcctgaggatcaaaagaagtttattgaccaagtggtagagaaaatagaggatttattacaaagtgaagaaaacaagaacttggatttagagccatgtaccgggttccaaagaaaactaatttatcagactttgagctggaagtatccgaaaggcattcatgttgagactttagaaactgaaaagaaggagcgatatatagttatcagcaaagtagatgaagaagaacgcaaaagaagagagcagcagaaacatgccaaagaacaggaggagctgaatgatgctgtgggattttctagagtcattcacgccattgctaattcgggaaaacttgttattggacacaatatgctcttggacgtcatgcacacagttcatcagttctactgccctctgcctgcggacttaagtgagtttaaagagatgacaacatgtgttttccccagactcttggatactaaattgatggccagcacacaaccttttaaggatatcattaacaacacatcccttgcggaattggaaaagcggttaaaagagacacctttcaaccctcctaaagttgaaagtgccgaaggttttccaagttatgacacagcctctgaacaactccacgaggcaggctacgatgcctacatcacagggctgtgcttcatctccatggccaattacctaggttcttttctcagccctccaaaaattcatgtgtctgccagatcaaaactcattgaacctttttttaacaagttatttcttatgagggtcatggatatcccctatctaaacttggaaggaccagacttgcagcctaaacgtgatcatgttctccatgtgacattccccaaagaatggaaaaccagcgacctttaccagcttttcagtgcctttggtaacattcagatatcctggattgatgacacatcagcatttgtttcccttagccagcccgagcaagtaaagattgctgtcaataccagcaaatatgcagaaagctatcggatccaaacctatgctgaatatatggggagaaaacaggaagagaagcagatcaaaagaaagtggactgaagatagctggaaggaggctgacagcaaacggttaaacccccagtgcataccctacaccctgcagaatcactattaccgcaacaatagttttacagctcccagcacagtaggaaagagaaatttgagtcctagtcaagaggaagctggcctggaggacggagtgtcaggggagatttccgacactgagcttgagcagaccgattcctgtgcagagcccctctcagagggaaggaaaaaggccaagaaattaaaaagaatgaagaaggagctttctccagcaggaagcatctcgaagaacagccctgccacactctttgaagttcctgacacatggtaaccaagacctgagggcagcaaaccgctggtgctgtcgctgtgagcaagagccggctggcacatttggaagccgcactgtatttaacttaatcaaatgtggtatgggaggggttggaaaccaagttgtctcctgggggggagaaaacaggttttatttttgtggctgtggttttttcccctttttaatctaactgcctgttgacattgacactcatcacggttgtaggctgtcatgaatgtgtacgtgcttaaccagtgaattccgtgttgctcttgtgaggcctttcctgtcatgacccagtgtgcttaagaacctgcctgatggggagtgtcggctgtgaaatctgcaaaaagagctgacattccagctgctgtgatcatgaatttgggggtgtactgtcctgcctgtgcatcttctcgcactgagattttgaggcagttgcagccctcggttagtctcccagtggaaaaatcggttgtgcctccctgcttcccaccatagctgcctgaaaacatgacgctctcaagcttgtccttccttcaggaagatgtccactcatgcccacccatgagagggcttgccgtatgccctggcctttgggcatatttatgtagagttcctttctcctaagacgtgagtttctcatgggggatgtacgagtaaaaaggttaacttctgttcttatgcgtggcgctgtgttcactttccagagtctctgttcgtttgtttggatggcggtctcggggtacggcagcgtgtgtgcgtacgtgtctgtgtgtgtgtgtgtgtgtgtgtgtgtgtgtgtgtgtgtgtgaaatcgtgcaaatctacaacatgtcccagcccattctccgttgaaacagatcacagcaacgacaaacgctcatggcgctgctttgctccacccgcttcagatagatcattgttagatatttcacatttttgtatggtggaaataaaaatgaaaaatgtatttccaaaagatgaaaattaaaaacattttcatagga

SEQ ID NO: 342240 - DNA, 2094 bp, Homo sapiens
tgggtggatcacctgaggttaggagtttgagaccagcctgaccaacatggaaaaaccctgtctccactaaaaatacaaaattagctgggcatggtggcacatgtctgtgatccctggtcctcgggaggctgaggcaggacaatcacttgaatctgggaggtggaagtttcagtgaaccgagattgcgccattgcactccagcctgggcaacaagagtgaaactctgactccaaaaaaaaagaatacctttcacacttgttgaaccatgctgttaatttaaatctgttttggtctgaactttcaggcttggtctatgtgactatgaataataatacctctcttcttttcttcattaggttcttttctcagccctccaaaaattcatgtgtctgccagatcaaaactcattgaacctttttttaacaagttatttcttatgagggtcatggatatcccctatctaaacttggaaggaccagacttgcagcctaaacgtgatcatgttctccatgtgacattccccaaagaatggaaaaccagcgacctttaccagcttttcagtgcctttggtaacattcagatatcctggattgatgacacatcagcatttgtttcccttagccagcccgagcaagtaaagattgctgtcaataccagcaaatatgcagaaagctatcggatccaaacctatgctgaatatatggggagaaaacaggaagagaagcagatcaaaagaaagtggactgaagatagctggaaggaggctgacagcaaacggttaaacccccagtgcataccctacaccctgcagaatcactattaccgcaacaatagttttacagctcccagcacagtaggaaagagaaatttgagtcctagtcaagaggaagctggcctggaggacggagtgtcaggggagatttccgacactgagcttgagcagaccgattcctgtgcagagcccctctcagagggaaggaaaaaggccaagaaattaaaaagaatgaagaaggagctttctccagcaggaagcatctcgaagaacagccctgccacactctttgaagttcctgacacatggtaaccaagacctgagggcagcaaaccgctggtgctgtcgctgtgagcaagagccggctggcacatttggaagccgcactgtatttaacttaatcaaatgtggtatgggaggggttggaaaccaagttgtctcctgggggggagaaaacaggttttatttttgtggctgtggttttttcccctttttaatctaactgcctgttgacattgacactcatcacggttgtaggctgtcatgaatgtgtacgtgcttaaccagtgaattccgtgttgctcttgtgaggcctttcctgtcatgacccagtgtgcttaagaacctgcctgatggggagtgtcggctgtgaaatctgcaaaaagagctgacattccagctgctgtgatcatgaatttgggggtgtactgtcctgcctgtgcatcttctcgcactgagattttgaggcagttgcagccctcggttagtctcccagtggaaaaatcggttgtgcctccctgcttcccaccatagctgcctgaaaacatgacgctctcaagcttgtccttccttcaggaagatgtccactcatgcccacccatgagagggcttgccgtatgccctggcctttgggcatatttatgtagagttcctttctcctaagacgtgagtttctcatgggggatgtacgagtaaaaaggttaacttctgttcttatgcgtggcgctgtgttcactttccagagtctctgttcgtttgtttggatggcggtctcggggtacggcagcgtgtgtgcgtacgtgtctgtgtgtgtgtgtgtgtgtgtgtgtgtgtgtgtgtgtgtgtgaaatcgtgcaaatctacaacatgtcccagcccattctccgttgaaacagatcacagcaacgacaaacgctcatggcgctgctttgctccacccgcttcagatagatcattgttagatatttcacatttttgtatggtggaaataaaaatgaaaaatgtatttccaaaagatgaaaattaaaaacattttcatagga

SEQ ID NO: 342241 - DNA, 2612 bp, Homo sapiens
tgcctcagctactgccgcagtcgccgcggaattcggcgagtagaaccgctgaggcgggcgcgggcccgggtggggccaaggttccggccactctgcagaatggagataatcaggagcaattttaagagtaatcttcacaaagtgtaccaggccatagaggaggccgacttcttcgccatcgatggggagttttcaggaatcagtgatggaccttcagtctctgcattaacaaatggttttgacactccagaagagaggtatcagaagcttaaaaaggtatataacgaagtcatttaacttctatgttttcccgaaacccttcaatagatcctcaccagatgtcaaatttgtttgtcagagctccagcattgactttctagcaagccagggatttgattttaataaagtttttcgaaatggaattccatatttaaatcaggaagaagaaagacagttaagagagcagtatgatgaaaaacgttcacaggcgaatggtgcaggagctctgtcctatgtatctcctaacacttcaaaatgtcctgtcacgattcctgaggatcaaaagaagtttattgaccaagtggtagagaaaatagaggatttattacaaagtgaagaaaacaagaacttggatttagagccatgtaccgggttccaaagaaaactaatttatcagactttgagctggaagtatccgaaaggcattcatgttgagactttagaaactgaaaagaaggagcgatatatagttatcagcaaagtagatgaagaagaacgcaaaagaagagagcagcagaaacatgccaaagaacaggaggagctgaatgatgctgtgggattttctagagtcattcacgccattgctaattcgggaaaacttgttattggacacaatatgctcttggacgtcatgcacacagttcatcagttctactgccctctgcctgcggacttaagtgagtttaaagagatgacaacatgtgttttccccagactcttggatactaaattgatggccagcacacaaccttttaaggatatcattaacaacacatcccttgcggaattggaaaagcggttaaaagagacacctttcaaccctcctaaagttgaaagtgccgaaggttttccaagttatgacacagcctctgaacaactccacgaggcaggctacgatgcctacatcacagggctgtgcttcatctccatggccaattacctaggttcttttctcagccctccaaaaattcatgtgtctgccagatcaaaactcattgaacctttttttaacaagttatttcttatgagggtcatggatatcccctatctaaacttggaaggaccagacttgcagcctaaacgtgatcatgttctccatgtgacattccccaaagaatggaaaaccagcgacctttaccagcttttcagtgcctttggtaacattcagatatcctggattgatgacacatcagcatttgtttcccttagccagcccgagcaagtaaagattgctgtcaataccagcaaatatgcagaaagctatcggatccaaacctatgctgaatatatggggagaaaacaggaattcctgacacatggtaaccaagacctgagggcagcaaaccgctggtgctgtcgctgtgagcaagagccggctggcacatttggaagccgcactgtatttaacttaatcaaatgtggtatgggaggggttggaaaccaagttgtctcctgggggggagaaaacaggttttatttttgtggctgtggttttttcccctttttaatctaactgcctgttgacattgacactcatcacggttgtaggctgtcatgaatgtgtacgtgcttaaccagtgaattccgtgttgctcttgtgaggcctttcctgtcatgacccagtgtgcttaagaacctgcctgatggggagtgtcggctgtgaaatctgcaaaaagagctgacattccagctgctgtgatcatgaatttgggggtgtactgtcctgcctgtgcatcttctcgcactgagattttgaggcagttgcagccctcggttagtctcccagtggaaaaatcggttgtgcctccctgcttcccaccatagctgcctgaaaacatgacgctctcaagcttgtccttccttcaggaagatgtccactcatgcccacccatgagagggcttgccgtatgccctggcctttgggcatatttatgtagagttcctttctcctaagacgtgagtttctcatgggggatgtacgagtaaaaaggttaacttctgttcttatgcgtggcgctgtgttcactttccagagtctctgttcgtttgtttggatggcggtctcggggtacggcagcgtgtgtgcgtacgtgtctgtgtgtgtgtgtgtgtgtgtgtgtgtgtgtgtgtgtgtgtgaaatcgtgcaaatctacaacatgtcccagcccattctccgttgaaacagatcacagcaacgacaaacgctcatggcgctgctttgctccacccgcttcagatagatcattgttagatatttcacatttttgtatggtggaaataaaaatgaaaaatgtatttccaaaagatgaaaattaaaaacattttcatagga

SEQ ID NO: 342242 - DNA, 2897 bp, Homo sapiens
tgcctcagctactgccgcagtcgccgcggaattcggcgagtagaaccgctgaggcgggcgcgggcccgggtggggccaaggttccggccactctgcagaatggagataatcaggagcaattttaagagtaatcttcacaaagtgtaccaggccatagaggaggccgacttcttcgccatcgatggggagttttcaggaatcagtgatggaccttcagtctctgcattaacaaatggttttgacactccagaagagaggtatcagaagcttaaaaaggtatataacgaagtcatttaacttctatgttttcccgaaacccttcaatagatcctcaccagatgtcaaatttgtttgtcagagctccagcattgactttctagcaagccagggatttgattttaataaagtttttcgaaatggaattccatatttaaatcaggaagaagaaagacagttaagagagcagtatgatgaaaaacgttcacaggcgaatggtgcaggagctctgtcctatgtatctcctaacacttcaaaatgtcctgtcacgattcctgaggatcaaaagaagtttattgaccaagtggtagagaaaatagaggatttattacaaagtgaagaaaacaagaacttggatttagagccatgtaccgggttccaaagaaaactaatttatcagactttgagctggaagtatccgaaaggcattcatgttgagactttagaaactgaaaagaaggagcgatatatagttatcagcaaagtagatgaagaagaacgcaaaagaagagagcagcagaaacatgccaaagaacaggaggagctgaatgatgctgtgggattttctagagtcattcacgccattgctaattcgggaaaacttgttattggacacaatatgctcttggacgtcatgcacacagttcatcagttctactgccctctgcctgcggacttaagtgagtttaaagagatgacaacatgtgttttccccagactcttggatactaaattgatggccagcacacaaccttttaaggatatcattaacaacacatcccttgcggaattggaaaagcggttaaaagagacacctttcaaccctcctaaagttgaaagtgccgaaggttttccaagttatgacacagcctctgaacaactccacgaggcaggctacgatgcctacatcacagggctgtgcttcatctccatggccaattacctaggttcttttctcagccctccaaaaattcatgtgtctgccagatcaaaactcattgaacctttttttaacaagttatttcttatgagggtcatggatatcccctatctaaacttggaaggaccagacttgcagcctaaacgtgatcatgttctccatgtgacattccccaaagaatggaaaaccagcgacctttaccagcttttcagtgcctttggtaacattcagatatcctggattgatgacacatcagcatttgtttcccttagccagcccgagcaagtaaagattgctgtcaataccagcaaatatgcagaaagctatcggatccaaacctatgctgaatatatggggagaaaacaggaagagaagcagatcaaaagaaagtggactgaagatagctggaaggaggctgacagcaaacggttaaacccccagtgcataccctacaccctgcagaatcactattaccgcaacaatagttttacagctcccagcacagtaggaaagagaaatttgagtcctagtcaagaggaagctggcctggaggacggagtgtcaggggagatttccgacactgagcttgagcagaccgattcctgtgcagagcccctctcagagggaaggaaaaaggccaagaaattaaaaagaatgaagaaggagctttctccagcaggaagcatctcgaagaacagccctgccacactctttgaagttcctgacacatggtaaccaagacctgagggcagcaaaccgctggtgctgtcgctgtgagcaagagccggctggcacatttggaagccgcactgtatttaacttaatcaaatgtggtatgggaggggttggaaaccaagttgtctcctgggggggagaaaacaggttttatttttgtggctgtggttttttcccctttttaatctaactgcctgttgacattgacactcatcacggttgtaggctgtcatgaatgtgtacgtgcttaaccagtgaattccgtgttgctcttgtgaggcctttcctgtcatgacccagtgtgcttaagaacctgcctgatggggagtgtcggctgtgaaatctgcaaaaagagctgacattccagctgctgtgatcatgaatttgggggtgtactgtcctgcctgtgcatcttctcgcactgagattttgaggcagttgcagccctcggttagtctcccagtggaaaaatcggttgtgcctccctgcttcccaccatagctgcctgaaaacatgacgctctcaagcttgtccttccttcaggaagatgtccactcatgcccacccatgagagggcttgccgtatgccctggcctttgggcatatttatgtagagttcctttctcctaagacgtgagtttctcatgggggatgtacgagtaaaaaggttaacttctgttcttatgcgtggcgctgtgttcactttccagagtctctgttcgtttgtttggatggcggtctcggggtacggcagcgtgtgtgcgtacgtgtctgtgtgtgtgtgtgtgtgtgtgtgtgtgtgtgtgtgactgtgctaaaaaaattgcaagatctggcttctgcgacattgtggcagcccttggcttatcacaaggaccactatcgcttgatgcccctcggcagtggaaccgctccttatgcaacaaccgaggcccatccccttctg

SEQ ID NO: 342243 - DNA, 2635 bp, Homo sapiens
tgcctcagctactgccgcagtcgccgcggaattcggcgagtagaaccgctgaggcgggcgcgggcccgggtggggccaaggttccggccactctgcagaatggagataatcaggagcaattttaagagtaatcttcacaaagtgtaccaggccatagaggaggccgacttcttcgccatcgatggggagttttcaggaatcagtgatggaccttcagtctctgcattaacaaatggttttgacactccagaagagaggtatcagaagcttaaaaaggtatataacgaagtcatttaacttctatgttttcccgaaacccttcaatagatcctcaccagatgtcaaatttgtttgtcagagctccagcattgactttctagcaagccagggatttgattttaataaagtttttcgaaatggaattccatatttaaatcaggaagaagaaagacagttaagagagcagtatgatgaaaaacgttcacaggcgaatggtgcaggagctctgtcctatgtatctcctaacacttcaaaatgtcctgtcacgattcctgaggatcaaaagaagtttattgaccaagtggtagagaaaatagaggatttattacaaagtgaagaaaacaagaacttggatttagagccatgtaccgggttccaaagaaaactaatttatcagactttgagctggaagtatccgaaaggcattcatgttgagactttagaaactgaaaagaaggagcgatatatagttatcagcaaagtagatgaagaagaacgcaaaagaagagagcagcagaaacatgccaaagaacaggaggagctgaatgatgctgtgggattttctagagtcattcacgccattgctaattcgggaaaacttgttattggacacaatatgctcttggacgtcatgcacacagttcatcagttctactgccctctgcctgcggacttaagtgagtttaaagagatgacaacatgtgttttccccagactcttggatactaaattgatggccagcacacaaccttttaaggatatcattaacaacacatcccttgcggaattggaaaagcggttaaaagagacacctttcaaccctcctaaagttgaaagtgccgaaggttttccaagttatgacacagcctctgaacaactccacgaggcaggctacgatgcctacatcacagggctgtgcttcatctccatggccaattacctaggttcttttctcagccctccaaaaattcatgtgtctgccagatcaaaactcattgaacctttttttaacaagttatttcttatgagggtcatggatatcccctatctaaacttggaaggaccagacttgcagcctaaacgtgatcatgttctccatgtgacattccccaaagaatggaaaaccagcgacctttaccagcttttcagtgcctttggtaacattcagatatcctggattgatgacacatcagcatttgtttcccttagccagcccgagcaagtaaagattgctgtcaataccagcaaatatgcagaaagctatcggatccaaacctatgctgaatatatggggagaaaacaggaagagaagcagatcaaaagaaagtggactgaagatagctggaaggaggctgacagcaaacggttaaacccccagtgcataccctacaccctgcagaatcactattaccgcaacaatagttttacagctcccagcacagtaggaaagagaaatttgagtcctagtcaagaggaagctggcctggaggacggagtgtcaggggagatttccgacactgagcttgagcagaccgattcctgtgcagagcccctctcagagggaaggaaaaaggccaagaaattaaaaagaatgaagaaggagctttctccagcaggaagcatctcgaagaacagccctgccacactctttgaagttcctgacacatggtaaccaagacctgagggcagcaaaccgctggtgctgtcgctgtgagcaagagccggctggcacatttggaagccgcactgtatttaacttaatcaaatgtggtatgggaggggttggaaaccaagttgtctcctgggggggagaaaacaggttttatttttgtggctgtggttttttcccctttttaatctaactgcctgttgacattgacactcatcacggttgtaggctgtcatgaatgtgtacgtgcttaaccagtgaattccgtgttgctcttgtgaggcctttcctgtcatgacccagtgtgcttaagaacctgcctgatggggagtgtcggctgtgaaatctgcaaaaagagctgacattccagctgctgtgatcatgaatttgggggtgtactgtcctgcctgtgcatcttctcgcactgagattttgaggcagttgcagccctcggttaggtctacctggaccccttacgagtgcggcttcgaccctatatcccccgcccgcgtccctttctccataaaattcttcttagtagctattaccttcttattatttgatctagaaattgccctccttttacccctaccatgagccctacaaacaactaacctgccactaatagttaggtctacctgggttaggtctacctgagttaggtctaccttggttaggtctaccttg

SEQ ID NO: 342244 - DNA, 1264 bp, Homo sapiens
tgcctcagctactgccgcagtcgccgcggaattcggcgagtagaaccgctgaggcgggcgcgggcccgggtggggccaaggttccggccactctgcagaatggagataatcaggagcaattttaagagtaatcttcacaaagtgtaccaggccatagaggaggccgacttcttcgccatcgatggggagttttcaggaatcagtgatggaccttcagtctctgcattaacaaatggttttgacactccagaagagaggtatcagaagcttaaaaaggtatataacgaagtcatttaacttctatgttttcccgaaacccttcaatagatcctcaccagatgtcaaatttgtttgtcagagctccagcattgactttctagcaagccagggatttgattttaataaagtttttcgaaatggaattccatatttaaatcaggaagaagaaagacagttaagagagcagtatgatgaaaaacgttcacaggcgaatggtgcaggagctctgtcctatgtatctcctaacacttcaaaatgtcctgtcacgattcctgaggatcaaaagaagtttattgaccaagtggtagagaaaatagaggatttattacaaagtgaagaaaacaagaacttggatttagagccatgtaccgggttccaaagaaaactaatttatcagactttgagctggaagtatccgaaaggcattcatgttgagactttagaaactgaaaagaaggagcgatatatagttatcagcaaagtagatgaagaagaacgcaaaagaagagagcagcagaaacatgccaaagaacaggaggagctgaatgatgctgtgggattttctagagtcattcacgccattgctaattcgggaaaacttgttattggacacaatatgctcttggacgtcatgcacacagttcatcagttctactgccctctgcctgcggacttaagtgagtttaaagagatgacaacatgtgttttccccagactcttggatactaaattgatggccagcacacaaccttttaaggatatcattaacaacacatcccttgcggaattggaaaagcggttaaaagagacacctttcaaccctcctaaagttgaaagtgccgaaggttttccaagttatgacacagcctctgaacaactccacgaggcaggctacgatgcctacatcacagggctgtgcttcatctccatggccaattacctaggttcttttctcagacatctccagtccggtaccgagctcgat

SEQ ID NO: 342245 - DNA, 521 bp, Homo sapiens
gcggggctggcacccgggccgaggctctgattctggggggaggccgactccaccctggctggaggaactgggtgctcctgcccgctggcccctcgcgcgtgaggatctatctcaggtgtgtgcttcctgggagaccccttcccccgcctctagtattctagggggggagtggtccctttctgacccgggcgagtgttctgggactccagtcttggcggtaggtggtggcgggaaacgggaaagatttagaatttcttcccaccagcagaagatggattcgctcttctctagggtttcgttgtttatgttttggaggcggcatttgtaaaatagtaaagtggcaggacttttggggcgagggttggtaccccattgaaagttcatgcaaacttttagcttgtagatgcggctagtctgataaggattgttgctcccttccgaagcaagagtgagaacgagtctggaggagggctgaggcttctttgagaaactcagctgctggcgtgtgaccgtcctaggag

SEQ ID NO: 342246 - DNA, 6041 bp, Homo sapiens
ttttttttttttgggtggcggggggttgcaagtgggaagcctgctgttcagctgccggggctctccgcctccccccacctgtatgaggctgggtctggggaacctgtgctcagcattccaccccctggagcttgggcttggtcttccctgcgggtccctgcgctgacattcaggcggggagccaggaggcctggcgcgcctccagagcccgccgggggagccgggcgagggttctgggctctgacggcggggtcgcagggtcgcccgcctcctggacacgtctgtaggcctagggaagcctgccggccgggaggtacagagtaggagaagccagatcccagggcggacaacgagaagtcgtcaggctaagaaatggcatttcaaaaggcagtgaaagggacgattcttgttggaggaggtgctcttgcaactgttttaggactttctcagtttgctcattacagaaggaaacaaatgaacctggcctatgttaaagcagcagactgcatttcagaaccagttaacagggagcctccttccagagaagctcagctactgactttgcaaaacacatctgaatttgatatccttgttattggaggaggagcaacaggaagtggctgtgcgctagatgctgtcaccagaggactaaaaacagcccttgtagaaagagatgatttctcatcagggaccagcagcagaagcactaaattgatccatggtggtgtgagatatctgcagaaggccatcatgaagttggatattgagcagtataggatggtaaaagaagcccttcatgagcgtgccaacctgctagaaattgctccccatttatcagctccattgcctataatgcttccagtttacaagtggtggcagttaccttactactgggtaggaatcaagctgtatgatttggttgcaggaagcaattgcctaaaaagcagttatgtcctcagcaaatcaagagcccttgaacatttcccaatgctccagaaggacaaactggtaggagcaattgtctactatgacggacaacataacgatgcacggatgaaccttgccattgctctgactgctgccaggtatggggctgccacagccaattacatggaggtagtgagcttgctcaagaagacagacccccagacagggaaagtgcatgtgagcggcgcacggtgcaaggatgtcctcacagggcaggaatttgacgtgagagccaaatgtgttatcaatgccacgggacctttcacggactctgtgcgcaaaatggatgataaagacgcagcagctatctgccagccaagtgctggtgtccatattgtgatgcctggttattacagcccagagagcatgggacttcttgacccagcgaccagtgatgggcgagttattttcttcttaccctggcaaaagatgacgatcgctggcactactgatactccaactgatgttacacaccatccaattccttcagaagaagatatcaacttcattttgaatgaagtgcgtaattacctgagttgtgatgttgaagtgagaagaggggatgtcctggcagcatggagtggaatccgtcctcttgttacagaccccaaatctgcagatactcagtctatctcccgaaatcatgttgttgatatcagtgagagtggccttattactatagcaggtggaaagtggacaacttatcggtctatggcagaagataccataaatgctgctgtcaaaactcataatttaaaagcaggaccaagtagaacagttgggcttttccttcaagggggtaaagattggagccccacactctacattaggcttgtgcaggattatggacttgaaagcgaggtggcacagcatcttgccgccacctatggtgataaggcctttgaggtggccaaaatggcaagtgtgactggcaaaaggtggcctattgttggagtacgtcttgtgtcagaatttccatatattgaagcagaggtgaaatatgggattaaggagtatgcctgcactgctgtggatatgatttcacgtcgtactcgcctggcctttctaaatgtccaggcagcagaggaagccctacccaggattgttgaactgatgggcagggaactgaattgggatgattataagaagcaggaacaacttgaaacagccaggaagtttctatattatgaaatgggctataaatctcgatcagaacagttaacagatcgctctgaaattagcctactgccttcagacattgacaggtataagaagagatttcataagtttgatgcagaccagaaaggctttattaccattgttgatgttcagcgtgtattagagagtatcaatgtccaaatggatgaaaatacactccatgaaattctaaatgaagttgatttgaataaaaatggacaggttgaactcaatgaatttttgcagctgatgagtgctattcaaaaaggaagggtatctggaagccggcttgctatactaatgaaaactgcagaagagaacctcgacagaagagttccaattccagtggaccgtagttgtggaggattgtgagtctgggcagtaaatccacagccaacaaacatagaaacgacaaatcaccatgtaacaaccagagatgactgaaaccactctgaaataatgaatgtggatagctgccttttttaacactagaaaacattccaaaactttaaggtgttggtgtatttgccagctttatttgctgtactttatttgtatttgccattcagtctagcttttaagtatatttttttctttttctcattttcaatgcacattagttttgcatctgttttgtgacctgttagatgtgacacattctctttttgtttattcccttattctaaatgagttctaaaaacataatattttggcaaaaattgaaaaaagctggagacattttgtgacatgcatacagatagcatgtgttattaaaaagagttgcctattgaaatgatcgtgtttctggagaaattaagcttatagacagcatgtgttattaaaaagagttacctattgaaatgatagtgtttctggagatttctcagccccatcttcctccagcttgtctaccttcctcatgcaaacaatattccacatttttatatctagagcatgactggctaactggagagggaaggaaaagtttagatctggttactggagcaagtctcaaagagaaactctgaaagcttccagaatcacaggtataagataaggatagcattgacatttgctgggagttacagtgatagtttcatctcagcagttcatttttttcttcagtcactgctggttttctttgactattatagttgccaggaagatccttgctcttcttactttaaaaccagcatttaagtggcaatttggatgtaataggatgagaccaaatttatctaattattacagtagtaatacatttaagagttaaaaatgtgtttttatatatccacatatgataacaaaagattcaattcccaagcctaaattttgaagcatgtggtattgtcaaatctagcttaccatcttttttgggggtacttgcaaccatagtaaaggaagatggaatagactttagttaactttaattataattatatgttaaataaggcacataaccagtttccaaggtcatcatggttgcttaaagtctttccccttctgtactccatggaaatattctcagtaaaccaaaaacaaaaatggaaaaataatcaccaacccccatcccgacacacacacacagtccaaagcaaaagtcagtgtgtattgaatttaacaagtaatgcagtttgggatgcttttgctacattttggtggcattttaactagttatctgaatatttattaatcgtacttcctcttgtaaagttaactacttacttttttgttgttgtttttttaacatcaggttctgtatctaataggagatgtaacactttatttcatggcaggtttttattgcagagacttgaagtcttagttttttaaactggcacataaaacactttttgctgttatttttatttatgtcaatactgcagagtatctttatgccttattcaagtggattctgagcctgtatgtcacaatgtaaacactggaggttcactcacctacgcactcacccaccacctctgaaagaaacagaaactgcagagaaagacagcatcttagctcattttgtttttaaatgaggttttagacgcttgccacttcctaagggaaatcctaaaacagagcaagtgatgctcccaggtatcactgtgaacttttttctttcaaagtgtgaatttttacactggctttttcatttttttaaagtaattgaagcttgtggctttacaacttagtgttttttgctatccagataacaagtttcattgtttagaacccagtgacacttaataggtagataaattgtcctttaaaatatcccagatgatatacacaatatggtacatttgtgctctctctctctgtttttctctctttctctttctagttagatcaagataacgatgacttgtaccctccctgattctgttacagtagggcccgggcagatctgtgtttgttaaacaggccttgtttgtgcatgctttgctatgaatgaagttcctttaaggacaaagaaaagcacacttttcttcttttgagcatatctgcttttactttaaatctgctaatttctaaaatgtagagtccttcaccaatcccagagactcaatttggaaatgaactgatttcaagccgttactgtgaataaagcaccccagcattttgtataagctcttaattaaacctgtacagcttctttacctgatttaagaaagggagacaagcaataggggggaataagcttcttcaaaattcattccaagcacaaaagaaattttttccctttgcatataaacttgacatcagttgattctgttggggtcggggtgggtatgcagggattgccttttattatcaagtgatttatttcaagagcctttgaggggattcaggtgaaggaacccccatctgtgctggagagttggatactcctttaaatagcccccaccacagtcataacaataatgataatgctggattatttgttaagccaaggttgtctgcctcatatccatcatgctgtttgcaatattcttgctttcaatcaatttatactgagtgtaactttaggatttctgctattaaatgcatgctctctatcctgcttcagtttctggctttgctttgtctgtttcaaaatatgtagcttcctcttttgtacaacaaaaaactcattctcacttttactaaatatactgtaggagtcatcattgatgttatttttctcttatgtatctgtaaagatttttggcatatgaatgtaatattaaagtcaatgatgctataacttgcgatgtttgcatcatgtcaacctttttgaaggagtgaaaaagccctactatgtttttaaatagcaagtgtaagctcagtgctagagtggatatacacaccgcatgttttcatatgtggcacttttatgtatcatgttgggttattgttctagactggactgttaaatactatgtttgaggctgggttgtcatttttataactgtcttggtgttttatggccattatttattacttttgatacacagaatgagctgcatgcatttatagagcaataagaggatgtatttaatgtgccttgtttttaactgaataagaactggaagcatgaatcaataaaactgattaaaatggtctatttgctagcattttgatgttacttgcagtcagataactttgattactgttgaagtttaaaaaaagtttgaaaatatttttacaaactgtgtttttgatgacacaaaagtgaaatatctacagagatagatgtaattttataagactgccagaattatttgtattaatttgttgctgtagcctttagggcatgacttctgtatttgtgcaatcctattctacaattacattcatcctattacaactca

SEQ ID NO: 342247 - DNA, 5840 bp, Homo sapiens
  misc_feature (1)..(3): n is a, c, g, or t
nnnagtcacaacactcatatcctagggaccaccacactgctatgagtcaggcatgtgcgttgtttaaggctaagaaatggcatttcaaaaggcagtgaaagggacgattcttgttggaggaggtgctcttgcaactgttttaggactttctcagtttgctcattacagaaggaaacaaatgaacctggcctatgttaaagcagcagactgcatttcagaaccagttaacagggagcctccttccagagaagctcagctactgactttgcaaaacacatctgaatttgatatccttgttattggaggaggagcaacaggaagtggctgtgcgctagatgctgtcaccagagggtcagcggaatcgacttaagaaactgtaaaactttaagaagagaactacgcctgtgagatttactagactgattttgaaaaagactactgataagactaaaaacagcccttgtagaaagagatgatttctcatcagggaccagcagcagaagcactaaattgatccatggtggtgtgagatatctgcagaaggccatcatgaagttggatattgagcagtataggatggtaaaagaagcccttcatgagcgtgccaacctgctagaaattgctccccatttatcagctccattgcctataatgcttccagtttacaagtggtggcagttaccttactactgggtaggaatcaagctgtatgatttggttgcaggaagcaattgcctaaaaagcagttatgtcctcagcaaatcaagagcccttgaacatttcccaatgctccagaaggacaaactggtaggagcaattgtctactatgacggacaacataacgatgcacggatgaaccttgccattgctctgactgctgccaggtatggggctgccacagccaattacatggaggtagtgagcttgctcaagaagacagacccccagacagggaaagtgcatgtgagcggcgcacggtgcaaggatgtcctcacagggcaggaatttgacgtgagagccaaatgtgttatcaatgccacgggacctttcacggactctgtgcgcaaaatggatgataaagacgcagcagctatctgccagccaagtgctggtgtccatattgtgatgcctggttattacagcccagagagcatgggacttcttgacccagcgaccagtgatgggcgagttattttcttcttaccctggcaaaagatgacgatcgctggcactactgatactccaactgatgttacacaccatccaattccttcagaagaagatatcaacttcattttgaatgaagtgcgtaattacctgagttgtgatgttgaagtgagaagaggggatgtcctggcagcatggagtggaatccgtcctcttgttacagaccccaaatctgcagatactcagtctatctcccgaaatcatgttgttgatatcagtgagagtggccttattactatagcaggtggaaagtggacaacttatcggtctatggcagaagataccataaatgctgctgtcaaaactcataatttaaaagcaggaccaagtagaacagttgggcttttccttcaagggggtaaagattggagccccacactctacattaggcttgtgcaggattatggacttgaaagcgaggtggcacagcatcttgccgccacctatggtgataaggcctttgaggtggccaaaatggcaagtgtgactggcaaaaggtggcctattgttggagtacgtcttgtgtcagaatttccatatattgaagcagaggtgaaatatgggattaaggagtatgcctgcactgctgtggatatgatttcacgtcgtactcgcctggcctttctaaatgtccaggcagcagaggaagccctacccaggattgttgaactgatgggcagggaactgaattgggatgattataagaagcaggaacaacttgaaacagccaggaagtttctatattatgaaatgggctataaatctcgatcagaacagttaacagatcgctctgaaattagcctactgccttcagacattgacaggtataagaagagatttcataagtttgatgcagaccagaaaggctttattaccattgttgatgttcagcgtgtattagagagtatcaatgtccaaatggatgaaaatacactccatgaaattctaaatgaagttgatttgaataaaaatggacaggttgaactcaatgaatttttgcagctgatgagtgctattcaaaaaggaagggtatctggaagccggcttgctatactaatgaaaactgcagaagagaacctcgacagaagagttccaattccagtggaccgtagttgtggaggattgtgagtctgggcagtaaatccacagccaacaaacatagaaacgacaaatcaccatgtaacaaccagagatgactgaaaccactctgaaataatgaatgtggatagctgccttttttaacactagaaaacattccaaaactttaaggtgttggtgtatttgccagctttatttgctgtactttatttgtatttgccattcagtctagcttttaagtatatttttttctttttctcattttcaatgcacattagttttgcatctgttttgtgacctgttagatgtgacacattctctttttgtttattcccttattctaaatgagttctaaaaacataatattttggcaaaaattgaaaaaagctggagacattttgtgacatgcatacagatagcatgtgttattaaaaagagttgcctattgaaatgatcgtgtttctggagaaattaagcttatagacagcatgtgttattaaaaagagttacctattgaaatgatagtgtttctggagatttctcagccccatcttcctccagcttgtctaccttcctcatgcaaacaatattccacatttttatatctagagcatgactggctaactggagagggaaggaaaagtttagatctggttactggagcaagtctcaaagagaaactctgaaagcttccagaatcacaggtataagataaggatagcattgacatttgctgggagttacagtgatagtttcatctcagcagttcatttttttcttcagtcactgctggttttctttgactattatagttgccaggaagatccttgctcttcttactttaaaaccagcatttaagtggcaatttggatgtaataggatgagaccaaatttatctaattattacagtagtaatacatttaagagttaaaaatgtgtttttatatatccacatatgataacaaaagattcaattcccaagcctaaattttgaagcatgtggtattgtcaaatctagcttaccatcttttttgggggtacttgcaaccatagtaaaggaagatggaatagactttagttaactttaattataattatatgttaaataaggcacataaccagtttccaaggtcatcatggttgcttaaagtctttccccttctgtactccatggaaatattctcagtaaaccaaaaacaaaaatggaaaaataatcaccaacccccatcccgacacacacacacagtccaaagcaaaagtcagtgtgtattgaatttaacaagtaatgcagtttgggatgcttttgctacattttggtggcattttaactagttatctgaatatttattaatcgtacttcctcttgtaaagttaactacttacttttttgttgttgtttttttaacatcaggttctgtatctaataggagatgtaacactttatttcatggcaggtttttattgcagagacttgaagtcttagttttttaaactggcacataaaacactttttgctgttatttttatttatgtcaatactgcagagtatctttatgccttattcaagtggattctgagcctgtatgtcacaatgtaaacactggaggttcactcacctacgcactcacccaccacctctgaaagaaacagaaactgcagagaaagacagcatcttagctcattttgtttttaaatgaggttttagacgcttgccacttcctaagggaaatcctaaaacagagcaagtgatgctcccaggtatcactgtgaacttttttctttcaaagtgtgaatttttacactggctttttcatttttttaaagtaattgaagcttgtggctttacaacttagtgttttttgctatccagataacaagtttcattgtttagaacccagtgacacttaataggtagataaattgtcctttaaaatatcccagatgatatacacaatatggtacatttgtgctctctctctctgtttttctctctttctctttctagttagatcaagataacgatgacttgtaccctccctgattctgttacagtagggcccgggcagatctgtgtttgttaaacaggccttgtttgtgcatgctttgctatgaatgaagttcctttaaggacaaagaaaagcacacttttcttcttttgagcatatctgcttttactttaaatctgctaatttctaaaatgtagagtccttcaccaatcccagagactcaatttggaaatgaactgatttcaagccgttactgtgaataaagcaccccagcattttgtataagctcttaattaaacctgtacagcttctttacctgatttaagaaagggagacaagcaataggggggaataagcttcttcaaaattcattccaagcacaaaagaaattttttccctttgcatataaacttgacatcagttgattctgttggggtcggggtgggtatgcagggattgccttttattatcaagtgatttatttcaagagcctttgaggggattcaggtgaaggaacccccatctgtgctggagagttggatactcctttaaatagcccccaccacagtcataacaataatgataatgctggattatttgttaagccaaggttgtctgcctcatatccatcatgctgtttgcaatattcttgctttcaatcaatttatactgagtgtaactttaggatttctgctattaaatgcatgctctctatcctgcttcagtttctggctttgctttgtctgtttcaaaatatgtagcttcctcttttgtacaacaaaaaactcattctcacttttactaaatatactgtaggagtcatcattgatgttatttttctcttatgtatctgtaaagatttttggcatatgaatgtaatattaaagtcaatgatgctataacttgcgatgtttgcatcatgtcaacctttttgaaggagtgaaaaagccctactatgtttttaaatagcaagtgtaagctcagtgctagagtggatatacacaccgcatgttttcatatgtggcacttttatgtatcatgttgggttattgttctagactggactgttaaatactatgtttgaggctgggttgtcatttttataactgtcttggtgttttatggccattatttattacttttgatacacagaatgagctgcatgcatttatagagcaataagaggatgtatttaatgtgccttgtttttaactgaataagaactggaagcatgaatcaataaaactgattaaaatggtctatttgctagcattttgatgttacttgcagtcagataactttgattactgttgaagtttaaaaaaagtttgaaaatatttttacaaactgtgtttttgatgacacaaaagtgaaatatctacagagatagatgtaattttataagactgccagaattatttgtattaatttgttgctgtagcctttagggcatgacttctgtatttgtgcaatcctattctacaattacattcatcctattacaactca

SEQ ID NO: 342248 - DNA, 6125 bp, Homo sapiens
ttttttttttttgggtggcggggggttgcaagtgggaagcctgctgttcagctgccggggctctccgcctccccccacctgtatgaggctgggtctggggaacctgtgctcagcattccaccccctggagcttgggcttggtcttccctgcgggtccctgcgctgacattcaggcggggagccaggaggcctggcgcgcctccagagcccgccgggggagccgggcgagggttctgggctctgacggcggggtcgcagggtcgcccgcctcctggacacgtctgtaggcctagggaagcctgccggccgggaggtacagagtaggagaagccagatcccagggcggacaacgagaagtcgtcaggctaagaaatggcatttcaaaaggcagtgaaagggacgattcttgttggaggaggtgctcttgcaactgttttaggactttctcagtttgctcattacagaaggaaacaaatgaacctggcctatgttaaagcagcagactgcatttcagaaccagttaacagggagcctccttccagagaagctcagctactgactttgcaaaacacatctgaatttgatatccttgttattggaggaggagcaacaggaagtggctgtgcgctagatgctgtcaccagaggactaaaaacagcccttgtagaaagagatgatttctcatcagggaccagcagcagaagcactaaattgatccatggtggtgtgagatatctgcagaaggccatcatgaagttggatattgagcagtataggatggtaaaagaagcccttcatgagcgtgccaacctgctagaaattgctccccatttatcagctccattgcctataatgcttccagtttacaagtggtggcagttaccttactactgggtaggaatcaagctgtatgatttggttgcaggaagcaattgcctaaaaagcagttatgtcctcagcaaatcaagagcccttgaacatttcccaatgctccagaaggacaaactggtaggagcaattgtctactatgacggacaacataacgatgcacggatgaaccttgccattgctctgactgctgccaggtatggggctgccacagccaattacatggaggtagtgagcttgctcaagaagacagacccccagacagggaaagtgcatgtgagcggcgcacggtgcaaggatgtcctcacagggcaggaatttgacgtgagagccaaatgtgttatcaatgccacgggacctttcacggactctgtgcgcaaaatggatgataaagacgcagcagctatctgccagccaagtgctggtgtccatattgtgatgcctggttattacagcccagagagcatgggacttcttgacccagcgaccagtgatgggcgagttattttcttcttaccctggcaaaagatgacgatcgctggcactactgatactccaactgatgttacacaccatccaattccttcagaagaagatatcaacttcattttgaatgaagtgcgtaattacctgagttgtgatgttgaagtgagaagaggggatgtcctggcagcatggagtggaatccgtcctcttgttacagaccccaaatctgcagatactcagtctatctcccgaaatcatgttgttgatatcagtgagagtggccttattactatagcaggtggaaagtggacaacttatcggtctatggcagaagataccataaatgctgctgtcaaaactcataatttaaaagcaggaccaagtagaacagttgggcttttccttcaagggggtaaagattggagccccacactctacattaggcttgtgcaggattatggacttgaaagcgaggtggcacagcatcttgccgccacctatggtgataaggcctttgaggtggccaaaatggcaagtgtgactggcaaaaggtggcctattgttggagtacgtcttgtgtcagaatttccatatattgaagcagaggtgaaatatgggattaaggagtatgcctgcactgctgtggatatgatttcacgtcgtactcgcctggcctttctaaatgtccaggcagcagaggaagccctacccaggattgttgaactgatgggcagggaactgaattgggatgattataagaagcaggaacaacttgaaacagccaggaagtttctatattatgaaatgggctataaatctcgatcagaacagttaacagatcgctctgaaattagcctactgccttcagacattgacaggtacttataataagtgtctatctatctctctttttttttggcctatgtaagtatatttttccattatttaatcttgtgttccaggtataagaagagatttcataagtttgatgcagaccagaaaggctttattaccattgttgatgttcagcgtgtattagagagtatcaatgtccaaatggatgaaaatacactccatgaaattctaaatgaagttgatttgaataaaaatggacaggttgaactcaatgaatttttgcagctgatgagtgctattcaaaaaggaagggtatctggaagccggcttgctatactaatgaaaactgcagaagagaacctcgacagaagagttccaattccagtggaccgtagttgtggaggattgtgagtctgggcagtaaatccacagccaacaaacatagaaacgacaaatcaccatgtaacaaccagagatgactgaaaccactctgaaataatgaatgtggatagctgccttttttaacactagaaaacattccaaaactttaaggtgttggtgtatttgccagctttatttgctgtactttatttgtatttgccattcagtctagcttttaagtatatttttttctttttctcattttcaatgcacattagttttgcatctgttttgtgacctgttagatgtgacacattctctttttgtttattcccttattctaaatgagttctaaaaacataatattttggcaaaaattgaaaaaagctggagacattttgtgacatgcatacagatagcatgtgttattaaaaagagttgcctattgaaatgatcgtgtttctggagaaattaagcttatagacagcatgtgttattaaaaagagttacctattgaaatgatagtgtttctggagatttctcagccccatcttcctccagcttgtctaccttcctcatgcaaacaatattccacatttttatatctagagcatgactggctaactggagagggaaggaaaagtttagatctggttactggagcaagtctcaaagagaaactctgaaagcttccagaatcacaggtataagataaggatagcattgacatttgctgggagttacagtgatagtttcatctcagcagttcatttttttcttcagtcactgctggttttctttgactattatagttgccaggaagatccttgctcttcttactttaaaaccagcatttaagtggcaatttggatgtaataggatgagaccaaatttatctaattattacagtagtaatacatttaagagttaaaaatgtgtttttatatatccacatatgataacaaaagattcaattcccaagcctaaattttgaagcatgtggtattgtcaaatctagcttaccatcttttttgggggtacttgcaaccatagtaaaggaagatggaatagactttagttaactttaattataattatatgttaaataaggcacataaccagtttccaaggtcatcatggttgcttaaagtctttccccttctgtactccatggaaatattctcagtaaaccaaaaacaaaaatggaaaaataatcaccaacccccatcccgacacacacacacagtccaaagcaaaagtcagtgtgtattgaatttaacaagtaatgcagtttgggatgcttttgctacattttggtggcattttaactagttatctgaatatttattaatcgtacttcctcttgtaaagttaactacttacttttttgttgttgtttttttaacatcaggttctgtatctaataggagatgtaacactttatttcatggcaggtttttattgcagagacttgaagtcttagttttttaaactggcacataaaacactttttgctgttatttttatttatgtcaatactgcagagtatctttatgccttattcaagtggattctgagcctgtatgtcacaatgtaaacactggaggttcactcacctacgcactcacccaccacctctgaaagaaacagaaactgcagagaaagacagcatcttagctcattttgtttttaaatgaggttttagacgcttgccacttcctaagggaaatcctaaaacagagcaagtgatgctcccaggtatcactgtgaacttttttctttcaaagtgtgaatttttacactggctttttcatttttttaaagtaattgaagcttgtggctttacaacttagtgttttttgctatccagataacaagtttcattgtttagaacccagtgacacttaataggtagataaattgtcctttaaaatatcccagatgatatacacaatatggtacatttgtgctctctctctctgtttttctctctttctctttctagttagatcaagataacgatgacttgtaccctccctgattctgttacagtagggcccgggcagatctgtgtttgttaaacaggccttgtttgtgcatgctttgctatgaatgaagttcctttaaggacaaagaaaagcacacttttcttcttttgagcatatctgcttttactttaaatctgctaatttctaaaatgtagagtccttcaccaatcccagagactcaatttggaaatgaactgatttcaagccgttactgtgaataaagcaccccagcattttgtataagctcttaattaaacctgtacagcttctttacctgatttaagaaagggagacaagcaataggggggaataagcttcttcaaaattcattccaagcacaaaagaaattttttccctttgcatataaacttgacatcagttgattctgttggggtcggggtgggtatgcagggattgccttttattatcaagtgatttatttcaagagcctttgaggggattcaggtgaaggaacccccatctgtgctggagagttggatactcctttaaatagcccccaccacagtcataacaataatgataatgctggattatttgttaagccaaggttgtctgcctcatatccatcatgctgtttgcaatattcttgctttcaatcaatttatactgagtgtaactttaggatttctgctattaaatgcatgctctctatcctgcttcagtttctggctttgctttgtctgtttcaaaatatgtagcttcctcttttgtacaacaaaaaactcattctcacttttactaaatatactgtaggagtcatcattgatgttatttttctcttatgtatctgtaaagatttttggcatatgaatgtaatattaaagtcaatgatgctataacttgcgatgtttgcatcatgtcaacctttttgaaggagtgaaaaagccctactatgtttttaaatagcaagtgtaagctcagtgctagagtggatatacacaccgcatgttttcatatgtggcacttttatgtatcatgttgggttattgttctagactggactgttaaatactatgtttgaggctgggttgtcatttttataactgtcttggtgttttatggccattatttattacttttgatacacagaatgagctgcatgcatttatagagcaataagaggatgtatttaatgtgccttgtttttaactgaataagaactggaagcatgaatcaataaaactgattaaaatggtctatttgctagcattttgatgttacttgcagtcagataactttgattactgttgaagtttaaaaaaagtttgaaaatatttttacaaactgtgtttttgatgacacaaaagtgaaatatctacagagatagatgtaattttataagactgccagaattatttgtattaatttgttgctgtagcctttagggcatgacttctgtatttgtgcaatcctattctacaattacattcatcctattacaactca

SEQ ID NO: 342249 - DNA, 5988 bp, Homo sapiens
ttttttttttttgggtggcggggggttgcaagtgggaagcctgctgttcagctgccggggctctccgcctccccccacctgtatgaggctgggtctggggaacctgtgctcagcattccaccccctggagcttgggcttggtcttccctgcgggtccctgcgctgacattcaggcggggagccaggaggcctggcgcgcctccagagcccgccgggggagccgggcgagggttctgggctctgacggcggggtcgcagggtcgcccgcctcctggacacgtctgtaggcctagggaagcctgccggccgggaggtacagagtaggagaagccagatcccagggcggacaacgagaagtcgtcaggctaagaaatggcatttcaaaaggcagtgaaagggacgattcttgttggaggaggtgctcttgcaactgttttaggactttctcagtttgctcattacagaaggaaacaaatgaacctggcctatgttaaagcagcagactgcatttcagaaccagttaacagggagcctccttccagagaagctcagctactgactttgcaaaacacatctgaatttgatatccttgttattggaggaggagcaacaggaagtggctgtgcgctagatgctgtcaccagaggactaaaaacagcccttgtagaaagagatgatttctcatcagggaccagcagcagaagcactaaattgatccatggtggtgtgagatatctgcagaaggccatcatgaagttggatattgagcagtataggatggtaaaagaagcccttcatgagcgtgccaacctgctagaaattgctccccatttatcagctccattgcctataatgcttccagtttacaagtggtggcagttaccttactactgggtaggaatcaagctgtatgatttggttgcaggaagcaattgcctaaaaagcagttatgtcctcagcaaatcaagagcccttgaacatttcccaatgctccagaaggacaaactggtaggagcaattgtctactatgacggacaacataacgatgcacggatgaaccttgccattgctctgactgctgccaggtatggggctgccacagccaattacatggaggtagtgagcttgctcaagaagacagacccccagacagggaaagtgcatgtgagcggcgcacggtgcaaggatgtcctcacagggcaggaatttgacgtgagagccaaatgtgttatcaatgccacgggacctttcacggactctgtgcgcaaaatggatgataaagacgcagcagctatctgccagccaagtgctggtgtccatattgtgatgcctggttattacagcccagagagcatgggacttcttgacccagcgaccagtgatgggcgagttattttcttcttaccctggcaaaagatgacgatcgctggcactactgatactccaactgatgttacacaccatccaattccttcagaagaagatatcaacttcattttgaatgaagtgcgtaattacctgagttgtgatgttgaagtgagaagaggggatgtcctggcagcatggagtggaatccgtcctcttgttacagaccccaaatctgcagatactcagtctatctcccgaaatcatgttgttgatatcagtgagagtggccttattactatagcaggtggaaagtggacaacttatcggtctatggcagaagataccataaatgctgctgtcaaaactcataatttaaaagcaggaccaagtagaacagttgggcttttccttcaagggggtaaagattggagccccacactctacattaggcttgtgcaggattatggacttgaaagcgaggtggcacagcatcttgccgccacctatggtgataaggcctttgaggtggccaaaatggcaagtgtgactggcaaaaggtggcctattgttggagtacgtcttgtgtcagaatttccatatattgaagcagaggtgaaatatgggattaaggagtatgcctgcactgctgtggatatgatttcacgtcgtactcgcctggcctttctaaatgtccaggcagcagaggaagccctacccaggattgttgaactgatgggcagggaactgaattgggatgattataagaagcaggaacaacttgaaacagccaggaagtttctatattatgaaatgggctataaatctcgatcagaacagttaacagatcgctctgaaattagcctactgccttcagacattgacaggtataagaagagatttcataagtttgatgcagaccagaaaggctttattaccattgttgatgttcagcgtgtattagagagtatcaatgtccaaatggatgaaaatacactccatgaaattctaaatgaagttgatttgaataaaaatggacaggttgaactcaatgaatttttgcagctgatgagtgctattcaaaaaggaagggtatctggaagccggcttgctatactaatgttgtggaggattgtgagtctgggcagtaaatccacagccaacaaacatagaaacgacaaatcaccatgtaacaaccagagatgactgaaaccactctgaaataatgaatgtggatagctgccttttttaacactagaaaacattccaaaactttaaggtgttggtgtatttgccagctttatttgctgtactttatttgtatttgccattcagtctagcttttaagtatatttttttctttttctcattttcaatgcacattagttttgcatctgttttgtgacctgttagatgtgacacattctctttttgtttattcccttattctaaatgagttctaaaaacataatattttggcaaaaattgaaaaaagctggagacattttgtgacatgcatacagatagcatgtgttattaaaaagagttgcctattgaaatgatcgtgtttctggagaaattaagcttatagacagcatgtgttattaaaaagagttacctattgaaatgatagtgtttctggagatttctcagccccatcttcctccagcttgtctaccttcctcatgcaaacaatattccacatttttatatctagagcatgactggctaactggagagggaaggaaaagtttagatctggttactggagcaagtctcaaagagaaactctgaaagcttccagaatcacaggtataagataaggatagcattgacatttgctgggagttacagtgatagtttcatctcagcagttcatttttttcttcagtcactgctggttttctttgactattatagttgccaggaagatccttgctcttcttactttaaaaccagcatttaagtggcaatttggatgtaataggatgagaccaaatttatctaattattacagtagtaatacatttaagagttaaaaatgtgtttttatatatccacatatgataacaaaagattcaattcccaagcctaaattttgaagcatgtggtattgtcaaatctagcttaccatcttttttgggggtacttgcaaccatagtaaaggaagatggaatagactttagttaactttaattataattatatgttaaataaggcacataaccagtttccaaggtcatcatggttgcttaaagtctttccccttctgtactccatggaaatattctcagtaaaccaaaaacaaaaatggaaaaataatcaccaacccccatcccgacacacacacacagtccaaagcaaaagtcagtgtgtattgaatttaacaagtaatgcagtttgggatgcttttgctacattttggtggcattttaactagttatctgaatatttattaatcgtacttcctcttgtaaagttaactacttacttttttgttgttgtttttttaacatcaggttctgtatctaataggagatgtaacactttatttcatggcaggtttttattgcagagacttgaagtcttagttttttaaactggcacataaaacactttttgctgttatttttatttatgtcaatactgcagagtatctttatgccttattcaagtggattctgagcctgtatgtcacaatgtaaacactggaggttcactcacctacgcactcacccaccacctctgaaagaaacagaaactgcagagaaagacagcatcttagctcattttgtttttaaatgaggttttagacgcttgccacttcctaagggaaatcctaaaacagagcaagtgatgctcccaggtatcactgtgaacttttttctttcaaagtgtgaatttttacactggctttttcatttttttaaagtaattgaagcttgtggctttacaacttagtgttttttgctatccagataacaagtttcattgtttagaacccagtgacacttaataggtagataaattgtcctttaaaatatcccagatgatatacacaatatggtacatttgtgctctctctctctgtttttctctctttctctttctagttagatcaagataacgatgacttgtaccctccctgattctgttacagtagggcccgggcagatctgtgtttgttaaacaggccttgtttgtgcatgctttgctatgaatgaagttcctttaaggacaaagaaaagcacacttttcttcttttgagcatatctgcttttactttaaatctgctaatttctaaaatgtagagtccttcaccaatcccagagactcaatttggaaatgaactgatttcaagccgttactgtgaataaagcaccccagcattttgtataagctcttaattaaacctgtacagcttctttacctgatttaagaaagggagacaagcaataggggggaataagcttcttcaaaattcattccaagcacaaaagaaattttttccctttgcatataaacttgacatcagttgattctgttggggtcggggtgggtatgcagggattgccttttattatcaagtgatttatttcaagagcctttgaggggattcaggtgaaggaacccccatctgtgctggagagttggatactcctttaaatagcccccaccacagtcataacaataatgataatgctggattatttgttaagccaaggttgtctgcctcatatccatcatgctgtttgcaatattcttgctttcaatcaatttatactgagtgtaactttaggatttctgctattaaatgcatgctctctatcctgcttcagtttctggctttgctttgtctgtttcaaaatatgtagcttcctcttttgtacaacaaaaaactcattctcacttttactaaatatactgtaggagtcatcattgatgttatttttctcttatgtatctgtaaagatttttggcatatgaatgtaatattaaagtcaatgatgctataacttgcgatgtttgcatcatgtcaacctttttgaaggagtgaaaaagccctactatgtttttaaatagcaagtgtaagctcagtgctagagtggatatacacaccgcatgttttcatatgtggcacttttatgtatcatgttgggttattgttctagactggactgttaaatactatgtttgaggctgggttgtcatttttataactgtcttggtgttttatggccattatttattacttttgatacacagaatgagctgcatgcatttatagagcaataagaggatgtatttaatgtgccttgtttttaactgaataagaactggaagcatgaatcaataaaactgattaaaatggtctatttgctagcattttgatgttacttgcagtcagataactttgattactgttgaagtttaaaaaaagtttgaaaatatttttacaaactgtgtttttgatgacacaaaagtgaaatatctacagagatagatgtaattttataagactgccagaattatttgtattaatttgttgctgtagcctttagggcatgacttctgtatttgtgcaatcctattctacaattacattcatcctattacaactca

SEQ ID NO: 342250 - DNA, 2371 bp, Homo sapiens
ttttttttttttgggtggcggggggttgcaagtgggaagcctgctgttcagctgccggggctctccgcctccccccacctgtatgaggctgggtctggggaacctgtgctcagcattccaccccctggagcttgggcttggtcttccctgcgggtccctgcgctgacattcaggcggggagccaggaggcctggcgcgcctccagagcccgccgggggagccgggcgagggttctgggctctgacggcggggtcgcagggtcgcccgcctcctggacacgtctgtaggcctagggaagcctgccggccgggaggtacagagtaggagaagccagatcccagggcggacaacgagaagtcgtcaggctaagaaatggcatttcaaaaggcagtgaaagggacgattcttgttggaggaggtgctcttgcaactgttttaggactttctcagtttgctcattacagaaggaaacaaatgaacctggcctatgttaaagcagcagactgcatttcagaaccagttaacagggagcctccttccagagaagctcagctactgactttgcaaaacacatctgaatttgatatccttgttattggaggaggagcaacaggaagtggctgtgcgctagatgctgtcaccagaggactaaaaacagcccttgtagaaagagatgatttctcatcagggaccagcagcagaagcactaaattgatccatggtggtgtgagatatctgcagaaggccatcatgaagttggatattgagcagtataggatggtaaaagaagcccttcatgagcgtgccaacctgctagaaattgctccccatttatcagctccattgcctataatgcttccagtttacaagtggtggcagttaccttactactgggtaggaatcaagctgtatgatttggttgcaggaagcaattgcctaaaaagcagttatgtcctcagcaaatcaagagcccttgaacatttcccaatgctccagaaggacaaactggtaggagcaattgtctactatgacggacaacataacgatgcacggatgaaccttgccattgctctgactgctgccaggtatggggctgccacagccaattacatggaggtagtgagcttgctcaagaagacagacccccagacagggaaagtgcatgtgagcggcgcacggtgcaaggatgtcctcacagggcaggaatttgacgtgagagccaaatgtgttatcaatgccacgggacctttcacggactctgtgcgcaaaatggatgataaagacgcagcagctatctgccagccaagtgctggtgtccatattgtgatgcctggttattacagcccagagagcatgggacttcttgacccagcgaccagtgatgggcgagttattttcttcttaccctggcaaaagatgacgatcgctggcactactgatactccaactgatgttacacaccatccaattccttcagaagaagatatcaacttcattttgaatgaagtgcgtaattacctgagttgtgatgttgaagtgagaagaggggatgtcctggcagcatggagtggaatccgtcctcttgttacagaccccaaatctgcagatactcagtctatctcccgaaatcatgttgttgatatcagtgagagtggccttattactatagcaggtggaaagtggacaacttatcggtctatggcagaagataccataaatgctgctgtcaaaactcataatttaaaagcaggaccaagtagaacagttgggcttttccttcaagggggtaaagattggagccccacactctacattaggcttgtgcaggattatggacttgaaagcgaggtggcacagcatcttgccgccacctatggtgataaggcctttgaggtggccaaaatggcaagtgtgactggcaaaaggtggcctattgttggagtacgtcttgtgtcagaatttccatatattgaagcagaggtgaaatatgggattaaggagtatgcctgcactgctgtggatatgatttcacgtcgtactcgcctggcctttctaaatgtccaggcagcagaggaagccctacccaggattgttgaactgatgggcagggaactgaattgggatgattataagaagcaggaacaacttgaaacagccaggaagtttctatattatgaaatgggctataaatctcgatcagaacagttaacagatcgctctgaaattagcctactgccttcagacattgacaggtataagaagagatttcataagtttgatgcagaccagaaaggctttattaccattgttgatgttcagcgtgtattagaggtaattttctttggttgatgtcagcctctgatactagaag

SEQ ID NO: 342251 - DNA, 492 bp, Homo sapiens
ggtcagcggaatcgacttaagaaactgtaaaactttaagaagagaactacgcctgtgagatttactagactgattttgaaaaagactactgataagggaagtagagacctatcagatactaaagtgtattctaaaactactgtaattaaaataatctggtaaaggaacagagaatcagtcatggagtctataaattagtctatcagtctttaaatacatgaagtttagaatatggtaaaggcagcatttcaaaactgtcatcattagttacttaataaatgatgttggggtatccactccccccgatttatatatatgcatgtgtgtgtgtgtgtgtgtgtctgtgtatgtatgcatgcatatatattctgttttatcatattccatgtgaatcaaggatgtaactttaaaacatcataaaactattagaagcaggtatatgtaaattttttttaaaaattgggtaggaaaggtgtttttaagtatgacagc

SEQ ID NO: 342252 - DNA, 5792 bp, Homo sapiens
gcggggctggcacccgggccgaggctctgattctggggggaggccgactccaccctggctggaggaactgggtgctcctgcccgctggcccctcgcgcgtgaggatctatctcaggctaagaaatggcatttcaaaaggcagtgaaagggacgattcttgttggaggaggtgctcttgcaactgttttaggactttctcagtttgctcattacagaaggaaacaaatgaacctggcctatgttaaagcagcagactgcatttcagaaccagttaacagggagcctccttccagagaagctcagctactgactttgcaaaacacatctgaatttgatatccttgttattggaggaggagcaacaggaagtggctgtgcgctagatgctgtcaccagaggactaaaaacagcccttgtagaaagagatgatttctcatcagggaccagcagcagaagcactaaattgatccatggtggtgtgagatatctgcagaaggccatcatgaagttggatattgagcagtataggatggtaaaagaagcccttcatgagcgtgccaacctgctagaaattgctccccatttatcagctccattgcctataatgcttccagtttacaagtggtggcagttaccttactactgggtaggaatcaagctgtatgatttggttgcaggaagcaattgcctaaaaagcagttatgtcctcagcaaatcaagagcccttgaacatttcccaatgctccagaaggacaaactggtaggagcaattgtctactatgacggacaacataacgatgcacggatgaaccttgccattgctctgactgctgccaggtatggggctgccacagccaattacatggaggtagtgagcttgctcaagaagacagacccccagacagggaaagtgcatgtgagcggcgcacggtgcaaggatgtcctcacagggcaggaatttgacgtgagagccaaatgtgttatcaatgccacgggacctttcacggactctgtgcgcaaaatggatgataaagacgcagcagctatctgccagccaagtgctggtgtccatattgtgatgcctggttattacagcccagagagcatgggacttcttgacccagcgaccagtgatgggcgagttattttcttcttaccctggcaaaagatgacgatcgctggcactactgatactccaactgatgttacacaccatccaattccttcagaagaagatatcaacttcattttgaatgaagtgcgtaattacctgagttgtgatgttgaagtgagaagaggggatgtcctggcagcatggagtggaatccgtcctcttgttacagaccccaaatctgcagatactcagtctatctcccgaaatcatgttgttgatatcagtgagagtggccttattactatagcaggtggaaagtggacaacttatcggtctatggcagaagataccataaatgctgctgtcaaaactcataatttaaaagcaggaccaagtagaacagttgggcttttccttcaagggggtaaagattggagccccacactctacattaggcttgtgcaggattatggacttgaaagcgaggtggcacagcatcttgccgccacctatggtgataaggcctttgaggtggccaaaatggcaagtgtgactggcaaaaggtggcctattgttggagtacgtcttgtgtcagaatttccatatattgaagcagaggtgaaatatgggattaaggagtatgcctgcactgctgtggatatgatttcacgtcgtactcgcctggcctttctaaatgtccaggcagcagaggaagccctacccaggattgttgaactgatgggcagggaactgaattgggatgattataagaagcaggaacaacttgaaacagccaggaagtttctatattatgaaatgggctataaatctcgatcagaacagttaacagatcgctctgaaattagcctactgccttcagacattgacaggtataagaagagatttcataagtttgatgcagaccagaaaggctttattaccattgttgatgttcagcgtgtattagagagtatcaatgtccaaatggatgaaaatacactccatgaaattctaaatgaagttgatttgaataaaaatggacaggttgaactcaatgaatttttgcagctgatgagtgctattcaaaaaggaagggtatctggaagccggcttgctatactaatgaaaactgcagaagagaacctcgacagaagagttccaattccagtggaccgtagttgtggaggattgtgagtctgggcagtaaatccacagccaacaaacatagaaacgacaaatcaccatgtaacaaccagagatgactgaaaccactctgaaataatgaatgtggatagctgccttttttaacactagaaaacattccaaaactttaaggtgttggtgtatttgccagctttatttgctgtactttatttgtatttgccattcagtctagcttttaagtatatttttttctttttctcattttcaatgcacattagttttgcatctgttttgtgacctgttagatgtgacacattctctttttgtttattcccttattctaaatgagttctaaaaacataatattttggcaaaaattgaaaaaagctggagacattttgtgacatgcatacagatagcatgtgttattaaaaagagttgcctattgaaatgatcgtgtttctggagaaattaagcttatagacagcatgtgttattaaaaagagttacctattgaaatgatagtgtttctggagatttctcagccccatcttcctccagcttgtctaccttcctcatgcaaacaatattccacatttttatatctagagcatgactggctaactggagagggaaggaaaagtttagatctggttactggagcaagtctcaaagagaaactctgaaagcttccagaatcacaggtataagataaggatagcattgacatttgctgggagttacagtgatagtttcatctcagcagttcatttttttcttcagtcactgctggttttctttgactattatagttgccaggaagatccttgctcttcttactttaaaaccagcatttaagtggcaatttggatgtaataggatgagaccaaatttatctaattattacagtagtaatacatttaagagttaaaaatgtgtttttatatatccacatatgataacaaaagattcaattcccaagcctaaattttgaagcatgtggtattgtcaaatctagcttaccatcttttttgggggtacttgcaaccatagtaaaggaagatggaatagactttagttaactttaattataattatatgttaaataaggcacataaccagtttccaaggtcatcatggttgcttaaagtctttccccttctgtactccatggaaatattctcagtaaaccaaaaacaaaaatggaaaaataatcaccaacccccatcccgacacacacacacagtccaaagcaaaagtcagtgtgtattgaatttaacaagtaatgcagtttgggatgcttttgctacattttggtggcattttaactagttatctgaatatttattaatcgtacttcctcttgtaaagttaactacttacttttttgttgttgtttttttaacatcaggttctgtatctaataggagatgtaacactttatttcatggcaggtttttattgcagagacttgaagtcttagttttttaaactggcacataaaacactttttgctgttatttttatttatgtcaatactgcagagtatctttatgccttattcaagtggattctgagcctgtatgtcacaatgtaaacactggaggttcactcacctacgcactcacccaccacctctgaaagaaacagaaactgcagagaaagacagcatcttagctcattttgtttttaaatgaggttttagacgcttgccacttcctaagggaaatcctaaaacagagcaagtgatgctcccaggtatcactgtgaacttttttctttcaaagtgtgaatttttacactggctttttcatttttttaaagtaattgaagcttgtggctttacaacttagtgttttttgctatccagataacaagtttcattgtttagaacccagtgacacttaataggtagataaattgtcctttaaaatatcccagatgatatacacaatatggtacatttgtgctctctctctctgtttttctctctttctctttctagttagatcaagataacgatgacttgtaccctccctgattctgttacagtagggcccgggcagatctgtgtttgttaaacaggccttgtttgtgcatgctttgctatgaatgaagttcctttaaggacaaagaaaagcacacttttcttcttttgagcatatctgcttttactttaaatctgctaatttctaaaatgtagagtccttcaccaatcccagagactcaatttggaaatgaactgatttcaagccgttactgtgaataaagcaccccagcattttgtataagctcttaattaaacctgtacagcttctttacctgatttaagaaagggagacaagcaataggggggaataagcttcttcaaaattcattccaagcacaaaagaaattttttccctttgcatataaacttgacatcagttgattctgttggggtcggggtgggtatgcagggattgccttttattatcaagtgatttatttcaagagcctttgaggggattcaggtgaaggaacccccatctgtgctggagagttggatactcctttaaatagcccccaccacagtcataacaataatgataatgctggattatttgttaagccaaggttgtctgcctcatatccatcatgctgtttgcaatattcttgctttcaatcaatttatactgagtgtaactttaggatttctgctattaaatgcatgctctctatcctgcttcagtttctggctttgctttgtctgtttcaaaatatgtagcttcctcttttgtacaacaaaaaactcattctcacttttactaaatatactgtaggagtcatcattgatgttatttttctcttatgtatctgtaaagatttttggcatatgaatgtaatattaaagtcaatgatgctataacttgcgatgtttgcatcatgtcaacctttttgaaggagtgaaaaagccctactatgtttttaaatagcaagtgtaagctcagtgctagagtggatatacacaccgcatgttttcatatgtggcacttttatgtatcatgttgggttattgttctagactggactgttaaatactatgtttgaggctgggttgtcatttttataactgtcttggtgttttatggccattatttattacttttgatacacagaatgagctgcatgcatttatagagcaataagaggatgtatttaatgtgccttgtttttaactgaataagaactggaagcatgaatcaataaaactgattaaaatggtctatttgctagcattttgatgttacttgcagtcagataactttgattactgttgaagtttaaaaaaagtttgaaaatatttttacaaactgtgtttttgatgacacaaaagtgaaatatctacagagatagatgtaattttataagactgccagaattatttgtattaatttgttgctgtagcctttagggcatgacttctgtatttgtgcaatcctattctacaattacattcatcctattacaactca

SEQ ID NO: 342253 - DNA, 5543 bp, Homo sapiens
gcggggctggcacccgggccgaggctctgattctggggggaggccgactccaccctggctggaggaactgggtgctcctgcccgctggcccctcgcgcgtgaggatctatctcaggctaagaaatggcatttcaaaaggcagtgaaagggacgattcttgttggaggaggtgctcttgcaactgttttaggactttctcagtttgctcattacagaaggaaacaaatgaacctggcctatgttaaagcagcagactgcatttcagaaccagttaacagggagcctccttccagagaagctcagctactgactttgcaaaacacatctgaatttgatatccttgttattggaggaggagcaacaggaagtggctgtgcgctagatgctgtcaccagaggactaaaaacagcccttgtagaaagagatgatttctcatcagggaccagcagcagaagcactaaattgatccatggtggtgtgagatatctgcagaaggccatcatgaagttggatattgagcagtataggatggtaaaagaagcccttcatgagcgtgccaacctgctagaaattgctccccatttatcagctccattgcctataatgcttccagtttacaagtggtggcagttaccttactactgggtaggaatcaagctgtatgatttggttgcaggaagcaattgcctaaaaagcagttatgtcctcagcaaatcaagagcccttgaacatttcccaatgctccagaaggacaaactggtaggagcaattgtctactatgacggacaacataacgatgcacggatgaaccttgccattgctctgactgctgccaggtatggggctgccacagccaattacatggaggtagtgagcttgctcaagaagacagacccccagacagggaaagtgcatgtgagcggcgcacggtgcaaggatgtcctcacagggcaggaatttgacgtgagagccaaatgtgttatcaatgccacgggacctttcacggactctgtgcgcaaaatggatgataaagacgcagcagctatctgccagccaagtgctggtgtccatattgtgatgcctggttattacagcccagagagcatgggacttcttgacccagcgaccagtgatgggcgagttattttcttcttaccctggcaaaagatgacgatcgctggcactactgatactccaactgatgttacacaccatccaattccttcagaagaagatatcaacttcattttgaatgaagtgcgtaattacctgagttgtgatgttgaagtgagaagaggggatgtcctggcagcatggagtggaatccgtcctcttgttacagaccccaaatctgcagatactcagtctatctcccgaaatcatgttgttgatatcagtgagagtggccttattactatagcaggtggaaagtggacaacttatcggtctatggcagaagataccataaatgctgctgtcaaaactcataatttaaaagcaggaccaagtagaacagttgggcttttccttcaagggggtaaagattggagccccacactctacattaggcttgtgcaggattatggacttgaaagcgaggtggcacagcatcttgccgccacctatggtgataaggcctttgaggtggccaaaatggcaagtgtgactggcaaaaggtggcctattgttggagtacgtcttgtgtcagaatttccatatattgaagcagaggtgaaatatgggattaaggagtatgcctgcactgctgtggatatgatttcacgtcgtactcgcctggcctttctaaatgtccaggcagcagaggaagccctacccaggattgttgaactgatgggcagggaactgaattgggatgattataagaagcaggaacaacttgaaacagccaggaagtttctatattatgaaatgggctataaatctcgatcagaacagttaacagatcgctctgaaattagcctactgccttcagacattgacaggtataagaagagatttcataagtttgatgcagaccagaaaggctttattaccattgttgatgttcagcgtgtattagagagtatcaatgtccaaatggatgaaaatacactccatgaaattctaaatgaagttgatttgaataaaaatggacaggttgaactcaatgaatttttgcagctgatgagtgctattcaaaaaggaagggtatctggaagccggcttgctatactaatgaaaactgcagaagagaacctcgacagaagagttccaattccagtggaccgtagttgtggaggattgtgagtctgggcagtaaatccacagccaacaaacatagaaacgacaaatcaccatgtaacaaccagagatgactgaaaccactctgaaataatgaatgtggatagctgccttttttaacactagaaaacattccaaaactttaaggtgttggtgtatttgccagctttatttgctgtactttatttgtatttgccattcagtctagcttttaagtatatttttttctttttctcattttcaatgcacattagttttgcatctgttttgtgacctgttagatgtgacacattctctttttgtttattcccttattctaaatgagttctaaaaacataatattttggcaaaaattgaaaaaagctggagacattttgtgacatgcatacagatagcatgtgttattaaaaagagttgcctattgaaatgatcgtgtttctggagaaattaagcttatagacagcatgtgttattaaaaagagttacctattgaaatgatagtgtttctggagatttctcagccccatcttcctccagcttgtctaccttcctcatgcaaacaatattccacatttttatatctagagcatgactggctaactggagagggaaggaaaagtttagatctggttactggagcaagtctcaaagagaaactctgaaagcttccagaatcacaggtataagataaggatagcattgacatttgctgggagttacagtgatagtttcatctcagcagttcatttttttcttcagtcactgctggttttctttgactattatagttgccaggaagatccttgctcttcttactttaaaaccagcatttaagtggcaatttggatgtaataggatgagaccaaatttatctaattattacagtagtaatacatttaagagttaaaaatgtgtttttatatatccacatatgataacaaaagattcaattcccaagcctaaattttgaagcatgtggtattgtcaaatctagcttaccatcttttttgggggtacttgcaaccatagtaaaggaagatggaatagactttagttaactttaattataattatatgttaaataaggcacataaccagtttccaaggtcatcatggttgcttaaagtctttccccttctgtactccatggaaatattctcagtaaaccaaaaacaaaaatggaaaaataatcaccaacccccatcccgacacacacacacagtccaaagcaaaagtcagtgtgtattgaatttaacaagtaatgcagtttgggatgcttttgctacattttggtggcattttaactagttatctgaatatttattaatcgtacttcctcttgtaaagttaactacttacttttttgttgttgtttttttaacatcaggttctgtatctaataggagatgtaacactttatttcatggcaggtttttattgcagagacttgaagtcttagttttttaaactggcacataaaacactttttgctgttatttttatttatgtcaatactgcagagtatctttatgccttattcaagtggattctgagcctgtatgtcacaatgtaaacactggaggttcactcacctacgcactcacccaccacctctgaaagaaacagaaactgcagagaaagacagcatcttagctcattttgtttttaaatgaggttttagacgcttgccacttcctaagggaaatcctaaaacagagcaagtgatgctcccaggtatcactgtgaacttttttctttcaaagtgtgaatttttacactggctttttcatttttttaaagtaattgaagcttgtggctttacaacttagtgttttttgctatccagataacaagtttcattgtttagaacccagtgacacttaataggtagataaattgtcctttaaaatatcccagatgatatacacaatatggtacatttgtgctctctctctctgtttttctctctttctctttctagttagatcaagataacgatgacttgtaccctccctgattctgttacagtagggcccgggcagatctgtgtttgttaaacaggccttgtttgtgcatgctttgctatgaatgaagttcctttaaggacaaagaaaagcacacttttcttcttttgagcatatctgcttttactttaaatctgctaatttctaaaatgtagagtccttcaccaatcccagagactcaatttggaaatgaactgatttcaagccgttactgtgaataaagcaccccagcattttgtataagctcttaattaaacctgtacagcttctttacctgatttaagaaagggagacaagcaataggggggaataagcttcttcaaaattcattccaagcacaaaagaaattttttccctttgcatataaacttgacatcagttgattctgttggggtcggggtgggtatgcagggattgccttttattatcaagtgatttatttcaagagcctttgaggggattcaggtgaaggaacccccatctgtgctggagagttggatactcctttaaatagcccccaccacagtcataacaataatgataatgctggattatttgttaagccaaggttgtctgcctcatatccatcatgctgtttgcaatattcttgctttcaatcaatttatactgagtgtaactttaggatttctgctattaaatgcatgctctctatcctgcttcagtttctggctttgctttgtctgtttcaaaatatgtagcttcctcttttgtacaacaaaaaactcattctcacttttactaaatatactgtaggagtcatcattgatgttatttttctcttatgtatctgtaaagatttttggcatatgaatgtaatattaaagtcaatgatgctataacttgcgatgtttgcatcatgtcaacctttttgaaggagtgaaaaagccctactatgtttttaaatagcaagtgtaagctcagtgctagagtggatatacacaccgcatgttttcatatgtggcacttttatgtatcatgttgggttattgttctagactggactgttaaatactatgtttgaggctgggttgtcatttttataactgtcttggtgttttatggccattatttattacttttgatacacagaatgagctgcatgcatttatagagcaataagaggatgtatttaatgtgccttgtttttaactgaataagaactggaagcatgaatcaataaaactgattaaaatggtc

SEQ ID NO: 342254 - DNA, 5987 bp, Homo sapiens
ttttttttttttgggtggcggggggttgcaagtgggaagcctgctgttcagctgccggggctctccgcctccccccacctgtatgaggctgggtctggggaacctgtgctcagcattccaccccctggagcttgggcttggtcttccctgcgggtccctgcgctgacattcaggcggggagccaggaggcctggcgcgcctccagagcccgccgggggagccgggcgagggttctgggctctgacggcggggtcgcagggtcgcccgcctcctggacacgtctgtaggcctagggaagcctgccggccgggaggtacagagtaggagaagccagatcccagggcggacaacgagaagtcgtcaggctaagaaatggcatttcaaaaggcagtgaaagggacgattcttgttggaggaggtgctcttgcaactgttttaggactttctcagtttgctcattacagaaggaaacaaatgaacctggcctatgttaaagcagcagactgcatttcagaaccagttaacagggagcctccttccagagaagctcagctactgactttgcaaaacacatctgaatttgatatccttgttattggaggaggagcaacaggaagtggctgtgcgctagatgctgtcaccagaggactaaaaacagcccttgtagaaagagatgatttctcatcagggaccagcagcagaagcactaaattgatccatggtggtgtgagatatctgcagaaggccatcatgaagttggatattgagcagtataggatggtaaaagaagcccttcatgagcgtgccaacctgctagaaattgctccccatttatcagctccattgcctataatgcttccagtttacaagtggtggcagttaccttactactgggtaggaatcaagctgtatgatttggttgcaggaagcaattgcctaaaaagcagttatgtcctcagcaaatcaagagcccttgaacatttcccaatgctccagaaggacaaactggtaggagcaattgtctactatgacggacaacataacgatgcacggatgaaccttgccattgctctgactgctgccaggtatggggctgccacagccaattacatggaggtagtgagcttgctcaagaagacagacccccagacagggaaagtgcatgtgagcggcgcacggtgcaaggatgtcctcacagggcaggaatttgacgtgagagccaaatgtgttatcaatgccacgggacctttcacggactctgtgcgcaaaatggatgataaagacgcagcagctatctgccagccaagtgctggtgtccatattgtgatgcctggttattacagcccagagagcatgggacttcttgacccagcgaccagtgatgggcgagttattttcttcttaccctggccaattccttcagaagaagatatcaacttcattttgaatgaagtgcgtaattacctgagttgtgatgttgaagtgagaagaggggatgtcctggcagcatggagtggaatccgtcctcttgttacagaccccaaatctgcagatactcagtctatctcccgaaatcatgttgttgatatcagtgagagtggccttattactatagcaggtggaaagtggacaacttatcggtctatggcagaagataccataaatgctgctgtcaaaactcataatttaaaagcaggaccaagtagaacagttgggcttttccttcaagggggtaaagattggagccccacactctacattaggcttgtgcaggattatggacttgaaagcgaggtggcacagcatcttgccgccacctatggtgataaggcctttgaggtggccaaaatggcaagtgtgactggcaaaaggtggcctattgttggagtacgtcttgtgtcagaatttccatatattgaagcagaggtgaaatatgggattaaggagtatgcctgcactgctgtggatatgatttcacgtcgtactcgcctggcctttctaaatgtccaggcagcagaggaagccctacccaggattgttgaactgatgggcagggaactgaattgggatgattataagaagcaggaacaacttgaaacagccaggaagtttctatattatgaaatgggctataaatctcgatcagaacagttaacagatcgctctgaaattagcctactgccttcagacattgacaggtataagaagagatttcataagtttgatgcagaccagaaaggctttattaccattgttgatgttcagcgtgtattagagagtatcaatgtccaaatggatgaaaatacactccatgaaattctaaatgaagttgatttgaataaaaatggacaggttgaactcaatgaatttttgcagctgatgagtgctattcaaaaaggaagggtatctggaagccggcttgctatactaatgaaaactgcagaagagaacctcgacagaagagttccaattccagtggaccgtagttgtggaggattgtgagtctgggcagtaaatccacagccaacaaacatagaaacgacaaatcaccatgtaacaaccagagatgactgaaaccactctgaaataatgaatgtggatagctgccttttttaacactagaaaacattccaaaactttaaggtgttggtgtatttgccagctttatttgctgtactttatttgtatttgccattcagtctagcttttaagtatatttttttctttttctcattttcaatgcacattagttttgcatctgttttgtgacctgttagatgtgacacattctctttttgtttattcccttattctaaatgagttctaaaaacataatattttggcaaaaattgaaaaaagctggagacattttgtgacatgcatacagatagcatgtgttattaaaaagagttgcctattgaaatgatcgtgtttctggagaaattaagcttatagacagcatgtgttattaaaaagagttacctattgaaatgatagtgtttctggagatttctcagccccatcttcctccagcttgtctaccttcctcatgcaaacaatattccacatttttatatctagagcatgactggctaactggagagggaaggaaaagtttagatctggttactggagcaagtctcaaagagaaactctgaaagcttccagaatcacaggtataagataaggatagcattgacatttgctgggagttacagtgatagtttcatctcagcagttcatttttttcttcagtcactgctggttttctttgactattatagttgccaggaagatccttgctcttcttactttaaaaccagcatttaagtggcaatttggatgtaataggatgagaccaaatttatctaattattacagtagtaatacatttaagagttaaaaatgtgtttttatatatccacatatgataacaaaagattcaattcccaagcctaaattttgaagcatgtggtattgtcaaatctagcttaccatcttttttgggggtacttgcaaccatagtaaaggaagatggaatagactttagttaactttaattataattatatgttaaataaggcacataaccagtttccaaggtcatcatggttgcttaaagtctttccccttctgtactccatggaaatattctcagtaaaccaaaaacaaaaatggaaaaataatcaccaacccccatcccgacacacacacacagtccaaagcaaaagtcagtgtgtattgaatttaacaagtaatgcagtttgggatgcttttgctacattttggtggcattttaactagttatctgaatatttattaatcgtacttcctcttgtaaagttaactacttacttttttgttgttgtttttttaacatcaggttctgtatctaataggagatgtaacactttatttcatggcaggtttttattgcagagacttgaagtcttagttttttaaactggcacataaaacactttttgctgttatttttatttatgtcaatactgcagagtatctttatgccttattcaagtggattctgagcctgtatgtcacaatgtaaacactggaggttcactcacctacgcactcacccaccacctctgaaagaaacagaaactgcagagaaagacagcatcttagctcattttgtttttaaatgaggttttagacgcttgccacttcctaagggaaatcctaaaacagagcaagtgatgctcccaggtatcactgtgaacttttttctttcaaagtgtgaatttttacactggctttttcatttttttaaagtaattgaagcttgtggctttacaacttagtgttttttgctatccagataacaagtttcattgtttagaacccagtgacacttaataggtagataaattgtcctttaaaatatcccagatgatatacacaatatggtacatttgtgctctctctctctgtttttctctctttctctttctagttagatcaagataacgatgacttgtaccctccctgattctgttacagtagggcccgggcagatctgtgtttgttaaacaggccttgtttgtgcatgctttgctatgaatgaagttcctttaaggacaaagaaaagcacacttttcttcttttgagcatatctgcttttactttaaatctgctaatttctaaaatgtagagtccttcaccaatcccagagactcaatttggaaatgaactgatttcaagccgttactgtgaataaagcaccccagcattttgtataagctcttaattaaacctgtacagcttctttacctgatttaagaaagggagacaagcaataggggggaataagcttcttcaaaattcattccaagcacaaaagaaattttttccctttgcatataaacttgacatcagttgattctgttggggtcggggtgggtatgcagggattgccttttattatcaagtgatttatttcaagagcctttgaggggattcaggtgaaggaacccccatctgtgctggagagttggatactcctttaaatagcccccaccacagtcataacaataatgataatgctggattatttgttaagccaaggttgtctgcctcatatccatcatgctgtttgcaatattcttgctttcaatcaatttatactgagtgtaactttaggatttctgctattaaatgcatgctctctatcctgcttcagtttctggctttgctttgtctgtttcaaaatatgtagcttcctcttttgtacaacaaaaaactcattctcacttttactaaatatactgtaggagtcatcattgatgttatttttctcttatgtatctgtaaagatttttggcatatgaatgtaatattaaagtcaatgatgctataacttgcgatgtttgcatcatgtcaacctttttgaaggagtgaaaaagccctactatgtttttaaatagcaagtgtaagctcagtgctagagtggatatacacaccgcatgttttcatatgtggcacttttatgtatcatgttgggttattgttctagactggactgttaaatactatgtttgaggctgggttgtcatttttataactgtcttggtgttttatggccattatttattacttttgatacacagaatgagctgcatgcatttatagagcaataagaggatgtatttaatgtgccttgtttttaactgaataagaactggaagcatgaatcaataaaactgattaaaatggtctatttgctagcattttgatgttacttgcagtcagataactttgattactgttgaagtttaaaaaaagtttgaaaatatttttacaaactgtgtttttgatgacacaaaagtgaaatatctacagagatagatgtaattttataagactgccagaattatttgtattaatttgttgctgtagcctttagggcatgacttctgtatttgtgcaatcctattctacaattacattcatcctattacaactca

SEQ ID NO: 342255 - DNA, 533 bp, Homo sapiens
tctctcttttcctcctgctctggccgcgttaagatgtggctacttcccttcgcgttctacctcgattgaaaattttctgaggcctccgtagccatgcttcccgtacagctgtggaaccggcctcattttcttctgtcactggagccatcatttatttagcagctttgttaaacagaaaggggtctgtcctgcgtgtgcagtctttggatttaaaattatggaaattcttcaggcagaaaatgggcacatatggttatcacagaaaagctgttttaaagccagttttaaggtattattatgccgctaccttcaagaagtaatttgcgtgctgtttattggagctgtgaatttaatcatctcaatcccacgctattacaggatgactataagaagatgtattgacatttctttggacacataattttgcctccattgtgtgttgttttgccagaatactgaaggcagtgtttgtatgatggcacatccaaataaaaagcaggtcctccttttgggacagtgatccatttaagtta

SEQ ID NO: 342256 - DNA, 445 bp, Homo sapiens
tctctcttttcctcctgctctggccgcgttaagatgtggctacttcccttcgcgttctacctcgattgaaaattttctgaggcctccgtagccatgcttcccgtacagctgtggaaccgatttaaaattatggaaattcttcaggcagaaaatgggcacatatggttatcacagaaaagctgttttaaagccagttttaaggtattattatgccgctaccttcaagaagtaatttgcgtgctgtttattggagctgtgaatttaatcatctcaatcccacgctattacaggatgactataagaagatgtattgacatttctttggacacataattttgcctccattgtgtgttgttttgccagaatactgaaggcagtgtttgtatgatggcacatccaaataaaaagcaggtcctccttttgggacagtgatccatttaagtta

SEQ ID NO: 342257 - DNA, 408 bp, Homo sapiens
ttgcctgcttgtaatgttacccctgagaaaagtcatctgaaaatgggaaatggacctggacaggaataagcagagcatgctgatttaaaattatggaaattcttcaggcagaaaatgggcacatatggttatcacagaaaagctgttttaaagccagttttaaggtattattatgccgctaccttcaagaagtaatttgcgtgctgtttattggagctgtgaatttaatcatctcaatcccacgctattacaggatgactataagaagatgtattgacatttctttggacacataattttgcctccattgtgtgttgttttgccagaatactgaaggcagtgtttgtatgatggcacatccaaataaaaagcaggtcctccttttgggacagtgatccatttaagtta

SEQ ID NO: 342258 - DNA, 774 bp, Homo sapiens
tctctcttttcctcctgctctggccgcgttaagatgtggctacttcccttcgcgttctacctcgattgaaaattttctgaggcctccgtagccatgcttcccgtacagctgtggaaccgtaagtggtgttttatcttcattgcttcagggagtgttgatttgtctgccattcgactctcagaaattctgtcaggaaaaacaaatggatatgaaatctgaagataaaggtttgtggggaaagaataaaaggatcatgaaatgtcagggctgaaaaatatcttagcatccagcctagtgttctatttacaccagccctgttttggctcccaatctgattctcttcctattgcatcaaactgagttttaaagaaatttgaaactatgcatttcaagactatttggtgattatgttaatctccaattctgcctatttttgattatgttaaaatcagccaaaatatagaacatagagttatacttatgcccaacatcataatatgccttcagttattaacatatgttgtaggtaagcttgttattatttgaaatgtaaatatttatatgtgtaatgtgtaaaagttttcaaatatgggtcataacatatccaatggtttatttgtctatgccactaatacatctttgggcacccaagtttaagtgcagtacattttgctggttgatgtaccaaggaatgacttataattgtgatgaaatttgaccttcatattgcaaaagataatcatcatttgctagaaaaaattaaaaccgtttaaa

SEQ ID NO: 342259 - DNA, 301 bp, Homo sapiens
  misc_feature (29)..(29): n is a, c, g, or t
atggaaagagggagggggggagggggggnggggaggtgaaaaaatgatgagattctggtattattatgccgctaccttcaagaagtaatttgcgtgctgtttattggagctgtgaatttaatcatctcaatcccacgctattacaggatgactataagaagatgtattgacatttctttggacacataattttgcctccattgtgtgttgttttgccagaatactgaaggcagtgtttgtatgatggcacatccaaataaaaagcaggtcctccttttgggacagtgatccatttaagtta

SEQ ID NO: 342260 - DNA, 465 bp, Homo sapiens
atgtattttctctttttgcagggcctcattttcttctgtcactggagccatcatttatttagcagctttgttaaacagaaaggggtctgtcctgcgtgtgcagtctttggtaagtctagataaacaccaagaaggtcttacatctgcattactatgaaatgtccctggttattagttgatatcaccataggacacaggtgatcgttacactcagttggagaagtgcggccccaagtccattctctaaatcatgactacttgtagcaaacaccttttaagatgcaattggccagtgacacaagtgtggtcctgtggtctctacaatgcaatcagtcaatttttagagaggctgctctctaggcaacagccagaatgttggggccttttgcgattctgatccactaataagtgtttgctgttgacaaataattgagattgcaggttaggttcacaaaagtacaactc

SEQ ID NO: 342261 - DNA, 2771 bp, Homo sapiens
  misc_feature (3)..(4): n is a, c, g, or t
  misc_feature (7)..(8): n is a, c, g, or t
ggnncgnngcagccgccgagcggccgcgatttcccggggactgctggggcgcagcggggaggcgggccggggggcggcggggcgcgagcagagcgcggttgacctccctttctctgctcagctccagcgtcatttcggcctcttagttcttctgaaccctgctcctgagctaggtaggaaacatgagcggcaccaacttggatgggaacgatgagtttgatgagcagttgcgaatgcaagaattgtacggagacggcaaggatggtgacacccagaccgatgccggcggagaacccgattctctcgggcagcagccgacggacactccctacgagtgggacctggacaaaaaggcttggttccccaagattactgaagatttcattgctacatatcaggccaattatggcttctctaacgatggcgcatctagttctaccgcaaatgttgaagatgtccatgctaggactgcagaggaacctccacaagaaaaagccccggaacccactgatgccagaaagaagggagaaaaaagaaaggctgagtcaggatggtttcatgttgaagaagacagaaatacaaatgtatacgtgtctggtttgcctccagatattacagtggatgaatttatacaacttatgtccaagtttggcattattatgagagatcctcagacagaagaatttaaggtcaaactttacaaagataatcaaggaaatcttaaaggagacggtctttgctgttatttgaaaagagaatctgtggaacttgcattaaaacttttggatgaagatgaaattagaggctacaaattacatgttgaggtggcaaagtttcaactgaagggagaatatgatgcctcaaagaagaagaagaagtgcaaagactataagaagaagctgtctatgcaacaaaagcagttggattggagacctgagaggcgagccggaccatcccggatgcgccatgagcgagttgtcatcatcaagaatatgtttcatcctatggattttgaggatgatccgttggtgctgaatgagatcagagaagaccttcgagtagagtgttcgaagtttggacaaattaggaaactccttctctttgataggcacccagatggtgtggcctctgtgtcctttcgggatccagaggaagctgattattgtattcagactctcgatggaagatggtttggtggccgtcaaatcactgcccaggcatgggatgggactacagattatcaggtggaggaaacctcaagagaaagggaggaaaggctgagaggatgggaggctttcctcaatgctcctgaggccaacagaggccttaggcgttcagattctgtctctgcttccgaaagggcagggccttctagagcaaggcatttttcagagcaccccagcacatctaaaatgaatgctcaagaaactgcaactggaatggcgtttgaagaacctatagatgagaagaagtttgaaaagacagaagatgggggagaatttgaagaaggtgcttctgaaaacaatgctaaggaaagtagccccgaaaaagaggctgaagaaggctgccctgaaaaagaatctgaagagggctgccccaaaagagggtttgaaggcagctgctcccaaaaagagtctgaagaaggcaatcccgtaagaggatctgaagaggatagtcctaaaaaagagtctaaaaagaagacactcaaaaatgattgtgaagagaatggccttgcaaaggaatctgaagatgacctcaacaaggagtctgaagaggaggttggccccacaaaagagtccgaagaagatgactcagagaaagagtctgatgaagactgctctgaaaaacagtctgaagatggctccgaaagagaatttgaagaaaatggtctcgagaaagatttggacgaggaaggttctgaaaaggagcttcatgaaaatgttcttgacaaagagttagaagaaaatgactctgaaaactccgaatttgaagatgacggctctgaaaaagtgttagatgaggaaggctctgagagagagtttgacgaagattcagatgaaaaggaagaagaggaggatacatatgaaaaagtatttgatgatgagtctgatgagaaagaggatgaagaatatgcagatgaaaaggggcttgaagctgctgataaaaaggcggaagaaggtgatgcagatgaaaagctgtttgaagagtcagatgacaaggaagatgaagatgcagatggaaaggaagttgaagatgctgacgaaaagttgttcgaagatgatgattccaatgagaagttgtttgatgaggaggaagattccagtgagaagttgtttgacgattctgatgagagggggactttgggtggttttgggagtgttgaagaagggcccctatccactggcagcagctttattctcagtagcgatgatgatgacgatgatatttaatcccttaaacttgctttttagggagagtcctccatctacatttgcctgtgcttcagggtaattactagtagtgttacatgaacatgtgcatagtggtaggatgccatcagattaaagcattgaagtgtttcattgttacctgtacctaatggttttaaatatatgttaattgattgtttagttaaaatgtcatagttacaatgcaagtaaactggatacttgttcttttgtcagatttgttaaatgcatgcagaataatatttttaagagtattgattgaagtttgtgatattcatcaataaaaatgagttgataatatgc

SEQ ID NO: 342262 - DNA, 3060 bp, Homo sapiens
  misc_feature (3)..(4): n is a, c, g, or t
  misc_feature (7)..(8): n is a, c, g, or t
ggnncgnngcagccgccgagcggccgcgatttcccggggactgctggggcgcagcggggaggcgggccggggggcggcggggcgcgagcagagcgcggttgacctccctttctctgctcagctccagcgtcatttcggcctcttagttcttctgaaccctgctcctgagctaggtaggaaacatgagcggcaccaacttggatgggaacgatgagtttgatgagcagttgcgaatgcaagaattgtacggagacggcaaggatggtgacacccagaccgatgccggcggagaacccgattctctcgggcagcagccgacggacactccctacgagtgggacctggacaaaaaggcttggttccccaagattactgaagatttcattgctacatatcaggccaattatggcttctctaacgatggcgcatctagttctaccgcaaatgttgaagatgtccatgctaggactgcagaggaacctccacaagaaaaagccccggaacccactgatgccagaaagaagggagaaaaaagaaaggctgagtcaggatggtttcatgttgaagaagacagaaatacaaatgtatacgtgtctggtttgcctccagatattacagtggatgaatttatacaacttatgtccaagtttggcattattatgagagatcctcagacagaagaatttaaggtcaaactttacaaagataatcaaggaaatcttaaaggagacggtctttgctgttatttgaaaagagaatctgtggaacttgcattaaaacttttggatgaagatgaaattagaggctacaaattacatgttgaggtggcaaagtttcaactgaagggagaatatgatgcctcaaagaagaagaagaagtgcaaagactataagaagaagctgtctatgcaacaaaagcagttggattggagacctgagaggcgagccggaccatcccggatgcgccatgagcgagttgtcatcatcaagaatatgtttcatcctatggattttgaggatgatccgttggtgctgaatgagatcagagaagaccttcgagtagagtgttcgaagtttggacaaattaggaaactccttctctttgataggcacccagatggtgtggcctctgtgtcctttcgggatccagaggaagctgattattgtattcagactctcgatggaagatggtttggtggccgtcaaatcactgcccaggcatgggatgggactacagattatcaggtggaggaaacctcaagagaaagggaggaaaggctgagaggatgggaggctttcctcaatgctcctgaggccaacagaggccttaggcgttcagattctgtctctgcttccgaaagggcagggccttctagagcaaggcatttttcagagcaccccagcacatctaaaatgaatgctcaagaaactgcaactggaatggcgtttgaagaacctatagatgagaagaagtttgaaaagacagaagatgggggagaatttgaagaaggtgcttctgaaaacaatgctaaggaaagtagccccgaaaaagaggctgaagaaggctgccctgaaaaagaatctgaagagggctgccccaaaagagggtttgaaggcagctgctcccaaaaagagtctgaagaaggcaatcccgtaagaggatctgaagaggatagtcctaaaaaagagtctaaaaagaagacactcaaaaatgattgtgaagagaatggccttgcaaaggaatctgaagatgacctcaacaaggagtctgaagaggaggttggccccacaaaagagtccgaagaagatgactcagagaaagagtctgatgaagactgctctgaaaaacagtctgaagatggctccgaaagagaatttgaagaaaatggtctcgagaaagatttggacgaggaaggttctgaaaaggagcttcatgaaaatgttcttgacaaagagttagaagaaaatgactctgaaaactccgaatttgaagatgacggctctgaaaaagtgttagatgaggaaggctctgagagagagtttgacgaagattcagatgaaaaggaagaagaggaggatacatatgaaaaagtatttgatgatgagtctgatgagaaagaggatgaagaatatgcagatgaaaaggggcttgaagctgctgataaaaaggcggaagaaggtgatgcagatgaaaagctgtttgaagagtcagatgacaaggaagatgaagatgcagatggaaaggaagttgaagatgctgacgaaaagttgttcgaagatgatgattccaatgagaagttgtttgatgaggaggaagattccagtgagaagttgtttgacgattctgatgagagggggactttgggtggttttgggagtgttgaagaagggcccctatccactggcagcagctttattctcagtagcgatgatgatgacgatgatatttaatcccttaaacttgctttttagggagagtcctccatctacatttgcctgtgcttcagggtaattactagtagtgttacatgaacatgtgcatagtggtaggatgccatcagattaaagcattgaagtgtttcattgttacctgtacctaatggttttaaatatatgttaattgattgtttagttaaaatgtcatagttacaatgcaagtaaactggatacttgttcttttgtcagatttgttaaatgcatgcagaataatatttttaagagtattgattgaagtttgtgatattcatcaataaaaatgagttgataatatgcagaaactgaaaattggacttgagttaaattgcattttaaattcttgatattgctttatttatactgaaggttggcttttctgaggacttgaagaatctctttggagtctccttgcttcccgctggtattagcacgtatgtctccatttcctctctataaaccagaacatgttcctaaactcagaaaacaaccctctggattttttttttctgcccagtccttgcaaattaactcttgtttgttttctaccctctttccattaaaattgactctcagatgtgcaaaagtg

SEQ ID NO: 342263 - DNA, 3085 bp, Homo sapiens
gccacgcgccgacaatggcggctgcgtcggcctgagcagggcttagtttagaagtaatttcctgacgttgccgagggagccgcagtcgcctcagatccggtcggcggcggcggcggtggcggcggcggcagcgcgcctgcgcgctcccgcagcgccctggacctagcggcggtgccgaggcccggcggagcaagccaggtaggaaacatgagcggcaccaacttggatgggaacgatgagtttgatgagcagttgcgaatgcaagaattgtacggagacggcaaggatggtgacacccagaccgatgccggcggagaacccgattctctcgggcagcagccgacggacactccctacgagtgggacctggacaaaaaggcttggttccccaagattactgaagatttcattgctacatatcaggccaattatggcttctctaacgatggcgcatctagttctaccgcaaatgttgaagatgtccatgctaggactgcagaggaacctccacaagaaaaagccccggaacccactgatgccagaaagaagggagaaaaaagaaaggctgagtcaggatggtttcatgttgaagaagacagaaatacaaatgtatacgtgtctggtttgcctccagatattacagtggatgaatttatacaacttatgtccaagtttggcattattatgagagatcctcagacagaagaatttaaggtcaaactttacaaagataatcaaggaaatcttaaaggagacggtctttgctgttatttgaaaagagaatctgtggaacttgcattaaaacttttggatgaagatgaaattagaggctacaaattacatgttgaggtggcaaagtttcaactgaagggagaatatgatgcctcaaagaagaagaagaagtgcaaagactataagaagaagctgtctatgcaacaaaagcagttggattggagacctgagaggcgagccggaccatcccggatgcgccatgagcgagttgtcatcatcaagaatatgtttcatcctatggattttgaggatgatccgttggtgctgaatgagatcagagaagaccttcgagtagagtgttcgaagtttggacaaattaggaaactccttctctttgataggcacccagatggtgtggcctctgtgtcctttcgggatccagaggaagctgattattgtattcagactctcgatggaagatggtttggtggccgtcaaatcactgcccaggcatgggatgggactacagattatcaggtggaggaaacctcaagagaaagggaggaaaggctgagaggatgggaggctttcctcaatgctcctgaggccaacagaggccttaggcgttcagattctgtctctgcttccgaaagggcagggccttctagagcaaggcatttttcagagcaccccagcacatctaaaatgaatgctcaagaaactgcaactggaatggcgtttgaagaacctatagatgagaagaagtttgaaaagacagaagatgggggagaatttgaagaaggtgcttctgaaaacaatgctaaggaaagtagccccgaaaaagaggctgaagaaggctgccctgaaaaagaatctgaagagggctgccccaaaagagggtttgaaggcagctgctcccaaaaagagtctgaagaaggcaatcccgtaagaggatctgaagaggatagtcctaaaaaagagtctaaaaagaagacactcaaaaatgattgtgaagagaatggccttgcaaaggaatctgaagatgacctcaacaaggagtctgaagaggaggttggccccacaaaagagtccgaagaagatgactcagagaaagagtctgatgaagactgctctgaaaaacagtctgaagatggctccgaaagagaatttgaagaaaatggtctcgagaaagatttggacgaggaaggttctgaaaaggagcttcatgaaaatgttcttgacaaagagttagaagaaaatgactctgaaaactccgaatttgaagatgacggctctgaaaaagtgttagatgaggaaggctctgagagagagtttgacgaagattcagatgaaaaggaagaagaggaggatacatatgaaaaagtatttgatgatgagtctgatgagaaagaggatgaagaatatgcagatgaaaaggggcttgaagctgctgataaaaaggcggaagaaggtgatgcagatgaaaagctgtttgaagagtcagatgacaaggaagatgaagatgcagatggaaaggaagttgaagatgctgacgaaaagttgttcgaagatgatgattccaatgagaagttgtttgatgaggaggaagattccagtgagaagttgtttgacgattctgatgagagggggactttgggtggttttgggagtgttgaagaagggcccctatccactggcagcagctttattctcagtagcgatgatgatgacgatgatatttaatcccttaaacttgctttttagggagagtcctccatctacatttgcctgtgcttcagggtaattactagtagtgttacatgaacatgtgcatagtggtaggatgccatcagattaaagcattgaagtgtttcattgttacctgtacctaatggttttaaatatatgttaattgattgtttagttaaaatgtcatagttacaatgcaagtaaactggatacttgttcttttgtcagatttgttaaatgcatgcagaataatatttttaagagtattgattgaagtttgtgatattcatcaataaaaatgagttgataatatgcagaaactgaaaattggacttgagttaaattgcattttaaattcttgatattgctttatttatactgaaggttggcttttctgaggacttgaagaatctctttggagtctccttgcttcccgctggtattagcacgtatgtctccatttcctctctataaaccagaacatgttcctaaactcagaaaacaaccctctggattttttttttctgcccagtccttgcaaattaactcttgtttgttttctaccctctttccattaaaattgactctcagatgtgcaaaagtg

SEQ ID NO: 342264 - DNA, 2852 bp, Homo sapiens
  misc_feature (3)..(4): n is a, c, g, or t
  misc_feature (7)..(8): n is a, c, g, or t
ggnncgnngcagccgccgagcggccgcgatttcccggggactgctggggcgcagcggggaggcgggccggggggcggcggggcgcgagcagagcgcggttgacctccctttctctgctcagctccagcgtcatttcggcctcttagttcttctgaaccctgctcctgagctaggtaggaaacatgagcggcaccaacttggatgggaacgatgagtttgatgagcagttgcgaatgcaagaattgtacggagacggcaaggatggtgacacccagaccgatgccggcggagaacccgattctctcgggcagcagccgacggacactccctacgagtgggacctggacaaaaaggcttggttccccaagattactgaagatttcattgctacatatcaggccaattatggcttctctaacgatggcgcatctagttctaccgcaaatgttgaagatgtccatgctaggactgcagaggaacctccacaagaaaaagccccggaacccactgatgccagaaagaagggagaaaaaagaaaggctgagtcaggatggtttcatgttgaagaagacagaaatacaaatgtatacgtgtctggtttgcctccagatattacagtggatgaatttatacaacttatgtccaagtttggcattattatgagagatcctcagacagaagaatttaaggtcaaactttacaaagataatcaaggaaatcttaaaggagacggtctttgctgttatttgaaaagagaatctgtggaacttgcattaaaacttttggatgaagatgaaattagaggctacaaattacatgttgaggtggcaaagtttcaactgaagggagaatatgatgcctcaaagaagaagaagaagtgcaaagactataagaagaagctgtctatgcaacaaaagcagttggattggagacctgagaggcgagccggaccatcccggatgcgccatgagcgagttgtcatcatcaagaatatgtttcatcctatggattttgaggatgatccgttggtgctgaatgagatcagagaagaccttcgagtagagtgttcgaagtttggacaaattaggaaactccttctctttgataggcacccagatggtgtggcctctgtgtcctttcgggatccagaggaagctgattattgtattcagactctcgatggaagatggtttggtggccgtcaaatcactgcccaggcatgggatgggactacagattatcaggtggaggaaacctcaagagaaagggaggaaaggctgagaggatgggaggctttcctcaatgctcctgaggccaacagaggccttaggcgttcagattctgtctctgcttccgaaagggcagggccttctagagcaaggcatttttcagagcaccccagcacatctaaaatgaatgctcaagaaactgcaactggaatggcgtttgaagaacctatagatgagaagaagtttgaaaagacagaagatgggggagaatttgaagaaggtgcttctgaaaacaatgctaaggaaagtagccccgaaaaagaggctgaagaaggctgccctgaaaaagaatctgaagagggctgccccaaaagagggtttgaaggcagctgctcccaaaaagagtctgaagaaggcaatcccgtaagaggatctgaagaggatagtcctaaaaaagagtctaaaaagaagacactcaaaaatgattgtgaagagaatggccttgcaaaggaatctgaagatgacctcaacaaggagtctgaagaggaggttggccccacaaaagagtccgaagaagatgactcagagaaagagtctgatgaagactgctctgaaaaacagtctgaagatggctccgaaagagaatttgaagaaaatggtctcgagaaagatttggacgaggaaggttctgaaaaggagcttcatgaaaatgttcttgacaaagagttagaagaaaatgactctgaaaactccgaatttgaagatgacggctctgaaaaagtgttagatgaggaaggctctgagagagagtttgacgaagattcagatgaaaaggaagaagaggaggatacatatgaaaaagtatttgatgatgagtctgatgagaaagaggatgaagaatatgcagatgaaaaggggcttgaagctgctgataaaaaggcggaagaaggtgatgcagatgaaaagctgtttgaagagtcagatgacaaggaagatgaagatgcagatggaaaggaagttgaagatgctgacgaaaagttgttcgaagatgatgattccaatgagaagttgtttgatgaggaggaagattccagtgagaagttgtttgacgattctgatgagagggggactttgggtggttttgggagtgttgaagaagggcccctatccactggcagcagctttattctcagtagcgatgatgatgacgatgatatttaatcccttaaacttgctttttagggagagtcctccatctacatttgcctgtgcttcagggtaattactagtagtgttacatgaacatgtgcatagtggtaggatgccatcagattaaagcattgaagtgtttcattgttacctgtacctaatggttttaaatatatgttaattgattgtttagttaaaatgtcatagttacaatgcaagtaaactggatacttgttcttttgtcagatttgttaaatgcatgcagaataatatttttaagagtattgattgaagtttgtgatattcatcaataaaaatgagttgataatatgcctaatatttaattttcttttatctttctacatattttttaataaaacctctgggtggggtcccgacccctattttgtcctt

SEQ ID NO: 342265 - DNA, 2758 bp, Homo sapiens
  misc_feature (3)..(4): n is a, c, g, or t
  misc_feature (7)..(8): n is a, c, g, or t
ggnncgnngcagccgccgagcggccgcgatttcccggggactgctggggcgcagcggggaggcgggccggggggcggcggggcgcgagcagagcgcggttgacctccctttctctgctcagctccagcgtcatttcggcctcttagttcttctgaaccctgctcctgagctaggtaggaaacatgagcggcaccaacttggatgggaacgatgagtttgatgagcagttgcgaatgcaagaattgtacggagacggcaaggatggtgacacccagaccgatgccggcggagaacccgattctctcgggcagcagccgacggacactccctacgagtgggacctggacaaaaaggcttggttccccaagattactgaagatttcattgctacatatcaggccaattatggcttctctaacgatggcgcatctagttctaccgcaaatgttgaagatgtccatgctaggactgcagaggaacctccacaagaaaaagccccggaacccactgatgccagaaagaagggagaaaaaagaaaggctgagtcaggatggtttcatgttgaagaagacagaaatacaaatgtatacgtgtctggtttgcctccagatattacagtggatgaatttatacaacttatgtccaagtttggcattattatgagagatcctcagacagaagaatttaaggtcaaactttacaaagataatcaaggaaatcttaaaggagacggtctttgctgttatttgaaaagagaatctgtggaacttgcattaaaacttttggatgaagatgaaattagaggctacaaattacatgttgaggtggcaaagtttcaactgaagggagaatatgatgcctcaaagaagaagaagaagtgcaaagactataagaagaagctgtctatgcaacaaaagcagttggattggagacctgagaggcgagccggaccatcccggatgcgccatgagcgagttgtcatcatcaagaatatgtttcatcctatggattttgaggatgatccgttggtgctgaatgagatcagagaagaccttcgagtagagtgttcgaagtttggacaaattaggaaactccttctctttgataggcacccagatggtgtggcctctgtgtcctttcgggatccagaggaagctgattattgtattcagactctcgatggaagatggtttggtggccgtcaaatcactgcccaggcatgggatgggactacagattatcaggtggaggaaacctcaagagaaagggaggaaaggctgagaggatgggaggctttcctcaatgctcctgaggccaacagaggccttaggcgttcagattctgtctctgcttccgaaagggcagggccttctagagcaaggcatttttcagagcaccccagcacatctaaaatgaatgctcaagaaactgcaactggaatggcgtttgaagaacctatagatgagaagaagtttgaaaagacagaagatgggggagaatttgaagaaggtgcttctgaaaacaatgctaaggaaagtagccccgaaaaagaggctgaagaaggctgccctgaaaaagaatctgaagagggctgccccaaaagagggtttgaaggcagctgctcccaaaaagagtctgaagaaggcaatcccgtaagaggatctgaagaggatagtcctaaaaaagagtctaaaaagaagacactcaaaaatgattgtgaagagaatggccttgcaaaggaatctgaagatgacctcaacaaggagtctgaagaggaggttggccccacaaaagagtccgaagaagatgactcagagaaagagtctgatgaagactgctctgaaaaacagtctgaagatggctccgaaagagaatttgaagaaaatggtctcgagaaagatttggacgaggaaggttctgaaaaggagcttcatgaaaatgttcttgacaaagagttagaagaaaatgactctgaaaactccgaatttgaagatgacggctctgaaaaagtgttagatgaggaaggctctgagagagagtttgacgaagattcagatgaaaaggaagaagaggaggatacatatgaaaaagtatttgatgatgagtctgatgagaaagaggatgaagaatatgcagatgaaaaggggcttgaagctgctgataaaaaggcggaagaaggtgatgcagatgaaaagctgtttgaagagtcagatgacaaggaagatgaagatgcagatggaaaggaagttgaagatgctgacgaaaagttgttcgaagatgatgattccaatgagaagttgtttgatgaggaggaagattccagtgagaagttgtttgacgattctgatgagagggggactttgggtggttttgggagtgttgaagaagggcccctatccactggcagcagctttattctcagtagcgatgatgatgacgatgatatttaatcccttaaacttgctttttagggagagtcctccatctacatttgcctgtgcttcagggtaattactagtagtgttacatgaacatgtgcatagtggtaggatgccatcagattaaagcattgaagtgtttcattgttacctgtacctaatggttttaaatatatgttaattgattgtttagttaaaatgtcatagttacaatgcaagtaaactggatacttgttcttttgtcagatttgttaaatgcatgcagaataatatttttaagagtattgattgaagccacgacggagggccgagctcgatta

SEQ ID NO: 342266 - DNA, 2968 bp, Homo sapiens
  misc_feature (3)..(4): n is a, c, g, or t
  misc_feature (7)..(8): n is a, c, g, or t
ggnncgnngcagccgccgagcggccgcgatttcccggggactgctggggcgcagcggggaggcgggccggggggcggcggggcgcgagcagagcgcggttgacctccctttctctgctcagctccagcgtcatttcggcctcttagttcttctgaaccctgctcctgagctaggtaggaaacatgagcggcaccaacttggatgggaacgatgagtttgatgagcagttgcgaatgcaagaattgtacggagacggcaaggatggtgacacccagaccgatgccggcggagaacccgattctctcgggcagcagccgacggacactccctacgagtgggacctggacaaaaaggcttggttccccaagattactgaagatttcattgctacatatcaggccaattatggcttctctaacgatggcgcatctagttctaccgcaaatgttgaagatgtccatgctaggactgcagaggaacctccacaagaaaaagccccggaacccactgatgccagaaagaagggagaaaaaagaaaggctgagtcaggatggtttcatgttgaagaagacagaaatacaaatgtatacgtgtctggtttgcctccagatattacagtggatgaatttatacaacttatgtccaagtttggcattattatgagagatcctcagacagaagaatttaaggtcaaactttacaaagataatcaaggaaatcttaaaggagacggtctttgctgttatttgaaaagagaatctgtggaacttgcattaaaacttttggatgaagatgaaattagaggctacaaattacatgttgaggtggcaaagtttcaactgaagggagaatatgatgcctcaaagaagaagaagaagtgcaaagactataagaagaagctgtctatgcaacaaaagcagttggattggagacctgagaggcgagccggaccatcccggatgcgccatgagcgagttgtcatcatcaagaatatgtttcatcctatggattttgaggatgatccgttggtgctgaatgagatcagagaagaccttcgagtagagtgttcgaagtttggacaaattaggaaactccttctctttgataggcacccagatggtgtggcctctgtgtcctttcgggatccagaggaagctgattattgtattcagactctcgatggaagatggtttggtggccgtcaaatcactgcccaggcatgggatgggactacagattatcaggtggaggaaacctcaagagaaagggaggaaaggctgagaggatgggaggctttcctcaatgctcctgaggccaacagaggccttaggcgttcagattctgtctctgcttccgaaagggcagggccttctagagcaaggcatttttcagagcaccccagcacatctaaaatgaatgctcaagaaactgcaactggaatggcgtttgaagaacctatagatgagaagaagtttgaaaagacagaagatgggggagaatttgaagaaggtgcttctgaaaacaatgctaaggaaagtagccccgaaaaagaggctgaagaaggctgccctgaaaaagaatctgaagagggctgccccaaaagagggtttgaaggcagctgctcccaaaaagagtctgaagaaggcaatcccgtaagaggatctgaagaggatagtcctaaaaaagagtctaaaaagaagacactcaaaaatgattgtgaagagaatggccttgcaaaggaatctgaagatgacctcaacaaggagtctgaagaggaggttggccccacaaaagagtccgaagaagatgactcagagaaagagtctgatgaagactgctctgaaaaacagtctgaagatggctccgaaagagaatttgaagaaaatggtctcgagaaagatttggacgaggaaggttctgaaaaggagcttcatgaaaatgttcttgacaaagagttagaagaaaatgactctgaaaactccgaatttgaagatgacggctctgaaaaagtgttagatgaggaaggctctgagagagagtttgacgaagattcagatgaaaaggaagaagaggaggatacatatgaaaaagtatttgatgatgagtctgatgagaaagaggatgaagaatatgcagatgaaaaggggcttgaagctgctgataaaaaggcggaagaaggtgatgcagatgaaaagctgtttgaagagtcagatgacaaggaagatgaagatgcagatggaaaggaagttgaagatgctgacgaaaagttgttcgaagatgatgattccaatgagaagttgtttgatgaggaggaagattccagtgagaagttgtttgacgattctgatgagagggggactttgggtggttttgggagtgttgaagaagggcccctatccactggcagcagctttattctcagtagcgatgatgatgacgatgatatttaatcccttaaacttgctttttagggagagtcctccatctacatttgcctgtgcttcagggtaattactagtagtgttacatgaacatgtgcatagtggtaggatgccatcagattaaagcattgaagtgtttcattgttacctgaagatggctccgaaagagaatttgaagaaaatggtctcgagaaagatttggacgaggaaggttctgaaaaggagcttcatgaaaatgttcttgacaaagagttagaagaaaatgactctgaaaactccgaatttgaagatgacggctctgaaaaagtgttagatgaggaaggctctgagagagagtttgacgaagattcagatggaaaggaagttgaagatgctgacgaaaagttgttcgaagatgatgattccaatgagctaagcaaggctgagcctcctcctgttgcttgaaataatgatgatataaaggctggatttggagtttgtatcccctggtccctctgggatgctcattaaaaccttcccactccttg

SEQ ID NO: 342267 - DNA, 1807 bp, Homo sapiens
  misc_feature (3)..(4): n is a, c, g, or t
  misc_feature (7)..(8): n is a, c, g, or t
ggnncgnngcagccgccgagcggccgcgatttcccggggactgctggggcgcagcggggaggcgggccggggggcggcggggcgcgagcagagcgcggttgacctccctttctctgctcagctccagcgtcatttcggcctcttagttcttctgaaccctgctcctgagctaggtaggaaacatgagcggcaccaacttggatgggaacgatgagtttgatgagcagttgcgaatgcaagaattgtacggagacggcaaggatggtgacacccagaccgatgccggcggagaacccgattctctcgggcagcagccgacggacactccctacgagtgggacctggacaaaaaggcttggttccccaagattactgaagatttcattgctacatatcaggccaattatggcttctctaacgatggcgcatctagttctaccgcaaatgttgaagatgtccatgctaggactgcagaggaacctccacaagaaaaagccccggaacccactgatgccagaaagaagggagaaaaaagaaaggctgagtcaggatggtttcatgttgaagaagacagaaatacaaatgtatacgtgtctggtttgcctccagatattacagtggatgaatttatacaacttatgtccaagtttggcattattatgagagatcctcagacagaagaatttaaggtcaaactttacaaagataatcaaggaaatcttaaaggagacggtctttgctgttatttgaaaagagaatctgtggaacttgcattaaaacttttggatgaagatgaaattagaggctacaaattacatgttgaggtggcaaagtttcaactgaagggagaatatgatgcctcaaagaagaagaagaagtgcaaagactataagaagaagctgtctatgcaacaaaagtttgtaatttttttcccttttgaaaggttccatatattctagagtatatttttggtaatagccatctagttttattctgtcaagtgtgcctacacattattttaaaataatttcattagctcatcaggtacctttagcaatctatacaataggtttagatttagcagtggtggggattttaattttccagagtgtctatttgtaatataataagggcttaaatgagctaagagaagccatctgtttggaaaacgttgaacatcaaattaaataagatagtttaggcttatgtaccagaaccgtttacttctgtgtggattgaaatcagtggtaccaggagctaaatttttctatacaggtttgttataggaattagaaatgacaggattttataattgtatttactgtagttgtatgtagtatatacataatgtcatcaagtttctattattattctgtttgtttaatatactttgaaatatactagttttaagaaattagtcaaaatgataaatacttttatcagagtaaattctaatgacacttctaacaccatgcttaaactaattaaatatcataaaagcatttagttgtgatgtctcattgtttttacaagtgtaggtaaaattgataaccacatattttttaaacaatatcagtaaaatttatgattgtaacagagttgagtagttttatgtatttgagtgcagtttgttttttataatgataaagtacctaaaaaccaatacaatttaaatatattttttagcctcaaggtatatctttctgaactcataaatactaagaattagagatttttcaagggtctcattggaatgtttgtataatcagacaacagttgccctgaaaaacatttcatctggggattt

SEQ ID NO: 342268 - DNA, 762 bp, Homo sapiens
ttttcaggacagcagctcttacaggtagtatactgttcaaatctctcttgtttttcaatctgtgccttgactttaaaaattgatccttcatagtcactccgactggcagcagctttattctcagtagcgatgatgatgacgatgatatttaatcccttaaacttgctttttagggagagtcctccatctacatttgcctgtgcttcagggtaattactagtagtgttacatgaacatgtgcatagtggtaggatgccatcagattaaagcattgaagtgtttcattgttacctgtacctaatggttttaaatatatgttaattgattgtttagttaaaatgtcatagttacaatgcaagtaaactggatacttgttcttttgtcagatttgttaaatgcatgcagaataatatttttaagagtattgattgaagtttgtgatattcatcaataaaaatgagttgataatatgcagaaactgaaaattggacttgagttaaattgcattttaaattcttgatattgctttatttatactgaaggttggcttttctgaggacttgaagaatctctttggagtctccttgcttcccgctggtattagcacgtatgtctccatttcctctctataaaccagaacatgttcctaaactcagaaaacaaccctctggattttttttttctgcccagtccttgcaaattaactcttgtttgttttctaccctctttccattaaaattgactctcagatgtgcaaaagtg

SEQ ID NO: 342269 - DNA, 3137 bp, Homo sapiens
gccacgcgccgacaatggcggctgcgtcggcctgagcagggcttagtttagaagtaatttcctgacgttgccgagggagccgcagtcgcctcagatccggtcggcggcggcggcggtggcggcggcggcagcgcgcctgcgcgctcccgcagcgccctggacctagcggcggtgccgaggcccggcggagcaagccagctccagcgtcatttcggcctcttagttcttctgaaccctgctcctgagctaggtaggaaacatgagcggcaccaacttggatgggaacgatgagtttgatgagcagttgcgaatgcaagaattgtacggagacggcaaggatggtgacacccagaccgatgccggcggagaacccgattctctcgggcagcagccgacggacactccctacgagtgggacctggacaaaaaggcttggttccccaagattactgaagatttcattgctacatatcaggccaattatggcttctctaacgatggcgcatctagttctaccgcaaatgttgaagatgtccatgctaggactgcagaggaacctccacaagaaaaagccccggaacccactgatgccagaaagaagggagaaaaaagaaaggctgagtcaggatggtttcatgttgaagaagacagaaatacaaatgtatacgtgtctggtttgcctccagatattacagtggatgaatttatacaacttatgtccaagtttggcattattatgagagatcctcagacagaagaatttaaggtcaaactttacaaagataatcaaggaaatcttaaaggagacggtctttgctgttatttgaaaagagaatctgtggaacttgcattaaaacttttggatgaagatgaaattagaggctacaaattacatgttgaggtggcaaagtttcaactgaagggagaatatgatgcctcaaagaagaagaagaagtgcaaagactataagaagaagctgtctatgcaacaaaagcagttggattggagacctgagaggcgagccggaccatcccggatgcgccatgagcgagttgtcatcatcaagaatatgtttcatcctatggattttgaggatgatccgttggtgctgaatgagatcagagaagaccttcgagtagagtgttcgaagtttggacaaattaggaaactccttctctttgataggcacccagatggtgtggcctctgtgtcctttcgggatccagaggaagctgattattgtattcagactctcgatggaagatggtttggtggccgtcaaatcactgcccaggcatgggatgggactacagattatcaggtggaggaaacctcaagagaaagggaggaaaggctgagaggatgggaggctttcctcaatgctcctgaggccaacagaggccttaggcgttcagattctgtctctgcttccgaaagggcagggccttctagagcaaggcatttttcagagcaccccagcacatctaaaatgaatgctcaagaaactgcaactggaatggcgtttgaagaacctatagatgagaagaagtttgaaaagacagaagatgggggagaatttgaagaaggtgcttctgaaaacaatgctaaggaaagtagccccgaaaaagaggctgaagaaggctgccctgaaaaagaatctgaagagggctgccccaaaagagggtttgaaggcagctgctcccaaaaagagtctgaagaaggcaatcccgtaagaggatctgaagaggatagtcctaaaaaagagtctaaaaagaagacactcaaaaatgattgtgaagagaatggccttgcaaaggaatctgaagatgacctcaacaaggagtctgaagaggaggttggccccacaaaagagtccgaagaagatgactcagagaaagagtctgatgaagactgctctgaaaaacagtctgaagatggctccgaaagagaatttgaagaaaatggtctcgagaaagatttggacgaggaaggttctgaaaaggagcttcatgaaaatgttcttgacaaagagttagaagaaaatgactctgaaaactccgaatttgaagatgacggctctgaaaaagtgttagatgaggaaggctctgagagagagtttgacgaagattcagatgaaaaggaagaagaggaggatacatatgaaaaagtatttgatgatgagtctgatgagaaagaggatgaagaatatgcagatgaaaaggggcttgaagctgctgataaaaaggcggaagaaggtgatgcagatgaaaagctgtttgaagagtcagatgacaaggaagatgaagatgcagatggaaaggaagttgaagatgctgacgaaaagttgttcgaagatgatgattccaatgagaagttgtttgatgaggaggaagattccagtgagaagttgtttgacgattctgatgagagggggactttgggtggttttgggagtgttgaagaagggcccctatccactggcagcagctttattctcagtagcgatgatgatgacgatgatatttaatcccttaaacttgctttttagggagagtcctccatctacatttgcctgtgcttcagggtaattactagtagtgttacatgaacatgtgcatagtggtaggatgccatcagattaaagcattgaagtgtttcattgttacctgtacctaatggttttaaatatatgttaattgattgtttagttaaaatgtcatagttacaatgcaagtaaactggatacttgttcttttgtcagatttgttaaatgcatgcagaataatatttttaagagtattgattgaagtttgtgatattcatcaataaaaatgagttgataatatgcagaaactgaaaattggacttgagttaaattgcattttaaattcttgatattgctttatttatactgaaggttggcttttctgaggacttgaagaatctctttggagtctccttgcttcccgctggtattagcacgtatgtctccatttcctctctataaaccagaacatgttcctaaactcagaaaacaaccctctggattttttttttctgcccagtccttgcaaattaactcttgtttgttttctaccctctttccattaaaattgactctcagatgtgcaaaagtg

SEQ ID NO: 342270 - DNA, 3027 bp, Homo sapiens
  misc_feature (3)..(4): n is a, c, g, or t
  misc_feature (7)..(8): n is a, c, g, or t
ggnncgnngcagccgccgagcggccgcgatttcccggggactgctggggcgcagcggggaggcgggccggggggcggcggggcgcgagcagagcgcggttgacctccctttctctgctcagctccagcgtcatttcggcctcttagttcttctgaaccctgctcctgagctaggtaggaaacatgagcggcaccaacttggatgggaacgatgagtttgatgagcagttgcgaatgcaagaattgtacggagacggcaaggatggtgacacccagaccgatgccggcggagaacccgattctctcgggcagcagccgacggacactccctacgagtgggacctggacaaaaaggcttggttccccaagattactgaagatttcattgctacatatcaggccaattatggcttctctaacgatggcgcatctagttctaccgcaaatgttgaagatgtccatgctaggactgcagaggaacctccacaagaaaaagccccggaacccactgatgccagaaagaagggagaaaaaagaaaggctgagtcaggatggtttcatgttgaagaagacagaaatacaaatgtatacgtgtctggtttgcctccagatattacagtggatgaatttatacaacttatgtccaagtttggcattattatgagagatcctcagacagaagaatttaaggtcaaactttacaaagataatcaaggaaatcttaaaggagacggtctttgctgttatttgaaaagagaatctgtggaacttgcattaaaacttttggatgaagatgaaattagaggctacaaattacatgttgaggtggcaaagtttcaactgaagggagaatatgatgcctcaaagaagaagaagaagtgcaaagactataagaagaagctgtctatgcaacaaaagcagttggattggagacctgagaggcgagccggaccatcccggatgcgccatgagcgagttgtcatcatcaagaatatgtttcatcctatggattttgaggatgatccgttggtgctgaatgagatcagagaagaccttcgagtagagtgttcgaagtttggacaaattaggaaactccttctctttgataggcacccagatggtgtggcctctgtgtcctttcgggatccagaggaagctgattattgtattcagactctcgatggaagatggtttggtggccgtcaaatcactgcccaggcatgggatgggactacagattatcaggtggaggaaacctcaagagaaagggaggaaaggctgagaggatgggaggctttcctcaatgctcctgaggccaacagaggccttaggcgttcagattctgtctctgcttccgaaagggcagggccttctagagcaaggcatttttcagagcaccccagcacatctaaaatgaatgctcaagaaactgcaactggaatggcgtttgaagaacctatagatgagaagaagtttgaaaagacagaagatgggggagaatttgaagaaggtgcttctgaaaacaatgctaaggaaagtagccccgaaaaagaggctgaagaaggctgccctgaaaaagaatctgaagagggctgccccaaaagagggtttgaaggcagctgctcccaaaaagagtctgaagaaggcaatcccgtaagaggatctgaagaggatagtcctaaaaaagagtctaaaaagaagacactcaaaaatgattgtgaagagaatggccttgcaaaggaatctgaagatgacctcaacaaggagtctgaagaggaggttggccccacaaaagagtccgaagaagatgactcagagaaagagtctgatgaagactgctctgaaaaacagtctgaagatggctccgaaagagaatttgaagaaaatggtctcgagaaagatttggacgaggaaggttctgaaaaggagcttcatgaaaatgttcttgacaaagagttagaagaaaatgactctgaaaactccgaatttgaagatgacggctctgaaaaagtgttagatgaggaaggctctgagagagagtttgacgaagattcagatgaaaaggaagaagaggaggatacatatgaaaaagtatttgatgatgagtctgatgagaaagaggatgaagaatatgcagatgaaaaggggcttgaagctgctgataaaaaggcggaagaaggtgatgcagatgaaaagctgtttgaagagtcagatgacaaggaagatgaagatgcagatggaaaggaagttgaagatgctgacgaaaagttgttcgaggaggaagattccagtgagaagttgtttgacgattctgatgagagggggactttgggtggttttgggagtgttgaagaagggcccctatccactggcagcagctttattctcagtagcgatgatgatgacgatgatatttaatcccttaaacttgctttttagggagagtcctccatctacatttgcctgtgcttcagggtaattactagtagtgttacatgaacatgtgcatagtggtaggatgccatcagattaaagcattgaagtgtttcattgttacctgtacctaatggttttaaatatatgttaattgattgtttagttaaaatgtcatagttacaatgcaagtaaactggatacttgttcttttgtcagatttgttaaatgcatgcagaataatatttttaagagtattgattgaagtttgtgatattcatcaataaaaatgagttgataatatgcagaaactgaaaattggacttgagttaaattgcattttaaattcttgatattgctttatttatactgaaggttggcttttctgaggacttgaagaatctctttggagtctccttgcttcccgctggtattagcacgtatgtctccatttcctctctataaaccagaacatgttcctaaactcagaaaacaaccctctggattttttttttctgcccagtccttgcaaattaactcttgtttgttttctaccctctttccattaaaattgactctcagatgtgcaaaagtg

SEQ ID NO: 342271 - DNA, 2350 bp, Homo sapiens
atacttacctggcaggggagataccatgatcacgaaggtggttttcccagggcgaggcttatccattgcactccggatgtgctgacccctgcgatttccccaaatgtgggaaactcgactgcataatttgtggtagtgggggactgcgttcgcgctttcccctggaagtgcaaagactataagaagaagctgtctatgcaacaaaagcagttggattggagacctgagaggcgagccggaccatcccggatgcgccatgagcgagttgtcatcatcaagaatatgtttcatcctatggattttgaggatgatccgttggtgctgaatgagatcagagaagaccttcgagtagagtgttcgaagtttggacaaattaggaaactccttctctttgataggcacccagatggtgtggcctctgtgtcctttcgggatccagaggaagctgattattgtattcagactctcgatggaagatggtttggtggccgtcaaatcactgcccaggcatgggatgggactacagattatcaggtggaggaaacctcaagagaaagggaggaaaggctgagaggatgggaggctttcctcaatgctcctgaggccaacagaggccttaggcgttcagattctgtctctgcttccgaaagggcagggccttctagagcaaggcatttttcagagcaccccagcacatctaaaatgaatgctcaagaaactgcaactggaatggcgtttgaagaacctatagatgagaagaagtttgaaaagacagaagatgggggagaatttgaagaaggtgcttctgaaaacaatgctaaggaaagtagccccgaaaaagaggctgaagaaggctgccctgaaaaagaatctgaagagggctgccccaaaagagggtttgaaggcagctgctcccaaaaagagtctgaagaaggcaatcccgtaagaggatctgaagaggatagtcctaaaaaagagtctaaaaagaagacactcaaaaatgattgtgaagagaatggccttgcaaaggaatctgaagatgacctcaacaaggagtctgaagaggaggttggccccacaaaagagtccgaagaagatgactcagagaaagagtctgatgaagactgctctgaaaaacagtctgaagatggctccgaaagagaatttgaagaaaatggtctcgagaaagatttggacgaggaaggttctgaaaaggagcttcatgaaaatgttcttgacaaagagttagaagaaaatgactctgaaaactccgaatttgaagatgacggctctgaaaaagtgttagatgaggaaggctctgagagagagtttgacgaagattcagatgaaaaggaagaagaggaggatacatatgaaaaagtatttgatgatgagtctgatgagaaagaggatgaagaatatgcagatgaaaaggggcttgaagctgctgataaaaaggcggaagaaggtgatgcagatgaaaagctgtttgaagagtcagatgacaaggaagatgaagatgcagatggaaaggaagttgaagatgctgacgaaaagttgttcgaagatgatgattccaatgagaagttgtttgatgaggaggaagattccagtgagaagttgtttgacgattctgatgagagggggactttgggtggttttgggagtgttgaagaagggcccctatccactggcagcagctttattctcagtagcgatgatgatgacgatgatatttaatcccttaaacttgctttttagggagagtcctccatctacatttgcctgtgcttcagggtaattactagtagtgttacatgaacatgtgcatagtggtaggatgccatcagattaaagcattgaagtgtttcattgttacctgtacctaatggttttaaatatatgttaattgattgtttagttaaaatgtcatagttacaatgcaagtaaactggatacttgttcttttgtcagatttgttaaatgcatgcagaataatatttttaagagtattgattgaagtttgtgatattcatcaataaaaatgagttgataatatgcagaaactgaaaattggacttgagttaaattgcattttaaattcttgatattgctttatttatactgaaggttggcttttctgaggacttgaagaatctctttggagtctccttgcttcccgctggtattagcacgtatgtctccatttcctctctataaaccagaacatgttcctaaactcagaaaacaaccctctggattttttttttctgcccagtccttgcaaattaactcttgtttgttttctaccctctttccattaaaattgactctcagatgtgcaaaagtg

SEQ ID NO: 342272 - DNA, 878 bp, Homo sapiens
  misc_feature (26)..(26): n is a, c, g, or t
gtctctagaggatccacatacattgnctgatgacaaggaagatgaagatgcagatggaaaggaagttgaagatgctgacgaaaagttgttcgaagatgatgattccaatgagaagttgtttgatgaggaggaagattccagtgagaagttgtttgacgattctgatgagagggggactttgggtggttttgggagtgttgaagaagggcccctatccactggcagcagctttattctcagtagcgatgatgatgacgatgatatttaatcccttaaacttgctttttagggagagtcctccatctacatttgcctgtgcttcagggtaattactagtagtgttacatgaacatgtgcatagtggtaggatgccatcagattaaagcattgaagtgtttcattgttacctgtacctaatggttttaaatatatgttaattgattgtttagttaaaatgtcatagttacaatgcaagtaaactggatacttgttcttttgtcagatttgttaaatgcatgcagaataatatttttaagagtattgattgaagtttgtgatattcatcaataaaaatgagttgataatatgcagaaactgaaaattggacttgagttaaattgcattttaaattcttgatattgctttatttatactgaaggttggcttttctgaggacttgaagaatctctttggagtctccttgcttcccgctggtattagcacgtatgtctccatttcctctctataaaccagaacatgttcctaaactcagaaaacaaccctctggattttttttttctgcccagtccttgcaaattaactcttgtttgttttctaccctctttccattaaaattgactctcagatgtgcaaaagtg

SEQ ID NO: 342273 - DNA, 788 bp, Homo sapiens
agccaggccactcatcagagtccgggagccactggcagagagggcacggccccacactgccccagagacatataggagccaggcaaacaccagggcgagtgagctcgggccatctgctgcctgcctgtggaaggagcgctcgccagcctcacccagcccgagaaggtccacctctgcctccgccggagctgccctcattctggctccagtaagtgctgcttcttcctcctgggtttttttccactaccctattcagtaaccaggccactcctgtccctgtgggaaactcttgctgccaggaactcccagctgtctgctctcctgggcaaaaaagttccttcttcctgagccctcctctcaccatccaagatgtggtcaaaggtctgtgctgagtggaaaccctgaggcctctgctcctaggggagcctccccagctgctggcactcactgccccagcagggaccacatgcaccctggctgctcctgaacacctgtctgctggctcccctgggccccatggagacctggcggaaaggctccttccgcaacgcctccttcttcaagcagctgagcctggggcggccacggcggctccggcgacagagtagtgtgcttagccaggccagcacagcaggtggggaccacgaggagtacagcaaccgagaagtcatccgggagctacaagggaggccagatggccggcgcctgccactgtggggggacgagcagccccgggcccccctgctggccccacccaagcccccacgcctctaccgagagagctcaag

SEQ ID NO: 342274 - DNA, 242 bp, Homo sapiens
ttccatggcgcttaactcttgatccccaagtaggatcgtagccttggaggtggcttggtcattctctcagacaatcactcagaaaatcgttttgactaatcaccttcgtactggctctgactgaccaaccaccctttgtactggccacactgacaaacccatggaggggatgagagtttaagttccgtttgagaattgtctttcctggtttctctctttaagattacagttaaggataggtg

SEQ ID NO: 342275 - DNA, 799 bp, Homo sapiens
ggtagagtaagaaatcagaaactacactcggcatttcaacagaaagaattgattataaagtattggttaaataggcattcatgaaatggaaaggcaaagagaaccccaaggtgatgcagagataataacgtctggaagcagctttctcctgctagttttgagagaaaaagtgaagaggctgcagttatcagaatagagaattgtggagcaggggctctgaggaattggacctcacacttgtgaggatggggtgctgcccagctggtgccagtaactcaggagctcagaaggtgggtcttccaaggtagagcgctgccaatgagggtggttccaggagtgccataagaaagctggcacaagacccagtgcttccagcattaagggtcattgctggggctgcgctgatgggaacaacaaatggaacaaaagcatgtcccattcttctctttctgccgtcccatcctcatctattgcttcaatcagcagaatctgcaggaagccagcaggtagatgagaaatgtagtttgcagagtgccacagcctcagtaagcagggtcaagaagggtgggctcagagctaagagacagtatagtttaatttctggcacaaccaggtagtcaacaaaggacttctatccagaatacagactatcttgataagaaaatagccaaaaggagaggagaaaaataagcaaagaacttgacaagcatttcttagaagtaacaggaaagactactagacatatacaaaatgcttaacctcagtggtaatcaggtaaatgcaatttaaaatggaatac

SEQ ID NO: 342276 - DNA, 684 bp, Homo sapiens
atcatgtgcccactaagaaagacacctgtggggctgcagtggccagccatgccctcagcacggcacaaattctgtttgtgccactgaatctctccccaaagggctgctgagaggcctgtttctatagctgggctgggaatgagacagagccccttgcaggctttagagctcttcctgttgattcaggactaaaagcttttcattcaacttgtgatgtcagaaagctgggtgactgaccgccactgcacagtgacttgatggcccctttgaagcacaggcccacaaggatttgcaggtaaattgcaaatggccaatatccagtacaaacagccacccactgtgcctgtccccctggcagccactgcttttggattactgccccttcacccttggtaatgcaggcacacgggcacgcagtgcgggactggtgggcaactctgcccacggccaggcacaggatccactaggcaaagccagctgggcttctgagtcaggtggggacttggagaacttttatgtctagctggaggattgtatatgcaccaatcagcactctgtgtctagctgggggtttgtggatgcaccagtcaccactctgtatctagctaatctggtggggacttggagaacttttatgtctagctagaggattgtaaatgcaccaatcagcactctgtgtctagc

SEQ ID NO: 342277 - DNA, 382 bp, Homo sapiens
  misc_feature (366)..(366): n is a, c, g, or t
acttgttaccgcgatcgcttagactagattttctgagaatacctagttttactctcaataagccattaagtcctacattactggatcccacccacactagaaagatattcctgctattacccagagtccatagtccatagtaaagatccttcatccaagcaatgataatgataaaaactcagtctcgtctgtaagaactcccaaccaaaagaagttaaattaaatcaaatacccagaaggaccaaacaactagacagtgctaaccagataggaggtccaaaaaacaaaaaaatcacttaccggccgggcgtggtggctcaagcctgtaatcccagcactttctatggcttcttatcagtgcttatncccttaagcggatcag

SEQ ID NO: 342278 - DNA, 297 bp, Homo sapiens
tgtttttgagatggagtcttgctctgtcgcccagatgcaatgccgtcatctcggctcactgcactccagcatgggtgacagagctagactcagtaccccacacacacacacacaacaaaaaaatcacctaccaatagcacagtccctggaatgatttcttctactgtaaactgactaaagaaatacaatttggaattatgattcttaagaggttaagtgtataggctttgttatctgcctgggtttaagtataagatctatccttattagctatatgactttgggcaaagtatcaac

SEQ ID NO: 342279 - DNA, 718 bp, Homo sapiens
acttgttaccgcgatcgcttagactagattttctgagaatacctagttttactctcaataagccattaagtcctacattactggatcccacccacactagaaagatattcctgctattacccagagtccatagtccatagtaaagatccttcatccaagcaatgataatgataaaaactcagtctcgtctgtaagaactcccaaccaaaagaagttaaattaaatcaaatacccagaaggaccaaacaactagacagtgctaaccagataggaggtccaaaaaacaaaaaaatcacttaccggccgggcgtggtggctcaagcctgtaatcccagcactttgggaggccgaggtgagcggatcacaaggtcaggggtttgagaccggcctgaccaacatggtgaaaccccgtctctactaaaaataaaaaattagccaggcttggtggtgcacacctgtaatcccagctactcaggaggctgaggcaggagaatcacttgaacccgggaggcggaggttgcagtgagccgagatcatgccgctgcactccagcatgggtgacagagctagactcagtaccccacacacacacacacaacaaaaatacaatttggaattatgattcttaagaggttaagtgtataggctttgttatctgcctgggtttaagtataagatctatccttattagctatatgactttgggcaaagtatcaac

SEQ ID NO: 342280 - DNA, 683 bp, Homo sapiens
ggccactttgatgccatttgctaagacctacagctacctgacccccgacctctggaaggagactgtattcaccaagtctccctatcaggagtccatagtccatagtaaagatccttcatccaagcaatgataatgataaaaactcagtctcgtctgtaagaactcccaaccaaaagaagttaaattaaatcaaatacccagaaggaccaaacaactagacagtgctaaccagataggaggtccaaaaaacaaaaaaatcacttaccggccgggcgtggtggctcaagcctgtaatcccagcactttgggaggccgaggtgagcggatcacaaggtcaggggtttgagaccggcctgaccaacatggtgaaaccccgtctctactaaaaataaaaaattagccaggcttggtggtgcacacctgtaatcccagctactcaggaggctgaggcaggagaatcacttgaacccgggaggcggaggttgcagtgagccgagatcatgccgctgcactccagcatgggtgacagagctagactcagtaccccacacacacacacacaacaaaaatacaatttggaattatgattcttaagaggttaagtgtataggctttgttatctgcctgggtttaagtataagatctatccttattagctatatgactttgggcaaagtatcaac

SEQ ID NO: 342281 - DNA, 345 bp, Homo sapiens
acttgttaccgcgatcgcttagactagattttctgagaatacctagttttactctcaataagccattaagtcctacattactggatcccacccacactagaaagatattcctgctattacccagagtccatagtccatagtaaagatccttcatccaagcaatgataatgataaaaactcagtctcgtctgtaagaactcccaaccaaaagaagttaaattaaatcaaatacccagaaggaccaaacaactagacagtgctaaccagataggaggtccaaaaaacaaaaaaatcacttaccggccgggcgtggtgggtatcaaaggggtaccgaagctcggaaat

SEQ ID NO: 342282 - DNA, 383 bp, Homo sapiens
actcagctctcatcttcaagaagtgcactgagtttacggggataataagagagatatccattccagactgagcatacacaacccacattccacagacattagaaggaaagagaaaggagtcgaagggaagtgctagcttcaagaagcaagagaatggagccctatttccagctttgccaccaactggaaagtcatttgccctctctgggtcctagtttcctcatctgtataagaaaggactaggaccagagctcctccaatgtgcctgtgcagcaaacctctgacagtctatgggatttggaaattcagaggaggtggatgtcaatgttggcagaggtattgtggacatgtatcctcaaggatgtggaagttgagttgtccct

SEQ ID NO: 342283 - DNA, 225 bp, Homo sapiens
aaaaccagtatttggacagaaagaaaaagactttacaactcttcagcccttttagatgttgacataaatttggaactcgttctttgtttccctgaaaggagcatatattataaattataaaatacatgatttttaattgtattgtatttagtagctctgtctgtcatgagagtaatgccacgtatttctagcttacagtttattttttatctagtcaaaaactga

SEQ ID NO: 342284 - DNA, 191 bp, Homo sapiens
aattgtgttgcagtttttaacattcataacacatttcttgaataagctgcaaatgcttttaataatatatctcagagttaattttagctatgctacattggcactttttgctcctccacttcaaaaaaccaacacaagaaactattctcaaatcaagctgtgatttggatggggcattgtattttcctcaa

SEQ ID NO: 342285 - DNA, 4963 bp, Homo sapiens
  misc_feature (2720)..(2720): n is a, c, g, or t
  misc_feature (2909)..(2909): n is a, c, g, or t
  misc_feature (2916)..(2916): n is a, c, g, or t
  misc_feature (2924)..(2924): n is a, c, g, or t
  misc_feature (2966)..(2966): n is a, c, g, or t
  misc_feature (3181)..(3181): n is a, c, g, or t
  misc_feature (3376)..(3376): n is a, c, g, or t
  misc_feature (3509)..(3509): n is a, c, g, or t
  misc_feature (4041)..(4041): n is a, c, g, or t
  misc_feature (4046)..(4046): n is a, c, g, or t
  misc_feature (4122)..(4122): n is a, c, g, or t
  misc_feature (4128)..(4128): n is a, c, g, or t
  misc_feature (4144)..(4144): n is a, c, g, or t
  misc_feature (4306)..(4306): n is a, c, g, or t
  misc_feature (4333)..(4333): n is a, c, g, or t
  misc_feature (4347)..(4347): n is a, c, g, or t
  misc_feature (4391)..(4391): n is a, c, g, or t
  misc_feature (4409)..(4409): n is a, c, g, or t
  misc_feature (4443)..(4443): n is a, c, g, or t
  misc_feature (4512)..(4512): n is a, c, g, or t
  misc_feature (4553)..(4554): n is a, c, g, or t
  misc_feature (4870)..(4870): n is a, c, g, or t
  misc_feature (4914)..(4914): n is a, c, g, or t
agatgacacactgaacaaaaaaacttctcctggagtaaaatcatgtgaaagcagtgtgtgtggagaagtcttcgtgggtcattcttcccttaataggcacattagagctgacactgcacacaagccgtctgagtatcaggaatatggacaggagccatataagtgtcaacaacgtaagaaagccttcagatgtcacccctcctttcaaatgcaagaaaaggctcacactggagaaaaactctatgattgtaaagaatgtggaaaaaccttcatatcccattcaagcattcaaagacacatgataatgcacaatggagatggaacttataaatgtaagttttgtgggaaagcctgcccttgtctcagcatatatcttatacatgaacgagttcacactggagagaaaccatataaatgtaaacaatgtggtaaagcctttagttattcaacttcccttcaaatacatgaaagaactcacactggagagaagccttatgaatgtaaggaatgtgggaaagcattcggtagtcccaattccctttatgaacatagaagaactcacactggagagaagccatatgaatgcaaacaatgtggaaaagccttcagatggttccattcctttcaaatacatgaaagaactcacagtgaggagaaggcttatgaatgtaccaaatgtgggaaagcattcaagtgtcccagttatctttgtagacatgaagtgacccactctgggaaaaagccctgtgaatgtaaacaatgtgggaaagcattatcttatcttaactttcaaagacacatgaaaatgcacactagaatgagaccttataaatgtaagactgtggaaaagcctttgattctcccagttcgttttgaagacatgaaagaactcacactggagagaaaccttatgaatgcaagcactgtggtaaagccttcaatcgttccagttcctttcactatcatgaaaggactcacactggagagaaaccctatgaatgtaagcagtgtagtaaagccttcatttcttccacttcctttcgatatcatgaaaggactcacactggagagaaaccgtatgagtgtaagcaatgtgggaaagccttcagatctgcctcacaccttcaaatgcatggaaggactcacactcaagagaaaccctatgaatgtaagcagtgtggtaaagccttcattttttccacttcctttcgatatcatgaaaggactcacactggagagaaaccctatgagtgtaagcaatgtgggaaagccttcacatctgcctcacaccttcaaatgcatgaaaggactcacactggaaagcaactgtatgaatctaaacaatgtgaaaaaacctttggatctgtcagaaaccttcaaattcatgaaaagacacaccctggagagaaaccctataaggaatatggaaaagcattcaacaatttctcttcctttcaaatacatgcaacaatgcacagaggacagaatgcctatgaatgtaaagagtgtgacaaagcattcatatctgccaagatccttcgagtacatgcaagaacacaccctggagagaaaccctatgaatgtaaggaatgcggaaaagcgttcaattatttttcttctttgcgtatacacaaaaggatgcacactggagagaaaccatattaatgtaaggattgtgggaaagcattcagtttgcctggttcctttcgtagacataaaagggctcacactggagtgaaaccgtatgaatgcaaggaatgtggcaaagccttcacttcttctggttcctttcagtgtcataaaaggattcacactggagagaaaccctatgagtgtaagcagtgtggtaaagccttcatttcttccactgccattcgtagacatgaaaggactcacactggagagaaaccctatgagtgtaagcaatgtggaaaagcctttatttctttcagttccattcagtaccatgaaaggactcacactggagagaaacagtatgagtgtaagcagtgtggtaaagccttcatgtcttctactgcatttcagtatcatgaaaagacccacaccagagagaaacactatgaatgtaagcagtgtgggaaagccttcatttcttccggtagccttcgatatcatgaaaggactcacactggagagaaaccctatgaatgtaagcagtgtggtaaagccttcagatctgccactcaacttcagatgcatagaaagattcacactggcgagaaaccctatgaatgtaagcaatgtgggaaagcctacagatctgtctcacaacttctggtgcatgaaaggactcacactgtagagcaaccctatgaatataagcaatatgggaaagccttcagatttgctaagaaccttcaaatacagacaatgaatgtaaacaattaaatgtttatagcagctgcatactaacatgttattctgtattttttttttctttttgagacagagtctcgctctgtcacccaggctggagtgcagtggcgtgatctcggctcactgcaagctccacctcctgggttcacgccattctcctgcctcagtctcctgagtagctgggactacaggtgcctgccaccacacccggctgattttttgtattttttagtagagacggagtttcatcgtgttagccaggatggtctcaatctcctgacctcgtgatctgcccgcctcagtctcccaaagtgctgggattncaggtatgagccaccgtgcccggccgttattctctattttttgttgttgtttgagatgagtcttgttctgttgcccaggctggagtgcagtggcatgatctcgcctccgggttcaagcaattctcctgcctcaggctcctgaggaaaaagattcctaggattacaggtgtgcaccaccacacttggctnatttttntatttttngtagagatgaggtctcaccctattggccacactggtcttganctcctgacctgaagtgatccacctgccttagcctcccaaagtgctgggatgacaggcatgagccactgcacccagctgttattctctatttaattaattgagaagccataataaaatatctcagtgccatcatgcattagatcaagtttatgttaccacattattttttggacattgtgagtcaatattaccaagtggacaaaatcccaggcatntttttcctcatgtaaattttaattttcatgcttatatacttagaacatttatcttggtcctaattttttgttcattcataataccaaaagttatctcatgttcttcagagtgactttgtgccatatcccacagtggcatacctgtcttcaaagagggtataattcacaaaaggacttacactagaggaaaacccnatgaatgtaagctgcgtgggaaagcattttctgatctgagtggcattgaaacccacatggtattgcacatgacagataggcctctctccccgttcatttctttttttttgagacggagtcttgctctgtcgcngaggctgagaacagtggttccatctctgttcactgccacctccacctcctgggttcaagtgattctcctgccccagcctcccaagtagctgggattacaggtgaccgccaccacgcccagctaatttttgtatttttagtagagacggggcttcactatgttggccaggttcgtctcgaactcctgacctcaggtgatccacctgcctcagcctcccaaagtgctgtgcatacaggcatgagccactgcacccggccttctccccattcattttcaaagacataaaaggatgcacaataaagagagaccctctgaatgcaagcaatatggaaaagcattccattgtatcagatccttttgtagccatgaaagaactcgctgaagagaaaccctgtaaatgaagggaatgtgaaaagccttcattcctgaaatgaagcaattcatactattaatatatgagagaaatcctattataagaaattgattgctgtgcacggtagcttacctgtaattccagcacttccagaggctnaggcnggtggatcacttgaggtcaggagttcaataccagcctgggcaacatagtgaaaccctgtctctaccaaaaatacanaaattngccaggcatggtggcncgtgcctgtagtcccagctactcaggaggctgaggcaggagaatcacttgaacccaggagctggatgttgcagtgacccgagattacgccactgtaccccagcagagtgagactccatctgaaaaaaaaagcaaggggccggcacggtggttcacgcctgtnatcccagcactttgggagaccaaggcnggcagatcacctgnggtcaggagttcgagaccagcctggctaacatggcaaaaccccntcgctactaaaaatacanaaaattagatgggcatggtggcacatgcctgtantcccagctacatgggagactgaggcaggagaattgcttgaacctgggaggcggaggttgcagtgagccnagatcacagcattgcacttcagcctgggcaacaagagtgannctccatctcaaaaaaaaaaaaaaaaaaaattgaggaagcattcagttgtcccacttcctttcaaacaggaagagacactagagagaaaccctctgagataactgactgttgaattaagaagagaggcctggccggacacagtggctcacgcctgtaatcccagcactttgggaggctgaggtgggcggatcacgaggtcaggagatcaagaccatcctggctgacacggtgaaaccccgtctctactaaaaaatacaaaaaaactagctgggcgtggtggtgggcgcctgtagtcccagctactcgggaggctgangcaggagaatggcgtgaatccaggaggcagagcttgcagtgaancgagatcgcgccactgcactccagcggcgacagagcaagactccgtctc

SEQ ID NO: 342286 - DNA, 99 bp, Homo sapiens
acctgatgtcagctggcaaaggagagacattgaccacgtccagctcccgtaattcaaaggaaggcaaagaagggtatctgcagctgagaggtaacacat

SEQ ID NO: 342287 - DNA, 477 bp, Homo sapiens
aggtccgttgagtttatctattctgaggaacagaaagaaaaaagaatgaagaaaaataaacagagcctcagaacattctgttctgtttatggggactccacaaggagagggaggaaagtggcaggaatgatagctgaagaaatgtctgaaaacttcccagatttgattaaaaatatcaatctgcacatcaaagaagctcagcaaatgccaaatagtgaaaaataagagatccaaaccttgacacataataatcaaacagtcaagggccatagaaaaaaataatcttgaaagcagtaaaaaagaaacatgtcagggggatcctcaattaaaaattatcaactgatttctcatcagaaattatagaggccagaaggcaatgggatgacatattccaagtaacaaaaaaacactgtcagctgagaattattttatccagcaaaaccattcttcaaaaatgaaggaaaagcaatatattcc

SEQ ID NO: 342288 - DNA, 505 bp, Homo sapiens
cagagtgaggaaaaagaattgagaagaagtaagaggtaggcactttaggtagaacagaggtaccttggtaagaatcgagagaatgttaggaaaaatttaagggactcagttgatccaacttttttgctcaggactgtttaagaagcaggaaatatagccatgcttcttaatctccagtcaagctacctgatttgatctagatgtgattgagaactattatttttaaatgcaattataacatgagaaaaggtatgtgggaatgaccattctggcagtgtggacttgaatgggagaaactatggaagatccgtatggtcttttatattcaccagtaactggagagattatttatgatttattgtggatcttctgtatggcaggcactggattaggctttccccatcttttctatcttcattctacaattagtttggaaggtagatattgctgtttgcaggtttgttgttgttgttgttgtcgtttgttttttgagacagaatcttgc

SEQ ID NO: 342289 - DNA, 370 bp, Homo sapiens
tagagatgatgtttccctatgttgcctaagctggtttcgaactcctgggctcagcatcccccatgaagtggcgctgaaagatcacgatagcacagttccatgatgtgaaataccacaagtctgcaatttttcggtcttgagagtgtcgctgggctgagaggatggaaatctttcagtaattataccagtttgtattcgtctcacatttgggaccaaatacaaatccgatccactctttctccctgtgaatattcataaaaaacaaagtgccaattctggtctaatcatgtatggaaccaaatatgttgatgagtcctaagtatatactgtatgtatgtatacatatgaatatatatatttgtacacacta

SEQ ID NO: 342290 - DNA, 680 bp, Homo sapiens
cgccgcagctcgcgtgacgcaccgcggggcctcgcccgggtgttcgctccgccgcctgtccgcggatcggcgctgcgagccccgcggctgcctgcgggacacctgagcgcggagggtgcggcaccttggcaccttgaccctgtggcagggacatctcggcccaggaaagaatgaggtttaggcacggcctaaccacctaagtgagggcactgaagctgccgggggaagggcaaggtccgcgttgcagagcccaagcccagtggcgcaggatttgttttggtctcagtttgcttcatctctggaatggagatggtttcctatgtgatcatgaaaatttctcccagctctgaagaccttttattttcatcccccatgaagtggcgctgaaagatcacgatagcacagttccatgatgtgaaataccacaagtctgcaatttttcggtcttgagagtgtcgctgggctgagaggatggaaatctttcagtaattataccagtttgtattcgtctcacatttgggaccaaatacaaatccgatccactctttctccctgtgaatattcataaaaaacaaagtgccaattctggtctaatcatgtatggaaccaaatatgttgatgagtcctaagtatatactgtatgtatgtatacatatgaatatatatatttgtacacacta

SEQ ID NO: 342291 - DNA, 1479 bp, Homo sapiens
cgccgcagctcgcgtgacgcaccgcggggcctcgcccgggtgttcgctccgccgcctgtccgcggatcggcgctgcgagccccgcggctgcctgcgggacacctgagcgcggagggtgcggcaccttggcaccttgaccctgtggcagggacatctcggcccaggaaagaatgaggtttaggcacggcctaaccacctaagtgagggcactgaagctgccgggggaagggcaaggtccgcgttgcagagcccaagcccagtggcgcaggatttgttttggtctcagtttgcttcatctctggaatggagatggtttcctatgtgatcatgaaaatttctcccagctctgaagaccttttattttgtaagaatcattgtgaaggtatgggcttggcaaatgaatggaaagatgagcaatgggagaggaaagaattgaagagggctgtgaggtttgaagaatggcatcccccatgaagtggcgctgaaagatcacgatagcacagttccatgatgtgaaataccacaagtctgcaatttttcggtcttgagagtgtcgctgggctgagaggatggaaatctttcagtaattataccagtttgtattcgtctcacatttgggaccaaatacaaatccgatccactctttctccctgtgaatattcataaaaaacaaagtgccaattctggtctaatcatgtatggaaccaaatatgttgatgagtcctaagtatatactgtatgtatgtatacatatgaatatatatatttgtacacactaattttgcttgtgtcctcctctgtgcaatttgtttgtttagtataggggttgctgttataatgtgttaataagctgctgaaagcttggcacctattacttgaaatgacagctatgttagaagcctattaacactccatagcagcagctctgcagctactagaaatgaatttcaaagaaggtaaatgaacaaaagcgattcatatctctaaggaaagcaaataccatgcctagaaccatatatactttggaaatgtacagtgtataaaatgaaaaacctcttccagttaaagaaacagcggaagggaatatttggggaaaggaagactgcctaaaagatttccaaacaaccttgaagatgtaaatgtaaaggataccaaacataacttcctctctttgtttctattgtatttaaaccagatccatgtcaaacttataagaacagaatatagtacaggtagaggaaattcacttttcatgagcaaaagttaaatcatctggatttagctcaaacttctttttcttcatttctgagcttagaaggacaccctttgctattgttctcggaagcagggctctttatgagtcagcttgctctgcttttgaactactttacttacttttgactgtcattggaatttgcaagatggttgaaagtcctgggtaaaccttaaccatgataataaaaatgtggtaagttaaaa

SEQ ID NO: 342292 - DNA, 412 bp, Homo sapiens
ctttgatagaaaccccaatgcctggaagtccatctctagcaatatgttgacagaaaaacttggctcaggaggaggccagagagggacctctctggatgcacttggtaaaaccatcttctgctactctagctcccttggccacaggtgcgggggaaatactgccagttaatctggtaggtcggtgtaagtgagcttctcggtaatcagataagcgaggaagccgacacccacagatcgctgctggctttctcagacaggctaagcattcaatctgccaattttttccaaaattctcacctttgctagtggaggggatttcagagggtgggaaagtatcactgattctggatgatccatgatgatgtggtttcagggagaggcagatggtgccctgggtgacatcacacattac

SEQ ID NO: 342293 - DNA, 422 bp, Homo sapiens
ccagtgcagattgaccctcaaacaacatgggggttagcgccccagccccacacagttgaaaacttttgactcccccagcacttaactactaacagcctactgttgactggacgccttgcgataatgtaaatagccgatgaacacatatttcctatgtggcctgatttatatgctgtattattacaataaaataagctagagaaaagaaaacgtggttaagaaaaccataaggaagagaaaatgtgtttactatctggtaagtggaagtggatcattacaaaggtctccatcctcatggtcttcatgttgagtgggctgaggaggaagaggagaggagggatcagtcgtgctgtcttagcggaggatgactgttgatgccaatgcgaatggaatgactgcagcccgggggatacagttgttct

SEQ ID NO: 342294 - DNA, 468 bp, Homo sapiens
taaaggaaatattttaataaattagtgggtaatatctataatgactaatttatgataaattgttggtgttgacatgtactcctagttaaaacggcaactctcagcattgttgtccaggaagcacactgcaccagcattgtcttctaatttcgcagctgcctgggaggtgggcacctaggtttctccatttaactgatgaagagccaaacaccaagagacaaggttagcaatggcccagctgggactcgcaccattctgctgactctctgtcctgcctttttagtacccatgctcagccaagcatgctagaacactcaccagcgtctagggacaaagtcaagtagaaaagccaccactggtttctccatcagaaatagagagtgctgggagggatgggctcttggtcagactctgtgtgtcttatggttttgttcatcacatcccaatcccagataatatttcagaaat

SEQ ID NO: 342295 - DNA, 225 bp, Homo sapiens
tcatataagtggggacacatagagaggggtttgtaatggtcatcattctcatttttattttaggtgattcactccatggtgttcattaagttaataattaaaataatcaattgattaagtcaattaagaatgaagtgttaattgtgggtcagtggtgagaaagagggccagccatggaccaatgttgagaatgtggcacaagccaaggattatggtcaatccagt

SEQ ID NO: 342296 - DNA, 775 bp, Homo sapiens
ggacaccccttttcctggcctggacttgtctataaggagccaacacttaatcagtacaaaaggaaacagaagaatggaggaaggcattgtcttaccttgttaccgaaggtctccctcaacccacctctgtatcaattaaaaccacacagccccagttatgcagccagtgcactacaaggaaggccaccgctgcacgtcctgagggattccacagaagagcacacacaggaagtcatctgaactcactgaagaattagcgccgacgtgggctacagcaggaccctccattgaatgacaatacatttcagctgagcagctttatacataagtgcttgaagttactccttctctcagctctgttgtggatttctggcttctcagcccattgcccccagcccccaacccagctctgcagaaagtgaggtgtctgcagcgtgtgctccttggcccacagccatccgtcacctgtatctcaggtgatcccaggcacacggccatgagatattaaagcaatccctcctagtcataagagaatggtttcaatttaacaggcaaggttgagagcattttcaagttacgttcggccagatgagtactggcaacaatacctcattcttcttgcagaagggatataaggtgagagatatgaaagtccaggacatcaaacgttcctacctgactttgttcttaataacagaaattccatcttaaaaactgtacccaatccacactctgtgtgcttgctttaagaatataaaatctctcccctccatcc

SEQ ID NO: 342297 - DNA, 198 bp, Homo sapiens
agtgtctacgggtgccattaaattctaccctttggcctttctctgtgtctctgttaagaacaaaaacactatcatggaggcaaacacccattgccaataactaataactaattgccaataactaatcatcctgttttcttctgtatctgagagtttctaggggaggaacagagaaattttcgagcagagttgcctaag

SEQ ID NO: 342298 - DNA, 452 bp, Homo sapiens
tagagatggggtttcaccgtgttggccagggtgatcttgatctcctgacctcgtgatccgcccgccttggcctcccaaagtgctgggattccaggtgtgagccactgcacccagcccaatggcatgctttaacaactgcgttagtgagggtaccatctaaattgctgtagcaaagagactcttaaatcagtggttcaaacaagctacaagcttatttctctctcacgcactggtccagccacaggtagctagacctagtagaatggctctgccattttcgatatgtggtttccatctttggttccatgttagcttttccgcctcaccattttccagtccatatgaagtgagggaagagccggggaaatgcacattcagatttatgcttccatcccattggccagaaattagttacataatgacactgagctacaaggaaagctgacaaatgt

SEQ ID NO: 342299 - DNA, 367 bp, Homo sapiens
atgaatagcagagacagaaagcagaaaagaaatgaagaagagttaactatcatctaatatgcaagtgttatgggaaaaaaagtattttggaaacacagggaagtaagcaattaccaattactttgtgtaggactgggggattaggaaatgtttgtgatttttttttttttttgagatggagtcttgctttgtcacccagggctttacgatttttggaaagggtagatgaacactgaactaaaagccaccagctgcttttgtcttttagagagtaagtttgtctttaagcttgtctttgcaggaagacattgccctttcttttttagctataaaagtttaagatggcatttttttcaaatataaagct

SEQ ID NO: 342300 - DNA, 706 bp, Homo sapiens
ctgcgccccctggacatcctggcggaagtggtcccttctgatggcgccacaagcgggatcaggatagttcaggttcacggtgcacggggactccagctctcagtagccgccccccgcaccatgagcttcccagcatccaggattttctcccagtgtgacctcttccctgaagaattttccatcgtcgtaactttgagagttcccaatcttccacccaagaggaacgagtacctgctgacggtggtggcagaggagagcgacctgctgctgctcggcctgcggttgtcacctgcccagctgcacttcctgttccttcgcgaggacacggccggcgcctggcagacccgagtgtccttccgcagcccggccctggtggatggccgctggcacacactggtcctggctgtgtccgcaggcgtcttctccctcaccacggactgcggcctcccggtggacataatggccgatgtgcccttcccagccaccctgtcagtgaaaggagctcgattcttcgtcggcagccggaggagagccaaaggcctgttcatgggactggtgaggcaactggtcctgctgccgggctcagacgccaccccaaggctgtgtcccagcaggaacgccccgctggcggtgctgtccatcccacgggtcctgcaggctctcacggggaagccagaagataacgaggtgctaaaatatccctatg

SEQ ID NO: 342301 - DNA, 739 bp, Homo sapiens
gtgagccaccgcgcccggcccaaactaatttttctctaaaactttattaatatttcaaaatattttaaaagaactgaactagcaatactaaaaaaaaatctgtttgcagtttgttttcataatatgaatgccataaatgcctttaatgatttgttcaaaattatatgaagttgtagctctgtaccttctgtaaattgatttcctcaggacacatttctagttacataggcagtctctaattgaaacaaatggattagtttccagagtccacttgaataggcagttgtttgggatcttgaaaatacttatctatagaaacagtgttgtaaataagagagtctcagattatcaaatgaaacttatttaaatccatgtaactgaactaataataccagctgcagttttatcctggctgtaaggactaccatgatgggaaaaaataagaggaaaccttaccctcccccatatccatttgtggacccagatacaatccaagatcttttttatattttctcatttatcttcttcttctcttattccattgctgtttagaacatcccaggatcttattgtttgtacttatttttccaccttgctgtaataccagttcttctagtctgagtattgttgatcttgggtcttagggatgaatgtatcagccatttcataatgtatcatggtctctcaatgacagggattgtcttgcctccaactcttgctcctctttcattagatgtgc

SEQ ID NO: 342302 - DNA, 337 bp, Homo sapiens
agtggcccaaggcctcagaagactagaaggaagttcctggccattcagcatgctctcccacttctgtggcaggctcttctttatcctcaggcttcagctcagacatccctcacctgctaggccacagcagctcctgcaaagcttcccacggtccctgctgctctccctccccgcacctagtgttacttggtctacatctctctcccagcaacttgtaagctccacaacgtaaggacgcctcactcatcacagtatccccagcatctggtgctgctcctggcaccagcaggtgctcactatattgagtttattgatgaatacaagttagtacttaatc

SEQ ID NO: 342303 - DNA, 898 bp, Homo sapiens
tctcccctacttccttctcacacaattgtgtggccagagtagccggaccaatggctccaaactacccccaaatactcatccccgcctcactgcttgggcccccttggcttcccctaggccagctcacactcaaggtccagcttggatcggagctcctacaggaagccttccccagccctgctctgctcggagacctcttcctcctccatacctacctctcccacttctgtggcaggctcttctttatcctcaggcttcagctcagacatccctcacctgctaggccacagcagctcctgcaaagcttcccacggtccctgctgctctccctccccgcacctagtgttacttggtctacatctctctcccagcaacttgtaagctccacaacgtaaggacgcctcactcatcacaagaattccaccaatgcaattcaacactgcgagggggcgccactcagtacaagccaaggaacctcgcaagaggctcacagttgagtgtggaagacagacgtacacacaaataactggactatggagcaggagaatgcaaagctcttccacccaggagagcccggtggcccaagagagcacgggaccacatggggcactgttgggttgtccttgtgggtgtcctctcttgctggcctgtgacccttgtgggagcacgtgcatgagctgggcagaggaatgagggatgccctttgtgtgcttatttttcctacagagtgagttgtggtctttcggtgacctctcttggccatttaaagctgcccttgacattcactttaactggattctccagggagaggagaggggagtgccagaaggcacctgtgtaatttaccctggtgtccagcaccgcagtcttagcctggcatccccgtgtgtgcatgtgg

SEQ ID NO: 342304 - DNA, 764 bp, Homo sapiens
acacataaacagacaatggcaaccaaaccttctaaattttagaacacaggtttcctcaggggtctctgatctcttgatcattttcattttgcctggtggtttcaagacaaacttgatatagaaggtgatccttgagtcaaggcctgaaagatgaggaatcagcccccaataacttctggaatcgtgtgtcttcaggcttctggagaatgtgagagcaccaacaccaatattttgcacagcagcaggtcttatgtgggaggggcaagagtgaggaagagctatatgaaatgtgtattatttgtattagcttgtggattagtttgctgttgctgcataacacattgagtggcttaaaagaacacacatcgattatgtcagtttctggaggttaggagtccaggcatggcttagctgccatactctgcttggggtcgtagaggctgtaatccaggtgtcagccgggctgcattctcatctagaggcttgactggggaaggccgcctcagactgttggcagaatttatttcctggtggctgtagaattcatatctgcctgcttcttcaatgccaccagcagagagagaatctgtaacttctgggaaggcctggaccctcttttaaagggctcaccagattatgtcaagcccatccaggccactgttttaacttaatgtcatgtgattaaggaggggctttaattatatcggcaaagtctcttcctttgctatattttcttagttagatgccagtcacaggtcttaccc

SEQ ID NO: 342305 - DNA, 1603 bp, Homo sapiens
agggtagtgtgctccaatttttatttctccttcttatgggggatgaggatcaattatagtacaagaccatttggaaaatatgcatatatattttaaaatgaaatacaagatttccgccctcaagatctaaaccaagtaagtttgatggatggcagcacagataaagaaatcttctgaatacacatttgatttttatagctctctctttcaagagtaggatattactaagatattcagtgcaatctatcagtcctagtagtatttagaagtgacagagtgaatgctgatatttggaaaattgagcatttgaccattttggggtcactcacctggcctagtggaatagcttacactttaatacaatcaaacacagtctttctgatataaaatgtttgaatgcccagatttggttccctagttcactcaaatcatagatgttgacatacatcctgttttcataatgattttaaaaagaatgtaaatcctatggtcctccaaataaatgattcaacgtttatgtaaatgtcaagtttttgtgaatagggatttatgtctaagacagaaaaatctactgaactagttcttactgtggaactaattgtggataaaacattcgttatcatctaaattttaaatgaatgacaacagttatggacacatgcaaaaggtatcagacatagaaaatattgttgggggaaatttctgtgtggtgctaatttcttgtaagggttgtacagatagtgcttaactcaaaaagtgagagtgtggtcattgccaaataggggtttgctcagagttccttctctaggactgtatgcagaaagcatacacacacacatacgcacacagaaaaatatgatttttatatcatattcatgaaaatgtgccatatccaattataacacacacacacacacacacacacacacacacacacacacataaataaataaatgatggttcacataagaaatcctaattgctaattttaaaccaaacatttgtagttttgtttattgcaactttgctgcatgggactttgctttcataaatctatatggggttggggttaatttgccctaatttgctgacctgggacacatgtaatcactgttaaacttacacccggtaaccctgatgtgtttacatttcaaaagaaatgaaattggcctggaaaaaaattttggaagtactgtaagtcttttttctttttttttccgaagggaaatatttcaaaaaaggaaacattatgagtagacacttcaaaaaagataaaatattttacatttgttttttgactaatgtgctataaaaaggattatatttgtgagaaaagatactgatcgccaatatttcaaataccgtcttgcaatgtatagtttttagtgacattgtagtataaagctgtaatttgaaattttactttggaatgtaaagtagaaaatattagctatgtcaatgatatcttgcaaagtgttcccatttataattatttatattgtaaatagctttctgaagtaaattcgaagttaatgtgcataaaatgtatttattatgtgaggaattttttggtttaaaatatagttaccaatatgcactttga

SEQ ID NO: 342306 - DNA, 496 bp, Homo sapiens
tctaggaggtaagcaggcgcatctattcaacatggaaattaaccctccatctcctcaggccccgtaaatgcacaattacttggtgaattccaccctggagttcccaagtggcaggactctgcattccaacccatgtcttcctgaaatggggggctgtcttatctgcattcaaacccatgtcttcctgaaatggggggctgtcttacgggagtgggctgctcttctctgggctcaagtcagtacagttacctgatcaccctgtggcataaggaaggaaggcgaggagggaacagagggcggcagacgactgttggcacactcagggctcccttgaccaagcacggccctgccccatcactgcagccttcaggatgggctcagcaacgctgaggaaagaactcagctggggcctgacccagcagaagcagcaggggctggggagtgagcggaagtgcactgaaatccagctctgccacccgagggacccaggtcagat

SEQ ID NO: 342307 - DNA, 330 bp, Homo sapiens
ttatcttactgttctataagtcagaggtctgacaagagtctcactgggctaaaatcaaggtatcagcagggctgcattcctctctggaggctctagaggagaatccatttccttacttttttcagctgccagtggctgtttgcattcctcggctcatagaccccttccgtcttcaaacccagcaatgagtctttctcacattgcatcactctgatattgactcttctgcctccctcttccacctatgaggaccttgtgattactttggacccacagtgataatccaggataatctctcttttaaagtcttctgaccagcaactttaattg

SEQ ID NO: 342308 - DNA, 319 bp, Homo sapiens
cactgtctcatctttgctttattttaccagtagcaattgcatgaagagatcactcctttggagtttttccctctggttcccttgcctttaagctgactgtgtgatttaggtagctctgatttatttactgagagtggatgtttttgatctcacaaactctctgtggctctcaaatctggagctcacaacttctcgatttctgtttgcagtttggctgtgactgcaccaaggaaaggggtgcttaaacataaagacaaaatgttaaactaactcattatgaaaacagcctggttttaggagaaccagccaacagtctagt

SEQ ID NO: 342309 - DNA, 199 bp, Homo sapiens
catccatttcctcttctaacaggtgtcaaggtcccttacagggaactgcatatgcttcactggtgtatatactgtggtggaatccagaaactccctcctactacagggtctcagtgaatggggcccttcttttaacatgtccagtaaaataatggagaagtcacatgacctaagatcagccatcatgtgacctaagctc

SEQ ID NO: 342310 - DNA, 321 bp, Homo sapiens
tcatttctataacctatctggttctcgtaggtgtttcagtttgcaatcactggtctagcctacctctattccaaactaaagctattctttcgccattaataaaacgagaaccttttattctagcagacatgccgcaggaaaagttacttttcaaaaatccttctaatcttaaacaaatacagatttcattgttttgttttaacagctctgtccaagagacctttgctattgtcagaggttattctttagccaatcacaagtatctgttctaaagatcctgctcaaaaggacagcatgactgagtcaggtttaaactgcaca

SEQ ID NO: 342311 - DNA, 688 bp, Homo sapiens
accagggcctatcatgaggtgtggggctgggggagggatagcattaggagaaatacctaatgtaaatgacgagttaatgggcacaccaaaccaacaaggcacatgtaaacctatgcaacaaacctgcacattgtgcacatgtaccctagaacttaaagtatagtaataaaaaaaattcaccaaacaccacaaaaaaaatcaagattgtcaaagaaaatttccacgtcccccgaaatccaaataaatagttagacaaagcagggagttaaaccagactatggccccaattggcaaagctgtcccaaggacgacagggggaataaagctggcatggtgctctgtaagagctctgagcttgcagtcagagacatgagcacaaatctcagcactgccacttcctagctccttgacctacctacaaaacctcctgagcaacagtctttgtatttgtaaaatgtggataattgtttctaaaacccaaggctaatgtgaggatcaaatgatacatataaatatagaagtgtctaaaaactggacaccctacagtatgaattactcaaataaatgtggattactaacaaaaaaaattggggagaacagaaagtactcaacaatccccaaatcctctctcctccctacttcaaaggaagtataacagagtccaccaaatgggaatataatctccttt

SEQ ID NO: 342312 - DNA, 574 bp, Homo sapiens
gctccacaaccgaaaatagcttcctacaggcaagcttcgtgctatgttatgcctcacagcctccatattaataagcagagtgctaaccactacatgataattttgctcaaaatgcaaataaagctcacaccttagatgggttttcaggcctcacaacttattaccagcttagttagcaaagcatagccatcttcggatgagacctagaagggcctggatgcaaagaactaaaggatgatcagagtgggagattcaggaaaagaggtaccttaggaggaacggagagggaaagacagactatgattttgccagactgattctaaatacttgttgatatgggtagtaaatttcttttttgaaatattgtaatagcaagcactcaagtgtgatttcttacatggaaaatcctgacagaagggagatcctgggactgtcctagtgtatccacctattaggtttccaaactagccaacccagtgaagagaattgctctttgttgagccaggctagttacactatcttttcccactatattgctgccttagtattcatttattcattcagtcagtcattt

SEQ ID NO: 342313 - DNA, 414 bp, Homo sapiens
gtgcaacagagactgtttcaaaacaaaacaaaaacaacaacagcacaaacacctgaggttaaaataagtgaacaaatcttttcaaggtacagatcctatcacccaccccatcctgttcaggtacatgctcaataactaccctcccaggagacaccgcgccatgccccagtgagtgccccacgtgcattttactttgttaagtttttacgccctctcactggggtcagttttttttgtcttttgaagtgttttttcactacttttctgctccccacccaagagaatccaggggtcagaaattatttgttttcccctcaataccagcatctgattgtctgaccagcaatgtgtctccaagaaatggaagctaggttgggtgaagaaaatcttcatgtctcaaggggttagcttttc

SEQ ID NO: 342314 - DNA, 172 bp, Homo sapiens
ataccagtctcattcatttcccatcactacaataaaacactagtcaacaagcgggttttcagtaaccccacactccgaacaggcatttttcctcctacaattttttgtctcagatataatgccatggttacatctgacagatgttactgctttaaatcctgcttcaacactg

SEQ ID NO: 342315 - DNA, 266 bp, Homo sapiens
cctgctggggactacgccctgaaggatgtgggtcagagcagatctctgccccttccataactagacatttatagagcacctgctgtatgcagggcactgctctaggagctccctcctgatgcttacagtctgaagtgggaggaagttcgacagtggagagaaataaaattgtgacatggtgaaatgtaccagagaggacttcttgaaaaataactctttaagcagaataataaagaattgactttaaggaagtgaaacggaacggc

SEQ ID NO: 342316 - DNA, 618 bp, Homo sapiens
tggagggttggcacagtggtgatccctgaggtcccttccagctctggcagcctggcagctcctctgatgatccatccttcagggagccaaggactccccgtggaggtcctgcagggatgcccaagagttgggtggctgggaaacagctcaccgtgtgttaggctgtagacctgagtacctggccagggacccaatcgtccccagcagtcttgtcattgtgaccggccttcatctcacaggaacccaggctgggctacgtaaatgaactgagctgaactgccaggtgctggggttcaggcagagactggaggctagaagttgaggggggccaagtactgcagttgggctgggggacagtacttggggcagggttgagcttgggtccccacaccaagagctccacagtcatctcagggacccttcaacaatagccctgagggctatgcatccattttttagaggaggacatgatggggaggcacagtgggggacagtgacctggccgaggtcacacagcaagaaggagtctagatttggcttttaaccactctgcccccagccttgggcaaaggtgttcagtgtagatgtgagagtgaactgatagagaagttctagaag

SEQ ID NO: 342317 - DNA, 540 bp, Homo sapiens
agcgtcgtgtgcaggcgtccccgggctgtggataactagacacgttcttccctcattgcccaaggctcgttagaattcgccctagagctgtatcatgtattttctttcaaattaactttgcttgcaattaagcttagggaaccagcaacaaaagcaaacttggcccgaggtcgttcaccgcgaaaatggattagagaaacttcttccccgatttaaggggaaagattcctgcggccagcgctttggggaaagtgccccgaccgcagaggcgacgacaggggagcaggaagctgctcacggtagtcggcgttggcggcagcggtggccttcctcatctgggcgatgtgggctccgagaagagtaaggataacatcctggaaatgacttctgtacggtttgagcccaactgcacactcatgacttggagctgccctgtggagttacagtttaccaaacacattcatgaacataatctcatttactaaaaactttgtgagaattttcttttactaaaattttttcttattacaaaaaaaaaag

SEQ ID NO: 342318 - DNA, 162 bp, Homo sapiens
aattgttgaggggatcaaatgaaatatgtgaaaacaacttgtaagtcatcaagtaccatataaaattaggcagtgatccattatgtagtcaaatctttaaaatttgcagctagaatattataattagatgtttactagataacacatggcgcattcataatc

SEQ ID NO: 342319 - DNA, 448 bp, Homo sapiens
atttttctcttgcctgtctcctccctgcacaaacctggctagcttctgttgctagtcattagaaccacctggagaggtctttgaattacaaatccctgggcactgagaccagttgaattagaatctctggcaggtgggagctgggaatctgtattaaactccactgatacagtttattttttgcttaggaagattttctatggaaatcatggttaattattgctattgctttccttctatccattagtttgcttctctgtacaagaaagagattttagtagttttgcggagtttcttctgtgtaagaaaataaaatttgtatatctttttatagtttttagagggctcctattaacatttcattcaatcctcaacaattctgggaggtaggaaggtaggtcagatttgatcgttttaaatatctggaaattggagttcagagaattta

SEQ ID NO: 342320 - DNA, 210 bp, Homo sapiens
tgtcctctggtagaaaaaaaaatgaagaaataataactgattcaggaagtggtaacaggttgtggattagcttacagaaaagaccactcacttactaattactttcttgggctccccacttgtcccaaaatgtgtgtgtgtgtgtgtgtgtgtgtcttgtctgtctgtctgtccgtaagtggtagagtctggagatggaccacagtttaa

SEQ ID NO: 342321 - DNA, 268 bp, Homo sapiens
ctgggcaggatgccaccctttctacaataagttcggtcccagggattcccccaacacacacacacatacattctctcttactcacatcctcacacacactcacacaccccaccacactcacacactttcaaaatccaccgactctcacgctcacactcgccagccctttcccttgctctgtcacttccctccaagtccccgccccacacagcctcctgcagtcccagcccccttggtgccagccatctctggtgccagccatctcccc

SEQ ID NO: 342322 - DNA, 101 bp, Homo sapiens
gcaaacatgctgttgattgctaaatgtaagtctgatcatgatgcagaataaatgtctttttttaatgtgcaaagaaaaaagaatactgtatataatatata

SEQ ID NO: 342323 - DNA, 959 bp, Homo sapiens
atgtttggggagaataggaaaccaaggaaagttatgatgagggtacattaaattaaaaagaggatcttgggaggagccaagaagtatgagaacgagtgagtagaaaagttagagcattaggagacagtgaaattggagaaccccaggaaataaagtggttcaagaagacaaaatgataaatgggaaaatgctttttggtagtcatagatgactggaaaattatctactcctcaataaataggtcatatgcatttatgtctatattttcttaactgttaatttcacaactgagtgaagtgatacagttagctcaatggctgacatatagtaagcacttaatgagtattatttatcactacttggatctgtcattgttcacttatttcctcaatatagaaaactgagagttgtccttgaatttttctttctcctcaatcccaatattaaatcaattacagagtctcattgactatacttcctgtgtgtctcaaaaatacgttttgtgtttattccaactgcctctgtctttgctcacatgtgtaagcctttctgcattatttttccctttgcctgtaaggtccctttcaccttggcctcaatacttggctcaagtagtacccctttgtaaattttacctgaatgtctcagccagaattaggcatttatttcactgtgctctttaagcaactagtagagatttcatttgaggcacttaatttgtaatcatttatttgcatgcctgtcttttaattaaaacatagccattcaggcatagtgttctaaatatgtttatttcctacctcccatattggtacatggtaacatgtttggttttcagttaacaatatgttgagaaattgaataagtgaaaatatttacataaatagtgtttgtataactaaaaataggtgtctgatgagttcggtgatttcattgagggtacacttagtccattgtca

SEQ ID NO: 342324 - DNA, 302 bp, Homo sapiens
aatccagaagcagcattgttgttatcttagcactgttttctctttgtgtatgctttatgcaagctgattgatttttagcgttagcctagatgaactatctgtggaataaattatttgtggtttggaactacatgtatttgcttccttctcttttcaggattggaatactgtgggtaatgaagggttaattttagttcatgataatacaaaagctgaatggtttcggggaatggaagtgtacttagctaacaataactcatgcagcaaactttctggcatgtctcctacgtgtagggactgag

SEQ ID NO: 342325 - DNA, 455 bp, Homo sapiens
tgtctggtgtggaaaaaccagagtgtgtatacaactactcagtcaagaactaaatgtgcatttccaatgtcattcacgcggcaattatttggaaataaggatgggatcatgcaattttgccaacagtaaatatacagatttggtaacttcaagtgcctataatgtccaccagacagaggccttaaagcacattccacccatgttttcctccttgagaaaggcaatttgattgttaaaagaaacagtggccaggcacagtgacccacacctgtaatcccagcgctctgggaagccgggacaggaggatcacttgaagccaggagttcaagaccagcctgggcaacacagtgagaccccatgtctactaaaaatacaaaaattagccgagtgtggtgatgagcgcctgtgatcctcagcttcccaagtagctgggattacaggcatgcgccaccacg

SEQ ID NO: 342326 - DNA, 1003 bp, Homo sapiens
tggtaagtgaaagaagccaactgaaaaggctacatactatatgactccaactacatggcattctggaaaaggcaaaacgatggagacagtaaaaagatcaggggttgccatgggcttaagatggggggagggaggagtggggagagggaacgaggaaggagtgggtagaacataaaagatttttagggaagtgaaactatcctgtatgatactggtaataggggaaacatgtcattacacatgttaaagtccatagaatacataacacaaagtaaactataaaattagttaataataatatatcaatattcactcctttgtaataaatgtaccacactaacacaatatgttaatgagggggaaactgttgggatgaagaaggtatatgggaactcactgttttctgctcaattttctgtatatctaaaaaatgaagtcttttaatttagaaaaatatatctaagctatattttaaggccttaatactgtgacattaaagtgtttagacacctaaataggacacacgtattttacagttatcatgggcattttttcacattagcaaagagaggtgtaattctggcagaaatgctcagcagaatgtcatctagaatttgctttaaaataatccagttggagatgaaaggatagcaaagaggcctagatgaaaccagatgggccatttgtttctaattatagaagctgagtgttaaatatgtacaaatttattatactatgctccctatttttatgtgcttcagaacgtccataataaaagtggggggaggatatttatggttaagaaattaaaggaggccggccgggcgcggtggctcacgcctgtaatcccagcactttgggaggccaaggcaggcagatcacgaggtcaggagatcgagaccatcctggctaacatggtgaaaccccgtctctactaaaaatacaattgtgccactgcactccagcctgggcaaaagagcgagactccgtctcaaaaaaaaaa

SEQ ID NO: 342327 - DNA, 144 bp, Homo sapiens
tatctctccagcaatggatcctaaccagattgaaatgtctgaaacaactgacatagaattcagaatatggatggccaagaaagctcaacgagattcaagagaaaattaaaacccaatccaagaaaactcaaaaaatgatccaag

SEQ ID NO: 342328 - DNA, 398 bp, Homo sapiens
atttattcactatcatgagaacagcatgggaaagacctgcccccttgattcaattatctcccaccaggtctctcccacaacacgtgggaattcaagatgagatttggatggggacacagccaaaccatatcactctaagaagtagatgtagctccattttatagatgaggaagctgagacttctccctaagaaatgttatccaaggcaagactgggaggccactagaattacccaagcacagagaggagcttgagggtgggaggagagagagaacagcctagcggaaagcctggaagtgaggaataacagggagaattggcagggggtggggtgctgagtatttcagtaggcaggggtgtggagttgaagggtgtaagaggtaagtggtggtgagact

SEQ ID NO: 342329 - DNA, 627 bp, Homo sapiens
tctactttatctcctagagatctaggtagttcccaaaggaataatgctttacggagtctaatgttgatttattaggtaaaaacagaaaatgacttttttttttacccacaagttccataccaaaaaatgaatgtaaacttcttatgcagtttcacacattgaaaatgcaggttattttaattccattgcatttttcagaattctcaatcgcaatcctctgacaactgttgaagatccgtatctctttaaattactggcattaaaatatctgtaagtactatagtactcttgggagtcatgagatgatttatactctttttaaatttttcatcaaagattaagtattttgcatttaggctaaaatgtcataatttaaattttaactgagttattgaaaaacattattggcaaaggaaaggatgtgtaatggtcaagatagccagcaggggaaagagaacagtgttgaagaacccatatagatttggaacatgtagacacatggaggaatattacttaaccaagaaagcaaaggggaaaaggtgttcattattctaaaaaggaagaaaagagtaaataatcaagatgggtgaatgcaatatgaaaatgagaagtaagataatggtaaaa

SEQ ID NO: 342330 - DNA, 363 bp, Homo sapiens
tctactttatctcctagagatctaggtagttcccaaaggaataatgctttacggagtctaatgttgatttattaggtaaaaacagaaaatgacttttttttttacccacaagttccataccaaaaaatgaatgtaaacttcttatgcagtttcacacattgaaaatgcaggttattttaattccattgcatttttcagaattctcaatcgcaatcctctgacaactgttgaagatccgtatctctttaaattactggcattaaaatatctagacgtgggaacaacgcaagtcccacttacaacacttaagaacattctcatgatgaccgttgaactggaaaaactgtaagttatttttttctt

SEQ ID NO: 342331 - DNA, 880 bp, Homo sapiens
aacttctcattgaacaccactcccagctttcctacccccatttctcttcacaggtgtgcagagaagtctacattcccatgtcaagtaagtggggtgggtagatgggagggcatatgagagcggggcagcaattttatgtcttagttggaaggaagtttagagttcattgagtccaaatcctctttactaggtgaggaaactgaggcacaggagggggaggtgccattagccagggagtcagagccaggacttagaacctggtccatgcctcctagtttgttcctgaccaatcctcccagctcacccactccttttgctctcacctctgactccctacaggctacagctagagagttgactcctctatttgaggtaagagtgtctggatttgggataaggtgacctcagtttgcaggtctcatgggggagatcagagggtcctttgttgagaagaggggacttggtccacagtgagcaaaggaatttgtctaaattgctattaagggagatcatctcccaaggtgggccaagcctgaaccctcagccctccatttcttccctttcttttgccttcagattgacaggcctcggaagtcaaaataagtggtttcctagaccgggtcgagagcaagtctctattggtcccaactgagttttttcagctggtttttcaaccaaacagcacctcatctcccagtgaggggaagggaaggctgggctgagagcagcaaggctgctcatctcacctctccccacccagccatgccagccgccacacctggtggggagaggtgggcctcacctgggtcccctggcagtgctctgtgaagggtcttgacattgcactgtaataataaaggtgtgtgtgaagtatcaaata

SEQ ID NO: 342332 - DNA, 398 bp, Homo sapiens
taattgggcttgggggttcaggaggaggcagaaaagagagaagtctacattcccatgtcaagctacagctagagagttgactcctctatttgagattgacaggcctcggaagtcaaaataagtggtttcctagaccgggtcgagagcaagtctctattggtcccaactgagttttttcagctggtttttcaaccaaacagcacctcatctcccagtgaggggaagggaaggctgggctgagagcagcaaggctgctcatctcacctctccccacccagccatgccagccgccacacctggtggggagaggtgggcctcacctgggtcccctggcagtgctctgtgaagggtcttgacattgcactgtaataataaaggtgtgtgtgaagtatcaaata

SEQ ID NO: 342333 - DNA, 664 bp, Homo sapiens
gttctgctgccagcccatctcccgggctggaaagccgcaagcccttggcactttcttctgccccttgcctgacagtgtttgcctttctttggatgatggagcagtgagatcatccaggtgccccccaggggcttggcagagctgcttacttggatctgctccaggtcagccaacaagatggatttaagggtggatttaaacagagttgacaacaggttccagggtctttggcaggggtggggtaagggggccacactttggtcaccttcctgaggatcctgtcgcccttatcagcacgacctgagtggatgggcatcagacacaataagagagagaggcctatgtatcaggaccccgctggataaatgggggtttggggatcttctgtgatttgcatttcttcaataactgctgccaggaagacggatgatgaagggttaaggacacacagaagagatgagactcccaatataacaagcagggaataagacttccaactccaaacaccagtcttctgaatgtgcctgccagaattctgatcatgaagactgccgaagtgttctgaccttgcacctcagaattccaaccccgtacattagttccaacctgggacatcagcattctgaccttgcccgctagagttttaattacgaagagcaactct

SEQ ID NO: 342334 - DNA, 1037 bp, Homo sapiens
tgagctcagaaagtctttttccttctagggactgcctttttcacccaaactgttccctctgccccctcccccgacaaggcctgtcctgtaagagttaggctagcagggtaggagcaatgctatgaaaccactgctgggacccaggtcttcccagtccttcaccccgcaggtcaccctgagaaacacactaagaactccatcccccagacaggacagtcccatctacccgcagcttgagtcttggccctagtaccttgagggtgttgggggtgatggtgtaaccatcttcctcaggaattttcagccccggtgggcagggcagggcgaagtcatcgtgcaggtattttccactcatggcactctctaacagcctgtggagaagaaaagaggtgaggatgccccactgactatggttcctataccatctgccctcacccattttcctgccttacaggtgaagacagggaagccccacagcaaaaaggagaggcccagactgtgagttcccagcccggggctccatctaccggcttgacgctggaactgggaagcacagctggggttcagagggcgatgggctccctaggcggcccttcccctgtgactggccttccctctgacacatgcggctttacccacctttgtctgtccctgatgtctactgcactccacacagagccatatagggtcagctgccattgccggaggatgccgacctggaatgactcatcccctagggcagcaaggggcagctcgtgagccacgcccctctgtcagccatgccagacagcagaggccctgcccgccctgccacccaaaggggctcaggccacatggtctgctccaggagctgcctcactgtgtcccactgaccccaggttctgcagaagggcctcactgggtgcccttagggatggaaagggttgaaaggctgtactccaaagcagagtcttgcttttctctcccgtattttgggggttcagctgggattagaaaaaaatgtctttccaccaaattaaagaaagctttgaaaacca

SEQ ID NO: 342335 - DNA, 998 bp, Homo sapiens
agcatgtagtaaacggtccagaagacggtgaaacagcctaccagcaccaaggtcttgagggtgttgggggtgatggtgtaaccatcttcctcaggaattttcagccccggtgggcagggcagggcgaagtcatcgtgcaggtattttccactcatggcactctctaacagcctttgtctgtccctgatgtctactgcactccacacagagccatatagggtcagctgccattgccggaggatgccgacctggaatgactcatccccgacatccctgatgaccagcctgtaggtccctcgggctctctccccccagcatcgcacagtggagaaggtccagtcattgaagccgttgggatccctgaggaaagaacacagcagaaacaggtggaaggcgtgggccagagagctgaccttcccccagcaacactttcttactgtagtagccgtggaaacaacctgggagggtgccacgagggcttctcaggtgccccttgcccctggggtctcatggaaggaggaaattgtgttaacgtggtgtggtggaaaaagcaagcatggagcgcgcacaggcttggagtcccacggatctaggtttattcttgttctcttgggcacttactagctccatgacttgttttctttttctttctttttttttttggagacagggtctcactctgttatccaagctggagtgcagtggcatgatcacagctcactgcagccttgacttcctgggttcaagtgatcctcccacctcagtctcctgagtagctgggactataggcctgtaaggctaatctttaaatttttttgtagagacagggtctcactttgttgcccaggctggtcttgaactcctgagttcaagtgattctcctgccttgacctcccaaagtgctgggattacaggtgtgagccaccacacccagccagtttcctcatttgtaaaaggaggttacaaagtctaatctagggggttcttagaaggattag

SEQ ID NO: 342336 - DNA, 1131 bp, Homo sapiens
tgagctcagaaagtctttttccttctagggactgcctttttcacccaaactgttccctctgccccctcccccgacaaggcctgtcctgtaagagttaggctagcagggtaggagcaatgctatgaaaccactgctgggacccaggtcttcccagtccttcaccccgcaggtcaccctgagaaacacactaagaactccatcccccagacaggacagtcccatctacccgcagcttgagtcttggccctagtaccttgagggtgttgggggtgatggtgtaaccatcttcctcaggaattttcagccccggtgggcagggcagggcgaagtcatcgtgcaggtattttccactcatggcactctctaacagcctgtggagaagaaaagaggtgaggatgccccactgactatggttcctataccatctgccctcacccattttcctgccttacaggtgaagacagggaagccccacagcaaaaaggagaggcccagactgtgagttcccagcccggggctccatctaccggcttgacgctggaactgggaagcacagctggggttcagagggcgatgggctccctaggcggcccttcccctgtgactggccttccctctgacacatgcggctttacccacctttgtctgtccctgatgtctactgcactccacacagagccatatagggtcagctgccattgccggaggatgccgacctggaatgactcatcccctagggcagcaaggggcagctcgtgagccacgcccctctgtcagccatgccagacagcagaggccctgcccgccctgccacccaaaggggctcaggccacatggtctgctccaggagctgcctcactgtgtcccactgaccccaggttctgcagaagggcctcactgggtgcccttagggatggaaagggttgaaaggctgtactccaaagcagagtcttgcttttctctcccgtattttgggggttcagctgggattagaaaaaaatgtctttccaccaaattaaagaaagctttgaaaaccactggcctagagaatacctaactgactggaggatgggagggtggagctcaatttccagtctataggctgatactaaagatattcacaattcatgg

SEQ ID NO: 342337 - DNA, 1466 bp, Homo sapiens
tgagctcagaaagtctttttccttctagggactgcctttttcacccaaactgttccctctgccccctcccccgacaaggcctgtcctgtaagagttaggctagcagggtaggagcaatgctatgaaaccactgctgggacccaggtcttcccagtccttcaccccgcaggtcaccctgagaaacacactaagaactccatcccccagacaggacagtcccatctacccgcagcttgagtcttggccctagtaccttgagggtgttgggggtgatggtgtaaccatcttcctcaggaattttcagccccggtgggcagggcagggcgaagtcatcgtgcaggtattttccactcatggcactctctaacagcctgtggagaagaaaagaggtgaggatgccccactgactatggttcctataccatctgccctcacccattttcctgccttacaggtgaagacagggaagccccacagcaaaaaggagaggcccagactgtgagttcccagcccggggctccatctaccggcttgacgctggaactgggaagcacagctggggttcagagggcgatgggctccctaggcggcccttcccctgtgactggccttccctctgacacatgcggctttacccacctttgtctgtccctgatgtctactgcactccacacagagccatatagggtcagctgccattgccggaggatgccgacctggaatgactcatccccgacatccctgatgaccagcctgtaggtccctcgggctctctccccccagcatcgcacagtggagaaggtccagtcattgaagccgttgggatccctgaggaaagaacacagcagaaacaggtggaaggcgtgggccagagagctgaccttcccccagcaacactttcttactgtagtagccgtggaaacaacctgggagggtgccacgagggcttctcaggtgccccttgcccctggggtctcatggaaggaggaaattgtgttaacgtggtgtggtggaaaaagcaagcatggagcgcgcacaggcttggagtcccacggatctaggtttattcttgttctcttgggcacttactagctccatgacttgttttctttttctttctttttttttttggagacagggtctcactctgttatccaagctggagtgcagtggcatgatcacagctcactgcagccttgacttcctgggttcaagtgatcctcccacctcagtctcctgagtagctgggactataggcctgtaaggctaatctttaaatttttttgtagagacagggtctcactttgttgcccaggctggtcttgaactcctgagttcaagtgattctcctgccttgacctcccaaagtgctgggattacaggtgtgagccaccacacccagccagtttcctcatttgtaaaaggaggttacaaagtctaatctagggggttcttagaaggattag

SEQ ID NO: 342338 - DNA, 901 bp, Homo sapiens
agagcaatgcccatttcacggatgggcacactcttggcatcaactctcttggtccaatggcaaccctatatattgcacacgggacactttctgtggggactctgagatgcagagggaccagataacaagcaggaaaggtagggcctggtgtgagggcacgagactcaccgacatccctgatgaccagcctgtaggtccctcgggctctctccccccagcatcgcacagtggagaaggtccagtcattgaagccgttgggatccctgaggaaagaacacagcagaaacaggtggaaggcgtgggccagagagctgaccttcccccagcaacactttcttactgtagtagccgtggaaacaacctgggagggtgccacgagggcttctcaggtgccccttgcccctggggtctcatggaaggaggaaattgtgttaacgtggtgtggtggaaaaagcaagcatggagcgcgcacaggcttggagtcccacggatctaggtttattcttgttctcttgggcacttactagctccatgacttgttttctttttctttctttttttttttggagacagggtctcactctgttatccaagctggagtgcagtggcatgatcacagctcactgcagccttgacttcctgggttcaagtgatcctcccacctcagtctcctgagtagctgggactataggcctgtaaggctaatctttaaatttttttgtagagacagggtctcactttgttgcccaggctggtcttgaactcctgagttcaagtgattctcctgccttgacctcccaaagtgctgggattacaggtgtgagccaccacacccagccagtttcctcatttgtaaaaggaggttacaaagtctaatctagggggttcttagaaggattag

SEQ ID NO: 342339 - DNA, 163 bp, Homo sapiens
agggaattttcagcagtgaaactattttgcatgatgctgtattgaggatttaggacattacgtaattgccaaaacccacaatctgtgaaactcaaagaatgaactctaacgtaaactatggactttagttgataatgatgtatcaacagtggttcatcaattg

SEQ ID NO: 342340 - DNA, 1123 bp, Homo sapiens
agagagcttattcaactcttaattccattataaataatatttgaatgaatgtgttttacatctggaatgatttttatcatctgagtaaaggaaatatgtttgatggtagttgggaactttgaaggtattacgggctacagatgagaaaaaaatgttactacgtcatttcatgtttacatactgaccagcattttcaatgaaataagcttattactataggactataaaatgtttttcaaaggtttaactgtccagggcagatacttaagactatctgatcatccattaaaaacttttcacatagtcttgcttaaatggatccattatgtttacccattatattgttctcagctgtagttttaagaaatttatttcatttgttaatacttactttccattaccttccccttttctgtgacaatccgttgatacttgaagacctctcttgtattcatcttagggttaatatttttaaggccaaacagcctaaattctatggtaatcaactccagccttgtgtaatgaaatcttctgcataaagataggtttaaatcaaatcagattgcagattttattgaagaaattgtgtttttaagagttgacaaatatatgttgtatggctaaaacaaagaaaatacttctgttgcttctgcatttagtagaagaaaaactatatatgtttgtgaccaaagtataaaatatgattctttccagggaggtaaaggttatgcagaagattttcactagcagctctaaaaggctaccctcaattaattgccatgaacatttcatagccctagaaggatgttggctcatttcagtgtcatcctggtttattctttattgtattattcagcagtcattttaacactatgctagacactttagagattcagaagagtaacagggtttctgttctcatgaagcttatcagagacagaaaacatatgagttagatctaattggaggcaactgaaatatatagtggagttagtgtggttatcagcacataaatgagtgatccatcaacaaaaggagaaattgggagggttttatgggccaaaaacagcatgattaaatgtgatagagtatatgtcatgttttaggtgtgatgaacattcag

SEQ ID NO: 342341 - DNA, 569 bp, Homo sapiens
  misc_feature (500)..(500): n is a, c, g, or t
ggttcaatttattcacataaaagtttatataattttatctttgtgcataatttctgtttttctcatcagtgagatgaacacattgattctcaatcctctcagcagagtatttcctgtatggacattgtattctgctagaaacttcaaagatgtcagaataatcaaaatctctttgtctaggagtttgaaattcaaaaaattatgtatgacattttatacctttgcattatcttcaatgagcattatgagctgtaattcactcgactgaagtgtagattatcccagaattaattattccagtctagtgataaaaaccagcctcatttattgaaccggatagcttgccggcaagctatccggttcaattaaactttttctttgtttttagagacaggatcctgctatgttgcccaggctggagtgcagtggttattcacaggcatgatcataacatactacagccttgaactcctaggctcaagcaatcctccagcctcagnctcccgagtagctgggattacaggcacccgccaccatgcgcagttaattttttgtattttaagtagaga

SEQ ID NO: 342342 - DNA, 209 bp, Homo sapiens
agtgtattggctctgttccagggaatgacacaatcaataatgatgtgtcgttgtttagtgcattaatccaaattctcatgaagtagcagtcaggctgtggctccaatgctgaacttgttaaagaaggtataggaaaaatttaggatgaatttttgatcaactctttaaaaaggatttcttttttttttttttttttttttttttttgag

SEQ ID NO: 342343 - DNA, 439 bp, Homo sapiens
tgatcattccacctcagcctcccaagtagctgggactacagacatgcaccaccatgcctggctaattttttgtagagacaagttttcaccatattgcccaggctggtctcgaactcctgagctcaagtgatacacctgcctcggcctcccaaaggttgggattacaggtgtgagccaaggcaccctagtgccttacctatctttgttctcactttagagcattcaagtcaaatgcctaaagagatcacagaggaaaagtacctgagtttctaagtaaccaggatcttgtcacttttttttttttactttaaatacatactgattttttttttttacaaagtggtctctctagagtatataagcttttggcttaataaaatctgtatctgcctctgataaatccaatatttggtaaataatagctagattcactctgttt

SEQ ID NO: 342344 - DNA, 526 bp, Homo sapiens
tggtgcgtgcctgtagtcccagctactcgggaggctgaggcaggagaatcgcttgaatccaggaggcagaggttgcagtgagccgagatcatatcactgcactccagcctggtgacacagtgagactcggtctcaaaaaaaaaagagaaaaaagaaaggaaaaaaaaaaggaactgacccaaaagggaaaaaaagttaattgcgtctggatgaatcacaggtaagaaagaagtacaaagaaaaaacgcacagaaacttaaagcaccgcacgctcacaccatggggaagagaatgcacaccaacgagggcaaactaggcagacgtgcccaggcggctcctgggggccctgtgataaagtctaaacagaagtgatgcaagcccaggaagaaggacctgctataacccacatgggggaaggaagatggggtatcccctctggagggcagcccccagctggtgagcaggcatcactcccagctcccagggccccacctagagagggacacctgaatgtcaccttccatag

SEQ ID NO: 342345 - DNA, 779 bp, Homo sapiens
cagccccactttatcatttacataagctattgggcataataggcctatgattttgctaccttgttttagccatttgtctgctgtagtttccaggaactcgccatttagccaacctcttctgaatctgctttaatttttcaaagtgattcttaaaatgcgaatcaaaaactaaagtcatttctccagatgtccttaatagtaaaaggccaacatcacatcattgactcttcctgagcttatgaacaaataaaaccgcaggtctccttcacaagaagctgactgctaaatatggtctgccctggtctgtgatttttaaatgagaatctatagttctggcctgaatttctatatttctcatgagaggtttgtgattatcaaacacaccatagtatgaaatcatcagaatatttaaaatgaagccctatgcaagtatgaaataccttatcatttaaatatatagactgtacactgacaggatgtctctggcattaaatgtcttttatgattatcgttacatgttttattgttattgttacatgttttagtgggttttttttttaactttttaaaaaatatgccttttaaagtgtgttaaggctggctgcagtggctcatgcctgtaatcccagcatttttggaggctgaggcgggcgcatcacatgaggtcaggagttcaagaccagactggccaacatgggaaaaccccgtctctactaaaaatacaaaaagcaggagaatcacttgagcccaggaggcagaggttgcagagttaagatggt

SEQ ID NO: 342346 - DNA, 638 bp, Homo sapiens
ctactttggcctcccaaagtgctgggattacaggtgtgagccaccacgctcagccaggcatatccacagatgcaggttcagtgttaccctactctgtgacagttgttaccccattcagatgtctattcttgaagaaatgtggagaagcaaaatctctaagagccaagtactagcaagaaaggagaaccttaatacttgcatgttagcacaatttagaagttaatatttaagggacagccatctagctggtgattacaaacaggacaagatggaggaggagagactacacaatcagtgaagagagcagttagaaaagaggcagctcccttgcaccctaccgcctggaggagggaggacggtgggagaagcagctcttcctaaaagcacaacgccaggccccaaagaggagcatcacggccttagagggagttaaagagcgccagaacacagtgccctggatgccccactttcagattcactcttctttacaagcagggcaaaaggaacagagagaagtctgtgttgtttgcatctgttgatacaggaaaacattcctggttcttcattgattcatgagcaattataattagatcgtcatctttctggagaggcagctgtgaactcaactaatgaacaat

SEQ ID NO: 342347 - DNA, 1649 bp, Homo sapiens
ggtcggcctctgctgcgcctgcgtggtcgggaggggaagtgaggcggtttcctcggcgccttttccggcagcggcggcggcagaactgggaggaggagttggaggccggagggagcccgcgctcggggcggcggctggaggcagcgcaccgagttcccgcgaggatccatgacctgacggggccccggagccgcgctgcctctcgggtgtcctgggtcggtggggagcccagtgctcgcaggccggcgggcgggccggagggctgcagtctccctcgcggtgagaggaaggcggaggagcgggaaccgcggcggcgctcgcgcggcgcctgcggggggaagggcagttccgggccgggccgcgcctcagcagggcggcggctcccagcgcagtctcagggcccgggtggcggcggcgactggagaaatcaagttgtgcggtcggtgatgcccgagtgagcggggggcctgggcctctgcccttaggaggcaactcccacgcaggccgcaaaggcgctctcgcggccgagaggcttcgtttcggtttcgcggcggcggcggcgttgttggctgaggggacccgggacacctgaatgcccccggccccggctcctccgacgcgatggggaaggtgctatccaaaatcttcgggaacaaggaaatgcggatcctcatgttgggcctggacgcggccggcaagacaacaatcctgtacaagttgaagctgggccagtcggtgaccaccattcccactgtgggtttcaacgtggagacggtgacttacaaaaatgtcaagttcaacgtatgggatgtgggcggccaggacaagatccggccgctctggcggcattactacactgggacccaaggtctcatcttcgtagtggactgcgccgaccgcgaccgcatcgatgaggctcgccaggagctgcaccgcattatcaatgaccgggagatgagggacgccataatcctcatcttcgccaacaagcaggacctgcccgatgccatgaaaccccacgagatccaggagaaactgggcctgacccggattcgggacaggaactggtatgtgcagccctcctgtgccacctcaggggacggactctatgaggggctcacatggttaacctctaactacaaatcttaatgagcattctccacccatcccctggaaggagagaaatcaaaaacccattcataggattatcgccaccatcacctctttcaattgccactttctcttcttttgaatttgaactctggagttactgttctacagtttggcggggacggggcttgggggttttctcttttgtttgtttccctttctttttccttttttttttttttttttttgttggctttgcgttaggatgctctgatctgacatttgacatgaacacaaagttgctagatgctcttgttgacttccagcagatgggatgggggaaacacagcagttcttggtaaagtcctttgtaataatagtttgatttttttatttcgagagaatctttcattttcctatgtatgcttttttccttttttgcccagtttccttatcacttgctgtagatggcttattttgcattcatgcagactatgttgcaagtctgtttcatctagtaaactgaaaattattgctta

SEQ ID NO: 342348 - DNA, 649 bp, Homo sapiens
cccgggctgcaggaattcggcacgaggcctaaactggaggaaacttgaaaccctcatgttaaatcttaaatgtagtatttctaacttgtgaagacagattggtaggcagccatttttttgtgtcttaaaataactgggggcatagttaaaattttatacatcaagtgattgctattattgaatgttgcaggtgagatgtggttatttttagtttatttgaaatgtttgactggaaaggggggagggggaagcaaatatttgaaatttggaaaaccctaaaccttttggtaagaaattgtaattttcacttaaaattttctttaaggatataagaggtttataattgatgtagttaaattgaacaataaccattggtgactggagcaggtaattatagcctgcagaaaaaattatctaagaattttaaaaataagatcctgaagttgtttaattgcatccatttctgtatttatgtgaatttataaactgcagtaagttttgaatgaggttaatcttgtttaatataagtaaatgagtctgtagactgtgatctccccaaactaaaaagtacagtacttggaattgtgttctttatggttgtagtgttggtaaagcactaatatgcagaaaataaaggaattacacagtg

SEQ ID NO: 342349 - DNA, 534 bp, Homo sapiens
actctagaggatcccggcagctatcctagtacactgtctcctttaaggaaggaagcgtgatgaatgaatgatgtgtagacttgagggatgactattaaaggggacgtaggatgaagagaaagaacctacagatgacaatgaatgtaaacttatttttcttcatgtgtaagcagtgtgctcgctggtgatatccagatcctaacaagattacttggttagctggttaggaccagtaactggattgcgaccactatgataatattttgaaccaaatgttaatgcttgatgcagaattgtaaagcagcatctggttcctatatagccttaaggattaattttagtgatcctcaaggaattaaatagggaatttcagaaatgtagactgcaaaggcagtatacaggaaaaggtggagtgggttttgtttatgagggtgtctgaaaactaaaattgagcgggatagcttgccggcaagctatccggttcaatgccgtaacattctattccactccattccactcgggttgattccactc

SEQ ID NO: 342350 - DNA, 4032 bp, Homo sapiens
ggtcggcctctgctgcgcctgcgtggtcgggaggggaagtgaggcggtttcctcggcgccttttccggcagcggcggcggcagaactgggaggaggagttggaggccggagggagcccgcgctcggggcggcggctggaggtaaccccttgggccgagctggaaaggcgggccacctcggtcttcgctcctttgtggagctctggcagtaactcccctccctctctgtttctctgcaggcagcgcaccgagttcccgcgaggatccatgacctgacggggccccggagccgcgctgcctctcgggtgtcctgggtcggtggggagcccagtgctcgcaggccggcgggcgggccggagggctgcagtctccctcgcggtgagaggaaggcggaggagcgggaaccgcggcggcgctcgcgcggcgcctgcggggggaagggcagttccgggccgggccgcgcctcagcagggcggcggctcccagcgcagtctcagggcccgggtggcggcggcgactggagaaatcaagttgtgcggtcggtgatgcccgagtgagcggggggcctgggcctctgcccttaggaggcaactcccacgcaggccgcaaaggcgctctcgcggccgagaggcttcgtttcggtttcgcggcggcggcggcgttgttggctgaggggacccgggacacctgaatgcccccggccccggctcctccgacgcgatggggaaggtgctatccaaaatcttcgggaacaaggaaatgcggatcctcatgttgggcctggacgcggccggcaagacaacaatcctgtacaagttgaagctgggccagtcggtgaccaccattcccactgtgggtttcaacgtggagacggtgacttacaaaaatgtcaagttcaacgtatgggatgtgggcggccaggacaagatccggccgctctggcggcattactacactgggacccaaggtctcatcttcgtagtggactgcgccgaccgcgaccgcatcgatgaggctcgccaggagctgcaccgcattatcaatgaccgggagatgagggacgccataatcctcatcttcgccaacaagcaggacctgcccgatgccatgaaaccccacgagatccaggagaaactgggcctgacccggattcgggacaggaactggtatgtgcagccctcctgtgccacctcaggggacggactctatgaggggctcacatggttaacctctaactacaaatcttaatgagcattctccacccatcccctggaaggagagaaatcaaaaacccattcataggattatcgccaccatcacctctttcaattgccactttctcttcttttgaatttgaactctggagttactgttctacagtttggcggggacggggcttgggggttttctcttttgtttgtttccctttctttttccttttttttttttttttttttgttggctttgcgttaggatgctctgatctgacatttgacatgaacacaaagttgctagatgctcttgttgacttccagcagatgggatgggggaaacacagcagttcttggtaaagtcctttgtaataatagtttgatttttttatttcgagagaatctttcattttcctatgtatgcttttttccttttttgcccagtttccttatcacttgctgtagatggcttattttgcattcatgcagactatgttgcaagtctgtttcatctagtaaactgaaaattattgcttaatcaaactgccgtttgtcttttatatttaaggccttccccccccttccttatgagttctaacttagtaatttcaaatgtgaccttttatatctaagaccagtatagtaaacttagcccacagtggcaaataatgagtaatattgtaatatgttccagttgcacctcagtatgttaaacaggtaatgtaagaagttctctgaaatgtcagcaagtaagttctgaaacacatcatgcatgagtaggaataaaacccaagttccccataacgtagataacttaatgctgcataaaaatatgaaagtgtaacccatgaaggacactttttctttccactgcaaagttagccactttgctgtttttcctcttttttaaactttgaaaatagactctttccagaaattggagcaataatggtgttaccacacacagattaaataatttgtagatattttaagtgacttttgggcaaaactggaatgtatacttttaccttgtttcaaacacctaagaccagtaatttaaaaattactaaaaggtttactttgttcattaataaaacatttaacaattcaaattatatgcaccttttacctagttgaaaaaaatacacattcctgttttcacattatagcaactgattaagctgaagctgtaagtcattttttatagatgagtgatccgcatctccatcaattagaacactggaaaagatgttttataaaagaggtatttaattttgtttgtaggattaactcatgcaaataataaaaaagatatcctgttggttcaatagtacactgtctcctttaaggaaggaagcgtgatgaatgaatgatgtgtagacttgagggatgactattaaaggggacgtaggatgaagagaaagaacctacagatgacaatgaatgtaaacttatttttcttcatgtgtaagcagtgtgctcgctggtgatatccagatcctaacaagattacttggttagctggttaggaccagtaactggattgcgaccactatgataatattttgaaccaaatgttaatgcttgatgcagaattgtaaagcagcatctggttcctatatagccttaaggattaattttagtgatcctcaaggaattaaatagggaatttcagaaatgtagactgcaaaggcagtatacaggaaaaggtggagtgggttttgtttatgagggtgtctgaaaactaaaattgagcgggatatcatggtatagttggacagtattggtccttcacactttggccatattgtataatggagcttttaccaaagatgtatgagaagtgtaagactataaaaaaatgaactattcaaagtaaaactcttaacaaacattttacttaaagcagatgcaaaagggtattctcatgtaggctcctgttggtgcagagggattttttgatttcaggatacaactaaagtacgaagttctcagtttcactttagtagaaagagctctagaaatgaggctgataaacacatctaagaacactggttgctttctaaaatttccaaagctccaccataaatgtaatttttagtgtttcaaatgattgcattttaaagtatataaatatgggttatccaatatcaatgctatagtaacatcctgaaacaaaacaagcacaaaggtataaatgcctaaactggaggaaacttgaaaccctcatgttaaatcttaaatgtagtatttctaacttgtgaagacagattggtaggcagccatttttttgtgtcttaaaataactgggggcatagttaaaattttatacatcaagtgattgctattattgaatgttgcaggtgagatgtggttatttttagtttatttgaaatgtttgactggaaaggggggagggggaagcaaatatttgaaatttggaaaaccctaaaccttttggtaagaaattgtaattttcacttaaaattttctttaaggatataagaggtttataattgatgtagttaaattgaacaataaccattggtgactggagcaggtaattatagcctgcagaaaaaattatctaagaattttaaaaataagatcctgaagttgtttaattgcatccatttctgtatttatgtgaatttataaactgcagtaagttttgaatgaggttaatcttgtttaatataagtaaatgagtctgtagactgtgatctccccaaactaaaaagtacagtacttggaattgtgttctttatggttgtagtgttggtaaagcactaatatgcagaaaataaaggaattacacagtg

SEQ ID NO: 342351 - DNA, 3804 bp, Homo sapiens
ggtcggcctctgctgcgcctgcgtggtcgggaggggaagtgaggcggtttcctcggcgccttttccggcagcggcggcggcagaactgggaggaggagttggaggccggagggagcccgcgctcggggcggcggctggaggcagcgcaccgagttcccgcgaggatccatgacctgacggggccccggagccgcgctgcctctcgggtgtcctgggtcggtggggagcccagtgctcgcaggccggcgggcgggccggagggctgcagtctccctcgcggtgagaggaaggcggaggagcgggaaccgcggcggcgctcgcgcggcgcctgcggggggaagggcagttccgggccgggccgcgcctcagcagggcggcggctcccagcgcagtctcagggcccgggtggcggcggcgactggagaaatcaagttgtgcggtcggtgatgcccgagtgagcggggggcctgggcctctgcccttaggaggcaactcccacgcaggccgcaaaggcgctctcgcggccgagaggcttcgtttcggtttcgcggcggcggcggcgttgttggctgaggggacccgggacacctgaatgcccccggccccggctcctccgacgcgatggggaaggtgctatccaaaatcttcgggaacaaggaaatgcggatcctcatgttgggcctggacgcggccggcaagacaacaatcctgtacaagttgaagctgggccagtcggtgaccaccattcccactgtgggtttcaacgtggagacggtgacttacaaaaatgtcaagttcaacgtatgggatgtgggcggccaggacaagatccggccgctctggcggcattactacactgggacccaaggtctcatcttcgtagtggactgcgccgaccgcgaccgcatcgatgaggctcgccaggagctgcaccgcattatcaatgaccgggagatgagggacgccataatcctcatcttcgccaacaagcaggacctgcccgatgccatgaaaccccacgagatccaggagaaactgggcctgacccggattcgggacaggaactggtatgtgcagccctcctgtgccacctcaggggacggactctatgaggggctcacatggttaacctctaactacaaatcttaatgagcattctccacccatcccctggaaggagagaaatcaaaaacccattcataggattatcgccaccatcacctctttcaattgccactttctcttcttttgaatttgaactctggagttactgttctacagtttggcggggacggggcttgggggttttctcttttgtttgtttccctttctttttccttttttttttttttttttttgttggctttgcgttaggatgctctgatctttcattttcctatgtatgcttttttccttttttgcccagtttccttatcacttgctgtagatggcttattttgcattcatgcagactatgttgcaagtctgtttcatctagtaaactgaaaattattgcttaatcaaactgccgtttgtcttttatatttaaggccttccccccccttccttatgagttctaacttagtaatttcaaatgtgaccttttatatctaagaccagtatagtaaacttagcccacagtggcaaataatgagtaatattgtaatatgttccagttgcacctcagtatgttaaacaggtaatgtaagaagttctctgaaatgtcagcaagtaagttctgaaacacatcatgcatgagtaggaataaaacccaagttccccataacgtagataacttaatgctgcataaaaatatgaaagtgtaacccatgaaggacactttttctttccactgcaaagttagccactttgctgtttttcctcttttttaaactttgaaaatagactctttccagaaattggagcaataatggtgttaccacacacagattaaataatttgtagatattttaagtgacttttgggcaaaactggaatgtatacttttaccttgtttcaaacacctaagaccagtaatttaaaaattactaaaaggtttactttgttcattaataaaacatttaacaattcaaattatatgcaccttttacctagttgaaaaaaatacacattcctgttttcacattatagcaactgattaagctgaagctgtaagtcattttttatagatgagtgatccgcatctccatcaattagaacactggaaaagatgttttataaaagaggtatttaattttgtttgtaggattaactcatgcaaataataaaaaagatatcctgttggttcaatagtacactgtctcctttaaggaaggaagcgtgatgaatgaatgatgtgtagacttgagggatgactattaaaggggacgtaggatgaagagaaagaacctacagatgacaatgaatgtaaacttatttttcttcatgtgtaagcagtgtgctcgctggtgatatccagatcctaacaagattacttggttagctggttaggaccagtaactggattgcgaccactatgataatattttgaaccaaatgttaatgcttgatgcagaattgtaaagcagcatctggttcctatatagccttaaggattaattttagtgatcctcaaggaattaaatagggaatttcagaaatgtagactgcaaaggcagtatacaggaaaaggtggagtgggttttgtttatgagggtgtctgaaaactaaaattgagcgggatatcatggtatagttggacagtattggtccttcacactttggccatattgtataatggagcttttaccaaagatgtatgagaagtgtaagactataaaaaaatgaactattcaaagtaaaactcttaacaaacattttacttaaagcagatgcaaaagggtattctcatgtaggctcctgttggtgcagagggattttttgatttcaggatacaactaaagtacgaagttctcagtttcactttagtagaaagagctctagaaatgaggctgataaacacatctaagaacactggttgctttctaaaatttccaaagctccaccataaatgtaatttttagtgtttcaaatgattgcattttaaagtatataaatatgggttatccaatatcaatgctatagtaacatcctgaaacaaaacaagcacaaaggtataaatgcctaaactggaggaaacttgaaaccctcatgttaaatcttaaatgtagtatttctaacttgtgaagacagattggtaggcagccatttttttgtgtcttaaaataactgggggcatagttaaaattttatacatcaagtgattgctattattgaatgttgcaggtgagatgtggttatttttagtttatttgaaatgtttgactggaaaggggggagggggaagcaaatatttgaaatttggaaaaccctaaaccttttggtaagaaattgtaattttcacttaaaattttctttaaggatataagaggtttataattgatgtagttaaattgaacaataaccattggtgactggagcaggtaattatagcctgcagaaaaaattatctaagaattttaaaaataagatcctgaagttgtttaattgcatccatttctgtatttatgtgaatttataaactgcagtaagttttgaatgaggttaatcttgtttaatataagtaaatgagtctgtagactgtgatctccccaaactaaaaagtacagtacttggaattgtgttctttatggttgtagtgttggtaaagcactaatatgcagaaaataaaggaattacacagtg

SEQ ID NO: 342352 - DNA, 2252 bp, Homo sapiens
ctagttctagatcgcgagcggccgctcgcgaatctagttcaaatgtgaccttttatatctaagaccagtatagtaaacttagcccacagtggcaaataatgagtaatattgtaatatgttccagttgcacctcagtatgttaaacaggtaatgtaagaagttctctgaaatgtcagcaagtaagttctgaaacacatcatgcatgagtaggaataaaacccaagttccccataacgtagataacttaatgctgcataaaaatatgaaagtgtaacccatgaaggacactttttctttccactgcaaagttagccactttgctgtttttcctcttttttaaactttgaaaatagactctttccagaaattggagcaataatggtgttaccacacacagattaaataatttgtagatattttaagtgacttttgggcaaaactggaatgtatacttttaccttgtttcaaacacctaagaccagtaatttaaaaattactaaaaggtttactttgttcattaataaaacatttaacaattcaaattatatgcaccttttacctagttgaaaaaaatacacattcctgttttcacattatagcaactgattaagctgaagctgtaagtcattttttatagatgagtgatccgcatctccatcaattagaacactggaaaagatgttttataaaagaggtatttaattttgtttgtaggattaactcatgcaaataataaaaaagatatcctgttggttcaatagtacactgtctcctttaaggaaggaagcgtgatgaatgaatgatgtgtagacttgagggatgactattaaaggggacgtaggatgaagagaaagaacctacagatgacaatgaatgtaaacttatttttcttcatgtgtaagcagtgtgctcgctggtgatatccagatcctaacaagattacttggttagctggttaggaccagtaactggattgcgaccactatgataatattttgaaccaaatgttaatgcttgatgcagaattgtaaagcagcatctggttcctatatagccttaaggattaattttagtgatcctcaaggaattaaatagggaatttcagaaatgtagactgcaaaggcagtatacaggaaaaggtggagtgggttttgtttatgagggtgtctgaaaactaaaattgagcgggatatcatggtatagttggacagtattggtccttcacactttggccatattgtataatggagcttttaccaaagatgtatgagaagtgtaagactataaaaaaatgaactattcaaagtaaaactcttaacaaacattttacttaaagcagatgcaaaagggtattctcatgtaggctcctgttggtgcagagggattttttgatttcaggatacaactaaagtacgaagttctcagtttcactttagtagaaagagctctagaaatgaggctgataaacacatctaagaacactggttgctttctaaaatttccaaagctccaccataaatgtaatttttagtgtttcaaatgattgcattttaaagtatataaatatgggttatccaatatcaatgctatagtaacatcctgaaacaaaacaagcacaaaggtataaatgcctaaactggaggaaacttgaaaccctcatgttaaatcttaaatgtagtatttctaacttgtgaagacagattggtaggcagccatttttttgtgtcttaaaataactgggggcatagttaaaattttatacatcaagtgattgctattattgaatgttgcaggtgagatgtggttatttttagtttatttgaaatgtttgactggaaaggggggagggggaagcaaatatttgaaatttggaaaaccctaaaccttttggtaagaaattgtaattttcacttaaaattttctttaaggatataagaggtttataattgatgtagttaaattgaacaataaccattggtgactggagcaggtaattatagcctgcagaaaaaattatctaagaattttaaaaataagatcctgaagttgtttaattgcatccatttctgtatttatgtgaatttataaactgcagtaagttttgaatgaggttaatcttgtttaatataagtaaatgagtctgtagactgtgatctccccaaactaaaaagtacagtacttggaattgtgttctttatggttgtagtgttggtaaagcactaatatgcagaaaataaaggaattacacagtg

SEQ ID NO: 342353 - DNA, 1855 bp, Homo sapiens
gctcggtacccgctgatccgcttaagtgacttttgggcaaaactggaatgtatacttttaccttgtttcaaacacctaagaccagtaatttaaaaattactaaaaggtttactttgttcattaataaaacatttaacaattcaaattatatgcaccttttacctagttgaaaaaaatacacattcctgttttcacattatagcaactgattaagctgaagctgtaagtcattttttatagatgagtgatccgcatctccatcaattagaacactggaaaagatgttttataaaagaggtatttaattttgtttgtaggattaactcatgcaaataataaaaaagatatcctgttggttcaatagtacactgtctcctttaaggaaggaagcgtgatgaatgaatgatgtgtagacttgagggatgactattaaaggggacgtaggatgaagagaaagaacctacagatgacaatgaatgtaaacttatttttcttcatgtgtaagcagtgtgctcgctggtgatatccagatcctaacaagattacttggttagctggttaggaccagtaactggattgcgaccactatgataatattttgaaccaaatgttaatgcttgatgcagaattgtaaagcagcatctggttcctatatagccttaaggattaattttagtgatcctcaaggaattaaatagggaatttcagaaatgtagactgcaaaggcagtatacaggaaaaggtggagtgggttttgtttatgagggtgtctgaaaactaaaattgagcgggatatcatggtatagttggacagtattggtccttcacactttggccatattgtataatggagcttttaccaaagatgtatgagaagtgtaagactataaaaaaatgaactattcaaagtaaaactcttaacaaacattttacttaaagcagatgcaaaagggtattctcatgtaggctcctgttggtgcagagggattttttgatttcaggatacaactaaagtacgaagttctcagtttcactttagtagaaagagctctagaaatgaggctgataaacacatctaagaacactggttgctttctaaaatttccaaagctccaccataaatgtaatttttagtgtttcaaatgattgcattttaaagtatataaatatgggttatccaatatcaatgctatagtaacatcctgaaacaaaacaagcacaaaggtataaatgcctaaactggaggaaacttgaaaccctcatgttaaatcttaaatgtagtatttctaacttgtgaagacagattggtaggcagccatttttttgtgtcttaaaataactgggggcatagttaaaattttatacatcaagtgattgctattattgaatgttgcaggtgagatgtggttatttttagtttatttgaaatgtttgactggaaaggggggagggggaagcaaatatttgaaatttggaaaaccctaaaccttttggtaagaaattgtaattttcacttaaaattttctttaaggatataagaggtttataattgatgtagttaaattgaacaataaccattggtgactggagcaggtaattatagcctgcagaaaaaattatctaagaattttaaaaataagatcctgaagttgtttaattgcatccatttctgtatttatgtgaatttataaactgcagtaagttttgaatgaggttaatcttgtttaatataagtaaatgagtctgtagactgtgatctccccaaactaaaaagtacagtacttggaattgtgttctttatggttgtagtgttggtaaagcactaatatgcagaaaataaaggaattacacagtg

SEQ ID NO: 342354 - DNA, 2387 bp, Homo sapiens
ggtcggcctctgctgcgcctgcgtggtcgggaggggaagtgaggcggtttcctcggcgccttttccggcagcggcggcggcagaactgggaggaggagttggaggccggagggagcccgcgctcggggcggcggctggaggcagcgcaccgagttcccgcgaggatccatgacctgacggggccccggagccgcgctgcctctcgggtgtcctgggtcggtggggagcccagtgctcgcaggccggcgggcgggccggagggctgcagtctccctcgcggtgagaggaaggcggaggagcgggaaccgcggcggcgctcgcgcggcgcctgcggggggaagggcagttccgggccgggccgcgcctcagcagggcggcggctcccagcgcagtctcagggcccgggtggcggcggcgactggagaaatcaagttgtgcggtcggtgatgcccgagtgagcggggggcctgggcctctgcccttaggaggcaactcccacgcaggccgcaaaggcgctctcgcggccgagaggcttcgtttcggtttcgcggcggcggcggcgttgttggctgaggggacccgggacacctgaatgcccccggccccggctcctccgacgcgatggggaaggtgctatccaaaatcttcgggaacaaggaaatgcggatcctcatgttgggcctggacgcggccggcaagacaacaatcctgtacaagttgaagctgggccagtcggtgaccaccattcccactgtgggtttcaacgtggagacggtgacttacaaaaatgtcaagttcaacgtatgggatgtgggcggccaggacaagatccggccgctctggcggcattactacactgggacccaaggtctcatcttcgtagtggactgcgccgaccgcgaccgcatcgatgaggctcgccaggagctgcaccgcattatcaatgaccgggagatgagggacgccataatcctcatcttcgccaacaagcaggacctgcccgatgccatgaaaccccacgagatccaggagaaactgggcctgacccggattcgggacaggaactggtatgtgcagccctcctgtgccacctcaggggacggactctatgaggggctcacatggttaacctctaactacaaatcttaatgagcattctccacccatcccctggaaggagagaaatcaaaaacccattcataggattatcgccaccatcacctctttcaattgccactttctcttcttttgaatttgaactctggagttactgttctacagtttggcggggacggggcttgggggttttctcttttgtttgtttccctttctttttccttttttttttttttttttttgttggctttgcgttaggatgctctgatctgacatttgacatgaacacaaagttgctagatgctcttgttgacttccagcagatgggatgggggaaacacagcagttcttggtaaagtcctttgtaataatagtttgatttttttatttcgagagaatctttcattttcctatgtatgcttttttccttttttgcccagtttccttatcacttgctgtagatggcttattttgcattcatgcagactatgttgcaagtctgtttcatctagtaaactgaaaattattgcttaatcaaactgccgtttgtcttttatatttaaggccttccccccccttccttatgagttctaacttagtaatttcaaatgtgaccttttatatctaagaccagtatagtaaacttagcccacagtggcaaataatgagtaatattgtaatatgttccagttgcacctcagtatgttaaacaggtaatgtaagaagttctctgaaatgtcagcaagtaagttctgaaacacatcatgcatgagtaggaataaaacccaagttccccataacgtagataacttaatgctgcataaaaatatgaaagtgtaacccatgaaggacactttttctttccactgcaaagttagccactttgctgtttttcctcttttttaaactttgaaaatagactctttccagaaattggagcaataatggtgttaccacacacagattaaataatttgtagatattttaagtgacttttgggcaaaactggaatgtatacttttaccttgtttcaaacacctaagaccagtaatttaaaaattactaaaaggtttactttgttcattaataaaacatttaacaattcaaattatatgcaccttttacctagttgaaaaaaatacacattcctgttttcacattatagcaactgattaagctgaagctgtaagtcattttttatagatgagtgatccgcatctccatcaattagaacactggaaaagatgtcgttcagaggtaggaaaccgagc

SEQ ID NO: 342355 - DNA, 1520 bp, Homo sapiens
actctagaggatcccggcagctatcctagtacactgtctcctttaaggaaggaagcgtgatgaatgaatgatgtgtagacttgagggatgactattaaaggggacgtaggatgaagagaaagaacctacagatgacaatgaatgtaaacttatttttcttcatgtgtaagcagtgtgctcgctggtgatatccagatcctaacaagattacttggttagctggttaggaccagtaactggattgcgaccactatgataatattttgaaccaaatgttaatgcttgatgcagaattgtaaagcagcatctggttcctatatagccttaaggattaattttagtgatcctcaaggaattaaatagggaatttcagaaatgtagactgcaaaggcagtatacaggaaaaggtggagtgggttttgtttatgagggtgtctgaaaactaaaattgagcgggatatcatggtatagttggacagtattggtccttcacactttggccatattgtataatggagcttttaccaaagatgtatgagaagtgtaagactataaaaaaatgaactattcaaagtaaaactcttaacaaacattttacttaaagcagatgcaaaagggtattctcatgtaggctcctgttggtgcagagggattttttgatttcaggatacaactaaagtacgaagttctcagtttcactttagtagaaagagctctagaaatgaggctgataaacacatctaagaacactggttgctttctaaaatttccaaagctccaccataaatgtaatttttagtgtttcaaatgattgcattttaaagtatataaatatgggttatccaatatcaatgctatagtaacatcctgaaacaaaacaagcacaaaggtataaatgcctaaactggaggaaacttgaaaccctcatgttaaatcttaaatgtagtatttctaacttgtgaagacagattggtaggcagccatttttttgtgtcttaaaataactgggggcatagttaaaattttatacatcaagtgattgctattattgaatgttgcaggtgagatgtggttatttttagtttatttgaaatgtttgactggaaaggggggagggggaagcaaatatttgaaatttggaaaaccctaaaccttttggtaagaaattgtaattttcacttaaaattttctttaaggatataagaggtttataattgatgtagttaaattgaacaataaccattggtgactggagcaggtaattatagcctgcagaaaaaattatctaagaattttaaaaataagatcctgaagttgtttaattgcatccatttctgtatttatgtgaatttataaactgcagtaagttttgaatgaggttaatcttgtttaatataagtaaatgagtctgtagactgtgatctccccaaactaaaaagtacagtacttggaattgtgttctttatggttgtagtgttggtaaagcactaatatgcagaaaataaaggaattacacagtg

SEQ ID NO: 342356 - DNA, 1365 bp, Homo sapiens
  misc_feature (66)..(66): n is a, c, g, or t
tggtgactatgcctagagtctctagatgagcataactgtgagtcaccgtggctgtgaggatccagntaatggcatggtactaggctagcactagtgatccgtatgttttgatgccaaatgttaatgcttgatgcagaattgtaaagcagcatctggttcctatatagccttaaggattaattttagtgatcctcaaggaattaaatagggaatttcagaaatgtagactgcaaaggcagtatacaggaaaaggtggagtgggttttgtttatgagggtgtctgaaaactaaaattgagcgggatatcatggtatagttggacagtattggtccttcacactttggccatattgtataatggagcttttaccaaagatgtatgagaagtgtaagactataaaaaaatgaactattcaaagtaaaactcttaacaaacattttacttaaagcagatgcaaaagggtattctcatgtaggctcctgttggtgcagagggattttttgatttcaggatacaactaaagtacgaagttctcagtttcactttagtagaaagagctctagaaatgaggctgataaacacatctaagaacactggttgctttctaaaatttccaaagctccaccataaatgtaatttttagtgtttcaaatgattgcattttaaagtatataaatatgggttatccaatatcaatgctatagtaacatcctgaaacaaaacaagcacaaaggtataaatgcctaaactggaggaaacttgaaaccctcatgttaaatcttaaatgtagtatttctaacttgtgaagacagattggtaggcagccatttttttgtgtcttaaaataactgggggcatagttaaaattttatacatcaagtgattgctattattgaatgttgcaggtgagatgtggttatttttagtttatttgaaatgtttgactggaaaggggggagggggaagcaaatatttgaaatttggaaaaccctaaaccttttggtaagaaattgtaattttcacttaaaattttctttaaggatataagaggtttataattgatgtagttaaattgaacaataaccattggtgactggagcaggtaattatagcctgcagaaaaaattatctaagaattttaaaaataagatcctgaagttgtttaattgcatccatttctgtatttatgtgaatttataaactgcagtaagttttgaatgaggttaatcttgtttaatataagtaaatgagtctgtagactgtgatctccccaaactaaaaagtacagtacttggaattgtgttctttatggttgtagtgttggtaaagcactaatatgcagaaaataaaggaattacacagtg

SEQ ID NO: 342357 - DNA, 1041 bp, Homo sapiens
gtcgtctagaggatcccaagtcagttacacaaagtggagcttttaccaaagatgtatgagaagtgtaagactataaaaaaatgaactattcaaagtaaaactcttaacaaacattttacttaaagcagatgcaaaagggtattctcatgtaggctcctgttggtgcagagggattttttgatttcaggatacaactaaagtacgaagttctcagtttcactttagtagaaagagctctagaaatgaggctgataaacacatctaagaacactggttgctttctaaaatttccaaagctccaccataaatgtaatttttagtgtttcaaatgattgcattttaaagtatataaatatgggttatccaatatcaatgctatagtaacatcctgaaacaaaacaagcacaaaggtataaatgcctaaactggaggaaacttgaaaccctcatgttaaatcttaaatgtagtatttctaacttgtgaagacagattggtaggcagccatttttttgtgtcttaaaataactgggggcatagttaaaattttatacatcaagtgattgctattattgaatgttgcaggtgagatgtggttatttttagtttatttgaaatgtttgactggaaaggggggagggggaagcaaatatttgaaatttggaaaaccctaaaccttttggtaagaaattgtaattttcacttaaaattttctttaaggatataagaggtttataattgatgtagttaaattgaacaataaccattggtgactggagcaggtaattatagcctgcagaaaaaattatctaagaattttaaaaataagatcctgaagttgtttaattgcatccatttctgtatttatgtgaatttataaactgcagtaagttttgaatgaggttaatcttgtttaatataagtaaatgagtctgtagactgtgatctccccaaactaaaaagtacagtacttggaattgtgttctttatggttgtagtgttggtaaagcactaatatgcagaaaataaaggaattacacagtg

SEQ ID NO: 342358 - DNA, 1670 bp, Homo sapiens
ggtcggcctctgctgcgcctgcgtggtcgggaggggaagtgaggcggtttcctcggcgccttttccggcagcggcggcggcagaactgggaggaggagttggaggccggagggagcccgcgctcggggcggcggctggaggcagcgcaccgagttcccgcgaggatccatgacctgacggggccccggagccgcgctgcctctcgggtgtcctgggtcggtggggagcccagtgctcgcaggccggcgggcgggccggagggctgcagtctccctcgcggtgagaggaaggcggaggagcgggaaccgcggcggcgctcgcgcggcgcctgcggggggaagggcagttccgggccgggccgcgcctcagcagggcggcggctcccagcgcagtctcagggcccgggtggcggcggcgactggagaaatcaagttgtgcggtcggtgatgcccgagtgagcggggggcctgggcctctgcccttaggaggcaactcccacgcaggccgcaaaggcgctctcgcggccgagaggcttcgtttcggtttcgcggcggcggcggcgttgttggctgaggggacccgggacacctgaatgcccccggccccggctcctccgacgcgatggggaaggtgctatccaaaatcttcgggaacaaggaaatgcggatcctcatgttgggcctggacgcggccggcaagacaacaatcctgtacaagttgaagctgggccagtcggtgaccaccattcccactgtgggtttcaacgtggagacggtgacttacaaaaatgtcaagttcaacgtatgggatgtgggcggccaggacaagatccggccgctctggcggcattactacactgggacccaaggtctcatcttcgtagtggactgcgccgaccgcgaccgcatcgatgaggctcgccaggagctgcaccgcattatcaatgaccgggagatgagggacgccataatcctcatcttcgccaacaagcaggacctgcccgatgccatgaaaccccacgagatccaggagaaactgggcctgacccggattcgggacaggaactggtatgtgcagccctcctgtgccacctcaggggacggactctatgaggggctcacatggttaacctctaactacaaatcttaatgagcattctccacccatcccctggaaggagagaaatcaaaaacccattcataggattatcgccaccatcacctctttcaattgccactttctcttcttttgaatttgaactctggagttactgttctacagtttggcggggacggggcttgggggttttctcttttgtttgtttccctttctttttccttttttttttttttttttttgttggctttgcgttaggatgctctgatctgacatttgacatgaacacaaagttgctagatgctcttgttgacttccagcagatgggatgggggaaacacagcagttcttggtaaagtcctttgtaataatagtttgatttttttatttcgagagaatctttcattttcctatgtatgcttttttccttttttgcccagtttccttatcacttgctgtagatggcttattttgcattcatgcagactatgttgcaagtctgtttcatctagtaaactgaaaattattgcttaggtaaagacagaaaccccccc

SEQ ID NO: 342359 - DNA, 1423 bp, Homo sapiens
ggtcggcctctgctgcgcctgcgtggtcgggaggggaagtgaggcggtttcctcggcgccttttccggcagcggcggcggcagaactgggaggaggagttggaggccggagggagcccgcgctcggggcggcggctggaggcagcgcaccgagttcccgcgaggatccatgacctgacggggccccggagccgcgctgcctctcgggtgtcctgggtcggtggggagcccagtgctcgcaggccggcgggcgggccggagggctgcagtctccctcgcggtgagaggaaggcggaggagcgggaaccgcggcggcgctcgcgcggcgcctgcggggggaagggcagttccgggccgggccgcgcctcagcagggcggcggctcccagcgcagtctcagggcccgggtggcggcggcgactggagaaatcaagttgtgcggtcggtgatgcccgagtgagcggggggcctgggcctctgcccttaggaggcaactcccacgcaggccgcaaaggcgctctcgcggccgagaggcttcgtttcggtttcgcggcggcggcggcgttgttggctgaggggacccgggacacctgaatgcccccggccccggctcctccgacgcgatggggaaggtgctatccaaaatcttcgggaacaaggaaatgcggatcctcatgttgggcctggacgcggccggcaagacaacaatcctgtacaagttgaagctgggccagtcggtgaccaccattcccactgtgggtttcaacgtggagacggtgacttacaaaaatgtcaagttcaacgtatgggatgtgggcggccaggacaagatccggccgctctggcggcattactacactgggacccaaggtctcatcttcgtagtggactgcgccgaccgcgaccgcatcgatgaggctcgccaggagctgcaccgcattatcaatgaccgggagatgagggacgccataatcctcatcttcgccaacaagcaggacctgcccgatgccatgaaaccccacgagatccaggagaaactgggcctgacccggattcgggacaggaactggtatgtgcagccctcctgtgccacctcaggggacggactctatgaggggctcacatggttaacctctaactacaaatcttaatgagcattctccacccatcccctggaaggagagaaatcaaaaacccattcataggattatcgccaccatcacctctttcaattgccactttctcttcttttgaatttgaactctggagttactgttctacagtttggcggggacggggcttgggggttttctcttttgtttgtttcccccatcccatctgctggaagtcaacaagagcatctagcaactttgtgttcatgtcaaatgtcagatcagagcatcctaacgcaaagccaacaaaaaa

SEQ ID NO: 342360 - DNA, 3934 bp, Homo sapiens
ggtcggcctctgctgcgcctgcgtggtcgggaggggaagtgaggcggtttcctcggcgccttttccggcagcggcggcggcagaactgggaggaggagttggaggccggagggagcccgcgctcggggcggcggctggaggcagcgcaccgagttcccgcgaggatccatgacctgacggggccccggagccgcgctgcctctcgggtgtcctgggtcggtggggagcccagtgctcgcaggccggcgggcgggccggagggctgcagtctccctcgcggtgagaggaaggcggaggagcgggaaccgcggcggcgctcgcgcggcgcctgcggggggaagggcagttccgggccgggccgcgcctcagcagggcggcggctcccagcgcagtctcagggcccgggtggcggcggcgactggagaaatcaagttgtgcggtcggtgatgcccgagtgagcggggggcctgggcctctgcccttaggaggcaactcccacgcaggccgcaaaggcgctctcgcggccgagaggcttcgtttcggtttcgcggcggcggcggcgttgttggctgaggggacccgggacacctgaatgcccccggccccggctcctccgacgcgatggggaaggtgctatccaaaatcttcgggaacaaggaaatgcggatcctcatgttgggcctggacgcggccggcaagacaacaatcctgtacaagttgaagctgggccagtcggtgaccaccattcccactgtgggtttcaacgtggagacggtgacttacaaaaatgtcaagttcaacgtatgggatgtgggcggccaggacaagatccggccgctctggcggcattactacactgggacccaaggtctcatcttcgtagtggactgcgccgaccgcgaccgcatcgatgaggctcgccaggagctgcaccgcattatcaatgaccgggagatgagggacgccataatcctcatcttcgccaacaagcaggacctgcccgatgccatgaaaccccacgagatccaggagaaactgggcctgacccggattcgggacaggaactggtatgtgcagccctcctgtgccacctcaggggacggactctatgaggggctcacatggttaacctctaactacaaatcttaatgagcattctccacccatcccctggaaggagagaaatcaaaaacccattcataggattatcgccaccatcacctctttcaattgccactttctcttcttttgaatttgaactctggagttactgttctacagtttggcggggacggggcttgggggttttctcttttgtttgtttccctttctttttccttttttttttttttttttttgttggctttgcgttaggatgctctgatctgacatttgacatgaacacaaagttgctagatgctcttgttgacttccagcagatgggatgggggaaacacagcagttcttggtaaagtcctttgtaataatagtttgatttttttatttcgagagaatctttcattttcctatgtatgcttttttccttttttgcccagtttccttatcacttgctgtagatggcttattttgcattcatgcagactatgttgcaagtctgtttcatctagtaaactgaaaattattgcttaatcaaactgccgtttgtcttttatatttaaggccttccccccccttccttatgagttctaacttagtaatttcaaatgtgaccttttatatctaagaccagtatagtaaacttagcccacagtggcaaataatgagtaatattgtaatatgttccagttgcacctcagtatgttaaacaggtaatgtaagaagttctctgaaatgtcagcaagtaagttctgaaacacatcatgcatgagtaggaataaaacccaagttccccataacgtagataacttaatgctgcataaaaatatgaaagtgtaacccatgaaggacactttttctttccactgcaaagttagccactttgctgtttttcctcttttttaaactttgaaaatagactctttccagaaattggagcaataatggtgttaccacacacagattaaataatttgtagatattttaagtgacttttgggcaaaactggaatgtatacttttaccttgtttcaaacacctaagaccagtaatttaaaaattactaaaaggtttactttgttcattaataaaacatttaacaattcaaattatatgcaccttttacctagttgaaaaaaatacacattcctgttttcacattatagcaactgattaagctgaagctgtaagtcattttttatagatgagtgatccgcatctccatcaattagaacactggaaaagatgttttataaaagaggtatttaattttgtttgtaggattaactcatgcaaataataaaaaagatatcctgttggttcaatagtacactgtctcctttaaggaaggaagcgtgatgaatgaatgatgtgtagacttgagggatgactattaaaggggacgtaggatgaagagaaagaacctacagatgacaatgaatgtaaacttatttttcttcatgtgtaagcagtgtgctcgctggtgatatccagatcctaacaagattacttggttagctggttaggaccagtaactggattgcgaccactatgataatattttgaaccaaatgttaatgcttgatgcagaattgtaaagcagcatctggttcctatatagccttaaggattaattttagtgatcctcaaggaattaaatagggaatttcagaaatgtagactgcaaaggcagtatacaggaaaaggtggagtgggttttgtttatgagggtgtctgaaaactaaaattgagcgggatatcatggtatagttggacagtattggtccttcacactttggccatattgtataatggagcttttaccaaagatgtatgagaagtgtaagactataaaaaaatgaactattcaaagtaaaactcttaacaaacattttacttaaagcagatgcaaaagggtattctcatgtaggctcctgttggtgcagagggattttttgatttcaggatacaactaaagtacgaagttctcagtttcactttagtagaaagagctctagaaatgaggctgataaacacatctaagaacactggttgctttctaaaatttccaaagctccaccataaatgtaatttttagtgtttcaaatgattgcattttaaagtatataaatatgggttatccaatatcaatgctatagtaacatcctgaaacaaaacaagcacaaaggtataaatgcctaaactggaggaaacttgaaaccctcatgttaaatcttaaatgtagtatttctaacttgtgaagacagattggtaggcagccatttttttgtgtcttaaaataactgggggcatagttaaaattttatacatcaagtgattgctattattgaatgttgcaggtgagatgtggttatttttagtttatttgaaatgtttgactggaaaggggggagggggaagcaaatatttgaaatttggaaaaccctaaaccttttggtaagaaattgtaattttcacttaaaattttctttaaggatataagaggtttataattgatgtagttaaattgaacaataaccattggtgactggagcaggtaattatagcctgcagaaaaaattatctaagaattttaaaaataagatcctgaagttgtttaattgcatccatttctgtatttatgtgaatttataaactgcagtaagttttgaatgaggttaatcttgtttaatataagtaaatgagtctgtagactgtgatctccccaaactaaaaagtacagtacttggaattgtgttctttatggttgtagtgttggtaaagcactaatatgcagaaaataaaggaattacacagtg

SEQ ID NO: 342361 - DNA, 2948 bp, Homo sapiens
ggtcggcctctgctgcgcctgcgtggtcgggaggggaagtgaggcggtttcctcggcgccttttccggcagcggcggcggcagaactgggaggaggagttggaggccggagggagcccgcgctcggggcggcggctggaggcagcgcaccgagttcccgcgaggatccatgacctgacggggccccggagccgcgctgcctctcgggtgtcctgggtcggtggggagcccagtgctcgcaggccggcgggcgggccggagggctgcagtctccctcgcggtgagaggaaggcggaggagcgggaaccgcggcggcgctcgcgcggcgcctgcggggggaagggcagttccgggccgggccgcgcctcagcagggcggcggctcccagcgcagtctcagggcccgggtggcggcggcgactggagaaatcaagttgtgcggtcggtgatgcccgagtgagcggggggcctgggcctctgcccttaggaggcaactcccacgcaggccgcaaaggcgctctcgcggccgagaggcttcgtttcggtttcgcggcggcggcggcgttgttggctgaggggacccgggacacctgaatgcccccggccccggctcctccgacgcgatggggaaggtgctatccaaaatcttcgggaacaaggaaatgcggatcctcatgttgggcctggacgcggccggcaagacaacaatcctgtacaagttgaagctgggccagtcggtgaccaccattcccactgtgggtttcaacgtggagacggtgacttacaaaaatgtcaagttcaacgtatgggatgtgggcggccaggacaagatccggccgctctggcggcattactacactgggacccaaggtctcatcttcgtagtggactgcgccgaccgcgaccgcatcgatgaggctcgccaggagctgcaccgcattatcaatgaccgggagatgagggacgccataatcctcatcttcgccaacaagcaggacctgcccgatgccatgaaaccccacgagatccaggagaaactgggcctgacccggattcgggacaggaactggtatgtgcagccctcctgtgccacctcaggggacggactctatgaggggctcacatggttaacctctaactacaaatcttaatgagcattctccacccatcccctggaaggagagaaatcaaaaacccattcataggattatcgccaccatcacctctttcaattgccactttctcttcttttgaatttgaactctggagttactgttctacagtttggcggggacggggcttgggggttttctcttttgtttgtttccctttctttttccttttttttttttttttttttgttggctttgcgttaggatgctctgatctgacatttgacatgaacacaaagttgctagatgctcttgttgacttccagcagatgggatgggggaaacacagcagttcttggtaaagtcctttgtaataatagtttgatttttttatttcgagagaatctttcattttcctatgtatgcttttttccttttttgcccagtttccttatcacttgctgtagatggcttattttgcattcatgcagactatgttgcaagtctgtttcatctagtaaactgaaaattattgcttaatcaaactgccgtttgtcttttatatttaaggccttccccccccttccttatgagttctaacttagtaatttcaaatgtgaccttttatatctaagaccagtatagtaaacttagcccacagtggcaaataatgagtaatattgtaatatgttccagttgcacctcagtatgttaaacaggtaatgtaagaagttctctgaaatgtcagcaagtaagttctgaaacacatcatgcatgagtaggaataaaacccaagttccccataacgtagataacttaatgctgcataaaaatatgaaagtgtaacccatgaaggacactttttctttccactgcaaagttagccactttgctgtttttcctcttttttaaactttgaaaatagactctttccagaaattggagcaataatggtgttaccacacacagattaaataatttgtagatattttaagtgacttttgggcaaaactggaatgtatacttttaccttgtttcaaacacctaagaccagtaatttaaaaattactaaaaggtttactttgttcattaataaaacatttaacaattcaaattatatgcaccttttacctagttgaaaaaaatacacattcctgttttcacattatagcaactgattaagctgaagctgtaagtcattttttatagatgagtgatccgcatctccatcaattagaacactggaaaagatgttttataaaagaggtatttaattttgtttgtaggattaactcatgcaaataataaaaaagatatcctgttggttcaatagtacactgtctcctttaaggaaggaagcgtgatgaatgaatgatgtgtagacttgagggatgactattaaaggggacgtaggatgaagagaaagaacctacagatgacaatgaatgtaaacttatttttcttcatgtgtaagcagtgtgctcgctggtgatatccagatcctaacaagattacttggttagctggttaggaccagtaactggattgcgaccactatgataatattttgaaccaaatgttaatgcttgatgcagaattgtaaagcagcatctggttcctatatagccttaaggattaattttagtgatcctcaaggaattaaatagggaatttcagaaatgtagactgcaaaggcagtatacaggaaaaggtggagtgggttttgtttatgagggtgtctgaaaactaaaattgagcgggatagcttgccggcaagctatccggttcaatgccgtaacattctattccactccattccactcgggttgattccactc

SEQ ID NO: 342362 - DNA, 1691 bp, Homo sapiens
ggtcggcctctgctgcgcctgcgtggtcgggaggggaagtgaggcggtttcctcggcgccttttccggcagcggcggcggcagaactgggaggaggagttggaggccggagggagcccgcgctcggggcggcggctggaggcagcgcaccgagttcccgcgaggatccatgacctgacggggccccggagccgcgctgcctctcgggtgtcctgggtcggtggggagcccagtgctcgcaggccggcgggcgggccggagggctgcagtctccctcgcggtgagaggaaggcggaggagcgggaaccgcggcggcgctcgcgcggcgcctgcggggggaagggcagttccgggccgggccgcgcctcagcagggcggcggctcccagcgcagtctcagggcccgggtggcggcggcgactggagaaatcaagttgtgcggtcggtgatgcccgagtgagcggggggcctgggcctctgcccttaggaggcaactcccacgcaggccgcaaaggcgctctcgcggccgagaggcttcgtttcggtttcgcggcggcggcggcgttgttggctgaggggacccgggacacctgaatgcccccggccccggctcctccgacgcgatggggaaggtgctatccaaaatcttcgggaacaaggaaatgcggatcctcatgttgggcctggacgcggccggcaagacaacaatcctgtacaagttgaagctgggccagtcggtgaccaccattcccactgtgggtttcaacgtggagacggtgacttacaaaaatgtcaagttcaacgtatgggatgtgggcggccaggacaagatccggccgctctggcggcattactacactgggacccaaggtctcatcttcgtagtggactgcgccgaccgcgaccgcatcgatgaggctcgccaggagctgcaccgcattatcaatgaccgggagatgagggacgccataatcctcatcttcgccaacaagcaggacctgcccgatgccatgaaaccccacgagatccaggagaaactgggcctgacccggattcgggacaggaactggtatgtgcagccctcctgtgccacctcaggggacggactctatgaggggctcacatggttaacctctaactacaaatcttaatgagcattctccacccatcccctggaaggagagaaatcaaaaacccattcataggattatcgccaccatcacctctttcaattgccactttctcttcttttgaatttgaactctggagttactgttctacagtttggcggggacggggcttgggggttttctcttttgtttgtttccctttctttttccttttttttttttttttttttgttggctttgcgttaggatgctctgatctgacatttgacatgaacacaaagttgctagatgctcttgttgacttccagcagatgggatgggggaaacacagcagttcttggtaaagtcctttgtaataatagtttgatttttttatttcgagagaatctttcattttcctatgtatgcttttttccttttttgcccagtttccttatcacttgctgtagatggcttattttgcattcatgcagactatgttgcaagtctgtttcatctagtaaactgaaaattattgcttaaaaaaaaaaaaataaataatgaagaaatgaaaaaaataaaaa

SEQ ID NO: 342363 - DNA, 1606 bp, Homo sapiens
ggtcggcctctgctgcgcctgcgtggtcgggaggggaagtgaggcggtttcctcggcgccttttccggcagcggcggcggcagaactgggaggaggagttggaggccggagggagcccgcgctcggggcggcggctggaggcagcgcaccgagttcccgcgaggatccatgacctgacggggccccggagccgcgctgcctctcgggtgtcctgggtcggtggggagcccagtgctcgcaggccggcgggcgggccggagggctgcagtctccctcgcggtgagaggaaggcggaggagcgggaaccgcggcggcgctcgcgcggcgcctgcggggggaagggcagttccgggccgggccgcgcctcagcagggcggcggctcccagcgcagtctcagggcccgggtggcggcggcgactggagaaatcaagttgtgcggtcggtgatgcccgagtgagcggggggcctgggcctctgcccttaggaggcaactcccacgcaggccgcaaaggcgctctcgcggccgagaggcttcgtttcggtttcgcggcggcggcggcgttgttggctgaggggacccgggacacctgaatgcccccggccccggctcctccgacgcgatggggaaggtgctatccaaaatcttcgggaacaaggaaatgcggatcctcatgttgggcctggacgcggccggcaagacaacaatcctgtacaagttgaagctgggccagtcggtgaccaccattcccactgtgggtttcaacgtggagacggtgacttacaaaaatgtcaagttcaacgtatgggatgtgggcggccaggacaagatccggccgctctggcggcattactacactgggacccaaggtctcatcttcgtagtggactgcgccgaccgcgaccgcatcgatgaggctcgccaggagctgcaccgcattatcaatgaccgggagatgagggacgccataatcctcatcttcgccaacaagcaggacctgcccgatgccatgaaaccccacgagatccaggagaaactgggcctgacccggattcgggacaggaactggtatgtgcagccctcctgtgccacctcaggggacggactctatgaggggctcacatggttaacctctaactacaaatcttaatgagcattctccacccatcccctggaaggagagaaatcaaaaacccattcataggattatcgccaccatcacctctttcaattgccactttctcttcttttgaatttgaactctggagttactgttctacagtttggcggggacggggcttgggggttttctcttttgtttgtttccctttctttttccttttttttttttttttggtgggcttggccttgggtctcccgtggccggtaaacctacccgtgtaatgtctccataatcaggtccctctctcttaataagggaagctcaagagagcttaatattcggatttggaaaccccgggagccatgctaaggattcatatccatgatatctaaggattacagtggtgggtgtcctccacccttaaattccgtgtggggggagctttcttggcacagtaaacaacagcattacctttaattataat

SEQ ID NO: 342364 - DNA, 444 bp, Homo sapiens
gaattgggagaacagtctgtggcaggaggagaaacagcccaagcagctcctcagaggaggcaggccaaagagggaagagctttagattcttttcttatggtcagggcaacctctagcaatggaaagcccagatgtctcaaagacctggacggcactgccatggcattctccttgatttgcgagctggtgcatagtcctgaagagtcccttttaaaattcttcactctgaggaatcacttaaaacaaatcatgattcttgaaatctgcctctaacccccaaatagttttttttccacggtgaagaactggaatatttctgtgtgtttgctttgctctccatgggtaacctctcttcctgcatgataaatacacatttgaaaatattgatttgctgctacccctttgaaaagcttaagaaggctgacctctgcctcagcgttctct

SEQ ID NO: 342365 - DNA, 411 bp, Homo sapiens
gtgtcaacaattttggcattgcagaagaccatggagacaacttttttatttctccatcacacaaggactgaagatacaaaaatgagtttttctttcctatggccttggactagctatatacgatagtaattagcaagcaggctctgaattacacgagcccctcccactgactcttgtactttttagctataagaacctaagcacgaacttcgcagagctccagtgcttctgttttgaaaagagataatatttcctatgggatagggttgtctgggggtactaaatgagaactacatacaaagtacttaatggaaggtatgtaggactcaatagaggtagctattaaattgtatgtaagtaacaaatcctgataatgttcaattctgaataaaacttagcaaggtagtttta

SEQ ID NO: 342366 - DNA, 105 bp, Homo sapiens
atctatatctacttacatgtagtagtaaaaaagataatgcatacatactaatatttcattgtttagctaaggagaaaatcgatctcccatactataaactccctt

SEQ ID NO: 342367 - DNA, 342 bp, Homo sapiens
atgggctgtaaacaggggagtaattacatgggctggcaaggctagcagatgtctttagggaactagagagccaaaggagccaggagggcctggtatgtgaccctggccacttgtaccagccagcctgtgcacaagagggaacagcttgtgctccccatggagggacagggaagcaattaactccaacattcccttctcaaggaaccccccagctcctctctaccccctgaaatcccagccagcctcagagagtatcatggtaataagccagatcccaacactgccccccaacaactgccccctatcccaacttgggaaccttttacttagagcttgctcttt

SEQ ID NO: 342368 - DNA, 598 bp, Homo sapiens
gattcgagctagttctgctgtcttcgtgcgcccatagtatcatggtgattactggtctgctacacgtctgccagtgagctaaatttgtattttttaagtagagatggggtttcactatgttcgtcaggctagtctcgaactcctgacctcaggtgacccaccctccttagccttccgaagtgctgggattacaggtgtgagccactgcacctggcctaaacaatatactctcttaagaaataacacacttcttaaattttaaagcattttgactagtggttctttttttttctgtgtttgaaatttggctagttgggttggctatagtaatcatctggagatttttatgcctgaagcttgattgccctctagcaagtccaaagcaagaagaggttcttccccacagggatcaatttgttgcttttcctttctgcagcttctgccataatgtttgaacacagagttagacgttgacattttctcatgctgttccttctgtcttcccacaagggttttcttagacatagattcttaccgtatatagaccttggttctttttttttttttttaaatcctgattgtgaagtgtgtttagtca

SEQ ID NO: 342369 - DNA, 531 bp, Homo sapiens
ctatccatagaggtatccatccatatgtttttctgcaaaatgtttttactttacattccagccattttctggcctcctagaaacccagttgtgtggaagtcagtaagggctaccctactatgcatttacaaggacacctttcttactgccttcagtgtgaatgccaccccttgaaacacaactctaaccaaagttactggactcagaggtgatccaaaggtgaggccctggctcagagtttattttgcaagatccagtcaaatgcatctcaaattgaggcccagaaaatactcattttaacaaactttccagatgattgtgatgctggtgattaacaggctcttttgatgactcttttggactctgatggctctttgtcttttctagaatattccttttaacaagacaggggaataaaggtagcagactagacagaagtgcactagtagttatcggtgccaattctgcctcgagtactgagttgggcttgtatgatttgttaatgtaacttaattgaattttacccagtgt

SEQ ID NO: 342370 - DNA, 395 bp, Homo sapiens
aaaacattataatgttttgtctgatatttccaatgtttttgagcatggacataaatagagactattttatagtagaaagttgtgaaacatgtgaattggccctcattctgtcttacattctaagtccaaatattaattatccaacagtctgctcattatattgagcagacatatatgcacaaacacaggcatgcactcagcatgtgagaaatgaatagagactgagtaactaagaaagtttgttccttatggccattttctttagaatgtgttggattaagactacttaaagaacttcaaaaatcataatgtattttagagagattataaattattttttcataaagtctatatgtatagctgcctcacttttctgactatagatagtacactcc

SEQ ID NO: 342371 - DNA, 269 bp, Homo sapiens
tgttgaagatcctgagttctggtcccagctctgggggcttattagctgtgtgaccttggcaaggtatttaccctttctgagctcagtttcctttcctacaaaatggggaaaacatctcaggattgttgtgaggttgtttcatattaatccacttaacacataaggtttacctacactccaggctctattcttggcacagaggaataaaaaatgaatatagcatgtgtcctacccttagggaacttgtagtctttaaggataagattgta

SEQ ID NO: 342372 - DNA, 771 bp, Homo sapiens
gcagagctcgtgttgtctaacctgttttctggttgggcagataaacaggccatgaaatgagtgcacacagtgctcacgggaaccaagagctggctgggcgccgggtgccaagcgcaggggccctggaggggctggtccagctggcgtggcctcagtgtggtgggcggcccggtgagcacctgctgctctaggggctggcttccttgtcctctcccagcaccctgtatgtctgctgtgttctcagaaacaaagttcgagaccaaaggctggcgagccagggccctggctggaggcagacgagatgggtgcaggatctagaacgtgcttccaggcgtgtgctcagcggggagtgcggcctggcttggttgcattcttattgtagatttgcttttagaacaggtggtcttaaaaaggcctggatgctttgccagagcgtaggagccctgctgtgtacacaggcgtggcttacgattgttggtaacttaagacttcgagtcttgaatcaatcaccagaaaaaaaaaaaaaaaaaaaatcctaggaggtggcccaatccgagctgccatacagaaagtgtgtgcatgtggacctgtgtgtgcacgtacgcgcctgcctgctaacggcaatgaagacagaaacttacagagagaaagtggctcccatctgcaggttccagaagccaggctcttgtctgcaggcgagaatgctgtgtggtgtggccagaaacaagtgtgagcagagcctgctcggctctgagaccaagcttatcaccc

SEQ ID NO: 342373 - DNA, 467 bp, Homo sapiens
aaaagtttttttttgttttttattttgtggaaaacaaaagcagaaaaactaaaaccccaaactccagaaaaaatcctaaaaaatatgttttttcttaaaaaatactgtatgtctctactcctctccctccctcccaacagcccttcttgtgttctttcttttctaagtgccctatcccccccacatatacatgcacttctaagagaaggaaatctttctctgggaccccgtattcccctggcctccaagaacccttttcccagctccagattcttgcactctcaagagcaagtctctccaaggaatcatcttccctctctcaggatgtgtgcatctgctcagcctcccactcttacctttctgccccagaccccccaccccccaattctcctgggccaaagagccctttttccacgcagcccaggggccccagcctcctggcctccacgcctgcgcggctagcggat

SEQ ID NO: 342374 - DNA, 621 bp, Homo sapiens
ttttcttctctacttccataatagtgtagtagttaatagcatggataaatgtcagttgttctgaggctgagtaactgactttcactttctgaagtgaaagaactcgaaatttgagtcccaattccatcattccctatgatcttcatgtttcattaggcaaattgtttaaactcactttcctcatccataataacaataatagtactgcctctttcaaagcattgtcagaatttattgagattatatataataatagcagtgtgtgtatatatacgaatgtatatgcctagcacactgaagtgatttctcacagttaataataaaaatcaagggagtaggaggttcagaaaaagtaacgccaaaatgtgtatacaatctaacaattaaagaacattgtgttgccagatgattcagtaccctctaaaaagatgaacttcagatgatcctaaaatgaacatgatagaaggaaaaatattttccctcaccaaggagattgtaattaatgtttgaatcactcgatgcttatgaatccagcagagggataaatacctatatttatatacatacacacagaagatattaatatatatgcttttgaaacatgcccccacacatttatat

SEQ ID NO: 342375 - DNA, 179 bp, Homo sapiens
tcacacaaagattcattaggagctagctctagccctgatgctgggatacagaaatggatatgacagtgtccttatctccaaggatctcacaatataatagggaacacaggcaaatacacatgcaattatactatagcatcacaaatggtgttataaaggaaagtccaaggtgccatgag

SEQ ID NO: 342376 - DNA, 341 bp, Homo sapiens
cactgcacgtatttgagagcattattttggcccaggaatcacaaaacagagttttaaaactgttctttaaaatcctaacctgctagcaggctctagactctaactcatgaaagcctctgtgagtttggagtgtgcctgtcattgctgtgtagttccttgaacttttattggaaggtgaagatgtgatgtgtagatactgagcaagagaaaatggttggggggcaaagggtgatcgtgtttgaggttataaacaaccacaaaaccgcctttgagagttgagtgctctgaacgttaagagcttgcaaaccctttagaatggctgggctttgtatggttgactg

SEQ ID NO: 342377 - DNA, 2234 bp, Homo sapiens
gtcaacaacccccgaggaaatttccaccccaatagaaacaacatatagaacggaacattcaggtccaccagagtgggcaacttaaatcctggagctaaaatatgggtacagtgtccatcagatcctgcccctaagactgctgaccttgtagctattggagcagaatatgaaggcacagtacaatttcctaaagatgaaaaacagtatcatgttcccctccatttttgttactacagagaataacctgtctgctagtaatcagcacctggatcaccatgtctgaggctgagaatgagttcatcaactgggtagccactgctgcaatagaagccaactgcagtcagtgctggctctgtgttgagttgccagaggccgctgggaatgggctaccttggagaattgtccctgctaacatttctgaatggatatgccaataccaatgggagtgggataacacttggttttgttttgattttttgagccagagtgtctctctgtcgcccaggctggagtgcagtggcacgatcttggctcagtgcaacctctgcctcctgggttcaagcgattctcctgcctcagcctcccaagtagctgggattataggtgcatgtcgccacgcctggctaattttttgtatttttagtagagacggggtttcaccgtattgcccaggctgatgtcaaactcctgagttcaggtgatctgccctcctcggcctcccaaagtgctgggattgcaggtgtgagccaccgcgcctggcccgggataacacttgaaatccaacctggacttcttttaaccaaacagtctatttttgcccttgcccaaacaaaacacagcacctttgttacttcaattacacattacagcgatacaattataggagaactcttcctgttccctggggggccctctaggtatgcgaatcctacaggtggcaatacctgcttggacggggagacacacttgggggtggccattaattccattcaccatctgggataatatttctctccccagtaatctagatgcttacaaacattgctggttatgaatgcgccggactccctggtgacggtaccctatcacagtattctcccctgccaccggtacaatcctgcttcagcaacaaattcaaacattcagcttacatgtagaaaaagctcttaatgatagtagcatggaacttatgttgtaatcagataaatttgctcagctgtgtactgtcatgttgcaaagtcaaatggcattaggtttgcttactgcagcccaaggaaaggtttgccccttactgcatcctgaatgttatgtgtatatccctgacaattctcacaatatgaatctccttgcgaagccatgaggggtgtggtttttattaattatgcttttagttctcctgtgcttaccctgtatctgtaatctatatcaattgtggcttccctgtgtatccgtaagagtattttcctacagttgagtatcagattgaggccaaatgtggaggaaaagttaaatattaaatttgaactcaattgaacatggacacaaacaatggtcaccaagtcccggaacaggttgtgtgagccccttgaggcattcatccagcgctgtttcagataaatctctatttcaatctattcctatatgttagttattgaaaaacaacagacaatcgcaaaaacaagttgacctttttgtgttccttgagcctggtcatgaagggccctcgtgcctggagctcatgccaaacaactcattacaaaagagctagggtcctagattgtgccgaagcttcatgagacctctcctcgtctgtgcacggacgagtggccgactctggagcccaggctgttgtttcctagtctggtggtgaatccgccatagtctggtgagtgcagtgtccgactctcgagcccaggctgttgctgttgcttcccagtctggtggtgaatcctccatagtctggtgagtataaatacatatatctcttttcctttctccccttcccattgcaacttgcttactatatcatttgcttattatatctgcattgccatttatgtgggataaagcttgtttacccttaaaggtattgtatgtgtgccttttcttctcccctcactcgtctctcgcacagaacactaggcaggggtaggaggaactgggagtggggggaccacagggacaaatggctgtgttcatttctcaggggccaggccacccacccatccccctct

SEQ ID NO: 342378 - DNA, 254 bp, Homo sapiens
aagaggaaactgagcacagaagaggtcacgtggttttccactatccacagctggttagaagcagaataagggttgaaacccaaatgcctgcagcatcctggcatcacagagccttcatggtcttaaaggtgggatgaattattctataccagaataatgttttggatggcagtattggaaaactatctgccttgaaagttgcttcagatgaatgaaaacctattatttttaaaaagtaaagcacttcaaatgtg

SEQ ID NO: 342379 - DNA, 814 bp, Homo sapiens
ttaaatgtcccacacacaagacaaatacgtgttcaaatacatcagtctctgaagcctctgcaccactctacacgctgctccttctgactagaatgccctcctgcccctccttccacctgtcaaactcccaatcaccctttaaaaccagattgaattattttcttctgtgaagctttccctgacaccccgggaaagaataatgtttccacagtgttttgtcatttactccataaaagaaacaaaaacatgtatttttaaaagtatctgttatctctaatagcttgtaaacatcttgaggaaagagactaagttttgcttctttttcccccaaagagaactttattaaaacatttaccatctctttagagagaggttttaccatctctttagaaagctccagaatctacaaccaggaataagtgttaatgggatagaaccaatgagagaacagcatatgatagtgaaatgtactttattattaatacgaattcagtgggctcacagaatgaacctttttgccaaacggggggaaagcattttctgtaaagtatctttagaaaaatatgtataatttgaaaaatggttatccaaatttaacatttgtcatataaaaggctcataaaacgtgtgtggctgtgtttctcaaaattgtggggtcaattggtcacattatgcctagacattctggttttgttcttggggttaataatggttgtggtcttataagaaaaggaaatctggaaatcttgtccctgttattaatacacctgtcattactaataaaagtggtttgttgatatgctaaataggttga

SEQ ID NO: 342380 - DNA, 773 bp, Homo sapiens
cggggggggggaccggctcgggacctaagtaagggtttcacagccaaaggcttggacacaaggacaggatgacggaccgttgtgagtaccgtgagaaatccaagtctagcaggaaaaacggaaagctttcgcaatgggaatcgaaatttaagccttcaatataaaaccccggtatccagccaaattcaacattactgcaagtcttagagatttaaacattcatttgattcagagctaaatattcaccataatccaggagggtctccttccccactgcagaggcagaacgtccaagaatggagtaagattagtcatagtaaagtctcagtctgaatatttagcaagagaaacaggcagcagaggaacccaaaggcagtaaatcaaatattctaaaacccaaagttcattattttcatccaaaagactttcacagaaacacattactcacagccatgtatatcttggacagagtttcagatggaatgacttgtctgaaatttgtaaagcttaatataggttttgggggaattattttaatattcaaagaatgttttattatagtcctttgtgttaaaatttagccttactaattataacaataactcataaagttctaaattcagaaggaatgtctgttctttatcaagtgtatgtaactattttttagaaatgccatctactttctagaaacactaaagttattgttttctaagttaaataactataatttatatatctattaaaaaggtacttctcttcccaaaaaactagta

SEQ ID NO: 342381 - DNA, 1609 bp, Homo sapiens
cacaagctcacctcttggagctgcttctcctacacttctcagcccattgctttgccaccccctcatgtgccagggcatcccattccaggcttcctgcaaggaaacggttggaagtgggaaaggggagctagggattgaggggttaagggacctcacactaagaaggggctgtgctttgatcccctgcctcttgcactaccaatgtctcaagacataatattcatctcttgctgtcagacccattctatattctaaaagcttctgctccttccttcccaatttctcctttgtagcaggaaattacacccagccctcatctcaattaatgctaaataaagctattgtttttccaaaacacaaatctacactgggtctcaatatcagtgatgaggcttacaaaccaacacgttttctgccatgaggatttctctttaggccagaagtacaaaacaaaaaaaccaatggattttaaccaaaatgatttgaaatataggtgaggattcaggagaaggcaaaagctagaaacacttggggttgtcaacatgagtattacattaacattgcttgatgagaacctctaatgatactgacaacataaattacctagggtaaaggatagctgcaacaatgaaacaggaaagaagagagggagagagaggaaagggaaggaagaaaggaaggagggagaagggaagaaagaaacaatgtctaacccaaccctatcttgaaagttgaactcaagtagaaaaatggatagaaacaaaattctctagtactcatccaggaaaccattcttcaatgttgcatgtggctgtttgccaaggcacacaaagtgcttgtaggcagcaaccatatgctacaagaattgtaaactgcatacagtttgtttgaagtagacagtgaggataataacaaagttgctaggcaggaaaaaaaatcaggaaaaaagcttgtcgctatttgagaatctgtatatttttaaaggcttaaaatattataaccacagggtatccagccaaattcaacattactgcaagtcttagagatttaaacattcatttgattcagagctaaatattcaccataatccaggagggtctccttccccactgcagaggcagaacgtccaagaatggagtaagattagtcatagtaaagtctcagtctgaatatttagcaagagaaacaggcagcagaggaacccaaaggcagtaaatcaaatattctaaaacccaaagttcattattttcatccaaaagactttcacagaaacacattactcacagccatgtatatcttggacagagtttcagatggaatgacttgtctgaaatttgtaaagcttaatataggttttgggggaattattttaatattcaaagaatgttttattatagtcctttgtgttaaaatttagccttactaattataacaataactcataaagttctaaattcagaaggaatgtctgttctttatcaagtgtatgtaactattttttagaaatgccatctactttctagaaacactaaagttattgttttctaagttaaataactataatttatatatctattaaaaaggtacttctcttcccaaaaaactagta

SEQ ID NO: 342382 - DNA, 435 bp, Homo sapiens
ccccctcctccaatattggggattacaatttgacatgagatttgggcaaggacagaaatacaaaccatatcaattgtgatattaaaaatttaagagaaagttatcaaatatagtgttcaaaaccttttctttggggtaagagtagctttaaaatttttctgggattctctatctccttaatgccaaattctaacctgtgtaatatttagcctagaacatcaataaaacaggaatgcaggtggttggagggcatagaagcctcttcatgatgtaattgctgtccatgttttgttgttgttgttgttgtttttttgagacagggtcttgttctgttacccaggctggagtgcagtggcacaatcatggctcattgtagcctcagcctctgggctaaaataatcctcccacctcacctcctccccaccagtagcttga

SEQ ID NO: 342383 - DNA, 150 bp, Homo sapiens
ttgggtaaaagtgggcatttttcagttagacatttacctaattttaatgaaaatacaatgaccctagaacatcctgcccatgattctgcccaagtttatgcaaacagaaaaaatttattttggaaaaaaccggatcttaaactgaaattc

SEQ ID NO: 342384 - DNA, 325 bp, Homo sapiens
ccaggagacatttttgcccttaggtgattttggcatggcaacatacagtactgaagcggtcaacaatagtttcaccaacatggaaaatccaatggagtatatttccaaacgtctttgttacccaaatgcaaaaagttctctggtttgccagacacagatatcataagtaacagcgaaagtaaccttcccatagcccatcttccttctgggcattaagcacgtgaacacacacatcacagattgctactctgatcactatggaggcagaatctgcaacatgttatcttctgtatagccacaacatccgaagtggagtagtcccttg

SEQ ID NO: 342385 - DNA, 236 bp, Homo sapiens
gaagttacccagtaacctccatttcattacatatcaaagtgttttctactttggtagaagagaagtgacctctctcttcactcaggtagggagtcccagaaaaccagagccccagtgaagtccatctagaggaatttttcacacgaccaacagataaattttctttccaagtaaagccaagtgctgggtccagggtgctaggctatcaacacaagcacaatgaggaagacttctct

SEQ ID NO: 342386 - DNA, 645 bp, Homo sapiens
aaagagcattccagccagaggcaacagggtgtgcaaagtcctgaggtgggacagcaaattgagataatgaaggaccaggaagaaagttgatatggagtttttgctctgttgcccaggctggagtgcaatggcatgatcttggctcactgaaacctccacctcctgggttcaagtgattctcctgcctcagcctcccgagtagctgggattataggagcctgccaccacacccatctaattttcgtatttttagtagagacggggtttcaccatgttggccaggctggtctcaaactcttgacctcaggtgatccacctgccctggcctcccaaagtgctgggattacaggtgtgagccaccgcacctggcccagatttgcattttaaataacccttctggctacaatgccaataaaaattggaggagcaagagtgactgagggcagacctgggaggaggtcactgcaggtgtccagatgagagatgacaatggcctggaccaggatggggaggagagagagagagaagcggaaggctttttttgcaaagtaaatgagtaggacagatgcagctatgtaagggacagcatccataagaacctaaaatcaagatatgccagaatcattggccttattgatcatttgc

SEQ ID NO: 342387 - DNA, 701 bp, Homo sapiens
aaagagcattccagccagaggcaacagggtgtgcaaagtcctgaggtgggacagcaaattgagataatgaaggaccaggaagaaaggcagggtagctagagaagattctcagaattgatgtaatcagatttgcattttttttttgatatggagtttttgctctgttgcccaggctggagtgcaatggcatgatcttggctcactgaaacctccacctcctgggttcaagtgattctcctgcctcagcctcccgagtagctgggattataggagcctgccaccacacccatctaattttcgtatttttagtagagacggggtttcaccatgttggccaggctggtctcaaactcttgacctcaggtgatccacctgccctggcctcccaaagtgctgggattacaggtgtgagccaccgcacctggcccagatttgcattttaaataacccttctggctacaatgccaataaaaattggaggagcaagagtgactgagggcagacctgggaggaggtcactgcaggtgtccagatgagagatgacaatggcctggaccaggatggggaggagagagagagagaagcggaaggctttttttgcaaagtaaatgagtaggacagatgcagctatgtaagggacagcatccataagaacctaaaatcaagatatgccagaatcattggccttattgatcatttgc

SEQ ID NO: 342388 - DNA, 124 bp, Homo sapiens
tcatatttttctaaaagtatttttactctattactattactaaaatagcatgcacatgaattaaagaatgcattcaaataaatgtatgtacaatgcaaaacagatctccccactcagcctccag

SEQ ID NO: 342389 - DNA, 373 bp, Homo sapiens
agcattggaagatcaaatcttccatgtcgcactattgcttctgacaatgtatcaaaccgcatcactttttcagctttggatcttaccctctgcagaagttccttatgtaatagatttcatgttaagaaaacagggtttcctgcagttctgaacattcacagaaactcgattcaccaccagaatcttaggaggcattttggcgtctgatgcaatttagaacttaaatggagacacaatctgatgcctgacctgaattgtttaactataaaatatgttcctattaggaaagtcacatacaacaaaaggaaacatactgtgagagaagactggggaaaaattaaatgacttcccaaagcctaaacctctgaaaaat

SEQ ID NO: 342390 - DNA, 770 bp, Homo sapiens
tgcctgcccagtttctaattggccccacatgccctttctgtatgggaaatagatattttttttgtataagccttttctctagatgtaagcagctaaatctcgtgtttctctgggggcctgtttagctgggggcacagttccgattttcccctccccctaacccccctagtgcatcccttcttgactgctctagggaggttcttctgacctctgagtgtcagtcagtcagcctgttgggaatgctgacttttctggtggtggttatcggcctgggaggcttggtttcccctctcctgagccttaggcctctgatcatcttgatttgattttttttgcttggtgtttgggtggtagagggggtgagatttgagatagaagttggggacgaagacagaaatcaaaggtggaaagatagtttatctgaagtgaatctctgggattctttgcctgaaatgggagctaacttgtgagattaagagtgggagagtgggtttggtgttcttgggggaagctgcctgtgtgggggagggtgtgtcctgactaggaggcctgctctctttatctcttggaagttggaatgagggagtgggagaaactgggtgaaagccgaatgtaggaacagtttctacacctctgagcaggtaaaagtggccctaatctctgagctctcatactcaattcagcagttttaatttttccttttgaatgagagagggtccttgaagcttgaaccttcaccaggcctgcttcttccctgcagctcccacccc

SEQ ID NO: 342391 - DNA, 370 bp, Homo sapiens
tcaggaagataaaacacagagaggtttggacaaaacagattgaaggaagggagagatgttgctttctgagccattagggagcttgcctggattagggtatcaagttgattctcttggggatcttgttgaggcccacttggagcagccgttagtgacttgatctgtggaagctgggtcccgtgcagaccaagacctggaaattcaagtaatgatgggcctggtgagccagaacctcatctgacctcatgccatctagtcagaaagaacagctgatgtggtgaagtgccaaaagcctcctgcaaagtctggactgattgacttcctagagaatcctagtccagttgaatgagctcatggacccttcccagga

SEQ ID NO: 342392 - DNA, 197 bp, Homo sapiens
aagtattggaatttggttggcattgcatggaatctgtagatcacaactgggaacaattgatatcagtattgagtatttcaatccatgaacatggtatatcttcctattgatataggtctttagtttttctcagtaatgttttatcgttttttggggttgttttgtttgtttgtttgttttttgacggagttgcactc

SEQ ID NO: 342393 - DNA, 423 bp, Homo sapiens
gtccataaattggaaaaaaaaaaaaaaagaaacttttcttgttagactcagcccaccacatcaagaagtaacacaataggaactctgggatccttagccttttacctatttaactgtatttttaaaagatagggcattggccgggcgcagtggctcaccctgtaatcccagcactttgggaagctgaggtgggcggatcacctgaggtcgggagttcgagaccagcctgaccaacatggtgaaaccctgtctctatttaaaaaataccaaaaaattagccgggcatggtggcaggcacctgtagtcccagctactcaagaggctgaggcaggagaatggcgtgaacccggaaggcggagcttgcagtgagctgagattgtgccactgcactccagcctgggcaacagagcaagactccatctc

SEQ ID NO: 342394 - DNA, 274 bp, Homo sapiens
tcactgtacctcagcatctgtcaacttatttaaatgtgtgtgttggttttctgtgccttgggatctactcattcattagaatgtgtgttttggttagattgtgccccagtatctatgtattgaaatgtgtgtgttggttcactcagcctttccatttatctatgtattgaaatgtgtgtgttggttcattgtgccatggcatctgtctatttattgaaatgagtatgttggttttctggacctgggtatctgtctatttattgaaatgtgcgtg

SEQ ID NO: 342395 - DNA, 241 bp, Homo sapiens
tatggggctgtgagaagacgacgggacgggacgtggcggccgagtgtgtgcgaaacctaaacgaacgcatccggcgggacgtcagggtctacatcagcctcctgcccctgggcgatggactcaccttggccttcaagatctagggctggcccctagtgagtgggctcgagggagggttgcctgggaaccccaggaattgaccctgagttttaaattcgaaaataaagtggggctgggacac

SEQ ID NO: 342396 - DNA, 1140 bp, Homo sapiens
tctagacgcatactcccaaccacaccacctctgagttaggctaggtactgaggctggtgttttaaatttggcctgagggaccagccggtgccccggctctccgtgcccgccgcgctggccctgggctcagccgcactgggcgccgccttcgccactggcctcttcctggggaggcggtgccccccatggcgaggccggcgagagcagtgcctgcttccccccgaggacagccgcctgtggcagtatcttctgagccgctccatgcgggagcacccggcgctgcgaagcctgaggctgctgaccctggagcagccgcagggggattctatgatgacctgcgagcaggcccagctcttggccaacctggcgcggctcatccaggccaagaaggcgctggacctgggcaccttcacgggctactccgccctggccctggccctggcgctgcccgcggacgggcgcgtggtgacctgcgaggtggacgcgcagcccccggagctgggacggcccctgtggaggcaggccgaggcggagcacaagatcgacctccggctgaagcccgccttggagaccctggacgagctgctggcggcgggcgaggccggcaccttcgacgtggccgtggtggatgcggacaaggagaactgctccgcctactacgagcgctgcctgcagctgctgcgacccggaggcatcctcgccgtcctcagactcttggtcacctcctgccgggcacttccttccggagggccggctcccgcaaggaactacctccggaaacccgccttcgtctggaactccttccaagacccagagactaccagacagaacacaacactatacacaacgaaccaggattagacagacaactacagcagaaccccgcagaccaagctagtacgacaccgaccacggaaggcagatacacgagaagctcacactaaaagaaagggaatagcaagaaagtatctaaagaaatagcgagccagtagcgacaacatgaagagcaaacagagactgaataagaacaacccgatacaaaaggcaggacgaaaacagaagcaaggacaacaaccacacaagcagaggataaaaagatgataaaaacagcaagcacccaacgccacacagaactatcga

SEQ ID NO: 342397 - DNA, 985 bp, Homo sapiens
acgtgacctgtcactgcctcccgccgcctcctgcccgcgccatgacccagccggtgccccggctctccgtgcccgccgcgctggccctgggctcagccgcactgggcgccgccttcgccactggcctcttcctggggaggcggtgccccccatggcgaggccggcgagagcagtgcctgcttccccccgaggacagccgcctgtggcagtatcttctgagccgctccatgcgggagcacccggcgctgcgaagcctgaggctgctgaccctggagcagccgcagggggattctatgatgacctgcgagcaggcccagctcttggccaacctggcgcggctcatccaggccaagaaggcgctggacctgggcaccttcacgggctactccgccctggccctggccctggcgctgcccgcggacgggcgcgtggtgacctgcgaggtggacgcgcagcccccggagctgggacggcccctgtggaggcaggccgaggcggagcacaagatcgacctccggctgaagcccgccttggagaccctggacgagctgctggcggcgggcgaggccggcaccttcgacgtggccgtggtggatgcggacaaggagaactgctccgcctactacgagcgctgcctgcagctgctgcgacccggaggcatcctcgccgtcctcagagtcctgtggcgcgggaaggtgctgcaacctccgaaaggggacgtggcggccgagtgtgtgcgaaacctaaacgaacgcatccggcgggacgtcagggtctacatcagcctcctgcccctgggcgatggactcaccttggccttcaagatctagggctggcccctagtgagtgggctcgagggagggttgcctgggaaccccaggaattgaccctgagttttaaattcgaaaataaagtggggctgggacaccaccggaagcacacgccccacccactagaaccaagcctaacacacacaacaaagcgg

SEQ ID NO: 342398 - DNA, 1016 bp, Homo sapiens
acgtgacctgtcactgcctcccgccgcctcctgcccgcgccatgacccagccggtgccccggctctccgtgcccgccgcgctggccctgggctcagccgcactgggcgccgccttcgccactggcctcttcctggggaggcggtgccccccatggcgaggccggcgagagcagtgcctgcttccccccgaggacagccgcctgtggcagtatcttctgagccgctccatgcgggagcacccggcgctgcgaagcctgaggctgctgaccctggagcagccgcagggggattctatgatgacctgcgagcaggcccagctcttggccaacctggcgcggctcatccaggccaagaaggcgctggacctgggtaggggcacgcggccgggatcccggagggccgaggtttccgggccgacccccactctgggctgagcccgtctgtgtcctggtcccaggcaccttcacgggctactccgccctggccctggccctggcgctgcccgcggacgggcgcgtggtgacctgcgaggtggacgcgcagcccccggagctgggacggcccctgtggaggcaggccgaggcggagcacaagatcgacctccggctgaagcccgccttggagaccctggacgagctgctggcggcgggcgaggccggcaccttcgacgtggccgtggtggatgcggacaaggagaactgctccgcctactacgagcgctgcctgcagctgctgcgacccggaggcatcctcgccgtcctcagagtcctgtggcgcgggaaggtgctgcaacctccgaaaggggacgtggcggccgagtgtgtgcgaaacctaaacgaacgcatccggcgggacgtcagggtctacatcagcctcctgcccctgggcgatggactcaccttggccttcaagatctagggctggcccctagtgagtgggctcgagggagggttgcctgggaaccccaggaattgaccctgagttttaaattcgaaaataaagtggggctgggacac

SEQ ID NO: 342399 - DNA, 1552 bp, Homo sapiens
tctagacgcatactcccaaccacaccacctctgagttaggctaggtactgaggctggtgttttaaatttggcctgagggaccagccggtgccccggctctccgtgcccgccgcgctggccctgggctcagccgcactgggcgccgccttcgccactggcctcttcctggggaggcggtgccccccatggcgaggccggcgagagcagtgcctgcttccccccgaggacagccgcctgtggcagtatcttctgagccgctccatgcgggagcacccggcgctgcgaagcctgaggctggtcagcagggcgcgggacggaaacgggcgtccctctcgacccctgcgggtcccacgtggctgtgtgaccttgggctgggccctggccctccctgggcttccggcttccctgggccgggtgcggtgggcgttgccgaagggccagtcccccaggccacgcccagaaccgcgcccctggggcttgggacccccagggcgaaggtgggtgacctgcatggctggtgccaccctctcctttcacgcagctgaccctggagcagccgcagggggattctatgatgacctgcgagcaggcccagctcttggccaacctggcgcggctcatccaggccaagaaggcgctggacctgggtaggggcacgcggccgggatcccggagggccgaggtttccgggccgacccccactctgggctgagcccgtctgtgtcctggtcccaggcaccttcacgggctactccgccctggccctggccctggcgctgcccgcggacgggcgcgtggtgacctgcgaggtggacgcgcagcccccggagctgggacggcccctgtggaggcaggtgagcgcccgcgcctagctctgcagccccaggcgggggcgcaacggctgacccgctccctccgcaggccgaggcggagcacaagatcgacctccggctgaagcccgccttggagaccctgggtgagcaccgaagcgggaagggctttgaagccattcattgcaaacgaggctgctgtgtggccgagctgtgactgggcctgccgggcaggttaagggcagggccggttgtcacagagcccgggccggcctgggaggggcctcagggccgcgggggccgcggactcagcgcacctgcctccctccccccgaagacgagctgctggcggcgggcgaggccggcaccttcgacgtggccgtggtggatgcggacaaggagaactgctccgcctactacgagcgctgcctgcagctgctgcgacccggaggcatcctcgccgtcctcagagtcctgtggcgcgggaaggtgctgcaacctccgaaaggggacgtggcggccgagtgtgtgcgaaacctaaacgaacgcatccggcgggacgtcagggtctacatcagcctcctgcccctgggcgatggactcaccttggccttcaagatctagggctggcccctagtgagtgggctcgagggagggttgcctgggaaccccaggaattgaccctgagttttaaattcgaaaataaagtggggctgggacac

SEQ ID NO: 342400 - DNA, 928 bp, Homo sapiens
acgtgacctgtcactgcctcccgccgcctcctgcccgcgccatgacccagccggtgccccggctctccgtgcccgccgcgctggccctgggctcagccgcactgggcgccgccttcgccactggcctcttcctggggaggcggtgccccccatggcgaggccggcgagagcagtgcctgcttccccccgaggacagccgcctgtggcagtatcttctgagccgctccatgcgggagcacccggcgctgcgaagcctgaggctgctgaccctggagcagccgcagggggattctatgatgacctgcgagcaggcccagctcttggccaacctggcgcggctcatccaggccaagaaggcgctggacctgggcaccttcacgggctactccgccctggccctggccctggcgctgcccgcggacgggcgcgtggtgacctgcgaggtggacgcgcagcccccggagctgggacggcccctgtggaggcaggccgaggcggagcacaagatcgacctccggctgaagcccgccttggagaccctggacgagctgctggcggcgggcgaggccggcaccttcgacgtggccgtggtggatgcggacaaggagaactgctccgcctactacgagcgctgcctgcagctgctgcgacccggaggcatcctcgccgtcctcagagtcctgtggcgcgggaaggtgctgcaacctccgaaaggggacgtggcggccgagtgtgtgcgaaacctaaacgaacgcatccggcgggacgtcagggtctacatcagcctcctgcccctgggcgatggactcaccttggccttcaagatctagggctggcccctagtgagtgggctcgagggagggttgcctgggaaccccaggaattgaccctgagttttaaattcgaaaataaagtggggctgggacac

SEQ ID NO: 342401 - DNA, 1206 bp, Homo sapiens
tctagacgcatactcccaaccacaccacctctgagttaggctaggtactgaggctggtgttttaaatttggcctgagggaccagccggtgccccggctctccgtgcccgccgcgctggccctgggctcagccgcactgggcgccgccttcgccactggcctcttcctggggaggcggtgccccccatggcgaggccggcgagagcagtgcctgcttccccccgaggacagccgcctgtggcagtatcttctgagccgctccatgcgggagcacccggcgctgcgaagcctgaggctggtcagcagggcgcgggacggaaacgggcgtccctctcgacccctgcgggtcccacgtggctgtgtgaccttgggctgggccctggccctccctgggcttccggcttccctgggccgggtgcggtgggcgttgccgaagggccagtcccccaggccacgcccagaaccgcgcccctggggcttgggacccccagggcgaaggtgggtgacctgcatggctggtgccaccctctcctttcacgcagctgaccctggagcagccgcagggggattctatgatgacctgcgagcaggcccagctcttggccaacctggcgcggctcatccaggccaagaaggcgctggacctgggcaccttcacgggctactccgccctggccctggccctggcgctgcccgcggacgggcgcgtggtgacctgcgaggtggacgcgcagcccccggagctgggacggcccctgtggaggcaggccgaggcggagcacaagatcgacctccggctgaagcccgccttggagaccctggacgagctgctggcggcgggcgaggccggcaccttcgacgtggccgtggtggatgcggacaaggagaactgctccgcctactacgagcgctgcctgcagctgctgcgacccggaggcatcctcgccgtcctcagagtcctgtggcgcgggaaggtgctgcaacctccgaaaggggacgtggcggccgagtgtgtgcgaaacctaaacgaacgcatccggcgggacgtcagggtctacatcagcctcctgcccctgggcgatggactcaccttggccttcaagatctagggctggcccctagtgagtgggctcgagggagggttgcctgggaaccccaggaattgaccctgagttttaaattcgaaaataaagtggggctgggacac

SEQ ID NO: 342402 - DNA, 1273 bp, Homo sapiens
tctagacgcatactcccaaccacaccacctctgagttaggctaggtactgaggctggtgttttaaatttggcctgagggaccagccggtgccccggctctccgtgcccgccgcgctggccctgggctcagccgcactgggcgccgccttcgccactggcctcttcctggggaggcggtgccccccatggcgaggccggcgagagcagtgcctgcttccccccgaggacagccgcctgtggcagtatcttctgagccgctccatgcgggagcacccggcgctgcgaagcctgaggctggtcagcagggcgcgggacggaaacgggcgtccctctcgacccctgcgggtcccacgtggctgtgtgaccttgggctgggccctggccctccctgggcttccggcttccctgggccgggtgcggtgggcgttgccgaagggccagtcccccaggccacgcccagaaccgcgcccctggggcttgggacccccagggcgaaggtgggtgacctgcatggctggtgccaccctctcctttcacgcagctgaccctggagcagccgcagggggattctatgatgacctgcgagcaggcccagctcttggccaacctggcgcggctcatccaggccaagaaggcgctggacctgggcaccttcacgggctactccgccctggccctggccctggcgctgcccgcggacgggcgcgtggtgacctgcgaggtggacgcgcagcccccggagctgggacggcccctgtggaggcaggtgagcgcccgcgcctagctctgcagccccaggcgggggcgcaacggctgacccgctccctccgcaggccgaggcggagcacaagatcgacctccggctgaagcccgccttggagaccctggacgagctgctggcggcgggcgaggccggcaccttcgacgtggccgtggtggatgcggacaaggagaactgctccgcctactacgagcgctgcctgcagctgctgcgacccggaggcatcctcgccgtcctcagagtcctgtggcgcgggaaggtgctgcaacctccgaaaggggacgtggcggccgagtgtgtgcgaaacctaaacgaacgcatccggcgggacgtcagggtctacatcagcctcctgcccctgggcgatggactcaccttggccttcaagatctagggctggcccctagtgagtgggctcgagggagggttgcctgggaaccccaggaattgaccctgagttttaaattcgaaaataaagtggggctgggacac

SEQ ID NO: 342403 - DNA, 293 bp, Homo sapiens
ccgaagccccgcctcccacggcccggttggccccgccctcccgcaggtcctgtggcgcgggaaggtgctgcaacctccgaaaggggacgtggcggccgagtgtgtgcgaaacctaaacgaacgcatccggcgggacgtcagggtctacatcagcctcctgcccctgggcgatggactcaccttggccttcaagatctagggctggcccctagtgagtgggctcgagggagggttgcctgggaaccccaggaattgaccctgagttttaaattcgaaaataaagtggggctggg

SEQ ID NO: 342404 - DNA, 328 bp, Homo sapiens
aaagtgagactccatctcaaaaaaaaaaaaaaaaaactacttagctctgccaatgaactgataaacagaatgagctttttattaatgcatgaatagcttacattaaagtagagatgcaaatgtatattacaatatgagtgaatgtgattttagaggtttatatgaaaacatatgatgaaataattgagtttttttttaaagaagacaaaagtcagtcatcaggaaaatgcagactaaaacaacaactactcatcagaatggctaaaatgttagttagattgtgatgcagctggagcttctcataacttactgatgtgaattttaagtg

SEQ ID NO: 342405 - DNA, 699 bp, Homo sapiens
cgggaaggaagtcaaagaagtgagaaaggggaacagtggccatgagcctacaatggagtacacagggtcaggttaggtggtaccttgcaggccacgataaattttacattttattttaagggtaaagtgaagtcactgaagagttttgagcaaaagaatggcatgatccaagctgcactataaaaagatacttgtagaattctggttctggtaatagtggaatagcatgcatcacactaatccccgcagagagcaattataaactctggacaaaatatataaagcatctgttggaggtactggtgagcaaccaagagcaagtagaagcaagaaagaattcaactttggaaagaaagaaacacactgagtgaaatccatgtttatatggccttaccctcaattcaacagtgcactgtgactagaactcaaggagaaaactgtagtctggttggcaggaggaatcaagggaaatctggcactgctagagtagctggatactgaggaggaatattctaggaagggtaatgggggaggcccaaaatctgcatataaacttccctcaactcttggctgagccctggactgtgcatgtgtaggaaagattctaagaagtgcagggagaaaaaactgctgagaagccaaagaaactgccaccacaggggagacagagtttgttgttcaaatcccaccaagtagagg

SEQ ID NO: 342406 - DNA, 367 bp, Homo sapiens
ggttcaacataagattttatctggaggatgaagacatgagccagttagtccaaacaagctaatccgggaatcagaggaacggggatagagaaccttgggatggagggaagccagcagcccctgtacacatcagccccctgatggacggcgtgcccctgggacacctgattcccttgctctcagaatgaccgtgcatggtaggcaggacaagcaccatgactgccaccttaatgcccaaaactagttagaaggggccggagcccagacaaaaacttgggatgtctgacttctgggcccatgtttttttccacgggggcaggactgggcggagtctctattccgggacctaggcatcatccacagagca

SEQ ID NO: 342407 - DNA, 513 bp, Homo sapiens
gtcggacacggtggctcacacctgtaatgttatgtataccttagcgcaattaaaaaacaaaaacagtctggttcagtgggtttgttatccgatcttccctgctgaacactgtcgattacaactgtatatgtgaaaataataaaattaaagaacaaactccaaactgcacagaattaccagacactgaaacactgagagaacataatctctgaggccaggtgcagtggctcatgcctgtaatcctagcaccttgggaggccaaagcaggaggatcacttgaggccacgagttcaagaccagccagggcaacatagcgaagcctcatctccacaaaaattttaaaaacttagctgggcagccaggcacggtggctaacacctgtaatcccagcactttgggaggccaaggtgggcggatcacttgaggtcaggagtttaagaccagcctggccaacacagcgaaacctcatcttcacagaaacttttaaaacttagctggacggccgggtgcagt

SEQ ID NO: 342408 - DNA, 257 bp, Homo sapiens
tatgttagggggtggaaaagtatgtatgccaagacatggaggttcaagcctggaagagaaggggctgaggacagaggtccaatccgtatattagagtattaaggagtttagacttcattcagtgaaccgtggaatcctgtagaagttttaagcaggagtataatgtcatcgcacctccttttgcagtttagccaggcgatcatgacagctgaacctaggccaacggtggtctggaatggaatgggacagatggaaaa

SEQ ID NO: 342409 - DNA, 1104 bp, Homo sapiens
aggcaaggacacagagaaagaggactacttataggaatataagttaatacaagccttacagaagtctgactttgagccaggacttgaagcagacactatggctcatgcagaaaagaaacttcttcccacaagactgccagcgaaattttgcagactcaagatgttcggagagtttggacaatcatcacagtttttggacgcctatctgagagactggattctctgttgggaatatctaggtatcagatggtgccaagacttcagaggagggggacattccctgtttattagagggaaaagaatctggagcttctgcaatccaggataaaagagaaagctgagaagaaagggcagtttggagagagagaccatcttctgtgaagtttattcagctcataagtgtgaataaaaaattgctaaatgtgaactcaaagagacagtgcagttttacatctgagtccactgaatgcatcacagaagcagcatgtgcagcaacaggagtccaataggtgagaaaagatatggaagacatgctttgaactttcacaaaccataaaattggcgaggggaggagccaattatatcaatattgtgagaggcaggaacttcagttgcaggtgtctatctctctctgcagttctaggtttattgaagggatggatagagtctttgtacccttcaatacccaacagagctttacactcaaggagtgttctataaatgtccaacacatgcataacatagtccaaatgcacgtaatggacatcaatagcaagatgagagaataagggcagaggccttatctgcaaagaaatattttgtttaatgagaaggttgagattgttggctaaaatatcagacttccagatttgagatcttaactatcttcctttattaccaattgcagtggataaattagagttagctattgttactccatttctatcaaagtacattcagtcactattctggagagtaaatcctcaaaaacttctaattctttacagtatgtaattgttctaacacagaacccgagggccatagtaataatgaaatataaaatattgttaaatgtgcaccatttagaatggtgggaaacctaat

SEQ ID NO: 342410 - DNA, 665 bp, Homo sapiens
aggcaaggacacagagaaagaggactacttataggaatataagttaatacaagccttacagaagtctgactttgagccaggacttgaagcagacactatggctcatgcagaaaagaaacttcttcccacaagactgccagcgaaattttgcagactcaagatgttcggagagtttggacaatcatcacagtttttggacgcctatctgagaccatcttctgtgaagtttattcagctcataagtgtgaataaaaaattgctaaatgtgaactcaaagagacagtgcagttttacatctgagtccactgaatgcatcacagaagcagcatgtgcagcaacaggagtccaatagcgtcaaccaccaggaaacaaggatcacggagcatgtgagaaaatggtaattgagaaggctgatcaaggaacacactaaaattggaggcatgaaacacttgcagaattgtcccaatggtccatctggggatcctgggaacaagtgtctttcaagccacgaccagtctttctacttcttcctcatactttgtatctggcttgtgtacatgtcacagaatcaggtactaaaacaagaggtgatacagaaataagctatcccaaatatagcattaagtgaaacaaacacatcgtatactagttattatatccggaag

SEQ ID NO: 342411 - DNA, 404 bp, Homo sapiens
gttgctgctctttattaggtctgagtttagcacatttagagatccatcgatccattcaagagctactgctgaaacaaaattcaactttggtcaagataaaattttctctttaaaatcaatatattccatgtcataaaagactgctcttcatttcaagttactagcattctgtgcttgaattccaacatatgtttttctatataatcttttaatcattttaaaaaagattttatcttttattcattactatataatttttaattatttgaaaatgatcaattatttaacaataatcgtgttaaattaaaaccaattcagtaagactcatcattcccctaccctacctttggtagtattgtggaaacaaaaatgctaaagtgggagtttgtatccttaaaaagcct

SEQ ID NO: 342412 - DNA, 637 bp, Homo sapiens
cctgaaataaccactaatctattttcagttcctatagatttccctattctagaaatttaatatgaatggaattacataatatgtgactcctttggattttaagttgaggggattcataaaaggtcagaagtgaaacattcataggaagtagttgattgagccaggtgtagtggctcgcagctgtaatcccagtgtggatgagggggaaggatggcttgagtccaggagttggaggctgcagggagccatgatcgagccactgcactccagcctgggtgacattgtgagactctgactcttagaaataaaaaagctgaccaggctcagtggctcatggctgtaatcacagggcttcgggaggccaaggcaggtagatcacttgaggtcgggagttcgagaccagcctggccaacatgatgaaaccccatctctactaaaaacacaaaaaattagccggccatggtgggagctgcctgtaatcccagctacttgggaggctgaggcagaagaactgcttgaaccccagaggcaggggttgcagtgagccaagatcatgccatttcactccagcctgggcaacagagtgagactccatgtcaaaaaaaaaaaccaatacatatatatatataaaataagg

SEQ ID NO: 342413 - DNA, 473 bp, Homo sapiens
cctgaaataaccactaatctattttcagttcctatagatttccctattctagaaatttaatatgaatggaattacataatatgtgactcctttggattttaagttgaggggattcataaaaggtcagaagtgaaacattcataggaagtagttgattgagccaggtgtagtggctcgcagctgtaatcccagtgtggatgagggggaaggatggcttgagtccaggagttggagaccagcctggccaacatgatgaaaccccatctctactaaaaacacaaaaaattagccggccatggtgggagctgcctgtaatcccagctacttgggaggctgaggcagaagaactgcttgaaccccagaggcaggggttgcagtgagccaagatcatgccatttcactccagcctgggcaacagagtgagactccatgtcaaaaaaaaaaaccaatacatatatatatataaaataagg

SEQ ID NO: 342414 - DNA, 547 bp, Homo sapiens
cattcatctatcgatctaacgccaacatgcatactcacacagagacccatatcaaaaatatttaaatgcaacatgggcaggacttaaaaccgtaaacaccagtagaagcaaatgatgctaaccatacctctgaagtgccacaagataaagtatcataaatgcagaggaatgattccattgctttgtgcatatttaaaaggatatggcgctgagaggtccaatctgttatagacaattcaaaaataagccagaatctaggagggtttacatcccactggggcgagatttaaaagcagccctttccatctggccagttctcctgcctccaggaaccctgcaagcctagatcccacgacagtgtattgggcacagatttcaaagtggcattctgtgctgagcactatgagggctgactcggacctttcccccagctggctgcactctcgggccacattgtttcctgcccctccctggaaggtatgtacccttgaagataaagacatcttcatagcagcctaggtaggcttgcccacctcctgcctgaact

SEQ ID NO: 342415 - DNA, 821 bp, Homo sapiens
tggtgcggggggcgcacttctgagacggaagagcatctaggagctgaatcctccacgcgggtcgcccaggttgatctgaatttctggggaatggcttggctgcccgcccgggaccaggccgaccctccttgacggtggcgtagagggctggagcctgggtactgcgaggctcctcgcatggctgggcccgccgcgaggggttgcagagcggctcagggatcgattcaagcatcgtctctcctccctcgcccccagacagagctgggcgcggggttccccttccagatggagcgagggtctcggggtggccccggaaaaggggagcccgcggccacggctacgtattgccatctcgcgagcagagatgtcacctcctgcctttggaggaaagggagcccggtggggatgagcgcatttagcccaatgctgggaacaaagcgcactccgcgcttctgcgatttcgctccattttgaaatgtgttggcgctttggtggggccgctgcggtgggcaaggccgggggcgctgttaatggaggaacctcagggggacggtccttcgtaggaaactctatcctggctctgcgcgcgctttaaggaaatggcttccctccaggacctcgagggatgcagcttttgcgcggatgacggtggggtgctgaaccagccggtgcgcctctggaaatgtctgggcacggatcctggggccatcgacgactcctccccattcccagcaggcgggagctcttacattccgagcgagtgacccctctcaccctctggcgctcacacacctgtaactccaaacctccgtctcagaatg

SEQ ID NO: 342416 - DNA, 1792 bp, Homo sapiens
  misc_feature (7)..(7): n is a, c, g, or t
  misc_feature (136)..(136): n is a, c, g, or t
gatgacncaggcagcactagagatgcgtgttgttagactcttgcccttactgtataggacacttaattgccactttctgttggctcactgggtacgatgaaatttgtccataagtaggaatataatgctgaacttntgggaacgcgtcataatgggaacagttagatgttcgaggctttaagaaaattctggtataaatctgtcttactctgcatctagtagacagcctggcatgtaattgatgttccttaaatatttatcgaattaacccagaattttctaaactaaatttagcatgtaccactatttgttattcttgccaccaccccccattcccctagctcctcacactacctgccaatgtcatcctaaggtacatgtggatacctaggttgtagaaatgctggactacacaattgctgagttactctctggctgtagattatatgatgaggtattttacaatcagcttttgaaggtcaacattgaataatgctcttttaaaaaaattatatcctcagtgtttttccatggaaaaataagtgaaaattcttttaagagttgctgtttggtgaaaagaacaaacatgactttcaaagaaaatgttttactatcaccaaaatctcccaagtgaataagtaccacagaaattacttattgcacctgtatctgccattggctgtgaaaaaggctgcaaaaagtagggctgaaagggaaactttagaaactaatactctgaaagatgttttcctatggattaaatttagtgtctttctgaaagttgggggcaaattcccagatactaatagcatctttgctaagtgtctgattatcttctatcccctaggaggaaagagtggtccatgttgctgtaactactactatgagtgcttatgctgtattgtttttaaagagtaaaacctttaagtactaatagttgtcttttctcattcacaggagcagaaaggtgcagttgtttattctcttagccttttttttttcctgtatttcccacaaatctagaaataattattggagttaatatgaaagataaataggcttttctttttactttttaatttttttctttaaatcataaaaaaccttgggatttagaaaaatgtcaaaatcgacaaataaagatgaatcattggaatgagactcttccttggttctactagctagttatataaccttatttaagtcatttatgcttcttggagctcagttttctcaccaacaaggtgataaaagggttaatttagaatgatcctttgacatttcataattgtacaattaatatgtacgatcaggaagtcctaggcaggcagagttgttttctgatttccaaagattaagcccctgatgaaaaatctggaacaaatagagaattttcattattgtgttcatttgctaataatagctttattgagatataattcactctgaaaaagtatacaattaagtggtttttactatattcacagagttgtgcaacaataaccactcactaattacagaatattttataactcccaaaagaaatcctgtaaccattagtgatcacttcccactacctcctccccacaactcctggaaaccactatatgctttttgtctccatgcctattctggacatttcatataaatggaaccatacaacatgtgacctattgtatgtggcttctttcacttagcaaaatattttgagagttcatgcatgttgtaacacgtatgaatacttcattcctttttattactaaataataatccatcatatgaatataccaca

SEQ ID NO: 342417 - DNA, 377 bp, Homo sapiens
atatgtttactgcagcactgttcacaggagcaaagtcttggaaccaacccaaatgcccatcaacgatagactggatacagaaatgtggaatgcaccatatgtcctcatctgaaagtctctgcaggatggtctgactcacgcgagtggttttgagataagttgtgttatacctcaagttaggtaaagtcgagagatgaactaacttaaaaagtagtgatgtttacatagaatctaaattggaaaagacaataatatcagcattagaaagtttgcctttaagtaaaaaaaattattagccataataggttttacattcttcgtaatagaatatcctaaagcaataaaacctccactatgtgaactctaagttctgaaca

SEQ ID NO: 342418 - DNA, 4984 bp, Homo sapiens
cgctcagctgcttctccggcggaacccaggctggaccgcgggccccggcctgggggccactgctgccaccgccgccgccacctcgtctcctccccgtccccgcccagccccaggtctccccgcctcactcgggcccgtggccggggtcactccccgccgcccctccccgcacggatgccgaaggtgaaggcgctgcagtgcgccctggcgctggagatcagctcagtaacttgcccaggagtcgtgcttaaagacaaagaggacatctatcttagcatctgtgtgtttggccaatacaaaaagacacaatgtgtcccagccacttttcccctggtcttcaatgccagaatggtgtttgaaaaggtgttcccggacgcagtagatcctggagatgtggttacacagcttgaatatgatacagcagtgttcgagttgatacagctagttccaccagtgggtgaaacactgtctacgtatgacgaaaatacacgagatttcatgtttccgggtccaaaccaaatgtctggacaccatgattcaaaccgccaggttaccatgaggaggatttctggccttcgaggaaatgctccaaggctggaattttctacgacttcagtgattactgaatgtctgataagttcaaggaaatgccacactcaggataaatttatttaccatttggctccagttgaaaaatcacatggcagactgcaaaacagaacatcaagatcacaaaagaaaaaatccaagtcacctgagagaagtaaatactgtataaatgcaaaaaactacgaacagcctacaatttcttcaaaatcacactctccatctccctacacaaaaagacgcatgtgtgagctatctgaagacaccaggcggcggctggcccatttaaatctgggaccctatgagttcaaaaaagaaacagataaacctccatttgtgattagacatgttgatcccccaagtcccagggctgatactttattgggatcttctggaagagactgtgaaagagatggatggtcaagggtgcacaatgatcattctcatcttggctgctgccgacccaaggattataaggttatcaggacaccccatgggagagacttcgatgactctttagaaaaatgtgaagagtatttgagcccaaggtcgtgtagtaagccccggcattcagcgaggaccttgctagtccattcagcaccctcaacaatgccaaagcattctccaagccctgtgttaaatagagcttctctcagggaaagatttcattctgattggtgttcaccttcaaactgcgatgagatccatgaccgggtaaaaaatgtcttgaaatcacatcaggctcatcaaagacatttatatgatgagagagacctagagaaagatgatgaactggaactgaaaagaagtcttttatgtagagactctgcctatgacagtgaccccgagtatagctcatgtcagcagccacgtggcactttccatttggatgacggtgaatactggtccaacagggcagcctcttataagggaaaatcccaccgacccatctttgagaacagcatggacaagatgtacaggaacttatacaaaaaggcctgtagttctgcttcacatacacaggaaagcttctgagaccatccatgataaacctcattagtgtccgtgtcaatttctcaatgaaaatgtttgatgtgatcaatatctgtattcctttttttaaaaaaaatgggattataactaagtacaatagttatacttgaataagttcattacttcaaatggtaaattatcataggcaagccttttaaaataattattacagaagagtctgctgtgttacaaacattagagctctgtcacacaatcacaacttccaatatgtgacaaggatattctgttacatgtacacctcatattccatctgcaaatccaagaatagttcctttctagaaatgttttttttgccttactcaccttgcaattttcttctcatctacttaactggttatcttgcctgtgtaagatttaattaatattgactaccttttcttggtgatgaacaaaatgatatcctatacagaaatgaatttcctaagggtttaaaccctgttttcactaacattttctactttttcctttttcagaacaggctattctatttcttagctcataggctttctttttaaagactatatgatcattcactcctttttctctggaagaactgtgtaagttgcttaaaatgcatagcagttagctagaaatatcagtgccatggatgatcaaaaatttgaataactaatttttaaagataaaattctttgcatgattttttttctagggccataccttttggtgcaaccagaatcagaaaatggcctctgttagtaagcttatagaaacctaaaaataataatggaattatattgtaatttgactgcttggaatttgtgtaagtaccatatggcccaaggcactattatagtatcctcactttaaaaaaaaaaacacttggaaccacaatgtgagtaaaatattatagcagaacgctttgtggtagacactgaaaatgttgttgattgatggatagaattaacttctcctcccccaccccagcacacacctgtgaagccaatgatactataaagacataaagaaatcagctactttatatttaatagagagtgaggggagggaaaggagagtgtaggaataagtgaactgggcttatagtcttgaagagttgcctaaaagataatattttctcattgactctgtttttgattaattttacagttatgattgaaaaagaacaaaatgaacttcctttaaaatgaaattaaaatgtgaaacttgctgacttatttttgtagtagaacttgttaacatcatgttaagggtgctttagtatcacagtctgtgatatatcagaaagggcattagagctatctctatgagccaggagtcctaggctttagtatcccatgtctgccgttttctagctgagtctatttaattctcagatcctttgtttcctcagctatcaaatgataagaatgtagtagaccccaaactatgttctgtggaccaagatcactgttttaggagataatcgtaggaatgtaggtataagtatgtaattggccatctaagtttaggaaaatctgtttgctacacacatacacacacacacacacacacacacacacacacacacctcttagagagtcatatgtaggattatagaggtaaaaagagatgatattaatgctggaatagcgcctgtaaactggggctgtctacagcaaattaggatatatggtcactgtgctcattgtgaacagtagcttgttcgaggctttaagaaaattctggtataaatctgtcttactctgcatctagtagacagcctggcatgtaattgatgttccttaaatatttatcgaattaacccagaattttctaaactaaatttagcatgtaccactatttgttattcttgccaccaccccccattcccctagctcctcacactacctgccaatgtcatcctaaggtacatgtggatacctaggttgtagaaatgctggactacacaattgctgagttactctctggctgtagattatatgatgaggtattttacaatcagcttttgaaggtcaacattgaataatgctcttttaaaaaaattatatcctcagtgtttttccatggaaaaataagtgaaaattcttttaagagttgctgtttggtgaaaagaacaaacatgactttcaaagaaaatgttttactatcaccaaaatctcccaagtgaataagtaccacagaaattacttattgcacctgtatctgccattggctgtgaaaaaggctgcaaaaagtagggctgaaagggaaactttagaaactaatactctgaaagatgttttcctatggattaaatttagtgtctttctgaaagttgggggcaaattcccagatactaatagcatctttgctaagtgtctgattatcttctatcccctaggaggaaagagtggtccatgttgctgtaactactactatgagtgcttatgctgtattgtttttaaagagtaaaacctttaagtactaatagttgtcttttctcattcacaggagcagaaaggtgcagttgtttattctcttagccttttttttttcctgtatttcccacaaatctagaaataattattggagttaatatgaaagataaataggcttttctttttactttttaatttttttctttaaatcataaaaaaccttgggatttagaaaaatgtcaaaatcgacaaataaagatgaatcattggaatgagactcttccttggttctactagctagttatataaccttatttaagtcatttatgcttcttggagctcagttttctcaccaacaaggtgataaaagggttaatttagaatgatcctttgacatttcataattgtacaattaatatgtacgatcaggaagtcctaggcaggcagagttgttttctgatttccaaagattaagcccctgatgaaaaatctggaacaaatagagaattttcattattgtgttcatttgctaataatagctttattgagatataattcactctgaaaaagtatacaattaagtggtttttactatattcacagagttgtgcaacaataaccactcactaattacagaatattttataactcccaaaagaaatcctgtaaccattagtgatcacttcccactacctcctccccacaactcctggaaaccactatatgctttttgtctccatgcctattctggacatttcatataaatggaaccatacaacatgtgacctattgtatgtggcttctttcacttagcaaaatattttgagagttcatgcatgttgtaacacgtatgaatacttcattcctttttattactaaataataatccatcatatgaatataccaca

SEQ ID NO: 342419 - DNA, 4933 bp, Homo sapiens
cgctcagctgcttctccggcggaacccaggctggaccgcgggccccggcctgggggccactgctgccaccgccgccgccacctcgtctcctccccgtccccgcccagccccaggtctccccgcctcactcgggcccgtggccggggtcactccccgccgcccctccccgcacggatgccgagtgagggaggctgcgaatatatatgcgattgtaagaaaggaatcatctgtgtgtttggccaatacaaaaagacacaatgtgtcccagccacttttcccctggtcttcaatgccagaatggtgtttgaaaaggtgttcccggacgcagtagatcctggagatgtggttacacagcttgaatatgatacagcagtgttcgagttgatacagctagttccaccagtgggtgaaacactgtctacgtatgacgaaaatacacgagatttcatgtttccgggtccaaaccaaatgtctggacaccatgattcaaaccgccaggttaccatgaggaggatttctggccttcgaggaaatgctccaaggctggaattttctacgacttcagtgattactgaatgtctgataagttcaaggaaatgccacactcaggataaatttatttaccatttggctccagttgaaaaatcacatggcagactgcaaaacagaacatcaagatcacaaaagaaaaaatccaagtcacctgagagaagtaaatactgtataaatgcaaaaaactacgaacagcctacaatttcttcaaaatcacactctccatctccctacacaaaaagacgcatgtgtgagctatctgaagacaccaggcggcggctggcccatttaaatctgggaccctatgagttcaaaaaagaaacagataaacctccatttgtgattagacatgttgatcccccaagtcccagggctgatactttattgggatcttctggaagagactgtgaaagagatggatggtcaagggtgcacaatgatcattctcatcttggctgctgccgacccaaggattataaggttatcaggacaccccatgggagagacttcgatgactctttagaaaaatgtgaagagtatttgagcccaaggtcgtgtagtaagccccggcattcagcgaggaccttgctagtccattcagcaccctcaacaatgccaaagcattctccaagccctgtgttaaatagagcttctctcagggaaagatttcattctgattggtgttcaccttcaaactgcgatgagatccatgaccgggtaaaaaatgtcttgaaatcacatcaggctcatcaaagacatttatatgatgagagagacctagagaaagatgatgaactggaactgaaaagaagtcttttatgtagagactctgcctatgacagtgaccccgagtatagctcatgtcagcagccacgtggcactttccatttggatgacggtgaatactggtccaacagggcagcctcttataagggaaaatcccaccgacccatctttgagaacagcatggacaagatgtacaggaacttatacaaaaaggcctgtagttctgcttcacatacacaggaaagcttctgagaccatccatgataaacctcattagtgtccgtgtcaatttctcaatgaaaatgtttgatgtgatcaatatctgtattcctttttttaaaaaaaatgggattataactaagtacaatagttatacttgaataagttcattacttcaaatggtaaattatcataggcaagccttttaaaataattattacagaagagtctgctgtgttacaaacattagagctctgtcacacaatcacaacttccaatatgtgacaaggatattctgttacatgtacacctcatattccatctgcaaatccaagaatagttcctttctagaaatgttttttttgccttactcaccttgcaattttcttctcatctacttaactggttatcttgcctgtgtaagatttaattaatattgactaccttttcttggtgatgaacaaaatgatatcctatacagaaatgaatttcctaagggtttaaaccctgttttcactaacattttctactttttcctttttcagaacaggctattctatttcttagctcataggctttctttttaaagactatatgatcattcactcctttttctctggaagaactgtgtaagttgcttaaaatgcatagcagttagctagaaatatcagtgccatggatgatcaaaaatttgaataactaatttttaaagataaaattctttgcatgattttttttctagggccataccttttggtgcaaccagaatcagaaaatggcctctgttagtaagcttatagaaacctaaaaataataatggaattatattgtaatttgactgcttggaatttgtgtaagtaccatatggcccaaggcactattatagtatcctcactttaaaaaaaaaaacacttggaaccacaatgtgagtaaaatattatagcagaacgctttgtggtagacactgaaaatgttgttgattgatggatagaattaacttctcctcccccaccccagcacacacctgtgaagccaatgatactataaagacataaagaaatcagctactttatatttaatagagagtgaggggagggaaaggagagtgtaggaataagtgaactgggcttatagtcttgaagagttgcctaaaagataatattttctcattgactctgtttttgattaattttacagttatgattgaaaaagaacaaaatgaacttcctttaaaatgaaattaaaatgtgaaacttgctgacttatttttgtagtagaacttgttaacatcatgttaagggtgctttagtatcacagtctgtgatatatcagaaagggcattagagctatctctatgagccaggagtcctaggctttagtatcccatgtctgccgttttctagctgagtctatttaattctcagatcctttgtttcctcagctatcaaatgataagaatgtagtagaccccaaactatgttctgtggaccaagatcactgttttaggagataatcgtaggaatgtaggtataagtatgtaattggccatctaagtttaggaaaatctgtttgctacacacatacacacacacacacacacacacacacacacacacacctcttagagagtcatatgtaggattatagaggtaaaaagagatgatattaatgctggaatagcgcctgtaaactggggctgtctacagcaaattaggatatatggtcactgtgctcattgtgaacagtagcttgttcgaggctttaagaaaattctggtataaatctgtcttactctgcatctagtagacagcctggcatgtaattgatgttccttaaatatttatcgaattaacccagaattttctaaactaaatttagcatgtaccactatttgttattcttgccaccaccccccattcccctagctcctcacactacctgccaatgtcatcctaaggtacatgtggatacctaggttgtagaaatgctggactacacaattgctgagttactctctggctgtagattatatgatgaggtattttacaatcagcttttgaaggtcaacattgaataatgctcttttaaaaaaattatatcctcagtgtttttccatggaaaaataagtgaaaattcttttaagagttgctgtttggtgaaaagaacaaacatgactttcaaagaaaatgttttactatcaccaaaatctcccaagtgaataagtaccacagaaattacttattgcacctgtatctgccattggctgtgaaaaaggctgcaaaaagtagggctgaaagggaaactttagaaactaatactctgaaagatgttttcctatggattaaatttagtgtctttctgaaagttgggggcaaattcccagatactaatagcatctttgctaagtgtctgattatcttctatcccctaggaggaaagagtggtccatgttgctgtaactactactatgagtgcttatgctgtattgtttttaaagagtaaaacctttaagtactaatagttgtcttttctcattcacaggagcagaaaggtgcagttgtttattctcttagccttttttttttcctgtatttcccacaaatctagaaataattattggagttaatatgaaagataaataggcttttctttttactttttaatttttttctttaaatcataaaaaaccttgggatttagaaaaatgtcaaaatcgacaaataaagatgaatcattggaatgagactcttccttggttctactagctagttatataaccttatttaagtcatttatgcttcttggagctcagttttctcaccaacaaggtgataaaagggttaatttagaatgatcctttgacatttcataattgtacaattaatatgtacgatcaggaagtcctaggcaggcagagttgttttctgatttccaaagattaagcccctgatgaaaaatctggaacaaatagagaattttcattattgtgttcatttgctaataatagctttattgagatataattcactctgaaaaagtatacaattaagtggtttttactatattcacagagttgtgcaacaataaccactcactaattacagaatattttataactcccaaaagaaatcctgtaaccattagtgatcacttcccactacctcctccccacaactcctggaaaccactatatgctttttgtctccatgcctattctggacatttcatataaatggaaccatacaacatgtgacctattgtatgtggcttctttcacttagcaaaatattttgagagttcatgcatgttgtaacacgtatgaatacttcattcctttttattactaaataataatccatcatatgaatataccaca

SEQ ID NO: 342420 - DNA, 4936 bp, Homo sapiens
cgctcagctgcttctccggcggaacccaggctggaccgcgggccccggcctgggggccactgctgccaccgccgccgccacctcgtctcctccccgtccccgcccagccccaggtctccccgcctcactcgggcccgtggccggggtcactccccgccgcccctccccgcacggatgccgaaggtgaaggcgctgcagtgcgccctggcgctggagatcagctcagtaacttgcccaggagtcgtgcttaaagacaaagaggacatctatcttagcatctgtgtgtttggccaatacaaaaagacacaatgtgtcccagccacttttcccctggtcttcaatgccagaatggtgtttgaaaaggtgttcccggacgcagtagatcctggagatgtggttacacagcttgaatatgatacagcagtgttcgagttgatacagctagttccaccagtgggtgaaacactgtctacgtatgacgaaaatacacgagatttcatgtttccgggtccaaaccaaatgtctggacaccatgattcaaaccgccaggttaccatgaggaggatttctggccttcgaggaaatgctccaaggctggaattttctacgacttcagtgattactgaatgtctgataagttcaaggaaatgccacactcaggataaatttatttaccatttggctccagttgaaaaatcacatggcagactgcaaaacagaacatcaagatcacaaaagaaaaaatccaagtcacctgagagaagtaaatactgtataaatgcaaaaaactacgaacagcctacaatttcttcaaaatcacactctccatctccctacacaaaaagacgcatgtgtgagctatctgaagacaccaggcggcggctggcccatttaaatctgggaccctatgagttcaaaaaagaaacagataaacctccatttgtgattagacatgttgatcccccaagtcccagggctgatactttattgggatcttctggaagagactgtgaaagagatggatggtcaagggtgcacaatgatcattctcatcttggctgctgccgacccaaggattataaggttatcaggacaccccatgggagagacttcgatgactctttagaaaaatgtgaagagtatttgagcccaaggtcgtgtagtaagccccggcattcagcgaggaccttgctagtccattcagcaccctcaacaatgccaaagcattctccaagccctgtgttaaatagagcttctctcagggaaagatttcattctgattggtgttcaccttcaaactgcgatgagatccatgaccgggatgagagagacctagagaaagatgatgaactggaactgaaaagaagtcttttatgtagagactctgcctatgacagtgaccccgagtatagctcatgtcagcagccacgtggcactttccatttggatgacggtgaatactggtccaacagggcagcctcttataagggaaaatcccaccgacccatctttgagaacagcatggacaagatgtacaggaacttatacaaaaaggcctgtagttctgcttcacatacacaggaaagcttctgagaccatccatgataaacctcattagtgtccgtgtcaatttctcaatgaaaatgtttgatgtgatcaatatctgtattcctttttttaaaaaaaatgggattataactaagtacaatagttatacttgaataagttcattacttcaaatggtaaattatcataggcaagccttttaaaataattattacagaagagtctgctgtgttacaaacattagagctctgtcacacaatcacaacttccaatatgtgacaaggatattctgttacatgtacacctcatattccatctgcaaatccaagaatagttcctttctagaaatgttttttttgccttactcaccttgcaattttcttctcatctacttaactggttatcttgcctgtgtaagatttaattaatattgactaccttttcttggtgatgaacaaaatgatatcctatacagaaatgaatttcctaagggtttaaaccctgttttcactaacattttctactttttcctttttcagaacaggctattctatttcttagctcataggctttctttttaaagactatatgatcattcactcctttttctctggaagaactgtgtaagttgcttaaaatgcatagcagttagctagaaatatcagtgccatggatgatcaaaaatttgaataactaatttttaaagataaaattctttgcatgattttttttctagggccataccttttggtgcaaccagaatcagaaaatggcctctgttagtaagcttatagaaacctaaaaataataatggaattatattgtaatttgactgcttggaatttgtgtaagtaccatatggcccaaggcactattatagtatcctcactttaaaaaaaaaaacacttggaaccacaatgtgagtaaaatattatagcagaacgctttgtggtagacactgaaaatgttgttgattgatggatagaattaacttctcctcccccaccccagcacacacctgtgaagccaatgatactataaagacataaagaaatcagctactttatatttaatagagagtgaggggagggaaaggagagtgtaggaataagtgaactgggcttatagtcttgaagagttgcctaaaagataatattttctcattgactctgtttttgattaattttacagttatgattgaaaaagaacaaaatgaacttcctttaaaatgaaattaaaatgtgaaacttgctgacttatttttgtagtagaacttgttaacatcatgttaagggtgctttagtatcacagtctgtgatatatcagaaagggcattagagctatctctatgagccaggagtcctaggctttagtatcccatgtctgccgttttctagctgagtctatttaattctcagatcctttgtttcctcagctatcaaatgataagaatgtagtagaccccaaactatgttctgtggaccaagatcactgttttaggagataatcgtaggaatgtaggtataagtatgtaattggccatctaagtttaggaaaatctgtttgctacacacatacacacacacacacacacacacacacacacacacacctcttagagagtcatatgtaggattatagaggtaaaaagagatgatattaatgctggaatagcgcctgtaaactggggctgtctacagcaaattaggatatatggtcactgtgctcattgtgaacagtagcttgttcgaggctttaagaaaattctggtataaatctgtcttactctgcatctagtagacagcctggcatgtaattgatgttccttaaatatttatcgaattaacccagaattttctaaactaaatttagcatgtaccactatttgttattcttgccaccaccccccattcccctagctcctcacactacctgccaatgtcatcctaaggtacatgtggatacctaggttgtagaaatgctggactacacaattgctgagttactctctggctgtagattatatgatgaggtattttacaatcagcttttgaaggtcaacattgaataatgctcttttaaaaaaattatatcctcagtgtttttccatggaaaaataagtgaaaattcttttaagagttgctgtttggtgaaaagaacaaacatgactttcaaagaaaatgttttactatcaccaaaatctcccaagtgaataagtaccacagaaattacttattgcacctgtatctgccattggctgtgaaaaaggctgcaaaaagtagggctgaaagggaaactttagaaactaatactctgaaagatgttttcctatggattaaatttagtgtctttctgaaagttgggggcaaattcccagatactaatagcatctttgctaagtgtctgattatcttctatcccctaggaggaaagagtggtccatgttgctgtaactactactatgagtgcttatgctgtattgtttttaaagagtaaaacctttaagtactaatagttgtcttttctcattcacaggagcagaaaggtgcagttgtttattctcttagccttttttttttcctgtatttcccacaaatctagaaataattattggagttaatatgaaagataaataggcttttctttttactttttaatttttttctttaaatcataaaaaaccttgggatttagaaaaatgtcaaaatcgacaaataaagatgaatcattggaatgagactcttccttggttctactagctagttatataaccttatttaagtcatttatgcttcttggagctcagttttctcaccaacaaggtgataaaagggttaatttagaatgatcctttgacatttcataattgtacaattaatatgtacgatcaggaagtcctaggcaggcagagttgttttctgatttccaaagattaagcccctgatgaaaaatctggaacaaatagagaattttcattattgtgttcatttgctaataatagctttattgagatataattcactctgaaaaagtatacaattaagtggtttttactatattcacagagttgtgcaacaataaccactcactaattacagaatattttataactcccaaaagaaatcctgtaaccattagtgatcacttcccactacctcctccccacaactcctggaaaccactatatgctttttgtctccatgcctattctggacatttcatataaatggaaccatacaacatgtgacctattgtatgtggcttctttcacttagcaaaatattttgagagttcatgcatgttgtaacacgtatgaatacttcattcctttttattactaaataataatccatcatatgaatataccaca

SEQ ID NO: 342421 - DNA, 4257 bp, Homo sapiens
cgctcagctgcttctccggcggaacccaggctggaccgcgggccccggcctgggggccactgctgccaccgccgccgccacctcgtctcctccccgtccccgcccagccccaggtctccccgcctcactcgggcccgtggccggggtcactccccgccgcccctccccgcacggatgccgaaggtgaaggcgctgcagtgcgccctggcgctggagatcagctcagtaacttgcccaggagtcgtgcttaaagacaaagaggacatctatcttagcatctgtgtgtttggccaatacaaaaagacacaatgtgtcccagccacttttcccctggtcttcaatgccagaatggtgtttgaaaaggtgttcccggacgcagtagatcctggagatgtggttacacagcttgaatatgatacagcagtgttcgagttgatacagctagttccaccagtgggtgaaacactgtctacgtatgacgaaaatacacgagatttcatgtttccgggtccaaaccaaatgtctggacaccatgattcaaaccgccaggttaccatgaggaggatttctggccttcgaggaaatgctccaaggctggaattttctacgacttcagtgattactgaatgtctgataagttcaaggaaatgccacactcaggataaatttatttaccatttggctccagttgaaaaatcacatggcagactgcaaaacagaacatcaagatcacaaaagaaaaaatccaagtcacctgagagaagtaaatactgtataaatgcaaaaaactacgaacagcctcttataagggaaaatcccaccgacccatctttgagaacagcatggacaagatgtacaggaacttatacaaaaaggcctgtagttctgcttcacatacacaggaaagcttctgagaccatccatgataaacctcattagtgtccgtgtcaatttctcaatgaaaatgtttgatgtgatcaatatctgtattcctttttttaaaaaaaatgggattataactaagtacaatagttatacttgaataagttcattacttcaaatggtaaattatcataggcaagccttttaaaataattattacagaagagtctgctgtgttacaaacattagagctctgtcacacaatcacaacttccaatatgtgacaaggatattctgttacatgtacacctcatattccatctgcaaatccaagaatagttcctttctagaaatgttttttttgccttactcaccttgcaattttcttctcatctacttaactggttatcttgcctgtgtaagatttaattaatattgactaccttttcttggtgatgaacaaaatgatatcctatacagaaatgaatttcctaagggtttaaaccctgttttcactaacattttctactttttcctttttcagaacaggctattctatttcttagctcataggctttctttttaaagactatatgatcattcactcctttttctctggaagaactgtgtaagttgcttaaaatgcatagcagttagctagaaatatcagtgccatggatgatcaaaaatttgaataactaatttttaaagataaaattctttgcatgattttttttctagggccataccttttggtgcaaccagaatcagaaaatggcctctgttagtaagcttatagaaacctaaaaataataatggaattatattgtaatttgactgcttggaatttgtgtaagtaccatatggcccaaggcactattatagtatcctcactttaaaaaaaaaaacacttggaaccacaatgtgagtaaaatattatagcagaacgctttgtggtagacactgaaaatgttgttgattgatggatagaattaacttctcctcccccaccccagcacacacctgtgaagccaatgatactataaagacataaagaaatcagctactttatatttaatagagagtgaggggagggaaaggagagtgtaggaataagtgaactgggcttatagtcttgaagagttgcctaaaagataatattttctcattgactctgtttttgattaattttacagttatgattgaaaaagaacaaaatgaacttcctttaaaatgaaattaaaatgtgaaacttgctgacttatttttgtagtagaacttgttaacatcatgttaagggtgctttagtatcacagtctgtgatatatcagaaagggcattagagctatctctatgagccaggagtcctaggctttagtatcccatgtctgccgttttctagctgagtctatttaattctcagatcctttgtttcctcagctatcaaatgataagaatgtagtagaccccaaactatgttctgtggaccaagatcactgttttaggagataatcgtaggaatgtaggtataagtatgtaattggccatctaagtttaggaaaatctgtttgctacacacatacacacacacacacacacacacacacacacacacacctcttagagagtcatatgtaggattatagaggtaaaaagagatgatattaatgctggaatagcgcctgtaaactggggctgtctacagcaaattaggatatatggtcactgtgctcattgtgaacagtagcttgttcgaggctttaagaaaattctggtataaatctgtcttactctgcatctagtagacagcctggcatgtaattgatgttccttaaatatttatcgaattaacccagaattttctaaactaaatttagcatgtaccactatttgttattcttgccaccaccccccattcccctagctcctcacactacctgccaatgtcatcctaaggtacatgtggatacctaggttgtagaaatgctggactacacaattgctgagttactctctggctgtagattatatgatgaggtattttacaatcagcttttgaaggtcaacattgaataatgctcttttaaaaaaattatatcctcagtgtttttccatggaaaaataagtgaaaattcttttaagagttgctgtttggtgaaaagaacaaacatgactttcaaagaaaatgttttactatcaccaaaatctcccaagtgaataagtaccacagaaattacttattgcacctgtatctgccattggctgtgaaaaaggctgcaaaaagtagggctgaaagggaaactttagaaactaatactctgaaagatgttttcctatggattaaatttagtgtctttctgaaagttgggggcaaattcccagatactaatagcatctttgctaagtgtctgattatcttctatcccctaggaggaaagagtggtccatgttgctgtaactactactatgagtgcttatgctgtattgtttttaaagagtaaaacctttaagtactaatagttgtcttttctcattcacaggagcagaaaggtgcagttgtttattctcttagccttttttttttcctgtatttcccacaaatctagaaataattattggagttaatatgaaagataaataggcttttctttttactttttaatttttttctttaaatcataaaaaaccttgggatttagaaaaatgtcaaaatcgacaaataaagatgaatcattggaatgagactcttccttggttctactagctagttatataaccttatttaagtcatttatgcttcttggagctcagttttctcaccaacaaggtgataaaagggttaatttagaatgatcctttgacatttcataattgtacaattaatatgtacgatcaggaagtcctaggcaggcagagttgttttctgatttccaaagattaagcccctgatgaaaaatctggaacaaatagagaattttcattattgtgttcatttgctaataatagctttattgagatataattcactctgaaaaagtatacaattaagtggtttttactatattcacagagttgtgcaacaataaccactcactaattacagaatattttataactcccaaaagaaatcctgtaaccattagtgatcacttcccactacctcctccccacaactcctggaaaccactatatgctttttgtctccatgcctattctggacatttcatataaatggaaccatacaacatgtgacctattgtatgtggcttctttcacttagcaaaatattttgagagttcatgcatgttgtaacacgtatgaatacttcattcctttttattactaaataataatccatcatatgaatataccaca

SEQ ID NO: 342422 - DNA, 1750 bp, Homo sapiens
cgctcagctgcttctccggcggaacccaggctggaccgcgggccccggcctgggggccactgctgccaccgccgccgccacctcgtctcctccccgtccccgcccagccccaggtctccccgcctcactcgggcccgtggccggggtcactccccgccgcccctccccgcacggatgccgaaggtgaaggcgctgcagtgcgccctggcgctggagatcagctcagtaacttgcccaggagtcgtgcttaaagacaaagaggacatctatcttagcatctgtgtgtttggccaatacaaaaagacacaatgtgtcccagccacttttcccctggtcttcaatgccagaatggtgtttgaaaaggtgttcccggacgcagtagatcctggagatgtggttacacagcttgaatatgatacagcagtgttcgagttgatacagctagttccaccagtgggtgaaacactgtctacgtatgacgaaaatacacgagatttcatgtttccgggtccaaaccaaatgtctggacaccatgattcaaaccgccaggttaccatgaggaggatttctggccttcgaggaaatgctccaaggctggaattttctacgacttcagtgattactgaatgtctgataagttcaaggaaatgccacactcaggataaatttatttaccatttggctccagttgaaaaatcacatggcagactgcaaaacagaacatcaagatcacaaaagaaaaaatccaagtcacctgagagaagtaaatactgtataaatgcaaaaaactacgaacagcctacaatttcttcaaaatcacactctccatctccctacacaaaaagacgcatgtgtgagctatctgaagacaccaggcggcggctggcccatttaaatctgggaccctatgagttcaaaaaagaaacagataaacctccatttgtgattagacatgttgatcccccaagtcccagggctgatactttattgggatcttctggaagagactgtgaaagagatggatggtcaagggtgcacaatgatcattctcatcttggctgctgccgacccaaggattataaggttatcaggacaccccatgggagagacttcgatgactctttagaaaaatgtgaagagtatttgagcccaaggtcgtgtagtaagccccggcattcagcgaggaccttgctagtccattcagcaccctcaacaatgccaaagcattctccaagccctgtgttaaatagagcttctctcagggaaagatttcattctgattggtgttcaccttcaaactgcgatgagatccatgaccgggtaaaaaatgtcttgaaatcacatcaggctcatcaaagacatttatatgatgagagagacctagagaaagatgatgaactggaactgaaaagaagtcttttatgtagagactctgcctatgacagtgaccccgagtataggaatgcaccatatgtcctcatctgaaagtctctgcaggatggtctgactcacgcgagtggttttgagataagttgtgttatacctcaagttaggtaaagtcgagagatgaactaacttaaaaagtagtgatgtttacatagaatctaaattggaaaagacaataatatcagcattagaaagtttgcctttaagtaaaaaaaattattagccataataggttttacattcttcgtaatagaatatcctaaagcaataaaacctccactatgtgaactctaagttctgaaca

SEQ ID NO: 342423 - DNA, 1125 bp, Homo sapiens
  misc_feature (364)..(364): n is a, c, g, or t
  misc_feature (369)..(369): n is a, c, g, or t
  misc_feature (373)..(373): n is a, c, g, or t
  misc_feature (384)..(384): n is a, c, g, or t
  misc_feature (393)..(393): n is a, c, g, or t
cgctcagctgcttctccggcggaacccaggctggaccgcgggccccggcctgggggccactgctgccaccgccgccgccacctcgtctcctccccgtccccgcccagccccaggtctccccgcctcactcgggcccgtggccggggtcactccccgccgcccctccccgcacggatgccgaaggtgaaggcgctgcagtgcgccctggcgctggagatcagctcagtaacttgcccaggagtcgtgcttaaagacaaagaggacatctatcttagcatctgtgtgtttggccaatacaaaaagacacaatgtgtcccagccacttttcccctggtcttcaatgccagaatggtgtttgaaaagnaaganacancagtgttcganttgatacancaagttccaccaatgggtgaaacactgtctacgtatgacgaaaatacacgagatttcatgtttccgggtccaaaccaaatgtctggacaccatgattcaaaccgccaggttaccatgaggaggatttctggccttcgaggaaatgctccaaggctggaattttctacgacttcagtgattactgaatgtctgataagttcaaggaaatgccacactcaggataaatttatttaccatttggctccagttgaaaaatcacatggcagactgcaaaacagaacatcaagatcacaaaagaaaaaatccaagtcacctgagagaagtaaatactgtataaatgcaaaaaactacgaacagcctacaatttcttcaaaatcacactctccatctccctacacaaaaagacgcatgtgtgagctatctgaagacaccaggcggcggctggcccatttaaatctgggaccctatgagttcaaaaaagaaacagataaacctccatttgtgattagacatgtatgtgttctcttaagcatttctatttgaaactgatcagcttttttcccaaaaaaactgttattctgaaatatctttcaacttctagcttatattaataatacttttctcttctgactgctaccctagcagtctaagatgggaaattaatttagaatgaaagaacttgctttttttcagtcttcagacctgacagagatcaagctgtgttatgaatgc

SEQ ID NO: 342424 - DNA, 4447 bp, Homo sapiens
agcccagagggctcaaagggcaggactgggcttatcgtggaaggagtggattgttcatttactgcattatcagtattcaagtaaatttgctgaagatgataactgtgacttaagccaagaaaggataaatttatttaccatttggctccagttgaaaaatcacatggcagactgcaaaacagaacatcaagatcacaaaagaaaaaatccaagtcacctgagagaagtaaatactgtataaatgcaaaaaactacgaacagcctacaatttcttcaaaatcacactctccatctccctacacaaaaagacgcatgtgtgagctatctgaagacaccaggcggcggctggcccatttaaatctgggaccctatgagttcaaaaaagaaacagataaacctccatttgtgattagacatgttgatcccccaagtcccagggctgatactttattgggatcttctggaagagactgtgaaagagatggatggtcaagggtgcacaatgatcattctcatcttggctgctgccgacccaaggattataaggttatcaggacaccccatgggagagacttcgatgactctttagaaaaatgtgaagagtatttgagcccaaggtcgtgtagtaagccccggcattcagcgaggaccttgctagtccattcagcaccctcaacaatgccaaagcattctccaagccctgtgttaaatagagcttctctcagggaaagatttcattctgattggtgttcaccttcaaactgcgatgagatccatgaccgggtaaaaaatgtcttgaaatcacatcaggctcatcaaagacatttatatgatgagagagacctagagaaagatgatgaactggaactgaaaagaagtcttttatgtagagactctgcctatgacagtgaccccgagtatagctcatgtcagcagccacgtggcactttccatttggatgacggtgaatactggtccaacagggcagcctcttataagggaaaatcccaccgacccatctttgagaacagcatggacaagatgtacaggaacttatacaaaaaggcctgtagttctgcttcacatacacaggaaagcttctgagaccatccatgataaacctcattagtgtccgtgtcaatttctcaatgaaaatgtttgatgtgatcaatatctgtattcctttttttaaaaaaaatgggattataactaagtacaatagttatacttgaataagttcattacttcaaatggtaaattatcataggcaagccttttaaaataattattacagaagagtctgctgtgttacaaacattagagctctgtcacacaatcacaacttccaatatgtgacaaggatattctgttacatgtacacctcatattccatctgcaaatccaagaatagttcctttctagaaatgttttttttgccttactcaccttgcaattttcttctcatctacttaactggttatcttgcctgtgtaagatttaattaatattgactaccttttcttggtgatgaacaaaatgatatcctatacagaaatgaatttcctaagggtttaaaccctgttttcactaacattttctactttttcctttttcagaacaggctattctatttcttagctcataggctttctttttaaagactatatgatcattcactcctttttctctggaagaactgtgtaagttgcttaaaatgcatagcagttagctagaaatatcagtgccatggatgatcaaaaatttgaataactaatttttaaagataaaattctttgcatgattttttttctagggccataccttttggtgcaaccagaatcagaaaatggcctctgttagtaagcttatagaaacctaaaaataataatggaattatattgtaatttgactgcttggaatttgtgtaagtaccatatggcccaaggcactattatagtatcctcactttaaaaaaaaaaacacttggaaccacaatgtgagtaaaatattatagcagaacgctttgtggtagacactgaaaatgttgttgattgatggatagaattaacttctcctcccccaccccagcacacacctgtgaagccaatgatactataaagacataaagaaatcagctactttatatttaatagagagtgaggggagggaaaggagagtgtaggaataagtgaactgggcttatagtcttgaagagttgcctaaaagataatattttctcattgactctgtttttgattaattttacagttatgattgaaaaagaacaaaatgaacttcctttaaaatgaaattaaaatgtgaaacttgctgacttatttttgtagtagaacttgttaacatcatgttaagggtgctttagtatcacagtctgtgatatatcagaaagggcattagagctatctctatgagccaggagtcctaggctttagtatcccatgtctgccgttttctagctgagtctatttaattctcagatcctttgtttcctcagctatcaaatgataagaatgtagtagaccccaaactatgttctgtggaccaagatcactgttttaggagataatcgtaggaatgtaggtataagtatgtaattggccatctaagtttaggaaaatctgtttgctacacacatacacacacacacacacacacacacacacacacacacctcttagagagtcatatgtaggattatagaggtaaaaagagatgatattaatgctggaatagcgcctgtaaactggggctgtctacagcaaattaggatatatggtcactgtgctcattgtgaacagtagcttgttcgaggctttaagaaaattctggtataaatctgtcttactctgcatctagtagacagcctggcatgtaattgatgttccttaaatatttatcgaattaacccagaattttctaaactaaatttagcatgtaccactatttgttattcttgccaccaccccccattcccctagctcctcacactacctgccaatgtcatcctaaggtacatgtggatacctaggttgtagaaatgctggactacacaattgctgagttactctctggctgtagattatatgatgaggtattttacaatcagcttttgaaggtcaacattgaataatgctcttttaaaaaaattatatcctcagtgtttttccatggaaaaataagtgaaaattcttttaagagttgctgtttggtgaaaagaacaaacatgactttcaaagaaaatgttttactatcaccaaaatctcccaagtgaataagtaccacagaaattacttattgcacctgtatctgccattggctgtgaaaaaggctgcaaaaagtagggctgaaagggaaactttagaaactaatactctgaaagatgttttcctatggattaaatttagtgtctttctgaaagttgggggcaaattcccagatactaatagcatctttgctaagtgtctgattatcttctatcccctaggaggaaagagtggtccatgttgctgtaactactactatgagtgcttatgctgtattgtttttaaagagtaaaacctttaagtactaatagttgtcttttctcattcacaggagcagaaaggtgcagttgtttattctcttagccttttttttttcctgtatttcccacaaatctagaaataattattggagttaatatgaaagataaataggcttttctttttactttttaatttttttctttaaatcataaaaaaccttgggatttagaaaaatgtcaaaatcgacaaataaagatgaatcattggaatgagactcttccttggttctactagctagttatataaccttatttaagtcatttatgcttcttggagctcagttttctcaccaacaaggtgataaaagggttaatttagaatgatcctttgacatttcataattgtacaattaatatgtacgatcaggaagtcctaggcaggcagagttgttttctgatttccaaagattaagcccctgatgaaaaatctggaacaaatagagaattttcattattgtgttcatttgctaataatagctttattgagatataattcactctgaaaaagtatacaattaagtggtttttactatattcacagagttgtgcaacaataaccactcactaattacagaatattttataactcccaaaagaaatcctgtaaccattagtgatcacttcccactacctcctccccacaactcctggaaaccactatatgctttttgtctccatgcctattctggacatttcatataaatggaaccatacaacatgtgacctattgtatgtggcttctttcacttagcaaaatattttgagagttcatgcatgttgtaacacgtatgaatacttcattcctttttattactaaataataatccatcatatgaatataccaca

SEQ ID NO: 342425 - DNA, 4357 bp, Homo sapiens
atcattgaacaaggtggagaaggtccagaagcataccatgaactacagaagaaggaaagatggagtaatctgatgcaactggataaatttatttaccatttggctccagttgaaaaatcacatggcagactgcaaaacagaacatcaagatcacaaaagaaaaaatccaagtcacctgagagaagtaaatactgtataaatgcaaaaaactacgaacagcctacaatttcttcaaaatcacactctccatctccctacacaaaaagacgcatgtgtgagctatctgaagacaccaggcggcggctggcccatttaaatctgggaccctatgagttcaaaaaagaaacagataaacctccatttgtgattagacatgttgatcccccaagtcccagggctgatactttattgggatcttctggaagagactgtgaaagagatggatggtcaagggtgcacaatgatcattctcatcttggctgctgccgacccaaggattataaggttatcaggacaccccatgggagagacttcgatgactctttagaaaaatgtgaagagtatttgagcccaaggtcgtgtagtaagccccggcattcagcgaggaccttgctagtccattcagcaccctcaacaatgccaaagcattctccaagccctgtgttaaatagagcttctctcagggaaagatttcattctgattggtgttcaccttcaaactgcgatgagatccatgaccgggatgagagagacctagagaaagatgatgaactggaactgaaaagaagtcttttatgtagagactctgcctatgacagtgaccccgagtatagctcatgtcagcagccacgtggcactttccatttggatgacggtgaatactggtccaacagggcagcctcttataagggaaaatcccaccgacccatctttgagaacagcatggacaagatgtacaggaacttatacaaaaaggcctgtagttctgcttcacatacacaggaaagcttctgagaccatccatgataaacctcattagtgtccgtgtcaatttctcaatgaaaatgtttgatgtgatcaatatctgtattcctttttttaaaaaaaatgggattataactaagtacaatagttatacttgaataagttcattacttcaaatggtaaattatcataggcaagccttttaaaataattattacagaagagtctgctgtgttacaaacattagagctctgtcacacaatcacaacttccaatatgtgacaaggatattctgttacatgtacacctcatattccatctgcaaatccaagaatagttcctttctagaaatgttttttttgccttactcaccttgcaattttcttctcatctacttaactggttatcttgcctgtgtaagatttaattaatattgactaccttttcttggtgatgaacaaaatgatatcctatacagaaatgaatttcctaagggtttaaaccctgttttcactaacattttctactttttcctttttcagaacaggctattctatttcttagctcataggctttctttttaaagactatatgatcattcactcctttttctctggaagaactgtgtaagttgcttaaaatgcatagcagttagctagaaatatcagtgccatggatgatcaaaaatttgaataactaatttttaaagataaaattctttgcatgattttttttctagggccataccttttggtgcaaccagaatcagaaaatggcctctgttagtaagcttatagaaacctaaaaataataatggaattatattgtaatttgactgcttggaatttgtgtaagtaccatatggcccaaggcactattatagtatcctcactttaaaaaaaaaaacacttggaaccacaatgtgagtaaaatattatagcagaacgctttgtggtagacactgaaaatgttgttgattgatggatagaattaacttctcctcccccaccccagcacacacctgtgaagccaatgatactataaagacataaagaaatcagctactttatatttaatagagagtgaggggagggaaaggagagtgtaggaataagtgaactgggcttatagtcttgaagagttgcctaaaagataatattttctcattgactctgtttttgattaattttacagttatgattgaaaaagaacaaaatgaacttcctttaaaatgaaattaaaatgtgaaacttgctgacttatttttgtagtagaacttgttaacatcatgttaagggtgctttagtatcacagtctgtgatatatcagaaagggcattagagctatctctatgagccaggagtcctaggctttagtatcccatgtctgccgttttctagctgagtctatttaattctcagatcctttgtttcctcagctatcaaatgataagaatgtagtagaccccaaactatgttctgtggaccaagatcactgttttaggagataatcgtaggaatgtaggtataagtatgtaattggccatctaagtttaggaaaatctgtttgctacacacatacacacacacacacacacacacacacacacacacacctcttagagagtcatatgtaggattatagaggtaaaaagagatgatattaatgctggaatagcgcctgtaaactggggctgtctacagcaaattaggatatatggtcactgtgctcattgtgaacagtagcttgttcgaggctttaagaaaattctggtataaatctgtcttactctgcatctagtagacagcctggcatgtaattgatgttccttaaatatttatcgaattaacccagaattttctaaactaaatttagcatgtaccactatttgttattcttgccaccaccccccattcccctagctcctcacactacctgccaatgtcatcctaaggtacatgtggatacctaggttgtagaaatgctggactacacaattgctgagttactctctggctgtagattatatgatgaggtattttacaatcagcttttgaaggtcaacattgaataatgctcttttaaaaaaattatatcctcagtgtttttccatggaaaaataagtgaaaattcttttaagagttgctgtttggtgaaaagaacaaacatgactttcaaagaaaatgttttactatcaccaaaatctcccaagtgaataagtaccacagaaattacttattgcacctgtatctgccattggctgtgaaaaaggctgcaaaaagtagggctgaaagggaaactttagaaactaatactctgaaagatgttttcctatggattaaatttagtgtctttctgaaagttgggggcaaattcccagatactaatagcatctttgctaagtgtctgattatcttctatcccctaggaggaaagagtggtccatgttgctgtaactactactatgagtgcttatgctgtattgtttttaaagagtaaaacctttaagtactaatagttgtcttttctcattcacaggagcagaaaggtgcagttgtttattctcttagccttttttttttcctgtatttcccacaaatctagaaataattattggagttaatatgaaagataaataggcttttctttttactttttaatttttttctttaaatcataaaaaaccttgggatttagaaaaatgtcaaaatcgacaaataaagatgaatcattggaatgagactcttccttggttctactagctagttatataaccttatttaagtcatttatgcttcttggagctcagttttctcaccaacaaggtgataaaagggttaatttagaatgatcctttgacatttcataattgtacaattaatatgtacgatcaggaagtcctaggcaggcagagttgttttctgatttccaaagattaagcccctgatgaaaaatctggaacaaatagagaattttcattattgtgttcatttgctaataatagctttattgagatataattcactctgaaaaagtatacaattaagtggtttttactatattcacagagttgtgcaacaataaccactcactaattacagaatattttataactcccaaaagaaatcctgtaaccattagtgatcacttcccactacctcctccccacaactcctggaaaccactatatgctttttgtctccatgcctattctggacatttcatataaatggaaccatacaacatgtgacctattgtatgtggcttctttcacttagcaaaatattttgagagttcatgcatgttgtaacacgtatgaatacttcattcctttttattactaaataataatccatcatatgaatataccaca

SEQ ID NO: 342426 - DNA, 1802 bp, Homo sapiens
cgctcagctgcttctccggcggaacccaggctggaccgcgggccccggcctgggggccactgctgccaccgccgccgccacctcgtctcctccccgtccccgcccagccccaggtctccccgcctcactcgggcccgtggccggggtcactccccgccgcccctccccgcacggatgccgaaggtgaaggcgctgcagtgcgccctggcgctggagatcagctcagtaacttgcccaggagtcgtgcttaaagacaaagaggacatctatcttagcatctgtgtgtttggccaatacaaaaagacacaatgtgtcccagccacttttcccctggtcttcaatgccagaatggtgtttgaaaaggtgttcccggacgcagtagatcctggagatgtggttacacagcttgaatatgatacagcagtgttcgagttgatacagctagttccaccagtgggtgaaacactgtctacgtatgacgaaaatacacgagatttcatgtttccgggtccaaaccaaatgtctggacaccatgattcaaaccgccaggttaccatgaggaggatttctggccttcgaggaaatgctccaaggctggaattttctacgacttcagtgattactgaatgtctgataagttcaaggaaatgccacactcaggataaatttatttaccatttggctccagttgaaaaatcacatggcagactgcaaaacagaacatcaagatcacaaaagaaaaaatccaagtcacctgagagaagtaaatactgtataaatgcaaaaaactacgaacagcctacaatttcttcaaaatcacactctccatctccctacacaaaaagacgcatgtgtgagctatctgaagacaccaggcggcggctggcccatttaaatctgggaccctatgagttcaaaaaagaaacagataaacctccatttgtgattagacatgttgatcccccaagtcccagggctgatactttattgggatcttctggaagagactgtgaaagagatggatggtcaagggtgcacaatgatcattctcatcttggctgctgccgacccaaggattataaggttatcaggacaccccatgggagagacttcgatgactctttagaaaaatgtgaagagtatttgagcccaaggtcgtgtagtaagccccggcattcagcgaggaccttgctagtccattcagcaccctcaacaatgccaaagcattctccaagccctgtgttaaatagagcttctctcagggaaagatttcattctgattggtgttcaccttcaaactgcgatgagatccatgaccgggtaaaaaatgtcttgaaatcacatcaggctcatcaaagacatttatatgttagtttctaaaatttttttttgaagactatttataataggtcaagaaaaccaccaaagatgcctaaagcttacaaaatttagtcaccgggaagaaaaaaagaaagcaagcaagctccatttgatggaagtcagtggttttgcccaaggcaacatatctaaatgcctgcttgacctaagtcattatgcaaaatgtttgaaatagaccatcttaactataaacatgttagtgataattatcttataaagtttcagtacatagtgacttgatgataattatttcacagccttcaaaatatgagaactcttgttttgtggcccaatataaagcaatttcatctactgcaaatagatttaatcctaaatggtagcatgagtgggtaggagaggtatgtattttgaagaaacttctcagttaatttgtatgttaattg

SEQ ID NO: 342427 - DNA, 353 bp, Homo sapiens
agtacagcagcaggatgtcggctcactgcagcctccacctctctggctcaagccatcctcctgtctcaacctcccaagtagctgggactacaggcgcaggccaccaaacccagcatttttttttctttttttaaaatagagacagggttttgccaaattgtccaggctggtcttgaactcctgggctctagcaatccatctgcctcagcctctcaaagtgctgggattacagacatgagccagcgcacctggcctctatgaagtatttttgccaaaaatatttgacccaaatttagtcaaacctctctagatctaacttctagtttacaggaaataaaaggaatagagaaaca

SEQ ID NO: 342428 - DNA, 1005 bp, Homo sapiens
ataaacccaggtggtcctgctccagatttgtgctctaaattgcagaattatgctgcttctcataaatttcacacacacacacacacacacacacacacacacacacacacacaaaatgtgaaggtgatatttgaataactgaagttaggggaaaactgccctaaaaggttccccattttttctgtctccctgtatctactgccctttggttgccatactttttctttttctttatttttttatttttatttttatttttttgagacagaagcaagactctgtcaagaaagaaagaaagagagagagagagagaaagaaaaagagagggagtgagaaagaaatcacaaggggagaagcaactgcaaagcagtctgaaacctccatgctgacttgtcagcacactctttctcctgtgggaaagtcagaatctagttagaaggttggtttttgtggaatcaaagcaaggtgagcaaaatgagtgattttaatcaccaggaaaacctaagatatttgtaccctctgagggatacaagagtctagagtggcagcactgctagtataattgccccttcctgtgcttgtggtagaaatgtctgatcaatcactgcatcttttccttcctactgctccctgggccagccctaagattcttagcaagagagtattctggccctgtgcggtggctcatgcctgtaatcccagcactttgggagacaaaggcagaaggattgcttgagcccaggagctggtcttgactcctggtttcaagcaatcctcttgccttgggctcccaaactgctgagattacaggtgtgagccaccgcaccagtagaagagctccttaaatatgcagttacttgctggtcatgaccatggaatgtgaaggaaaggaaggtgtcacttaattcttctatgggcaggtgaattttaagttcttaaggttgactcaaatgtggtcagagactcaagtgaaaacttgccctacccaaagaaagagtcctgaac

SEQ ID NO: 342429 - DNA, 1443 bp, Homo sapiens
ggcaaagatactgcattcactcgatcccttgggcctactcatgaccaccactacatcagaactgacatttcagagcactactggctcaatggagcaaaatttattggaactttcttcataccagacacctacaatccagatgatgataaaatatatttcttctttcgtgaatcatctcaagaaggcagtacctccgataaaaccatcctttctcgagttggaagagtttgtaagaatgatgtaggaggacaacgcagcctgataaacaagtggacgacttttcttaaggccagactgatttgctcaattcctggaagtgatggggcagatacttactttgatgagcttcgtaagttccttctttccttctttcttggaaaggccttactgcctaattaagtaacttggcatttatttccctttggctccaaatgcctgattaattttacctgagcaaaccttacaggagtggttcttactaaaattcacacgcaaagtacacggaagtgctctaggtctgggcacacgtcataatgcagtaactcttctctttgtaagagtcctcaaagtaagtgaaggaaacaaaactacagcaagacacagaaaggtgtgagctctggaactacacagttcatccattctccatgcagtctttcattttgaaaggagccaccttctataggtaggaaaatcttggattccttattccacgggtgccctctgctggcaagtacaggagatttggtgaacactgtccctccgacttgttaatgaaagaataatcagaagcagtagacagcttcttctatttcacttctcctcttcactccctcaaaaactccttccaagtcctacaatgattttttttcttttttgtttatgtataatgttagcatcattagcttttagcttcttgaacttgttcttatttttgccatgtaatgtaaaaatgataatctatatcatggaattatttcatcagtattgtgtattttccaacttaaagtatacattgagtaatcgtggatgacctctcctattgtatgtaagcacattcacatcttaatcttttaaagaatattatttgcacataacttactgtcaatacggcactaatttgggggtagctattttcttattgttaccaaataggtaaatgaggtcaggtgtggtggctcacacctgaaatcccagcactttgggaggccgaggtgtttggaccacttgaggtcaggagtttaagaccagcctggccaacatggcgaaaccctatctctactaaaaataaaaaaaaaaattagccgggctggtggtgggcacctgtaatcctagatactagggaggctgaggcaggagaattgcttgaacccaggagggagaggttgcagtgggcagagattgtgccactgcattccagcctgggtgacacagcaagactccatc

SEQ ID NO: 342430 - DNA, 808 bp, Homo sapiens
ggcaaagatactgcattcactcgatcccttgggcctactcatgaccaccactacatcagaactgacatttcagagcactactggctcaatggagcaaaatttattggaactttcttcataccagacacctacaatccagatgatgataaaatatatttcttctttcgtgaatcatctcaagaaggcagtacctccgataaaaccatcctttctcgagttggaagagtttgtaagaatgatgtaggaggacaacgcagcctgataaacaagtggacgacttttcttaaggccagactgatttgctcaattcctggaagtgatggggcagatacttactttgatgagcttcaagatatttatttactccccacaagagatgaaagaaatcctgtagtatatggagtctttactacaaccagctccatcttcaaaggctctgctgtttgtgtgtatagcatggctgacatcagagcagtttttaatggtccatatgctcataaggaaagtgcagaccatcgttgggtgcagtatgatgggagaattccttatccacggcctggtacatgtccaagcaaaacctatgacccactgattaagtccacccgagattttccagatgatgtcatcagtttcataaagcggcactctgtgatgtataagtccgtatacccagttgcaggaggaccaacgttcaagagaatcaatgtggattacagactgacacagatagtggtggatcatgtcattgcagaagatggccagtacgatgtaatgtttcttggaacaggtaagctaaaactagattagg

SEQ ID NO: 342431 - DNA, 725 bp, Homo sapiens
ggcaaagatactgcattcactcgatcccttgggcctactcatgaccaccactacatcagaactgacatttcagagcactactggctcaatggagcaaaatttattggaactttcttcataccagacacctacaatccagatgatgataaaatatatttcttctttcgtgaatcatctcaagaaggcagtacctccgataaaaccatcctttctcgagttggaagagtttgtaagaatgatgtaggaggacaacgcagcctgataaacaagtggacgacttttcttaaggccagactgatttgctcaattcctggaagtgatggggcagatacttactttgatgagcttcaagatatttatttactccccacaagagatgaaagaaatcctgtagtatatggagtctttactacaaccagctccatcttcaaaggctctgctgtttgtgtgtatagcatggctgacatcagagcagtttttaatggtccatatgctcataaggaaagtgcagaccatcgttgggtgcagtatgatgggagaattccttatccacggcctggtacaacacctttttcatacaaggcccaggaggcttagtccagtctgtgctcctgggctacaaggacccagcctgagatggtcccatctgcagggcccccgcaccagttggagcagatgctcccaccaccaatttgccaaaggtccaataaaatgctcaaccacgg

SEQ ID NO: 342432 - DNA, 1301 bp, Homo sapiens
ggcaaagatactgcattcactcgatcccttgggcctactcatgaccaccactacatcagaactgacatttcagagcactactggctcaatggagcaaaatttattggaactttcttcataccagacacctacaatccagatgatgataaaatatatttcttctttcgtgaatcatctcaagaaggcagtacctccgataaaaccatcctttctcgagttggaagagtttgtaagaatgatgtaggaggacaacgcagcctgataaacaagtggacgacttttcttaaggccagactgatttgctcaattcctggaagtgatggggcagatacttactttgatgagcttcgtaagttccttctttccttctttcttggaaaggccttactgcctaattaagtaacttggcatttatttccctttggctccaaatgcctgattaattttacctgagcaaaccttacaggagtggttcttactaaaattcacacgcaaagtacacggaagtgctctaggtctgggcacacgtcataatgcagtaactcttctctttgtaagagtcctcaaagtaagtgaaggaaacaaaactacagcaagacacagaaaggtgtgagctctggaactacacagttcatccattctccatgcagtctttcattttgaaaggagccaccttctatagaagatatttatttactccccacaagagatgaaagaaatcctgtagtatatggagtctttactacaaccagctccatcttcaaaggctctgctgtttgtgtgtatagcatggctgacatcagagcagtttttaatggtccatatgctcataaggaaagtgcagaccatcgttgggtgcagtatgatgggagaattccttatccacggcctggtacatgtccaagcaaaacctatgacccactgattaagtccacccgagattttccagatgatgtcatcagtttcataaagcggcactctgtgatgtataagtccgtatacccagttgcaggaggaccaacgttcaagagaatcaatgtggattacagactgacacagatagtggtggatcatgtcattgcagaagatggccagtacgatgtaatgtttcttggaacagacattggaactgtcctcaaagttgtcagcatttcaaaggaaaagtggaatatggaagaggtagtgctggaggagttgcagatattcaagcactcatcaatcatcttgaacatggaattgtctctgaagcagcaacaattgtacattggttcccgagatggattggttcagctctccttgca

SEQ ID NO: 342433 - DNA, 873 bp, Homo sapiens
agcggcgggtcacatggcccgcgggacaacatggctgcgcccgcactagggctggtgtgtggacgttgccctgagctgggtctcgtcctcttgctgctgctgctctcgctgctgtgtggagcggcagggagccaggaggccgggaccggtgcgggcgcggggtcccttgcgggttcttgcggctgcggcacgccccagcggcctggcgcccatggcaattcggcagccgctcaccgatactcgcgggaggctaacgctccgggccccgtacccggagagcggcaactcgcgcactcaaagatggtccccatccctgctggagtatttacaatgggcacagatgatcctcagataaagcaggatggggaagcacctgcgaggagagttactattgatgccttttacatggatgcctatgaagtcagtaatactgaatttgagaagtttgtgaactcaactggctatttgacagaggctgagaagtttggcgactcctttgtctttgaaggcatgttgagtgagcaagtgaagaccaatattcaacaggcagttgcagctgctccctggtggttacctgtgaaaggcgctaactggagacacccagaagggcctgactctactattctgcacaggccggatcatccagttctccatgtgtcctggaatgatgcggttgcctactgcacttgggcagggaagcggctgcccacggaagctgagtgggaatacagctgtcgaggaggcctgcataatagacttttcccctggggcaacaaactgcagccaaaggccagcattatgccaacatttggcagggcgagtttccggtgaccaacactggtgaggatggcttccaaggaactgcgcctgtga

SEQ ID NO: 342434 - DNA, 798 bp, Homo sapiens
agcggcgggtcacatggcccgcgggacaacatggctgcgcccgcactagggctggtgtgtggacgttgccctgagctgggtctcgtcctcttgctgctgctgctctcgctgctgtgtggagcggcagggagccaggaggccgggaccggtgcgggcgcggggtcccttgcgggttcttgcggctgcggcacgccccagcggcctggcgcccatggcaattcggcagccgctcaccgatactcgcgggaggctaacgctccgggccccgtacccggagagcggcaactcgcgcactcaaagatggtccccatccctgctggagtatttacaatgggcacagatgatcctcagataaagcaggatggggaagcacctgcgaggagagttactattgatgccttttacatggatgcctatgaagtcagtaatactgaatttgagaagtttgtgaactcaactggctatttgacagaggttgcagctgctccctggtggttacctgtgaaaggcgctaactggagacacccagaagggcctgactctactattctgcacaggccggatcatccagttctccatgtgtcctggaatgatgcggttgcctactgcacttgggcagggaagcggctgcccacggaagctgagtgggaatacagctgtcgaggaggcctgcataatagacttttcccctggggcaacaaactgcagccaaaggccagcattatgccaacatttggcagggcgagtttccggtgaccaacactggtgaggatggcttccaaggaactgcgcctgtga

SEQ ID NO: 342435 - DNA, 621 bp, Homo sapiens
cactcaaatctagatttgctgagaaagtgtttgtaactatcatactttgcaataacctttcctctaaagacatcttcaaagaacagtttatttattttctaaatcacttctgacgttgtctttttctctgcttttgtgctgcgacagacacatagtctctctatgtcctttgtccaagggatggattacagtagccttccttcaagtgacattagcagaaatgtcaacgatatatgttcagatgttcagggcttatttttctttaggacagttttccccctcccttcagtgggttatgttaacctttaaagtgaaaatttctcaaacctttatacttgcaactttaataaaaactctttttttttcctctagttctggagagcatataatcagtcagggatttaattctcattaatcttagtttaccacacagacagcctttgaattactatccaatgttgttatacctctgcacacagagacaactgagtggaggaagggatgaggagaaaatagaaagctgaaacacagaggtgctctgaaagccctacctactgcaaaacggtccttcggaatttagaataataaatccctcgttagattgatctgtcagcaccctac

SEQ ID NO: 342436 - DNA, 821 bp, Homo sapiens
ctgtctgtttgcatcctggggaaacctctcacatagctggtccttcctccaattcgaggaacttaacaagctgcttgtctaagcatgtgcctgttctaggcaggggataaacattcttgacctgtggctttccaagtagagtaggaaggaagatgcgtcattaaattataagtcattaaatgcctgatacatgttttgcatgagagctgtgtttgaagtatttctgtagcaaagcggatggaatgacaaatctgaagggggtgaagagttggggaacacttcatggaggagcaagtgatatttgcaatgggtgctgaagtatacataggagttcaccaggcagtgggaacagcagctacagaataggaacgtggaaaaagtcatgactgatcctgggaatcccaagtcattttatgtagtttgagagtagggtgctctatggggagtcttgggagataccacaagatcatgagaggtttgtgtgcttggcaaatgacttggacattcttttgtaagcgggaaggtgggaggcttttaacaagagagaccagacaggagcagaaatgtattttagaaaggatggactggacggcagaattgatagtgacaagttgatcttctggctggctatttcatccatggagtagaataagatgccatgagggcctgaacccaacagggaggagtagatgaattcaagagaggataggggaggttagactggagatgtgattacagggcatgagggctatgggagatttcttgttttctggcttggaaggctgagttgacggtgttgccgttgaccttgaatgggagta

SEQ ID NO: 342437 - DNA, 468 bp, Homo sapiens
tggctcctgaggatatacagcccaactaaaggcacgattggagtagcttaaaagtctgtggagaaatggtagaataagccagttcatacttacttctttagcctctgaaataactactcttttttttttaggtaatattaaactagaaatttaatcattaatcagtacaacagaatagtctctaagctgcttttactgaaggagcaacctaagttgctgatcccttaagttacaatcagataacgtgaaataatagttaatgctatgacagtggaggtagtcaatagaatatgtgaaatatatcggtgctattttctttttatctttttttttccccctacaacatccagagtatgagagctattttcattttagataaaatagtcagggaaggctttatggaaggttatgacctgagctgggtgttaatgggaagtcaagatttgagtaggttgggggcagcatttc

SEQ ID NO: 342438 - DNA, 430 bp, Homo sapiens
ctgggtgacagagtgagacctagtcttcaagaaatatacaaaatagacaatagggctggtaggatagtgggaacataagagtttttcttttcttatttctctaactttggtaatatgttattttcgtaatttaaaaataaaatttcaaatgcaaatttactcccatccattaatatctctgagaaaaatccacaagtccttattgtcaagtatatgactaataccctgttcagcagccctacaaaaaggtaattaaaaccatctagaggcctggtgaggtttgatttacttttctgggaaacttggaaaagatcttcctagtatggacctgatttatcatctgactttgaaggttctccttgtgtttgatttctattaaccatctcttccacatactcagcctccttcccaacttccccatggctgagag

SEQ ID NO: 342439 - DNA, 986 bp, Homo sapiens
aagcgtcagtgtggccactgataagttgcactgacgtgtatctgcagcagttggaggcttctcttttgataactgccgcaggaatgccgtcttggaagccgattttgcaaagaggggatacaagcttccaaaggtccggaaaactggcacgaccatcgctggggtggtctataaggatggcatagttcttggagcagatacaagagcaactgaagggatggttgttgctgacaagaactgttcaaaaatacacttcatatctcctaatatttattgttgtggtgctgggacagctgcagacacagacatgacaacccagctcatttcttccaacctggagctccactccctctccactggccgtcttcccagagttgtgacagccaatcggatgctgaagcagatgcttttcaggtatcaaggttacattggtgcagccctagttttagggggagtagatgttactggacctcacctctacagcatctatcctcatggatcaactgataagttgccttatgtcaccatgggttctggctccttggcagcaatggctgtatttgaagataagtttaggccagacatggaggaggaggaagccaagaatctggtgagcgaagccatcgcagctggcatcttcaacgacctgggctccggaagcaacattgacctctgcgtcatcagcaagaacaagctggattttctccgcccatacacagtgcccaacaagaaggggaccaggcttggccggtacaggtgtgagaaagggactactgcagtcctcactgagaaaatcactcctctggagattgaggtgctggaagaaacagtccaaacaatggacacttcctgaatggcatcagtgggtggctggccgcggttctggaaggtggtgagcattgaggcccagtaagacactcatgtggctagtgtttgccgaatgaaactcaactcaataaaaaacaaaaaccaaattgggcagctga

SEQ ID NO: 342440 - DNA, 848 bp, Homo sapiens
tgccagattcactccaggaagaaggtgttgggtgtgtcctagtggggacccactgtgtccctgaaagggacagttaacttttcttgagacttgagagtggtctgaaatgacaagcccagagtctggctgcacattttttttacactgtttatgcttccagatgtttgtgcagtgtctaaggtaacagttaagtcattcttgttgctgcacggaagagcaatcatgcccttctcttgtgtaatgatgggatttgcttcctgctgtccctgaacagtattgtagggaggttgaagattgatgtcaagggaccaagtgcttcccagcacttgtggggatggtggggtggggggagagtcacgtgtccaccaagggccaggtgccgtgttcactaatgacactctttgcctcccaggcacccccattttgcagcacttgagaactgaggaagttgaatcccccaagatcacagagctgggatcgggagagccaagattccagtccagcctgctcactgcgttgcctgaatatttattttcactgtcttctgccctctggcaccttgaggagaatcctaactctgtgcttttgtttttctcttactaggcttggccggtacaggtgtgagaaagggactactgcagtcctcactgagaaaatcactcctctggagattgaggtgctggaagaaacagtccaaacaatggacacttcctgaatggcatcagtgggtggctggccgcggttctggaaggtggtgagcattgaggcccagtaagacactcatgtggctagtgtttgccgaatgaaactcaactcaataaaaaacaaaaaccaaattgggcagctga

SEQ ID NO: 342441 - DNA, 836 bp, Homo sapiens
tctttttcaaagatttttctggttttatcttgaacatttacaaattgattgctgattcctcccgagcttgtacagcactgttgttagttggaatgttctttggcacagatggtctgtttgccgaagagaccagcttccttttgtagtggcccagctgtgcccttccttgggcttgaggcaccagcgctatccagctttttgctctgggctttgggctgtctaggaatcttcttgactgtaaatgcggtggtaacgtggaatgttttcttgcgcaccaagctttctgtgtcacgatatctcaaaatgacaggtttttctgttcttactaagaacagaaaaactgtgtatgtctttgcatgttacagagacgtgacctgaaaatggaggcagttttaaaaatccctgtagatgattctgcatctggcagaagatggggacaagaccacacatgtgggggattcatctcagagcgtaatgatctagtgtctcagatacatgtatgagagattcttttattgtgttttctttggtggtgggggaaggtggtatcttctgaatgatactccacttaagtctactttaatgatagattgtctccaccccgccaccccctacatcttcaggacaaatgcacagctcttccatggtcactgtcgcaggaatgttgaatatgcctggatccatcatggtaccacgttactcctccacggcactacatctggccgctaaaccagcattcggcacataagcttttttgatggttgttaattttttgatggggagtatcaacttcttttcaacaattaataggtagtttatgagtggtttaccctatt

SEQ ID NO: 342442 - DNA, 232 bp, Homo sapiens
aaattattgagtgaagctgagcagaaggaaatatatgtgcctaggaaaaagaatagagcaaaaaaaaaaaaatttactgtgcaactgccaaggaaaggaatggccccggaggaaaaaacagctagtgatttttaaggaaaaatgcctttaaggttctggctccttggcagcaatggctgtatttgaagataagtttaggccagacatggaggtatgtaagtccctgcagttt

SEQ ID NO: 342443 - DNA, 1101 bp, Homo sapiens
  misc_feature (1018)..(1018): n is a, c, g, or t
  misc_feature (1036)..(1036): n is a, c, g, or t
  misc_feature (1039)..(1039): n is a, c, g, or t
  misc_feature (1051)..(1051): n is a, c, g, or t
cggacccggaactggctttcttgggaagatggcggctgtgtcggtgtatgctccaccagttggaggcttctcttttgataactgccgcaggaatgccgtcttggaagccgattttgcaaagaggggatacaagcttccaaaggtccggaaaactggcacgaccatcgctggggtggtctataaggatggcatagttcttggagcagatacaagagcaactgaagggatggttgttgctgacaagaactgttcaaaaatacacttcatatctcctaatatttattgttgtggtgctgggacagctgcagacacagacatgacaacccagctcatttcttccaacctggagctccactccctctccactggccgtcttcccagagttgtgacagccaatcggatgctgaagcagatgcttttcaggtatcaaggttacattggtgcagccctagttttagggggagtagatgttactggacctcacctctacagcatctatcctcatggatcaactgataagttgccttatgtcaccatgggttctggctccttggcagcaatggctgtatttgaagataagtttaggccagacatggaggaggaggaagccaagaatctggtgagcgaagccatcgcagctggcatcttcaacgacctgggctccggaagcaacattgacctctgcgtcatcagcaagaacaagctggattttctccgcccatacacagtgcccaacaagaaggggaccaggcttggccggtacaggtgtgagaaagggactactgcagtcctcactgagaaaatcactcctctggagattgaggtgctggaagaaacagtccaaacaatggacacttcctgaatggcatcagtgggtggctggccgcggttctggaaggtggtgagcattgaggcccagtaagacactcatgtggctagtgtttgccgaatgaaactcaactcaataaaaaacaaaaaccaaattgggcagctgaaaaaaaaaaaaaaaaaactccgnggggggccccgtacccanttnggcctattaggngtcctgtttcaatttactttggcctctgtttcaacctggtggctttgggg

SEQ ID NO: 342444 - DNA, 991 bp, Homo sapiens
cggacccggaactggctttcttgggaagatggcggctgtgtcggtgtatgctccaccagttggaggcttctcttttgataactgccgcaggaatgccgtcttggaagccgattttgcaaagaggggatacaagcttccaaaggtccggaaaactggcacgaccatcgctggggtggtctataaggatggcatagttcttggagcagatacaagagcaactgaagggatggttgttgctgacaagaactgttcaaaaatacacttcatatctcctaatatttattgttgtggtgctgggacagctgcagacacagacatgacaacccagctcatttcttccaacctggagctccactccctctccactggccgtcttcccagagttgtgacagccaatcggatgctgaagcagatgcttttcaggtatcaaggttacattggtgcagccctagttttagggggagtagatgttactggacctcacctctacagcatctatcctcatggatcaactgataagttgccttatgtcaccatgggttctggctccttggcagcaatggctgtatttgaagataagtttaggccagacatggaggaggaggaagccaagaatctggtgagcgaagccatcgcagctggcatcttcaacgacctgggctccggaagcaacattgacctctgcgtcatcagcaagaacaagctggattttctccgcccatacacagtgcccaacaagaaggggaccaggcttggccggtacaggtgtgagaaagggactactgcagtcctcactgagaaaatcactcctctggagattgaggtgctggaagaaacagtccaaacaatggacacttcctgaatggcatcagtgggtggctggccgcggttctggaaggtggtgagcattgaggcccagtaagcccatcctgtgcatagcgttccaagcctcgaggtccatcgcggggcagagtcgttggagactgtagag

SEQ ID NO: 342445 - DNA, 1620 bp, Homo sapiens
tgacagcggagatacaggacgtcgggtggccgctggtgctgctcgctgctcctgctggcagacggacaggatcacagtcccccaggggtccccacagtcaagggtgcagaagggctgtcagagtggccgagcctcacttctgggtagataggctgccaagtccagtggagttttgaggccatagtttctaggccatggaaaatgatttttcctgagtaggggaaggagactcatctgtgtctcctcgtcagccaccagcctgggagcagagatttggagccagaagctacagtgggacatcagtacctctttgcttctccccaagaaggcctcagaaatattttggagcagtggtgacactgctagccttcccaccaccattttatttggtagttaaaataaaggaggtgtgcccattgtaagattccttttgtgtgaagttctagatttttttttttttttttttgaggtaggtttctagctctgtcatccaggctggagtgcagtggcgtgatcatggctcactgtgacctctgtctcctggtctcaagggatcctcccacctcagcctctcaagtagtcgggaccacagatggggttgcactatgtcgcctaggttggagtgcggtgaacacaatcacagctcactgcagcctcgagttcctgggctcaagtgatcctcccacctcaacctcttgagcagctgggactgcaggaatgccgtcttggaagccgattttgcaaagaggggatacaagcttccaaaggtccggaaaactggcacgaccatcgctggggtggtctataaggatggcatagttcttggagcagatacaagagcaactgaagggatggttgttgctgacaagaactgttcaaaaatacacttcatatctcctaatatttattgttgtggtgctgggacagctgcagacacagacatgacaacccagctcatttcttccaacctggagctccactccctctccactggccgtcttcccagagttgtgacagccaatcggatgctgaagcagatgcttttcaggtatcaaggttacattggtgcagccctagttttagggggagtagatgttactggacctcacctctacagcatctatcctcatggatcaactgataagttgccttatgtcaccatgggttctggctccttggcagcaatggctgtatttgaagataagtttaggccagacatggaggaggaggaagccaagaatctggtgagcgaagccatcgcagctggcatcttcaacgacctgggctccggaagcaacattgacctctgcgtcatcagcaagaacaagctggattttctccgcccatacacagtgcccaacaagaaggggaccaggcttggccggtacaggtgtgagaaagggactactgcagtcctcactgagaaaatcactcctctggagattgaggtgctggaagaaacagtccaaacaatggacacttcctgaatggcatcagtgggtggctggccgcggttctggaaggtggtgagcattgaggcccagtaagacactcatgtggctagtgtttgccgaatgaaactcaactcaataaaaaacaaaaaccaaattgggcagctga

SEQ ID NO: 342446 - DNA, 941 bp, Homo sapiens
cggacccggaactggctttcttgggaagatggcggctgtgtcggtgtatgctccaccagttggaggcttctcttttgataactgccgcaggaatgccgtcttggaagccgattttgcaaagaggggatacaagcttccaaaggtccggaaaactggcacgaccatcgctggggtggtctataaggatggcatagttcttggagcagatacaagagcaactgaagggatggttgttgctgacaagaactctgcagacacagacatgacaacccagctcatttcttccaacctggagctccactccctctccactggccgtcttcccagagttgtgacagccaatcggatgctgaagcagatgcttttcaggtatcaaggttacattggtgcagccctagttttagggggagtagatgttactggacctcacctctacagcatctatcctcatggatcaactgataagttgccttatgtcaccatgggttctggctccttggcagcaatggctgtatttgaagataagtttaggccagacatggaggaggaggaagccaagaatctggtgagcgaagccatcgcagctggcatcttcaacgacctgggctccggaagcaacattgacctctgcgtcatcagcaagaacaagctggattttctccgcccatacacagtgcccaacaagaaggggaccaggcttggccggtacaggtgtgagaaagggactactgcagtcctcactgagaaaatcactcctctggagattgaggtgctggaagaaacagtccaaacaatggacacttcctgaatggcatcagtgggtggctggccgcggttctggaaggtggtgagcattgaggcccagtaagacactcatgtggctagtgtttgccgaatgaaactcaactcaataaaaaacaaaaaccaaattgggcagctga

SEQ ID NO: 342447 - DNA, 859 bp, Homo sapiens
cggacccggaactggctttcttgggaagatggcggctgtgtcggtgtatgctccaccagttggaggcttctcttttgataactgccgcaggaatgccgtcttggaagccgattttgcaaagaggggatacaagcttccaaaggtccggaaaactggcacgaccatcgctggggtggtctataaggatggcatagttcttggagcagatacaagagcaactgaagggatggttgttgctgacaagaactgttcaaaaatacacttcatatctcctaatatttattgttgtggtgctgggacagctgcagacacagacatgacaacccagctcatttcttccaacctggagctccactccctctccactggccgtcttcccagagttgtgacagccaatcggatgctgaagcagatgcttttcaggtatcaaggttacattggtgcagccctagttttagggggagtagatgttactggacctcacctctacagcatctatcctcatggatcaactgataagttgccttatgtcaccatgggttctggctccttggcagcaatggctgtatttgaagataagtttaggccagacatggaggaggaggaagccaagaatctggtgagcgaagccatcgcagctggcatcttcaacgacctgggctccggaagcaacattgacctctgcgtcatcagcaagaacaagctggattttctccgcccatacacagtgcccaacaagaaggggaccagcggttctggaaggtggtgagcattgaggcccagtaagacactcatgtggctagtgtttgccgaatgaaactcaactcaataaaaaacaaaaaccaaattgggcagctga

SEQ ID NO: 342448 - DNA, 1086 bp, Homo sapiens
  misc_feature (442)..(443): n is a, c, g, or t
tgggcaggtggacagatgtgcgagtcggcacgtagggttgtgtgcggtgtttgctaccaccagttggatggcttctcttgtagatatcatgccggtctggtaatgccgtctcgtgtaatgccgattttgcaatcgagtgtggatacgaagccttccatcaggcccggaaaactggtgcacgaccatcgctgggagtggctcgtataatggactgggcctagttctcgcgagcacgattgcaagacgcgatctgcccggtgcattgtgtctgttagtctggactaacgcaactagttgcaattacactgcagcgttcatattcctcctagaatatttacttgttagtggtgctaggcgatcagctgcaagacacacgcacgtgacagacctctacgctcatttcgttcctacagccttggatgctccacctgccctctcctannctggccgtcgttccctacgaggcgtgcttgccatgtcaggatgcttgataggcatcacttctgtgtcacgtgtatcaaggttacattggtgcagccctagttttagggggagtagatgttactggacctcacctctacagcatctatcctcatggatcaactgataagttgccttatgtcaccatgggttctggctccttggcagcaatggctgtatttgaagataagtttaggccagacatggaggaggaggaagccaagaatctggtgagcgaagccatcgcagctggcatcttcaacgacctgggctccggaagcaacattgacctctgcgtcatcagcaagaacaagctggattttctccgcccatacacagtgcccaacaagaaggggaccaggcttggccggtacaggtgtgagaaagggactactgcagtcctcactgagaaaatcactcctctggagattgaggtgctggaagaaacagtccaaacaatggacacttcctgaatggcatcagtgggtggctggccgcggttctggaaggtggtgagcattgaggcccagtaagacactcatgtggctagtgtttgccgaatgaaactcaactcaataaaaaacaaaaaccaaattgggcagctga

SEQ ID NO: 342449 - DNA, 2810 bp, Homo sapiens
tggcctcgtccgcttggatgcgcggggatctgcagcttctggttcctcaggggccggacaaggtggtccccaggcattgcaaaggttgccagtggtcctcccctgggcccgagagccccgtgcggacacctggtggaagtgcccaggcactgccggtgggcttcttgctgctgcacgggccgcccctttgtgttttttttcccaatttaaaaaagcctttattcatacttaaataacagcatacatgataatttgatgagtaaatcaaactatataattttaaaatttgcatattttaaagttttatcagttacttacagactgtttgcaaaatagagggaggatcactcataatcttacatagcactgtcagcagtctgctgtcctgtgcccagtcgaatggattgacactagatatgcatgtctcatgtcattcgtatatttccgtttccccaagtcttcacctgtccccatctacccagatcatttgggaaatgtaaatgtgcagtcctaagcgctgcccgcagggtcgcgatgtctgccaggtactgctggctggctctagacaccagcagcagtgataagaaacaaagcagaggagacagttaaatggtagagaagagaagggggagcagaggtggtaggccgggaacaggggaataagtatggttctccccgcacgtgcccatgtgcgcacacaccgaaggccatttaaagggaagcggttaggtatgaggttgtgtttgctgaattagtggttggtttttgctgtctatctagatagcagctgctgccagctcctcgtctaagaggctttctttgctgccaccttcactggtttgtggaaagcttctggccccatagactgttgagaattccaggagaaaattcctaattagcggatcccgtttgaatgcattcttacaggactgcatatgtacaaaagaagaattggcttcattggccccacatagatgtcacgtgagagtgaaaaaacctggggtataaatatcaaaggaacccctatctgctggtttgctgaggagcccacttccagcagaaccttctctgtccttctgagtctgtagagggcgcttatgtcactggaatcctagtctggcatggggcaggcagaggagcaggagcccccagtgggttcagatcttctgaaaacttgaggttagcggatctgccctttgagggtctcaggctggatttgggcctggagtccgtgtttctccaagggtgttgcttgggtgagcgctggagtgcacttgcatgtgtatgtactctcacgccctcgtggactgggtgtcctcgttgtatatagagcttgaacttggtgttccccaggtccagtaccactgccgttgctgcctgccttctgtttcactgctgttttctgagtgcctcgtgtgcagcctgtccttcagccctccctgaagctctgctgaccagctgtgttcccagctccttttcacgtgctctttagccagccttaccctgcattgtacttacttgggtcaggtgcccctgctagactcttaagcccctagggggcagggatctgggggcgtcatccacctctgcagccctagcttctggtatagcatgtgataggacatagcatgtgatggggcttctcggataagaaagggatgagtccatctgttcaccagtaactattagggatggggatttgtgtttaaaggtggggcaaaggagagagtgattcaaagtaatggattacttcagtgaacctataggttccttagtaggagagagagattattctgggcaagaggtcccgcccttggtctgccagcatttccccagaactaccggcttgtgttttggtgttagtttcttcctcctacagtgctgactttctcaagtaactttcagctattgttggacattcttgatcaggggatagttagtaaactgcagtcagtgggccacatctggcccactgcctgttgctaatagagttttattggaacacagttatacccattttttaatgtatttgtgtgtggctgttttgtgctagcgtgacagagttgagtaggtgtggtagagacttttggccacaaagcctaaaatatttactacctggcccttttaaagataagttactaaccctctagtaactgtcagcccatcgttttgtggtgattgtctgatgtggtcaagaggcggtgcatgcataaaaagttttaaaggcctgggtcgggaactttgggtaaatcatcaaggtactttgagatcttttcctcatctgtgagatgggcattaaaaacaacacctgtctcgcgggaggtcttgcgcactgctagtggacgtacattgcggatgtcagagcaggccctagtttggccggggacattattgccgccgttctgtttctcaggaggaggaagccaagaatctggtgagcgaagccatcgcagctggcatcttcaacgacctgggctccggaagcaacattgacctctgcgtcatcagcaagaacaagctggattttctccgcccatacacagtgcccaacaagaaggggaccaggcttggccggtacaggtgtgagaaagggactactgcagtcctcactgagaaaatcactcctctggagattgaggtgctggaagaaacagtccaaacaatggacacttcctgaatggcatcagtgggtggctggccgcggttctggaaggtggtgagcattgaggcccagtaagacactcatgtggctagtgtttgccgaatgaaactcaactcaataaaaaacaaaaaccaaattgggcagctga

SEQ ID NO: 342450 - DNA, 4764 bp, Homo sapiens
tggcctcgtccgcttggatgcgcggggatctgcagcttctggttcctcaggggccggacaaggtggtccccaggcattgcaaaggttgccagtggtcctcccctgggcccgagagccccgtgcggacacctggtggaagtgcccaggcactgccggtgggcttcttgctgctgcacgggccgcccctttgtgttttttttcccaatttaaaaaagcctttattcatacttaaataacagcatacatgataatttgatgagtaaatcaaactatataattttaaaatttgcatattttaaagttttatcagttacttacagactgtttgcaaaatagagggaggatcactcataatcttacatagcactgtcagcagtctgctgtcctgtgcccagtcgaatggattgacactagatatgcatgtctcatgtcattcgtatatttccgtttccccaagtcttcacctgtccccatctacccagatcatttgggaaatgtaaatgtgcagtcctaagcgctgcccgcagggtcgcgatgtctgccaggtactgctggctggctctagacaccagcagcagtgataagaaacaaagcagaggagacagttaaatggtagagaagagaagggggagcagaggtggtaggccgggaacaggggaataagtatggttctccccgcacgtgcccatgtgcgcacacaccgaaggccatttaaagggaagcggttaggtatgaggttgtgtttgctgaattagtggttggtttttgctgtctatctagatagcagctgctgccagctcctcgtctaagaggctttctttgctgccaccttcactggtttgtggaaagcttctggccccatagactgttgagaattccaggagaaaattcctaattagcggatcccgtttgaatgcattcttacaggactgcatatgtacaaaagaagaattggcttcattggccccacatagatgtcacgtgagagtgaaaaaacctggggtataaatatcaaaggaacccctatctgctggtttgctgaggagcccacttccagcagaaccttctctgtccttctgagtctgtagagggcgcttatgtcactggaatcctagtctggcatggggcaggcagaggagcaggagcccccagtgggttcagatcttctgaaaacttgaggttagcggatctgccctttgagggtctcaggctggatttgggcctggagtccgtgtttctccaagggtgttgcttgggtgagcgctggagtgcacttgcatgtgtatgtactctcacgccctcgtggactgggaaggcgccgtagcacaggttagattccctgctttcagggagcctggttcatttttgtcctcgttgtatatagagcttgaacttggtgttccccaggtccagtaccactgccgttgctgcctgccttctgtttcactgctgttttctgagtgcctcgtgtgcagcctgtccttcagccctccctgaagctctgctgaccagctgtgttcccagctccttttcacgtgctctttagccagccttaccctgcattgtacttacttgggtcaggtgcccctgctagactcttaagcccctagggggcagggatctgggggcgtcatccacctctgcagccctagcttctggtatagcatgtgataggacatagcatgtgatggggcttctcggataagaaagggatgagtccatctgttcaccagtaactattagggatggggatttgtgtttaaaggtggggcaaaggagagagtgattcaaagtaatggattacttcagtgaacctataggttccttagtaggagagagagattattctgggcaagaggtcccgcccttggtctgccagcatttccccagaactaccggcttgtgttttggtgttagtttcttcctcctacagtgctgactttctcaagtaactttcagctattgttggacattcttgatcaggggatagttagtaaactgcagtcagtgggccacatctggcccactgcctgttgctaatagagttttattggaacacagttatacccattttttaatgtatttgtgtgtggctgttttgtgctagcgtgacagagttgagtaggtgtggtagagacttttggccacaaagcctaaaatatttactacctggcccttttaaagataagttactaaccctctagtaactgtcagcccatcgttttgtggtgattgtctgatgtggtcaagaggcggtgcatgcataaaaagttttaaaggcctgggtcgggaactttgggtaaatcatcaaggtactttgagatcttttcctcatctgtgagatgggcattaaaaacaacacctgtctcgcgggaggtcttgcgcactgctagtggacgtacattgcggatgtcagagcaggccctagtttggccggggacattattgccgccgttctgtttctcaggaggaggaagccaagaatctggtgagcgaagccatcgcagctggcatcttcaacgacctgggctccggaagcaacattgacctctgcgtcatcagcaagaacaagctggattttctccgcccatacacagtgcccaacaagaaggggaccagggtgagtgaaggagacgaagttcttcctgggtcccctggcgtcgtggccacccttggtatctccatggcatctggatggagttttcctggttctttccacattaagtacatccagtgttcccaaatcaacctcccacacagaccttcggcttgttacttgctttatgacagtgggctgctgtcaggtgtaggaaagtgatttaatttgatgggagaggtggagggtggcccaggaaagagccctaggctgggaggtggggccggagaggtttggatcatctgctgtcctttctcaagtgtcttaaagaatcccctgatttctgggagaaggtgcatttttcagggcagccccagcactttccctcagagtgccccgagattcctaactgggtgtaagtcagcaatgctaacagcctcccagaggtggccttgggagctagtgtgtgtgtgctgtgctacagggagttgtgccattgagcctgagcctacatgccgagtgggcccctcggctcagtggtgcagcgcagactcagagcagtgggagaaggttctagttgatttgctgagcagaactgggaggtttccaaacctggtggctagcatgtgtcagaggagcagctcgtttgcagtgtctcgtgattgtccggctgcttgaccgtcctgtggctcctgacctcttctgggagcccgggcaggtcaggatgggctccctgagtgctgcttccagctgcagcatctgggtgcagcacagggcatttataaactacggctcccactcagctccacggtagccccgaggaagtgagcaccaccttctgcaggcttgcttccatctcccactgcacacacaactccacatcaggagtaattcacaaggaaggaatggaacgttcagaaccagcaggtattcactgtgggctgcactcaaccttgcggaagctcagtgggctcctgatggggtggggcagcacggggccagagaacgctggcactggggttggggagtgttggtggctggcttggtggcttccagcaaatcagtctgtcttggaaatggagctaaaccagatgacctctaatgagcccacgaagtccctcgggcctttagcaggaaggcaagccacctttcaggcccagagctgtgttggggaaccgggctttgccgagctccaggtaggcaggagccaagtactccatgtagcctgcttcgctggttattttgcaagatgcgtgatttgagcaagtccatggtgaagcggtgatggggtagggaatggttacaccattcaggctggccagggtcctgggcgaggactctgaaagccacgtctgggccagtgagaagtggttgcctagggaacctgtgctgagcgcaggagtcctcatccacagggagtgcagcagtggcacatcctacttcctgggacatgggctgctccacttgtaaacagaggctctaaacacccaagaacaaaagaaaaccgccttgcggctgcttgggaagaatcagcaaggcgacccagaagctgctgggcgtgtggtgggtgtgcagtaacctgcagggagcctgctccccatcggtgtcctggggccaagggcagcaagtgtccaagctccctggactctgttgtcttctttgccagtgactgaagatgggggcactgcctgagttaggggagcccttcccagggtggatgctagggtgcgggcagggcgataggcctgaggaagcatcccgtgccatgcgccagtgggccttgcctggcaagtccctgctgcctgtctgcccgcagccctccagcacacggtcttgcagtccactggcacgtaaggcggaagctctgaatgcatgccgcaaaaatcgggcactgtcaccacagtggtgaggaggctcttgtgtgtccaagcctcccggagacactgaggggtggttcagaggagtcaggcacacagaggccacgtgggactttggctctaagactgcacgctgccaccaaggttccagcgtgtgagggatgaggggcatcctcaaactgatggggtggggacacattgttcaaaggtacttttgcttggattctttaagagggtgggggtcgggggaggcttggcagcataaaggcaggccgctctgggctgaccgtg

SEQ ID NO: 342451 - DNA, 3219 bp, Homo sapiens
tggcctcgtccgcttggatgcgcggggatctgcagcttctggttcctcaggggccggacaaggtggtccccaggcattgcaaaggttgccagtggtcctcccctgggcccgagagccccgtgcggacacctggtggaagtgcccaggcactgccggtgggcttcttgctgctgcacgggccgcccctttgtgttttttttcccaatttaaaaaagcctttattcatacttaaataacagcatacatgataatttgatgagtaaatcaaactatataattttaaaatttgcatattttaaagttttatcagttacttacagactgtttgcaaaatagagggaggatcactcataatcttacatagcactgtcagcagtctgctgtcctgtgcccagtcgaatggattgacactagatatgcatgtctcatgtcattcgtatatttccgtttccccaagtcttcacctgtccccatctacccagatcatttgggaaatgtaaatgtgcagtcctaagcgctgcccgcagggtcgcgatgtctgccaggtactgctggctggctctagacaccagcagcagtgataagaaacaaagcagaggagacagttaaatggtagagaagagaagggggagcagaggtggtaggccgggaacaggggaataagtatggttctccccgcacgtgcccatgtgcgcacacaccgaaggccatttaaagggaagcggttaggtatgaggttgtgtttgctgaattagtggttggtttttgctgtctatctagatagcagctgctgccagctcctcgtctaagaggctttctttgctgccaccttcactggtttgtggaaagcttctggccccatagactgttgagaattccaggagaaaattcctaattagcggatcccgtttgaatgcattcttacaggactgcatatgtacaaaagaagaattggcttcattggccccacatagatgtcacgtgagagtgaaaaaacctggggtataaatatcaaaggaacccctatctgctggtttgctgaggagcccacttccagcagaaccttctctgtccttctgagtctgtagagggcgcttatgtcactggaatcctagtctggcatggggcaggcagaggagcaggagcccccagtgggttcagatcttctgaaaacttgaggttagcggatctgccctttgagggtctcaggctggatttgggcctggagtccgtgtttctccaagggtgttgcttgggtgagcgctggagtgcacttgcatgtgtatgtactctcacgccctcgtggactgggaaggcgccgtagcacaggttagattccctgctttcagggagcctggttcatttttgtcctcgttgtatatagagcttgaacttggtgttccccaggtccagtaccactgccgttgctgcctgccttctgtttcactgctgttttctgagtgcctcgtgtgcagcctgtccttcagccctccctgaagctctgctgaccagcttgtgtgtgtgctgtgctacagggagttgtgccattgagcctgagcctacatgccgagtgggcccctcggctcagtggtgcagcgcagactcagagcagtgggagaaggttctagttgatttgctgagcagaactgggaggtttccaaacctggtggctagcatgtgtcagaggagcagctcgtttgcagtgtctcgtgattgtccggctgcttgaccgtcctgtggctcctgacctcttctgggagcccgggcaggtcaggatgggctccctgagtgctgcttccagctgcagcatctgggtgcagcacagggcatttataaactacggctcccactcagctccacggtagccccgaggaagtgagcaccaccttctgcaggcttgcttccatctcccactgcacacacaactccacatcaggagtaattcacaaggaaggaatggaacgttcagaaccagcaggtattcactgtgggctgcactcaaccttgcggaagctcagtgggctcctgatggggtggggcagcacggggccagagaacgctggcactggggttggggagtgttggtggctggcttggtggcttccagcaaatcagtctgtcttggaaatggagctaaaccagatgacctctaatgagcccacgaagtccctcgggcctttagcaggaaggcaagccacctttcaggcccagagctgtgttggggaaccgggctttgccgagctccaggtaggcaggagccaagtactccatgtagcctgcttcgctggttattttgcaagatgcgtgatttgagcaagtccatggtgaagcggtgatggggtagggaatggttacaccattcaggctggccagggtcctgggcgaggactctgaaagccacgtctgggccagtgagaagtggttgcctagggaacctgtgctgagcgcaggagtcctcatccacagggagtgcagcagtggcacatcctacttcctgggacatgggctgctccacttgtaaacagaggctctaaacacccaagaacaaaagaaaaccgccttgcggctgcttgggaagaatcagcaaggcgacccagaagctgctgggcgtgtggtgggtgtgcagtaacctgcagggagcctgctccccatcggtgtcctggggccaagggcagcaagtgtccaagctccctggactctgttgtcttctttgccagtgactgaagatgggggcactgcctgagttaggggagcccttcccagggtggatgctagggtgcgggcagggcgataggcctgaggaagcatcccgtgccatgcgccagtgggccttgcctggcaagtccctgctgcctgtctgcccgcagccctccagcacacggtcttgcagtccactggcacgtaaggcggaagctctgaatgcatgccgcaaaaatcgggcactgtcaccacagtggtgaggaggctcttgtgtgtccaagcctcccggagacactgaggggtggttcagaggagtcaggcacacagaggccacgtgggactttggctctaagactgcacgctgccaccaaggttccagcgtgtgagggatgaggggcatcctcaaactgatggggtggggacacattgttcaaaggtacttttgcttggattctttaagagggtgggggtcgggggaggcttggcagcataaaggcaggccgctctgggctgaccgtg

SEQ ID NO: 342452 - DNA, 793 bp, Homo sapiens
cggacccggaactggctttcttgggaagatggcggctgtgtcggtgtatgctccaccagttggaggcttctcttttgataactgccgcaggaatgccgtcttggaagccgattttgcaaagaggggatacaagcttccaaaggtccggaaaactggcacgaccatcgctggggtggtctataaggatggcatagttcttggagcagatacaagagcaactgaagggatggttgttgctgacaagaactgttcaaaaatacacttcatatctcctaatatttattgttgtggtgctgggacagctgcagacacagacatgacaacccagctcatttctgttctggctccttggcagcaatggctgtatttgaagataagtttaggccagacatggaggaggaggaagccaagaatctggtgagcgaagccatcgcagctggcatcttcaacgacctgggctccggaagcaacattgacctctgcgtcatcagcaagaacaagctggattttctccgcccatacacagtgcccaacaagaaggggaccaggcttggccggtacaggtgtgagaaagggactactgcagtcctcactgagaaaatcactcctctggagattgaggtgctggaagaaacagtccaaacaatggacacttcctgaatggcatcagtgggtggctggccgcggttctggaaggtggtgagcattgaggcccagtaagacactcatgtggctagtgtttgccgaatgaaactcaactcaataaaaaacaaaaaccaaattgggcagctga

SEQ ID NO: 342453 - DNA, 912 bp, Homo sapiens
tggcctcgtccgcttggatgcgcggggatctgcagcttctggttcctcaggggccggacaaggtggtccccaggcattgcaaaggttgccagtggtcctcccctgggcccgagagccccgtgcggacacctggtggaagtgcccaggcactgccggtgggcttcttgctgctgcacgggccgcccctttgtgttttttttcccaatttaaaaaagcctttattcatacttaaataacagcatacatgataatttgatgagtaaatcaaactatataattttaaaatttgcatattttaaagttttatcagttacttacagactgtttgcaaaatagagggaggatcactcataatcttacatagcactgtcagcagtctgctgtcctgtgcccagtcgaatggattgacactagatatgcatgtctcatgtcattcgtatatttccgtttccccaagtcttcacctgtccccatctacccagatcatttgggaaatgtaaatgtgcagtcctaagcgctgcccgcagggtcgcgatgtctgccaggtactgctggctggctctagacaccagcagcagtgataagaaacaaagcagaggagacagttaaatggtagagaagagaagggggagcagaggtggtaggccgggaacaggggaataagtatggttctccccgcacgtgcccatgtgcgcacacaccgaaggccatttaaaggggattaataaccagaatatataaggagatcaaataactcaataggaaaaaaatctaataatccaattttttaaatgggcaaaagatctaaatagacatttctcaaaagaaggcacatgaatggcaaacagatatataaaaaggtgctcaacatcaatgatcatcagagaaatgctaatcaaaactacaatgaga

SEQ ID NO: 342454 - DNA, 181 bp, Homo sapiens
tgtcggtgtatgctccaccagttggaggcttctcttttgataactgccgcaggtgccgccttgcttggggcttggttcagggagggagaagagtgcggtgctcgggtgggagctgggccaaggtgtgatacgagaattctgagggaagaattcatggcggggcctgtggcccgcggctagt

SEQ ID NO: 342455 - DNA, 331 bp, Homo sapiens
aggacaaatgcacagctcttccatggtcactgtcgcaggaatgttgaatatgcctggatccatcatggtaccacgttactcctccacggcactacatctggccgctaaaccagcattcggcacataagcttttttgatggttgttaattttttgatggggagtatcaacttcttttcaacaattaataggtagtttatgagtggtttaccctatttcttagtatgtaggtttttgccatttctgacttcgcagtattgtttagggaccagagggtgtctctgggaattgctttttgacagtgccttatgtccagtcatctttggaaaagat

SEQ ID NO: 342456 - DNA, 995 bp, Homo sapiens
cggacccggaactggctttcttgggaagatggcggctgtgtcggtgtatgctccaccagttggaggcttctcttttgataactgccgcaggaatgccgtcttggaagccgattttgcaaagaggggatacaagcttccaaaggtccggaaaactggcacgaccatcgctggggtggtctataaggatggcatagttcttggagcagatacaagagcaactgaagggatggttgttgctgacaagaactgttcaaaaatacacttcatatctcctaatatttattgttgtggtgctgggacagctgcagacacagacatgacaacccagctcatttcttccaacctggagctccactccctctccactggccgtcttcccagagttgtgacagccaatcggatgctgaagcagatgcttttcaggtatcaaggttacattggtgcagccctagttttagggggagtagatgttactggacctcacctctacagcatctatcctcatggatcaactgataagttgccttatgtcaccatgggttctggctccttggcagcaatggctgtatttgaagataagtttaggccagacatggaggaggaggaagccaagaatctggtgagcgaagccatcgcagctggcatcttcaacgacctgggctccggaagcaacattgacctctgcgtcatcagcaagaacaagctggattttctccgcccatacacagtgcccaacaagaaggggaccaggcttggccggtacaggtgtgagaaagggactactgcagtcctcactgagaaaatcactcctctggagattgaggtgctggaagaaacagtccaaacaatggacacttcctgaatggcatcagtgggtggctggccgcggttctggaaggtggtgagcattgaggcccagtaagacactcatgtggctagtgtttgccgaatgaaactcaactcaataaaaaacaaaaaccaaattgggcagctga

SEQ ID NO: 342457 - DNA, 484 bp, Homo sapiens
acactaaaagtgcacctttttcttgcaggttctggctccttggcagcaatggctgtatttgaagataagtttaggccagacatggaggaggaggaagccaagaatctggtgagcgaagccatcgcagctggcatcttcaacgacctgggctccggaagcaacattgacctctgcgtcatcagcaagaacaagctggattttctccgcccatacacagtgcccaacaagaaggggaccaggcttggccggtacaggtgtgagaaagggactactgcagtcctcactgagaaaatcactcctctggagattgaggtgctggaagaaacagtccaaacaatggacacttcctgaatggcatcagtgggtggctggccgcggttctggaaggtggtgagcattgaggcccagtaagacactcatgtggctagtgtttgccgaatgaaactcaactcaataaaaaacaaaaaccaaattgggcagctga

SEQ ID NO: 342458 - DNA, 1439 bp, Homo sapiens
cggacccggaactggctttcttgggaagatggcggctgtgtcggtgtatgctccaccagttggaggcttctcttttgataactgccgcaggaatgccgtcttggaagccgattttgcaaagaggggatacaagcttccaaaggtccggaaaactggcacgaccatcgctggggtggtctataaggatggcatagttcttggagcagatacaagagcaactgaagggatggttgttgctgacaagaactgttcaaaaatacacttcatatctcctaatatttattgttgtggtgctgggacagctgcagacacagacatgacaacccagctcatttcttccaacctggagctccactccctctccactggccgtcttcccagagttgtgacagccaatcggatgctgaagcagatgcttttcaggtatcaaggttacattggtgcagccctagttttagggggagtagatgttactggacctcacctctacagcatctatcctcatggatcaactgataagttgccttatgtcaccatgggttctggctccttggcagcaatggctgtatttgaagataagtttaggccagacatggaggaggaggaagccaagaatctggtgagcgaagccatcgcagctggcatcttcaacgacctgggctccggaagcaacattgacctctgcgtcatcagcaagaacaagctggattttctccgcccatacacagtgcccaacaagaaggggaccaggcttggccggtacaggtgtgagaaagggactactgcagtcctcactgagaaaatcactcctctggagattgaggtgctggaagaaacagtccaaacaatggacacttcctgaatggcatcagtgggtggctggccgcggttctggaaggtggtgagcattgaggcccagtaagacactcatgtggctagtgtttgccgaatgaaactcaactcaataaaaaacaaaaaccaaattgggcagctgaagaccaaaaaaacgagacaaaccaacacaagacaaacaaaaaacacaacaaacgaacaagaaaaacaagaaacacaaagaaagaggggggagcagacagacaaaaagaatcacccacaaggggccacaaaatgaccggcacaacctgcaagactgtagaggagaagaaggcggttgcacccactaagggaccgaacaattgatagaaagagccaaagacggccgcgaaatcaaccacgcgcatggaagcaacaaacactacgcaatgagaatcactagagtgacaagacaacacatacagggggggaaggacaaatcgtgagaacaaacaacaccaagggtgtaaactccaggacgaataacaaggctccaagggactagacagcaaccccgacacttccgccaacacatcctacggcaaagcacaaaataacagggaacgagc

SEQ ID NO: 342459 - DNA, 1039 bp, Homo sapiens
cggacccggaactggctttcttgggaagatggcggctgtgtcggtgtatgctccaccagttggaggcttctcttttgataactgccgcaggaatgccgtcttggaagccgattttgcaaagaggggatacaagcttccaaaggtccggaaaactggcacgaccatcgctggggtggtctataaggatggcatagttcttggagcagatacaagagcaactgaagggatggttgttgctgacaagaactgttcaaaaatacacttcatatctcctaatatttattgttgtggtgctgggacagctgcagacacagacatgacaacccagctcatttcttccaacctggagctccactccctctccactggccgtcttcccagagttgtgacagccaatcggatgctgaagcagatgcttttcaggtatcaaggttacattggtgcagccctagttttagggggagtagatgttactggacctcacctctacagcatctatcctcatggatcaactgataagttgccttatgtcaccatgggttctggctccttggcagcaatggctgtatttgaagataagtttaggccagacatggaggaggaggaagccaagaatctggtgagcgaagccatcgcagctggcatcttcaacgacctgggctccggaagcaacattgacctctgcgtcatcagcaagaacaagctggattttctccgcccatacacagtgcccaacaagaaggggaccaggcttggccggtacaggtgtgagaaagggactactgcagtcctcactgagaaaatcactcctctggagattgaggtgctggaagaaacagtccaaacaatggacacttcctgaatggcatcagtgggtggctggccgcggttctggaaggtggtgagcattgaggcccagtaagacactcatgtggctagtgtttgccgaatgaaactcaactcaataaaaaacaaaaaccaaattgggcagctgaaaaaaaaaagaaaaaaaaaaaaaaaaaaaacaacaaaaaaaaac

SEQ ID NO: 342460 - DNA, 1474 bp, Homo sapiens
  misc_feature (1471)..(1471): n is a, c, g, or t
cggacccggaactggctttcttgggaagatggcggctgtgtcggtgtatgctccaccagttggaggcttctcttttgataactgccgcaggaatgccgtcttggaagccgattttgcaaagaggggatacaagcttccaaaggtccggaaaactggcacgaccatcgctggggtggtctataaggatggcatagttcttggagcagatacaagagcaactgaagggatggttgttgctgacaagaactgttcaaaaatacacttcatatctcctaatatttattgttgtggtgctgggacagctgcagacacagacatgacaacccagctcatttcttccaacctggagctccactccctctccactggccgtcttcccagagttgtgacagccaatcggatgctgaagcagatgcttttcaggtatcaaggttacattggtgcagccctagttttagggggagtagatgttactggacctcacctctacagcatctatcctcatggatcaactgataagttgccttatgtcaccatgggttctggctccttggcagcaatggctgtatttgaagataagtttaggccagacatggaggaggaggaagccaagaatctggtgagcgaagccatcgcagctggcatcttcaacgacctgggctccggaagcaacattgacctctgcgtcatcagcaagaacaagctggattttctccgcccatacacagtgcccaacaagaaggggaccaggcttggccggtacaggtgtgagaaagggactactgcagtcctcactgagaaaatcactcctctggagattgaggtgctggaagaaacagtccaaacaatggacacttcctgaatggcatcagtgggtggctggccgcggttctggaaggtggtgagcattgaggcccagtaagacactcatgtggctagtgtttgccgaatgaaactcaactcaataaaaaacaaaaaccaaattgggcagctgaaaaaacaaacaaaaaaacaattttgtgggggcgcggcttgggcccttgggaaagagctttcttcaagaacccatctcgggtgtgggggcggcgcggggccccccaagataagtgtatagaggtgcacaacgtgggccccacacagggcgggtgtcccctagagggagagaccaccgcggggacacaagagacacaaaggggggcgcgggggaatttctcccacccaactctaaaacaaaacggcgcccggggggggcgcgacaaaccccggagagcgtgtgtttctatgagagacaaaattcctcaacagaagagtggggagaggtcatcacgaagaggaggacacatatcaagcgggggagcactatattatacaaacagcgagggagagtgctcccaaagggagaagacgcgcctctccgaaagatttatcaaaaaatataaaccacgcccccggggcagtgtggtgggggggncga

SEQ ID NO: 342461 - DNA, 973 bp, Homo sapiens
tagggggtgtgtcggtgttggtctgagcgagcttaaacggcggctgtgtcggactaccgtgcgtggaagaatgccgtcttggaagccgattttgcaaagaggggatacaagcttccaaaggtccggaaaactggcacgaccatcgctggggtggtctataaggatggcatagttcttggagcagatacaagagcaactgaagggatggttgttgctgacaagaactgttcaaaaatacacttcatatctcctaatatttattgttgtggtgctgggacagctgcagacacagacatgacaacccagctcatttcttccaacctggagctccactccctctccactggccgtcttcccagagttgtgacagccaatcggatgctgaagcagatgcttttcaggtatcaaggttacattggtgcagccctagttttagggggagtagatgttactggacctcacctctacagcatctatcctcatggatcaactgataagttgccttatgtcaccatgggttctggctccttggcagcaatggctgtatttgaagataagtttaggccagacatggaggaggaggaagccaagaatctggtgagcgaagccatcgcagctggcatcttcaacgacctgggctccggaagcaacattgacctctgcgtcatcagcaagaacaagctggattttctccgcccatacacagtgcccaacaagaaggggaccaggcttggccggtacaggtgtgagaaagggactactgcagtcctcactgagaaaatcactcctctggagattgaggtgctggaagaaacagtccaaacaatggacacttcctgaatggcatcagtgggtggctggccgcggttctggaaggtggtgagcattgaggcccagtaagacactcatgtggctagtgtttgccgaatgaaactcaactcaataaaaaacaaaaaccaaattgggcagctga

SEQ ID NO: 342462 - DNA, 2895 bp, Homo sapiens
cggacccggaactggctttcttgggaagatggcggctgtgtcggtgtatgctccaccagttggaggcttctcttttgataactgccgcaggaatgccgtcttggaagccgattttgcaaagaggggatacaagcttccaaaggtccggaaaactggcacgaccatcgctggggtggtctataaggatggcatagttcttggagcagatacaagagcaactgaagggatggttgttgctgacaagaactgttcaaaaatacacttcatatctcctaatatttattgttgtggtgctgggacagctgcagacacagacatgacaacccagctcatttcttccaacctggagctccactccctctccactggccgtcttcccagagttgtgacagccaatcggatgctgaagcagatgcttttcaggtatcaaggttacattggtgcagccctagttttagggggagtagatgttactggacctcacctctacagcatctatcctcatggatcaactgataagttgccttatgtcaccatgggttctggctccttggcagcaatggctgtatttgaagataagtttaggccagacatggaggaggaggaagccaagaatctggtgagcgaagccatcgcagctggcatcttcaacgacctgggctccggaagcaacattgacctctgcgtcatcagcaagaacaagctggattttctccgcccatacacagtgcccaacaagaaggggaccagggtgagtgaaggagacgaagttcttcctgggtcccctggcgtcgtggccacccttggtatctccatggcatctggatggagttttcctggttctttccacattaagtacatccagtgttcccaaatcaacctcccacacagaccttcggcttgttacttgctttatgacagtgggctgctgtcaggtgtaggaaagtgatttaatttgatgggagaggtggagggtggcccaggaaagagccctaggctgggaggtggggccggagaggtttggatcatctgctgtcctttctcaagtgtcttaaagaatcccctgatttctgggagaaggtgcatttttcagggcagccccagcactttccctcagagtgccccgagattcctaactgggtgtaagtcagcaatgctaacagcctcccagaggtggccttgggagctagtgtgtgtgtgctgtgctacagggagttgtgccattgagcctgagcctacatgccgagtgggcccctcggctcagtggtgcagcgcagactcagagcagtgggagaaggttctagttgatttgctgagcagaactgggaggtttccaaacctggtggctagcatgtgtcagaggagcagctcgtttgcagtgtctcgtgattgtccggctgcttgaccgtcctgtggctcctgacctcttctgggagcccgggcaggtcaggatgggctccctgagtgctgcttccagctgcagcatctgggtgcagcacagggcatttataaactacggctcccactcagctccacggtagccccgaggaagtgagcaccaccttctgcaggcttgcttccatctcccactgcacacacaactccacatcaggagtaattcacaaggaaggaatggaacgttcagaaccagcaggtattcactgtgggctgcactcaaccttgcggaagctcagtgggctcctgatggggtggggcagcacggggccagagaacgctggcactggggttggggagtgttggtggctggcttggtggcttccagcaaatcagtctgtcttggaaatggagctaaaccagatgacctctaatgagcccacgaagtccctcgggcctttagcaggaaggcaagccacctttcaggcccagagctgtgttggggaaccgggctttgccgagctccaggtaggcaggagccaagtactccatgtagcctgcttcgctggttattttgcaagatgcgtgatttgagcaagtccatggtgaagcggtgatggggtagggaatggttacaccattcaggctggccagggtcctgggcgaggactctgaaagccacgtctgggccagtgagaagtggttgcctagggaacctgtgctgagcgcaggagtcctcatccacagggagtgcagcagtggcacatcctacttcctgggacatgggctgctccacttgtaaacagaggctctaaacacccaagaacaaaagaaaaccgccttgcggctgcttgggaagaatcagcaaggcgacccagaagctgctgggcgtgtggtgggtgtgcagtaacctgcagggagcctgctccccatcggtgtcctggggccaagggcagcaagtgtccaagctccctggactctgttgtcttctttgccagtgactgaagatgggggcactgcctgagttaggggagcccttcccagggtggatgctagggtgcgggcagggcgataggcctgaggaagcatcccgtgccatgcgccagtgggccttgcctggcaagtccctgctgcctgtctgcccgcagccctccagcacacggtcttgcagtccactggcacgtaaggcggaagctctgaatgcatgccgcaaaaatcgggcactgtcaccacagtggtgaggaggctcttgtgtgtccaagcctcccggagacactgaggggtggttcagaggagtcaggcacacagaggccacgtgggactttggctctaagactgcacgctgccaccaaggttccagcgtgtgagggatgaggggcatcctcaaactgatggggtggggacacattgttcaaaggtacttttgcttggattctttaagagggtgggggtcgggggaggcttggcagcataaaggcaggccgctctgggctgaccgtg

SEQ ID NO: 342463 - DNA, 895 bp, Homo sapiens
tgatggaaggacgagcgccgaggagtagtgagcgagaacgtgcgtattaactgcggtagtagctgtacatataccaaggtcatctaagtcgagcggtcgcggacagttatgacccgggaattacggtactaggttacgaggcccaagggttaatgcttgtatggttcgtgcgtgcaagggacaggcgttggacgaccccggacgctagcgaacgcagcgtcatttctgccaaaccgtagcctcgaatcaccatcattcatctggcccgtcttcacaagcgtgacggcgagttctacgtgctgtccgccagaatgtcatggcgagtatcaaggttacattggtgcagccctagttttagggggagtagatgttactggacctcacctctacagcatctatcctcatggatcaactgataagttgccttatgtcaccatgggttctggctccttggcagcaatggctgtatttgaagataagtttaggccagacatggaggaggaggaagccaagaatctggtgagcgaagccatcgcagctggcatcttcaacgacctgggctccggaagcaacattgacctctgcgtcatcagcaagaacaagctggattttctccgcccatacacagtgcccaacaagaaggggaccaggcttggccggtacaggtgtgagaaagggactactgcagtcctcactgagaaaatcactcctctggagattgaggtgctggaagaaacagtccaaacaatggacacttcctgaatggcatcagtgggtggctggccgcggttctggaaggtggtgagcattgaggcccagtaagacactcatgtggctagtgtttgccgaatgaaactcaactcaataaaaaacaaaaaccaaattgggcagctga

SEQ ID NO: 342464 - DNA, 2864 bp, Homo sapiens
tggcctcgtccgcttggatgcgcggggatctgcagcttctggttcctcaggggccggacaaggtggtccccaggcattgcaaaggttgccagtggtcctcccctgggcccgagagccccgtgcggacacctggtggaagtgcccaggcactgccggtgggcttcttgctgctgcacgggccgcccctttgtgttttttttcccaatttaaaaaagcctttattcatacttaaataacagcatacatgataatttgatgagtaaatcaaactatataattttaaaatttgcatattttaaagttttatcagttacttacagactgtttgcaaaatagagggaggatcactcataatcttacatagcactgtcagcagtctgctgtcctgtgcccagtcgaatggattgacactagatatgcatgtctcatgtcattcgtatatttccgtttccccaagtcttcacctgtccccatctacccagatcatttgggaaatgtaaatgtgcagtcctaagcgctgcccgcagggtcgcgatgtctgccaggtactgctggctggctctagacaccagcagcagtgataagaaacaaagcagaggagacagttaaatggtagagaagagaagggggagcagaggtggtaggccgggaacaggggaataagtatggttctccccgcacgtgcccatgtgcgcacacaccgaaggccatttaaagggaagcggttaggtatgaggttgtgtttgctgaattagtggttggtttttgctgtctatctagatagcagctgctgccagctcctcgtctaagaggctttctttgctgccaccttcactggtttgtggaaagcttctggccccatagactgttgagaattccaggagaaaattcctaattagcggatcccgtttgaatgcattcttacaggactgcatatgtacaaaagaagaattggcttcattggccccacatagatgtcacgtgagagtgaaaaaacctggggtataaatatcaaaggaacccctatctgctggtttgctgaggagcccacttccagcagaaccttctctgtccttctgagtctgtagagggcgcttatgtcactggaatcctagtctggcatggggcaggcagaggagcaggagcccccagtgggttcagatcttctgaaaacttgaggttagcggatctgccctttgagggtctcaggctggatttgggcctggagtccgtgtttctccaagggtgttgcttgggtgagcgctggagtgcacttgcatgtgtatgtactctcacgccctcgtggactgggaaggcgccgtagcacaggttagattccctgctttcagggagcctggttcatttttgtcctcgttgtatatagagcttgaacttggtgttccccaggtccagtaccactgccgttgctgcctgccttctgtttcactgctgttttctgagtgcctcgtgtgcagcctgtccttcagccctccctgaagctctgctgaccagctgtgttcccagctccttttcacgtgctctttagccagccttaccctgcattgtacttacttgggtcaggtgcccctgctagactcttaagcccctagggggcagggatctgggggcgtcatccacctctgcagccctagcttctggtatagcatgtgataggacatagcatgtgatggggcttctcggataagaaagggatgagtccatctgttcaccagtaactattagggatggggatttgtgtttaaaggtggggcaaaggagagagtgattcaaagtaatggattacttcagtgaacctataggttccttagtaggagagagagattattctgggcaagaggtcccgcccttggtctgccagcatttccccagaactaccggcttgtgttttggtgttagtttcttcctcctacagtgctgactttctcaagtaactttcagctattgttggacattcttgatcaggggatagttagtaaactgcagtcagtgggccacatctggcccactgcctgttgctaatagagttttattggaacacagttatacccattttttaatgtatttgtgtgtggctgttttgtgctagcgtgacagagttgagtaggtgtggtagagacttttggccacaaagcctaaaatatttactacctggcccttttaaagataagttactaaccctctagtaactgtcagcccatcgttttgtggtgattgtctgatgtggtcaagaggcggtgcatgcataaaaagttttaaaggcctgggtcgggaactttgggtaaatcatcaaggtactttgagatcttttcctcatctgtgagatgggcattaaaaacaacacctgtctcgcgggaggtcttgcgcactgctagtggacgtacattgcggatgtcagagcaggccctagtttggccggggacattattgccgccgttctgtttctcaggaggaggaagccaagaatctggtgagcgaagccatcgcagctggcatcttcaacgacctgggctccggaagcaacattgacctctgcgtcatcagcaagaacaagctggattttctccgcccatacacagtgcccaacaagaaggggaccaggcttggccggtacaggtgtgagaaagggactactgcagtcctcactgagaaaatcactcctctggagattgaggtgctggaagaaacagtccaaacaatggacacttcctgaatggcatcagtgggtggctggccgcggttctggaaggtggtgagcattgaggcccagtaagacactcatgtggctagtgtttgccgaatgaaactcaactcaataaaaaacaaaaaccaaattgggcagctga

SEQ ID NO: 342465 - DNA, 1011 bp, Homo sapiens
cggacccggaactggctttcttgggaagatggcggctgtgtcggtgtatgctccaccagttggaggcttctcttttgataactgccgcaggaatgccgtcttggaagccgattttgcaaagaggggatacaagcttccaaaggtccggaaaactggcacgaccatcgctggggtggtctataaggatggcatagttcttggagcagatacaagagcaactgaagggatggttgttgctgacaagaactgttcaaaaatacacttcatatctcctaatatttattgttgtggtgctgggacagctgcagacacagacatgacaacccagctcatttcttccaacctggagctccactccctctccactggccgtcttcccagagttgtgacagccaatcggatgctgaagcagatgcttttcaggtatcaaggttacattggtgcagccctagttttagggggagtagatgttactggacctcacctctacagcatctatcctcatggatcaactgataagttgccttatgtcaccatgggttctggctccttggcagcaatggctgtatttgaagataagtttaggccagacatggagaagtagctacccaactctctggtcaatgaagacatcacatttggtatattcttcctcctcgtccacgaaagacacattcacgtagtggttcacaccaagtgctaattgtgttttttgtgtccattcgccattggcagcacatgagtgtgtcaggcatgagcggagcaggtgttattaagggcatcctccagtcctctttccattcaatcgctgcctctggagatataggtgtgtggaagtgcacgtccaagcaatggcgtcttcttgaatggcatcagttggggcatgggcttggttttgcaatgtggtgatcattcaggaacagtgaacctgttatcagtctaatgttcaccgaatgtttctctattacaataaaaaactctttccatatttggctcctttttgaacacaaa

SEQ ID NO: 342466 - DNA, 881 bp, Homo sapiens
cggacccggaactggctttcttgggaagatggcggctgtgtcggtgtatgctccaccagttggaggcttctcttttgataactgccgcaggaatgccgtcttggaagccgattttgcaaagaggggatacaagcttccaaaggtccggaaaactggcacgaccatcgctggggtggtctataaggatggcatagttcttggagcagatacaagagcaactgaagggatggttgttgctgacaagaactgttcaaaaatacacttcatatctcctaatatttattgttgtggtgctgggacagctgcagacacagacatgacaacccagctcatttcttccaacctggagctccactccctctccactggccgtcttcccagagttgtgacagccaatcggatgctgaagcagatgcttttcaggtatcaaggttacattggtgcagccctagttttagggggagtagatgttactggacctcacctctacagcatctatcctcatggatcaactgatatcgcagctggcatcttcaacgacctgggctccggaagcaacattgacctctgcgtcatcagcaagaacaagctggattttctccgcccatacacagtgcccaacaagaaggggaccaggcttggccggtacaggtgtgagaaagggactactgcagtcctcactgagaaaatcactcctctggagattgaggtgctggaagaaacagtccaaacaatggacacttcctgaatggcatcagtgggtggctggccgcggttctggaaggtggtgagcattgaggcccagtaagacactcatgtggctagtgtttgccgaatgaaactcaactcaataaaaaacaaaaaccaaattgggcagctga

SEQ ID NO: 342467 - DNA, 1096 bp, Homo sapiens
tggcctcgtccgcttggatgcgcggggatctgcagcttctggttcctcaggggccggacaaggtggtccccaggcattgcaaaggttgccagtggtcctcccctgggcccgagagccccgtgcggacacctggtggaagtgcccaggcactgccggtgggcttcttgctgctgcacgggccgcccctttgtgttttttttcccaatttaaaaaagcctttattcatacttaaataacagcatacatgataatttgatgagtaaatcaaactatataattttaaaatttgcatattttaaagttttatcagttacttacagactgtttgcaaaatagagggaggatcactcataatcttacatagcactgtcagcagtctgctgtcctgtgcccagtcgaatggattgacactagatatgcatgtctcatgtcattcgtatatttccgtttccccaagtcttcacctgtccccatctacccagatcatttgggaaatgtaaatgtgcagtcctaagcgctgcccgcagggtcgcgatgtctgccaggtactgctggctggctctagacaccagcagcagtgataagaaacaaagcagaggagacagttaaatggtagagaagagaagggggagcagaggtggtaggccgggaacaggggaataagtatggttctccccgcacgtgcccatgtgcgcacacaccgaaggccatttaaagggaagcggttaggtatgaggttgtgtttgctgaattagtggttggtttttgctgtctatctagatagcagctgctgccagctcctcgtctaagaggctttctttgctgccaccttcactggtttgtggaaagcttctggccccatagactgttgagaattccaggagaaaattcctaattagcggatcccgtttgaatgcattcttacaggactgcatatgtacaaaagaagaattggcttcattggccccacatagatgtcacgtgagagtgaaaaaacctggggtataaatatcaaaaattccaatcctaatttctttcttcttactagcagtacgtaaactggtagagatgactctcatacataattcttcgctga

SEQ ID NO: 342468 - DNA, 345 bp, Homo sapiens
ctgcgttcaaattagccctgattctgtgacagaaataaaagtacgtctactttactgagaaggcaaaggcggagagaccacttaggagattgttgctgtgtgtccagataagaaggggtggtggcttgcgcagtgtattggcagagagggggcgcaatggacccattcactaggtatgtacaagatggactcaacagaactgaatgactgaggggatgagaggccaggggagaacagaagttaatgatacttcccacctgcactgtgcgtggacagactggctgttgcagtctgtcatcttgtcattcctgtggctgatgaggtggaggaaggacttctcccaca

SEQ ID NO: 342469 - DNA, 298 bp, Homo sapiens
cagtccagatgcatgccccaaccacctcctctatggggctttcacactccactttatggggccaccatccacttgcccttatcaccctagggccaggtaccagacgactagagtcagcccttatgcctcagagccaatgaaattattcaaactagccaattctaaatcttacccaggctcacctgttttgtcccatggaaaccacaataaaagctcttgtccacattttcccctgctcctctgcctcctcactggccctgatgcttccccatgtagccccctatgggttgatgtaccc

SEQ ID NO: 342470 - DNA, 2490 bp, Homo sapiens
  misc_feature (443)..(443): n is a, c, g, or t
  misc_feature (721)..(721): n is a, c, g, or t
ctttttttttgagacagggtctcactgtgttgcccaggctggagtgcaatggcgttaatatcgctcattacctcaaacttctgggctcaagcaatccttcctcctcagctcctcaagtaactgggactataggtgtacaccaccaagcttggctaatttttcatttttcatagagatagggtctcccaatgttacccaagctggtctgaaactcttaagctcaagcgatcttcttgccttggcctccgaaagtgctgggattataggcgtgagccactgtgccccgccaatttatatatcttcttacatgatacatcttattatcaattgacagctgttcttttacttgaattttactctttgggaggctaggtcacaaggcttggtgtggtagtgtctaagttctctctgctgtttggtgcttaactacacagggttcaacnagagaatcataggtagtcctagttcttctggatttgatagattgttgcttgtagcacagtttatttcttatttccgaacatctttccctgactgacagtatgtctgtttgggctcttgagctcataacagggacagctgggcagggctttgatgcagggttgtgtgagatgtggccagcactgtaaaggggcactttgttttaagtgtctccttttccatcccctttcagtgttgttacttgaaggactcttacctgtgcaacgtctttgaaagatcntatgggacctttggcacttgatttagtctggtctcagggccagaatcatcttgcatttaccagctgctttagtgttgctggtactgtgagagtggttagggctttgattgaatttccagaaggtaagaatattcttgtacagcttttacataagtaatgtcatcatgtacaagatgtgttcttctaaagaagcagaggttttctcttgcccctcagtcatgtctgtctgtctgcttcttgtgtttcagaacttaaagcagcagtattacacaggatacacagagaatgaagtattggaagtcatgcagcacatggccaagaatgtggtgaaagtaaatgaaaacttaactaaattcatcgtaagtactactgttttcttaagctgtggaaagctttaggttctgggttttgtgtgtatgttgggcgggggggggcggtgtgtgccgtcatgtaaatatattaataacgtgggagttttagcacaaatcctttatcctttatatttttctggtacagtatggtatggagcatactgataaaccctgaaagcaagctttatttgaaacaaggtcgataggctagccatgtccaggcccagatcccagtcaaccagtcggttactcaatgtattgaattactctgtgcttatactagcatcctggggagggcactttgcaagcagggaaggctggtctgcatgtgattgggaagagagagggcccacttcaaatggcggtgtattatattgcgtattcaggtgatgttactcagagcctttgtccagggtcttttgaggcaatgatggaaaaacgcctaattagcaagcatggttaagagggaagaggcccattcagggggcatcctgagggcatggtgtctatctctgcatggcccacctatgaggaggagccaaaggagacttagtgctgtcctgtgcttgtgtgacaccaaacatcagagctcaccaagtgtgtggtggcaaagagcaaggtatttgaacctcagaagagtctcaagtgtcctcacaacatgatttgcttcatggaagtgtaatatgtgttcagtcctgagaggactgtctgggatttgttaagcactagttgccaccctcttttattgtcttttattgtcttttagcttaaaaaaaaaaagtcactggtgacagtgtttcttatgtgagaatggtgttatggataggtacgaaaacgtactttttagaatatgcttctgaaacatttagcagggaagtgctgtgatatctgcaaatcgctttcaaatggcatagcaaaaattgtgtgtgagtatacacagagagggagaggagggaaacgtggcacatgttcatgattgatcagtctacatgaaggatatatagaggatcattctttcagtttttctgtagatttggaattttttgaaataaataaaacatttgaggcaaaaatgtcactggtacctggtaccaatggctcatttttagtcaccttactcttaaatgtgcttcgctctcccagttttctgagaatttatttcaaaaggctagaaattgtgcattatttcagtttttactcgtttcctctttcttcccttcaaagtattttaggattaaattgtgtagactgggcacagtggctcacacctgtagtttcagcagttttggaggctgaggcgggaagactgcttgagcccagagctttgagaccagctgggcaacacagggagaccccatctgtacaaataattagccgaatgtggtggcacatgcttgt

SEQ ID NO: 342471 - DNA, 777 bp, Homo sapiens
  misc_feature (29)..(29): n is a, c, g, or t
ccttggggtaccccgcccccccgagttangggatatcgtcgaccacggcgtctcggagagcagtcctaacggcgcctcgtacgctagtgtcctcccttttcagtccgcgtccctccctgggccgggctggcactcttgccttccccgtccctcatggcgctgctccgacgcccgacggtgtccagtgatttggagaatattgacacaggagttaattctaaagttaagagtcatgtgactattaggcgaactgttttagaagaaattggaaatagagttacaaccagagcagcacaagtagctaagaaagctcagaacaccaaagttccagttcaacccaccaaaacaacaaatgtcaacaaacaactgaaacctactgcttctgtcaaaccagtacagatggaaaagttggctccaaagggtccttctcccacacctgaggatgtctccatgaaggaagagaatctctgccaagctttttctgatgccttgctctgcaaaatcgaggacattgataacgaagattgggagaaccctcagctctgcagtgactacgttaaggatatctatcagtatctcaggcagctggaggttttgcagtccataaacccacatttcttagatggaagagatataaatggacgcatgcgtgccatcctagtggattggctggtacaagtccactccaagtttaggcttctgcaggagactctgtacatgtgcgttggcattatggatcgatttttacaggtaggtgtggcttcagggacttcacgc

SEQ ID NO: 342472 - DNA, 1718 bp, Homo sapiens
ttttttcttacttgagaatttgggtttttgagtaaacgccattattctctctttttttaagcacacttttgcatctcaaccacctaacacactgcatccctgagcaacccggaggggccggttcctgcacccaggccaacacaacttaaaccccaacacaccagaagaggaataaaggccaaccaacttccgcccacccactacaaacgtcgagagaaattcgtagatgaggccttgtcaaaattcagaggcgtcctacgtctgctttcccaatgagacagttcctttttgtttgtctcagagactggggtttttttttttttaaaagactgtaggcagaaaaaacaccccaaccggctgttgtgacaatcaaacgtgtctaagaaaattcagccaatgagagtgcgagagtgcatcttgtgttggccaatgagaacagcgacccgtgcgcagggccgcccaatggggcgcaagcgacgcggtatttgaatcctggaacaaggctacagcgtcgaagatccccagcgctgcgggctcggagagcagtcctaacggcgcctcgtacgctagtgtcctcccttttcagtccgcgtccctccctgggccgggctggcactcttgccttccccgtccctcatggcgctgctccgacgcccgacggtgagtgtgcccggggaccgctctcagaggcgagtccgtcggccccacagctcccctgtcgcttctctcatctgctccgagcttctccgtcccaaccggggctgcttttctcttctccggagctcactgcttcgcccgcgtccctggccctgcggccggtcctctccggcccgcctttccccgtctggattccgccctcccctaacccctccctgccccggggtgggagaagtgtaggaaagcgcttccgagatggcgcctgtcaagtgagcccccagagcactaggcctagtactcagcgagcgatccccgagtgctcttcattgctagagagttatctacttccacgttcctgggatttccctccccctttcttacaactccttgccaactaagggacctgtgatggcggctgggaggaggactggaagggttctgtaggcagtaaagtgtacggcgtgtttcatcaggcaactgccaggctgtttttcagattgttcacatttctttttgtatgagtttcccatttatttcggcacgctaagtcttccatgctacgttcactaataaatgggtttgtccccttaaaaaattaatttctttactcaaatgtaacagaggtttttgaatataatttggaccaatgtggcagactgagagaaaagggtccaaattcatttatttcatccttgcagagatcaaagtgttatggtgttttgggtatttttcctgtgggcttgaattgtaccgggacctacttttttcctttgccgaaagctagagggccctgacacacctgagttccatcatcttggctataaggttagataaaagctgccaattttcctatccagatgaatttaaattgagtcacattaccaggcttctacccataagcattacattttcaaacactttttcagattggcagttgctgctggaagaaattgaagtgtgacttttgagaatcctaatagattgaatacatttagcatttaattaatatccttttgtggatctaagtccaactgacaagtaattttttataataatgtatt

SEQ ID NO: 342473 - DNA, 1551 bp, Homo sapiens
  misc_feature (29)..(29): n is a, c, g, or t
ccttggggtaccccgcccccccgagttangggatatcgtcgaccacggcgtcgctacagcgtcgaagatccccagcgctgcgggctcggagagcagtcctaacggcgcctcgtacgctagtgtcctcccttttcagtccgcgtccctccctgggccgggctggcactcttgccttccccgtccctcatggcgctgctccgacgcccgacggtgtccagtgatttggagaatattgacacaggagttaattctaaagttaagagtcatgtgactattaggcgaactgttttagaagaaattggaaatagagttacaaccagagcagcacaagtagctaagaaagctcagaacaccaaagttccagttcaacccaccaaaacaacaaatgtcaacaaacaactgaaacctactgcttctgtcaaaccagtacagatggaaaagttggctccaaagggtccttctcccacacctgaggatgtctccatgaaggaagagaatctctgccaagctttttctgatgccttgctctgcaaaatcgaggacattgataacgaagattgggagaaccctcagctctgcagtgactacgttaaggatatctatcagtatctcaggcagctggaggttttgcagtccataaacccacatttcttagatggaagagatataaatggacgcatgcgtgccatcctagtggattggctggtacaagtccactccaagtttaggcttctgcaggagactctgtacatgtgcgttggcattatggatcgatttttacaggttcagccagtttcccggaagaagcttcaattagttgggattactgctctgctcttggcttccaagtatgaggagatgttttctccaaatattgaagactttgtttacatcacagacaatgcttataccagttcccaaatccgagaaatggaaactctaattttgaaagaattgaaatttgagttgggtcgacccttgccactacacttcttaaggcgagcatcaaaagccggggaggttgatgttgaacagcacactttagccaagtatttgatggagctgactctcatcgactatgatatggtgcattatcatccttctaaggtagcagcagctgcttcctgcttgtctcagaaggttctaggacaaggaaaatggaacttaaagcagcagtattacacaggatacacagagaatgaagtattggaagtcatgcagcacatggccaagaatgtggtgaaagtaaatgaaaacttaactaaattcatcgccatcaagaataagtatgcaagcagcaaactcctgaagatcagcatgatccctcagctgaactcaaaagccgtcaaagaccttgcctccccactgataggaaggtcctaggctgccgtggcccctggggatgtgtgcttcattgtgccctttttcttattggtttagaactcttgattttgtacatagtcctctggtctatctcatgaaacctcttctcagaccagttttctaaacatatattgaggaaaaataaagcgattggtttttcttaaggta

SEQ ID NO: 342474 - DNA, 2179 bp, Homo sapiens
ttttttcttacttgagaatttgggtttttgagtaaacgccattattctctctttttttaagcacacttttgcatctcaaccacctaacacactgcatccctgagcaacccggaggggccggttcctgcacccaggccaacacaacttaaaccccaacacaccagaagaggaataaaggccaaccaacttccgcccacccactacaaacgtcgagagaaattcgtagatgaggccttgtcaaaattcagaggcgtcctacgtctgctttcccaatgagacagttcctttttgtttgtctcagagactggggtttttttttttttaaaagactgtaggcagaaaaaacaccccaaccggctgttgtgacaatcaaacgtgtctaagaaaattcagccaatgagagtgcgagagtgcatcttgtgttggccaatgagaacagcgacccgtgcgcagggccgcccaatggggcgcaagcgacgcggtatttgaatcctggaacaaggctacagcgtcgaagatccccagcgctgcgggctcggagagcagtcctaacggcgcctcgtacgctagtgtcctcccttttcagtccgcgtccctccctgggccgggctggcactcttgccttccccgtccctcatggcgctgctccgacgcccgacggtgtccagtgatttggagaatattgacacaggagttaattctaaagttaagagtcatgtgactattaggcgaactgttttagaagaaattggaaatagagttacaaccagagcagcacaagtagctaagaaagctcagaacaccaaagttccagttcaacccaccaaaacaacaaatgtcaacaaacaactgaaacctactgcttctgtcaaaccagtacagatggaaaagttggctccaaagggtccttctcccacacctgaggatgtctccatgaaggaagagaatctctgccaagctttttctgatgccttgctctgcaaaatcgaggacattgataacgaagattgggagaaccctcagctctgcagtgactacgttaaggatatctatcagtatctcaggcagctggaggttttgcagtccataaacccacatttcttagatggaagagatataaatggacgcatgcgtgccatcctagtggattggctggtacaagtccactccaagtttaggcttctgcaggagactctgtacatgtgcgttggcattatggatcgatttttacaggttcagccagtttcccggaagaagcttcaattagttgggattactgctctgctcttggcttccaagtatgaggagatgttttctccaaatattgaagactttgtttacatcacagacaatgcttataccagttcccaaatccgagaaatggaaactctaattttgaaagaattgaaatttgagttgggtcgacccttgccactacacttcttaaggcgagcatcaaaagccggggaggttgatgttgaacagcacactttagccaagtatttgatggagctgactctcatcgactatgatatggtgcattatcatccttctaaggtagcagcagctgcttcctgcttgtctcagaaggttctaggacaaggaaaatggaacttaaagcagcagtattacacaggatacacagagaatgaagtattggaagtcatgcagcacatggccaagaatgtggtgaaagtaaatgaaaacttaactaaattcatcgccatcaagaataagtatgcaagcagcaaactcctgaagatcagcatgatccctcagctgaactcaaaagccgtcaaagaccttgcctccccactgataggaaggtcctaggctgccgtggcccctggggatgtgtgcttcattgtgccctttttcttattggtttagaactcttgattttgtacatagtcctctggtctatctcatgaaacctcttctcagaccagttttctaaacatatattgaggaaaaataaagcgattggtttttcttaaggtaaaaaaaaaaaaaaaaaaaaaggggggcgcaagaaattcctgggggcgagatacgttaccattttgtcaagggcctaggggcaataagaggaggggttaaacgaaggaacggatggatttgaagacattgggggaatggacccagagtagcggaaaagttaggagattgcagatggaaa

SEQ ID NO: 342475 - DNA, 2649 bp, Homo sapiens
ttttttcttacttgagaatttgggtttttgagtaaacgccattattctctctttttttaagcacacttttgcatctcaaccacctaacacactgcatccctgagcaacccggaggggccggttcctgcacccaggccaacacaacttaaaccccaacacaccagaagaggaataaaggccaaccaacttccgcccacccactacaaacgtcgagagaaattcgtagatgaggccttgtcaaaattcagaggcgtcctacgtctgctttcccaatgagacagttcctttttgtttgtctcagagactggggtttttttttttttaaaagactgtaggcagaaaaaacaccccaaccggctgttgtgacaatcaaacgtgtctaagaaaattcagccaatgagagtgcgagagtgcatcttgtgttggccaatgagaacagcgacccgtgcgcagggccgcccaatggggcgcaagcgacgcggtatttgaatcctggaacaaggctacagcgtcgaagatccccagcgctgcgggctcggagagcagtcctaacggcgcctcgtacgctagtgtcctcccttttcagtccgcgtccctccctgggccgggctggcactcttgccttccccgtccctcatggcgctgctccgacgcccgacggtgtccagtgatttggagaatattgacacaggagttaattctaaagttaagagtcatgtgactattaggcgaactgttttagaagaaattggaaatagagttacaaccagagcagcacaagtagctaagaaagctcagaacaccaaagttccagttcaacccaccaaaacaacaaatgtcaacaaacaactgaaacctactgcttctgtcaaaccagtacagatggaaaagttggctccaaagggtccttctcccacacctgaggatgtctccatgaaggaagagaatctctgccaagctttttctgatgccttgctctgcaaaatcgaggacattgataacgaagattgggagaaccctcagctctgcagtgactacgttaaggatatctatcagtatctcaggcagctggaggttttgcagtccataaacccacatttcttagatggaagagatataaatggacgcatgcgtgccatcctagtggattggctggtacaagtccactccaagtttaggcttctgcaggagactctgtacatgtgcgttggcattatggatcgatttttacaggttcagccagtttcccggaagaagcttcaattagttgggattactgctctgctcttggcttccaagtatgaggagatgttttctccaaatattgaagactttgtttacatcacagacaatgcttataccagttcccaaatccgagaaatggaaactctaattttgaaagaattgaaatttgagttgggtcgacccttgccactacacttcttaaggcgagcatcaaaagccggggaggttgatgttgaacagcacactttagccaagtatttgatggagctgactctcatcgactatgatatggtgcattatcatccttctaaggtagcagcagctgcttcctgcttgtctcagaaggttctaggacaaggaaaatggaacttaaagcagcagtattacacaggatacacagagaatgaagtattggaagtcatgcagcacatggccaagaatgtggtgaaagtaaatgaaaacttaactaaattcatcgccatcaagaataagtatgcaagcagcaaactcctgaagatcagcatgatccctcagctgaactcaaaagccgtcaaagaccttgcctccccactgataggaaggtcctaggctgccgtggcccctggggatgtgtgcttcattgtgccctttttcttattggtttagaactcttgattttgtacatagtcctctggtctatctcatgaaacctcttctcagaccagttttctaaacatatattgaggaaaaataaagcgattggtttttcttaaggtatcccatgtgtatttatttgtgtattctgtacttaagaaatcagtgaaagcttgctttgactaatttctttttgagctgttatgaatagcatgtaaattactgccattatggcttgggcaagacctttttaccattttctcaaatggaaaaaactagaacttggcctcagtgaacactaaacctattcctaagcttcttgaatacaaataagtttattgtgaaaattttaaatgggaggataaccatgacactttcctttctagaagctagtcagctgctctctaattcctgcataggaacgcctggcccagagcaacccttgtaatgggtccctctctcaaatgcattgttgagaccagagagagccatcccatgggtcacagctggagaaaatgggcccgtggcatcctgttcaaggtgaagcttggcatgcattttttcaggtacattatggggtaaatggctttgcatttttttgtttggttggtttttaatgggcattgaactttttttttttttaattgaagttctggggtacatgtgcagaacatgcaggtttgttacataagtatacatgtgccatggtggtttgctgcacccatcaccctgtcatctacattaggtatttctcctaatgctatctctccc

SEQ ID NO: 342476 - DNA, 1237 bp, Homo sapiens
ttttttcttacttgagaatttgggtttttgagtaaacgccattattctctctttttttaagcacacttttgcatctcaaccacctaacacactgcatccctgagcaacccggaggggccggttcctgcacccaggccaacacaacttaaaccccaacacaccagaagaggaataaaggccaaccaacttccgcccacccactacaaacgtcgagagaaattcgtagatgaggccttgtcaaaattcagaggcgtcctacgtctgctttcccaatgagacagttcctttttgtttgtctcagagactggggtttttttttttttaaaagactgtaggcagaaaaaacaccccaaccggctgttgtgacaatcaaacgtgtctaagaaaattcagccaatgagagtgcgagagtgcatcttgtgttggccaatgagaacagcgacccgtgcgcagggccgcccaatggggcgcaagcgacgcggtatttgaatcctggaacaaggctacagcgtcgaagatccccagcgctgcgggctcggagagcagtcctaacggcgcctcgtacgctagtgtcctcccttttcagtccgcgtccctccctgggccgggctggcactcttgccttccccgtccctcatggcgctgctccgacgcccgacggtgtccagtgatttggagaatattgacacaggagttaattctaaagttaagagtcatgtgactattaggcgaactgttttagaagaaattggaaatagagttacaaccagagcagcacaagtagctaagaaagctcagaacaccaaagttccagttcaacccaccaaaacaacaaatgtcaacaaacaactgaaacctactgcttctgtcaaaccagtacagatggaaaagttggctccaaagggtccttctcccacacctgaggatgtctccatgaaggaagagaatctctgccaagctttttctgatgccttgctctgctacgttaaggatatctatcagtatctcaggcagctggaggttttgcagtccataaacccacatttcttagatggaagagatataaatggacgcatgcgtgccatcctagtggattggctggtacaagtccactccaagtttaggcttctgcaggagactctgtacatgtgcgttggcattatggatcgatttttacagggtcaccatttccgcagaactccatagtggggaagccggcctgggcaataaagagaat

SEQ ID NO: 342477 - DNA, 2001 bp, Homo sapiens
ttttttcttacttgagaatttgggtttttgagtaaacgccattattctctctttttttaagcacacttttgcatctcaaccacctaacacactgcatccctgagcaacccggaggggccggttcctgcacccaggccaacacaacttaaaccccaacacaccagaagaggaataaaggccaaccaacttccgcccacccactacaaacgtcgagagaaattcgtagatgaggccttgtcaaaattcagaggcgtcctacgtctgctttcccaatgagacagttcctttttgtttgtctcagagactggggtttttttttttttaaaagactgtaggcagaaaaaacaccccaaccggctgttgtgacaatcaaacgtgtctaagaaaattcagccaatgagagtgcgagagtgcatcttgtgttggccaatgagaacagcgacccgtgcgcagggccgcccaatggggcgcaagcgacgcggtatttgaatcctggaacaaggctacagcgtcgaagatccccagcgctgcgggctcggagagcagtcctaacggcgcctcgtacgctagtgtcctcccttttcagtccgcgtccctccctgggccgggctggcactcttgccttccccgtccctcatggcgctgctccgacgcccgacggtgtccagtgatttggagaatattgacacaggagttaattctaaagttaagagtcatgtgactattaggcgaactgttttagaagaaattggaaatagagttacaaccagagcagcacaagtagctaagaaagctcagaacaccaaagttccagttcaacccaccaaaacaacaaatgtcaacaaacaactgaaacctactgcttctgtcaaaccagtacagatggaaaagttggctccaaagggtccttctcccacacctgaggatgtctccatgaaggaagagaatctctgccaagctttttctgatgccttgctctgcaaaatcgaggacattgataacgaagattgggagaaccctcagctctgcagtgactacgttaaggatatctatcagtatctcaggcagctggaggttttgcagtccataaacccacatttcttagatggaagagatataaatggacgcatgcgtgccatcctagtggattggctggtacaagtccactccaagtttaggcttctgcaggagactctgtacatgtgcgttggcattatggatcgatttttacaggttcagccagtttcccggaagaagcttcaattagttgggattactgctctgctcttggcttccaagtatgaggagatgttttctccaaatattgaagactttgtttacatcacagacaatgcttataccagttcccaaatccgagaaatggaaactctaattttgaaagaattgaaatttgagttgggtcgacccttgccactacacttcttaaggcgagcatcaaaagccggggaggttgatgttgaacagcacactttagccaagtatttgatggagctgactctcatcgactatgatatggtgcattatcatccttctaaggtagcagcagctgcttcctgcttgtctcagaaggttctaggacaaggaaaatggaacttaaagcagcagtattacacaggatacacagagaatgaagtattggaagtcatgcagcacatggccaagaatgtggtgaaagtaaatgaaaacttaactaaattcatcgccatcaagaataagtatgcaagcagcaaactcctgaagatcagcatgatccctcagctgaactcaaaagccgtcaaagaccttgcctccccactgataggaaggtcctaggctgccgtggcccctggggatgtgtgcttcattgtgccctttttcttattggtttagaactcttgattttgtacatagtcctctggtctatctcatgaaacctcttctcagaccagttttctaaacatatattgaggaaaaataaagcgattggtttttcttaaggta

SEQ ID NO: 342478 - DNA, 3138 bp, Homo sapiens
ttttttcttacttgagaatttgggtttttgagtaaacgccattattctctctttttttaagcacacttttgcatctcaaccacctaacacactgcatccctgagcaacccggaggggccggttcctgcacccaggccaacacaacttaaaccccaacacaccagaagaggaataaaggccaaccaacttccgcccacccactacaaacgtcgagagaaattcgtagatgaggccttgtcaaaattcagaggcgtcctacgtctgctttcccaatgagacagttcctttttgtttgtctcagagactggggtttttttttttttaaaagactgtaggcagaaaaaacaccccaaccggctgttgtgacaatcaaacgtgtctaagaaaattcagccaatgagagtgcgagagtgcatcttgtgttggccaatgagaacagcgacccgtgcgcagggccgcccaatggggcgcaagcgacgcggtatttgaatcctggaacaaggctacagcgtcgaagatccccagcgctgcgggctcggagagcagtcctaacggcgcctcgtacgctagtgtcctcccttttcagtccgcgtccctccctgggccgggctggcactcttgccttccccgtccctcatggcgctgctccgacgcccgacggtgtccagtgatttggagaatattgacacaggagttaattctaaagttaagagtcatgtgactattaggcgaactgttttagaagaaattggaaatagagttacaaccagagcagcacaagtagctaagaaagctcagaacaccaaagttccagttcaacccaccaaaacaacaaatgtcaacaaacaactgaaacctactgcttctgtcaaaccagtacagatggaaaagttggctccaaagggtccttctcccacacctgaggatgtctccatgaaggaagagaatctctgccaagctttttctgatgccttgctctgcaaaatcgaggacattgataacgaagattgggagaaccctcagctctgcagtgactacgttaaggatatctatcagtatctcaggcagctggaggttttgcagtccataaacccacatttcttagatggaagagatataaatggacgcatgcgtgccatcctagtggattggctggtacaagtccactccaagtttaggcttctgcaggagactctgtacatgtgcgttggcattatggatcgatttttacaggttcagccagtttcccggaagaagcttcaattagttgggattactgctctgctcttggcttccaagtatgaggagatgttttctccaaatattgaagactttgtttacatcacagacaatgcttataccagttcccaaatccgagaaatggaaactctaattttgaaagaattgaaatttgagttgggtcgacccttgccactacacttcttaaggcgagcatcaaaagccggggaggttgatgttgaacagcacactttagccaagtatttgatggagctgactctcatcgactatgatatggtgcattatcatccttctaaggtagcagcagctgcttcctgcttgtctcagaaggttctaggacaaggaaaatggaacttaaagcagcagtattacacaggatacacagagaatgaagtattggaagtcatgcagcacatggccaagaatgtggtgaaagtaaatgaaaacttaactaaattcatcgtaagtactactgttttcttaagctgtggaaagctttaggttctgggttttgtgtgtatgttgggcgggggggggcggtgtgtgccgtcatgtaaatatattaataacgtgggagttttagcacaaatcctttatcctttatatttttctggtacagtatggtatggagcatactgataaaccctgaaagcaagctttatttgaaacaaggtcgataggctagccatgtccaggcccagatcccagtcaaccagtcggttactcaatgtattgaattactctgtgcttatactagcatcctggggagggcactttgcaagcagggaaggctggtctgcatgtgattgggaagagagagggcccacttcaaatggcggtgtattatattgcgtattcaggtgatgttactcagagcctttgtccagggtcttttgaggcaatgatggaaaaacgcctaattagcaagcatggttaagagggaagaggcccattcagggggcatcctgagggcatggtgtctatctctgcatggcccacctatgaggaggagccaaaggagacttagtgctgtcctgtgcttgtgtgacaccaaacatcagagctcaccaagtgtgtggtggcaaagagcaaggtatttgaacctcagaagagtctcaagtgtcctcacaacatgatttgcttcatggaagtgtaatatgtgttcagtcctgagaggactgtctgggatttgttaagcactagttgccaccctcttttattgtcttttattgtcttttaattgttcctattgctgccaggcctggtgaacctgttatgtcctgatggcacttaggtgtcgtaaacacagctccccctcccatccctctggtagcctacaagaggaagcctgctacttggaccttgaaatcatttgttcctatcacctgtgctaccagctgtgttttattcattaatggggatggaaggaaatggtcaggcacatgttatgagcccagagctttcactggcttcagcgattgggcatcatcaatgtgatcatgattgtagccgtggacctttgataattgtgagttagactaggaataaggtatcattgggggttcctgacatgtgcttaatcacaaatgacttctgcaggccatcaagaataagtatgcaagcagcaaactcctgaagatcagcatgatccctcagctgaactcaaaagccgtcaaagaccttgcctccccactgataggaaggtcctaggctgccgtggcccctggggatgtgtgcttcattgtgccctttttcttattggtttagaactcttgattttgtacatagtcctctggtctatctcatgaaacctcttctcagaccagttttctaaacatatattgaggaaaaataaagcgattggtttttcttaaggta

SEQ ID NO: 342479 - DNA, 1049 bp, Homo sapiens
gtcgaccacgcgtccgctaagaacagctaaaagagcacacccgtctatgtagctcgtctggtatcgggggtcttagcttggctctccttgcaaagttatttctagttaattcattatgcggagttttgcagtccataaacccacatttcttagatggaagagatataaatggacgcatgcgtgccatcctagtggattggctggtacaagtccactccaagtttaggcttctgcaggagactctgtacatgtgcgttggcattatggatcgatttttacaggttcagccagtttcccggaagaagcttcaattagttgggattactgctctgctcttggcttccaagtatgaggagatgttttctccaaatattgaagactttgtttacatcacagacaatgcttataccagttcccaaatccgagaaatggaaactctaattttgaaagaattgaaatttgagttgggtcgacccttgccactacacttcttaaggcgagcatcaaaagccggggaggttgatgttgaacagcacactttagccaagtatttgatggagctgactctcatcgactatgatatggtgcattatcatccttctaaggtagcagcagctgcttcctgcttgtctcagaaggttctaggacaaggaaaatggaacttaaagcagcagtattacacaggatacacagagaatgaagtattggaagtcatgcagcacatggccaagaatgtggtgaaagtaaatgaaaacttaactaaattcatcgccatcaagaataagtatgcaagcagcaaactcctgaagatcagcatgatccctcagctgaactcaaaagccgtcaaagaccttgcctccccactgataggaaggtcctaggctgccgtggcccctggggatgtgtgcttcattgtgccctttttcttattggtttagaactcttgattttgtacatagtcctctggtctatctcatgaaacctcttctcagaccagttttctaaacatatattgaggaaaaataaagcgattggtttttcttaaggta

SEQ ID NO: 342480 - DNA, 325 bp, Homo sapiens
attcaaacttctgggctcaagcaatcctcccacctcagcctcctgagtagctgggactataggcatgtgccaccaggcccagtgttgaggcattagtattattatcattactattattattagagatagggtctcctctgtcacccaggctggagtgcagtgttaaaatcatagcttgctgcagccttgaactcctggactcaagtgatccttccacttcagcctcccaagcagctgggaccacaggcacatgccaccatgcccaactaattttttagattttttttttttttgagacagagtctcgctctgtcacccagcctgg

SEQ ID NO: 342481 - DNA, 391 bp, Homo sapiens
tttatcaccatgctcttttctactcctaccccatgtatggtttagagaccaactgtgttgtaattgctataataaaggagattataggagcctgtcccagaaacaaagatacaatagttcctcctttacccacagtctggttttccatggtttcagttatctgtggccaactatagtctgaaagtacatgagtacagtacaataagttattttgagagagagagcccacgttcacataacgtttattaaagtatattgttataattctattttattataaattattgttatcgatcccttactgtgcctaatttataaattgaactttatcataggtatatatgcttgggaaaaaacatagtaaatatggggttctgaactgtctgtgatt

SEQ ID NO: 342482 - DNA, 354 bp, Homo sapiens
tctcccactattattgtgtttctcccactattattgtgtttctatctatggcatttcttaggtctattagtaattgttttataaatttgggagctccagtgttaggtgcatatatgtttaggattgtaatatttttctgttgaacaaggccttttatcataatataatggccctctttgtctcttttaactgttgttgctttcatgtctgttttgtctgatataagaatagcttctcctactcacttttggtttccttttgcacgaaatgcctatttccaccccttgactttaagtttatgtgagtccttatgtgttaggtgagtctcctgaagcaggagatggttggtgactt

SEQ ID NO: 342483 - DNA, 732 bp, Homo sapiens
caccaattcagcccaccgtcatgcacggcagtgcaacttggttgaccatcgtctgcgtctgcactgccctcagtgcagtaagccacgctttctgtgcacaccgtcttaacgtagctgtgagtccatgggatgccacatggtggggaaatgggaaacaaaacagccaagaactgagacgggcaggcctggccgtgttgtgggagccagagctgttgggactgcaagccccattgtgaaaggctgcagagaaggtgacatggatgaaagagtgatttaggtgtcagtttcccttaagagcaaagggaaggagagagggagatggttgctcatggtggaagcaggagatggtgcattaggagattctcattgtcaaaggcagaggggacaatccacacacagtgcagagaacagaggggctggggtcgcatgccagagcactgagcatgccttgggagcgtgattgacacatcctcctgtaagaagagaggaacgggagaaaacaggatgacgaggtagagaggatctgaagaggagagggaggtgcaggtatgcgcaggtgatagcctgatgtgccatctacatccattgagcatttactgaatgctaactatatgcccagcaagacacacaggtgagaaggcatggcacctgttcccaggagggcctgatccttcaaggggcacagacagaggcatgagtgagagccgttcagggcaggaagggctaggaagc

SEQ ID NO: 342484 - DNA, 494 bp, Homo sapiens
tcccacccaagtagtccagggtgatgtcatctcaggttctctaaagacgctttctccaagtacggtcacactcacaggctccaggagttgggatgtgggcatatccttcttagggccaccaattcagcccaccgtcatgcacggcagtgcaacttggttgaccatcgtctgcgtctgcactgccctcagtgcagtaagccacgctttctgtgcacaccgtcttaacgtagctgtgagtccatgggatgccacatggtggggaaatgggaaacaaaacagccaagaactgagacgggcaggcctggccgtgttgtgggagccagagctgttgggactgcaagccccattgtgaaaggctgcagagaaggtgacatggatgaaagagtgatttaggtgtcagtttcccttaagagcaaagggaaggagagagggagatggttgctcatggtggaagcaggagatggtgcattaggagattctcattgtcaaaggca

SEQ ID NO: 342485 - DNA, 188 bp, Homo sapiens
actttctgttaaatatcagccattataactactctctctcctagaattaaatcctttaggacttaatattctactatagtttggaaaaggaagacatgactattgagatccaaagaggaagtagggaaacaatggtgaaagaaagcagaactactacaaatgcaggggcaagactagagaaattgggt

SEQ ID NO: 342486 - DNA, 794 bp, Homo sapiens
cctgagaggttgggcaaggtcagcctaggctggcagcaccgcggggcgccccctgcagtatggacgtggtattccctttccggcctctgcagggccagggcgctccatttcttcccaggactgcctgccctggtcgtggccgtcatttctgcagggaggttgctgttttcctccaggcatcggagttaaaaagcatttgttcaaaaatcacttcttccactttaggaataacatattctcccattccctgccggtgactttttcatttaattttcgttttgccatatggtctttcagaggcactctgatcttaattatagtattcagcctttgtttatttaaaaatcagaaggcagataggctattgagggtttatctgtactaattgtaccaccatacctgccaactgtccccttaaccactacaatccctgccgacagtgtgtatacacaaacacacgcgcgtgcacacatgggccacataacgtaatgtgttgatcagaaaggagcgtatttccagctttagaattgccgcactggcattttccatcatgaacccctgccatgtagtgttgacttgaaggggatttagccatgggattgggaagagcagggagttagggtcagaagacctgagctcaaatcctgattctgccacttacggtgttatcttggggaaacaattttattcctggagtctcagttttaccatctataaaatagggatagtgctatcaatgtcccagtaagggtgtgggatttattttttaatttttatttgtttatttatttttt

SEQ ID NO: 342487 - DNA, 119 bp, Homo sapiens
tttccattacccactgcccctctgtgtgcctggagtttccaaggcttctctccttcctttttgctccatctcatcttctctcactgtttcttccttgttcccccgggtgctcgcttcct

SEQ ID NO: 342488 - DNA, 538 bp, Homo sapiens
gctggtctcaaactcctgatctcaggtgatctgccctcctccgcctcccaaagtgctgggattacaggcgtgagccaccatgcccggcccctctcagatatttctatccattgtcatactcccactctttccctaactactactgacttcagcttgcagcagaaaattcagcctttgtaagcttgagaggactcaggttgctgaccaaaagcagaagaggcctcccttcaaaatgtatggaatgttgcaaaaagtagacagtgatcctcaataatcagatacttccctcagaatggtctgctaaaccttcagtcttgttgaaccaattggttcagtactttgtaacagaacttgggaatttctccaccctggatgggatatttcttatggcctcccatcccaattcatgtcagcccttcccgcatttagacttggttactttcaactctttactcctggcatcatttttaaatgattcaggactcttggtttcaagtgacataaacccaccttgaattatcataggtggagagtgttg

SEQ ID NO: 342489 - DNA, 952 bp, Homo sapiens
atgtctgcgacacctcctcccctggctgcctgcctggcatgagagaaagcaaacagcccagatttggctcaatcccatgaaatgcaaatgtctaacacaggctttctctatcatcttcacgtttacattatgcaccttaaagaagtgaaaactagctgggtgcagtggcatgagcctggagccccagctacttgggaggctgaggcaggaggattatttgagcccaggagtttgaatttagccagggcaacacagtaagaccgtatttctaaaaaccaaaacgcagtaaaaactcatttattgaaggtgtcgcatttatcctttcatgaaagtaaaaatccagtagataatgtaaagcaagtagtacttcccagactccaaagtgccccagatcacctgggaatcttactcaaatgcagattctgataccgtgtgtctagggcaggaccttctgatgatgacctgtgttctgaccttggcttcactgggatgcagggccagccataaacctcatgaatactcagcatctcctggtctccactgtctggttgaggacacaacaatggctctggttgaggaaatctaccccgacccttagtttgcatcttttccttgtaaacctcacctaagtccagttatcagtcacagaatcaatggaaatgatcacatcgtcaggctttttaatgctcctgtttgcctttttattgtttcagtgtttaataagcaaagagatggttaaagtttagcagtagaggagatgccagagggactgccagagggagatgccacagggagatgcgctgggactggtggattccagggccccttactatccgtcccctaccttcctctcacgcattaaccttcccccaccatcagctctgctaaactgtctgtagattcagacacgctacctctcagctccaggcctttgcacatgctcctccctgaa

SEQ ID NO: 342490 - DNA, 764 bp, Homo sapiens
cttatggccgggagaagtgagtgacttgttttcactggcggctcccttaggcagccgctgtatttttccactgcgtggatcacactggagattaattttggttcagccagtgcctgccaagcagaaagcgaaggccctagcccacggggaagtcagccatggcatctgtcacagactcgatgtcgctggtacatttccacggagagagatatttacaatagtaaatttctaggctttgatacactgggtacgatttgttttgataggcatgaacatacttgtaatcggaaacccagctgaggaaatgagcttgccagcccagggtaagttcttagaacttagaacacagggatctttcagaccctgggagtcaagtggcagacagtgagccacaggggcaaagtcaaggacactgattctgcgtaaagaccttgaacaacaggacaggaccagaaccatagcacagggtgctcatggataaggcgaatgggatatttccttttctgcttcccatagcactttgtccagaaacaaagagtggggtggggcgctaaggggccggtaatccaagagcttcgctgtttcttaacgcaacattatagactggattatggattggtagcaattacatctcttctgtttttgcctgcttggcaaggagtacaattcagaatattatcctagaacaagtcaggtttaattgcttatctcaacaaaactatgaaatcagagcagcaggtgacatgaaggaggcaactaccaaa

SEQ ID NO: 342491 - DNA, 167 bp, Homo sapiens
acacactatatctaaacatctagggtgccacagtgttattgccatgagctgtattttgttatttatagaggctataaaagtacacagcactttacaaaccacaaaacgcaggcaccagagcctggaggaactcagcctaaattacatacaaacagtggtggggaaaa

SEQ ID NO: 342492 - DNA, 524 bp, Homo sapiens
aaggggaagacagacacaggccgtggtgtgtggccagtgacgacctggggaatttggaggaaggaacagcttcttactggagccttgccttggcctcctgagtcagcatcatttactgtctggtaattcaggccttggttgtaatgtcagctccacagagagccccctagtccctaccctgtgtcattcttacaccaccctgggttatgtatttcaaaacggctaggaaaagaagttcagaatgcattgtttcttattggttttccttccttggttgacggtgagtccttaagatgaggtgggccctgcactgtcttgttcatgactgtatccaccttctggaacgtcgccagggagcagtgcatggtgcaggaatgagaaactggatgctggtgggaacatggccgctctcagctagcgggtcctcttcagggcagaccctgcctcgtggaagatgacagctggcttggacagagacagagataaccccttaacgtgcagctcctaacttaagcagcccctcg

SEQ ID NO: 342493 - DNA, 201 bp, Homo sapiens
gcggtggcttctagctgtgtcctcatgtggcagaagggacaaacaagttcccttgagcctccttttataagtccaataatctcattggtgaggacgtagcccttctgacttaattacttccccaaatgcctcacatcttttaacactgtcaacgttgaggattaagcttcaacatatcaatttgggggacacagacattga

SEQ ID NO: 342494 - DNA, 203 bp, Homo sapiens
acaggcgtgagccaccgtgcccggcctgtctctttcttttctctgtctctctctctccctcttccccctgctcctagtctctctctctgtctccctccctctcaatctctctctgcctatctccctctctgtctctgcctccctctctgcctctgtcttcctctctgcctctgtctctctctctgcctctgtctctgtctccc

SEQ ID NO: 342495 - DNA, 534 bp, Homo sapiens
  misc_feature (308)..(309): n is a, c, g, or t
taatgaatgaacaaggagatgagtgactcactggcccagccctactccaaatgacatgaaaattcgttacctcaaaggtacattgtaagaacttggtagtatacctgtgtcatggaaacacagtttattgtgtttccatttctaaatcttatccacaacaaattgttttttaaaagtaatgaatttccgtcttacttcccgtatgtttaaatccatctaatttgtactttattttcaaaagttagaacacattaggactagtcactggtagaaaaggaagtaaaagaaaaaaataacgaacaaaaccnntatttactatgatatcatgattaccacaacacactgtttccttaagggatttacactgcactcgctggagtgcaatgacacaatcttggctcactgcaacctcctcctcccaggttcaagtgattctcctgtctcagcctcccgagaagctgggattacaggcacccaccaccaagcctggctaattcttgtatttttagtagagacggggtttcaccatgttgg

SEQ ID NO: 342496 - DNA, 380 bp, Homo sapiens
aggaagtctgttaatagactgtaatgtaaagatttatgtcttcaagcaccccccaactccctgcacccccgtttcacaaataatttctcaatgtttgtttccaagcctgagataaataatgcatgcatttaaaaaaccgcagagtcatggggttccctctgagtagagagggatccatttttaagctcacagtcctggcagtgtttgctcatgcatacatgccttcagcattagctgccagcatcttccaccctgaggctggaccctggggaaggctccttatttcttaggaactccaagcctgccttacagagcaggggcagggcaggtcatcacagcaaaggccccagagccagatgagctgggggccagtggaatga

SEQ ID NO: 342497 - DNA, 520 bp, Homo sapiens
aggaagtctgttaatagactgtaatgtaaagatttatgtcttcaagcaccccccaactccctgcacccccgtttcacaaataatttctcaatgtttgtttccaagcctgagataaataatgcatgcatttaaaaaaccgcagagtcatggggttccctctgagtagagagggatccatttttaagctcacagtcctggcagtgtttgctcatgcatacatgccttcagcattagctgccagcatcttccaccctgaggctggaccctggggaagggcacgcagcccccaccaacgtggtggagaaccccctcccggagacagactctcagcccattcctccctctggtggcccctttagtgagccacagttccacaatggcgagtctgaggagagccacgagcagttcctgaaggcgctgcagaacgccgtcaccaccttcgtgaaccgcatgaagagtaaccacatgcggggccgcagcatcaccaatgactcggccgtgctctcactcttccagtcca

SEQ ID NO: 342498 - DNA, 538 bp, Homo sapiens
tggtaaggccagcagaaaagaatcataacattcctgccaaccagcctgctataggattggttggggagtatcggcaatcagtttctcagttaagtcatcctacaatcacagtcagagcaggtcttcttctattatttcaagtactttgaaatttaaaaagcactatcaaacaattcctccttgtatatggacttgacctttgcccattaccatcttactgtaccctcacaaaaatgagatatcaagaggacagctcttaggtatcccagtgggcagcatttgttccccaaaggtccaccttgaacacccacaacccccatctctgtcaggagctgtcacctgctgatgctgcaagtcataatgaggttgactcctacacatcagaaggcatgtgggtaggagccaatttccttggcatgcagggactctccctgttgtcctctgcttctccttgttttgcttgtcatgttgccctttgtggctgagcagtcttgctgcctcctgctacactactctgttgagacccatgacactcaga

SEQ ID NO: 342499 - DNA, 257 bp, Homo sapiens
agtcaatagttaaataactgagggaaaagaagtacaaatcaggcagctctacatgccatgtttcaaaagggaaggaaacaaaatagttaaactttgcatgttttggaaataaactgtatttatgaaacagagatctcaaaaagtaaaaggaaccccactttatctgatgaaagtgccaggaatctggagaaaagagttcaatttcaactttcagtttggagatgcagaaagaccctgaattttggcacagtaactga

SEQ ID NO: 342500 - DNA, 1033 bp, Homo sapiens
ccccagaaacctccaggtcccctctcttatgatgtctcgcctggactattacaattgttgcctaacttttctccctcctcaaattcatcctttatgtcagtggcaaattaatcttcctgaaacaattccctgattattgttactccagcctttaatatgttcacttgttgcctgttgcagacaggattaaataaaatctccttaccaggaatgttaagaccctctggcatgagtttttcctcctttatctcccctttgcagcctaggctctgactgctcccctaactacagcctctgttgcagctaagtcacctttcctcccttcacatttggaaattactgtctccatacttaacccttctgccagcatttcccagagattagttacagaaatgccaataggttgttcatgacgaaagcattccatagtccaataaattgagtacgcatgaaattctcatcttagagattcataatactcattagcatattaaaggtcccagatattttacactgaagaaacctgcctacctctttttcatatagatttcccatactcatttgaccacagcaccctttatctcagagcacccttcaacatctcctggaaatagtgttttcatagagcttagttgagaaatgttggcatacattattctctgtaagaaattccctcctttgctcatctgtgtgtgtgaaatgtatcctttaaggagaagctcattaagacatcttttggaaagcttcaccaaaaactccattagcgaatttctccgaactttcatatcacttttctagaccactcatgggatatttgtgtgcctgctctatttcttctgctagagcatagacaccttgaggacagtgtgtttcttattaaaggccccactgtacctagcacaggcctttaccgcacagtgagtagttgcttacttatggttaaattaactgtaaaaagtgcagaatcacgaagcattctcaactcctggcctcaagcattcctcctaccttagcctcccaaggagtagctggg

SEQ ID NO: 342501 - DNA, 533 bp, Homo sapiens
gcctgaacaataggacctcctggggggagaaaaatcagctgtggaaatttagagacactccctgttctccttcaacctgaaaggaagagaaaagagagggtgggtgtgctggtactgaagaggtggagctttgactaatatgctcatcaggactttgcctgcagcaaaaagatatctttggaagctgtgcctgtggaaaggtcagtattagctcaatcaaatttggcttatggagaaacttcgggattacttagttgcagtggaaatgtgtctttgtctctacagttttggttggaaagaaagcaatgtgtccctgggactgtcaaaacgctttttaaccagtaacaggaaaactatgtatgtgctggtaaatttgcattgaatatggaaacttggcacatagagtgtcaagcagatggagtttcagactgggaaaagaatgcctttcagattccatccagctctgagctatcctctctctcctgggggaattactcaggatgatctagaagagaaaggaaccgatagttggc

SEQ ID NO: 342502 - DNA, 274 bp, Homo sapiens
ttagctactttcaactgggaagctacaacatggatttatggaatctgtcttggtttctgttcttggatgctcttctcgtgatttctggcttggcaactccagaaaactttgatgtagatggcggaatggaccaggacatatttgatatcaatgaaggtttgggactggatctttttgagggtgacatcagacttgatagggcacaaattagaaattccatcattggagaaaagtatagatggcctcataccattccatatgttctagaagatag

SEQ ID NO: 342503 - DNA, 260 bp, Homo sapiens
cgtctgctaaatatcccttaagactgtccacttctatcccatccctctccactggtgcatgctgctaccgtctcgcccgggccactgcacccggccacagcttgggcactggcctccacccatttcacgttattccagtcctttctccatacagcacctaagtgagcttcaaaagcaccagttctagcttagattcttcagcagcctctgaatgctcttgagatgaaatctaaatcttcagcatgggttatactccctgc

SEQ ID NO: 342504 - DNA, 88 bp, Homo sapiens
gaaaaatagaagtaggtgggaaaagagattgaaagtaaaaaagactagaagaggaattttagaatgagaagtgtgtggggtggtaaaa

SEQ ID NO: 342505 - DNA, 273 bp, Homo sapiens
ctctttcagactcatactcctcctctgtggctttacaaatcctggatagaaaacatctcacaaaacatgttctcttctcttcacatatttaagaggccttcgagcattgacacacatttgcctccagattttctagttgaagaaatgtgcaaaaatcaataaaaagcccaaatacagtggtatttttccccagagttatggacaataacaaataatcaggtgggaaggcttgatgattttctttttagattgtgagctacaggcggccatatg

SEQ ID NO: 342506 - DNA, 435 bp, Homo sapiens
aaatggcagcagctacaatttttggagagctaacagattagagtcaccagggatacagtgttaaggtcaaccttgtctcggccctccttcatcttatagggaagctattagaaagaaacaattaaacagagtactgaatgttacaagagtagttctgaatattatagaaatacctcatagcacagacacctaactgactggaggagggacgctagtaaggcttgagcagggataggatagaggagggagaaagtgttccaggcagaggaaacagatccatgaagatctggaggcaccaaagcattgggcaaggcagagcacttttttcaaactgaaggtcaagacccattactggattttgaaattagtctagtcttttatgacctacattttaataacaatgaaatatgattaaatagaaaatcagtgcaaagc

SEQ ID NO: 342507 - DNA, 307 bp, Homo sapiens
gcttgatatagttctgattgttggtgattttacagtctgatggaagagacatgtatacaaaagggcaatttatgaggtctcgatgtttgtaaaatagaatagacgtgttaactgccacaaggggtttggaggaacgagaggaagatagaattggcgtgagagcactgttacctgaaatagcagagaaaagtttcagggaggaaatagaacttttgctgagctttgaaaattgggagaggtttgcataggtagatagagaaaaattgggaaagcattgtagttaggaaatagtagggactaataaata

SEQ ID NO: 342508 - DNA, 319 bp, Homo sapiens
aagaatgtggaaaagctggagagaaactagaacccccccccaatacacagtggctaagaatgtaaaatgcaatccctgtgaaagtctgtcagtttctcaaaaagttcaacacagagctaccatatgacccaacaatcccacttgtaggtgtacacccaagagaaagaagacatatccccactggaaaacctgtccacaaatgctcacagcagaattattcatgaaggccaaaaagtggtaacaatccaaatgtccgtcaacaggcgaacagataaagcaaacatggtatatccacctaagggactatcgttcagccata

SEQ ID NO: 342509 - DNA, 843 bp, Homo sapiens
gggggagatggcgcgacgcttccatcaagagactctgatgtgtcccaggggaagaatcacagttttttagaggtgtgccctgccactccctcagggttagaggagagttgcatagacatggggacctcttcccaccatagtttcacatgactgctttcctggaagtagactgttgacattctctgtccctgctactttcacaaagtgtggcagtattttagtgtgcccattagggacattgatggagagtgcaccaagacctcttagttagcagatagcatgctcacggatgtcactgtcctgtaaatgtctggaggtagacatcctgagggatcttggcagctttttctgggaagtaattcacgtttactctgccttacaagaccaggcttgtgccgcagaacgtgggggcaggtccagcgtctggtattcttccatgggcccacttgacagggccacgatgtgttttcagttgttgtggggttttttggttttctgtttttgagacaaggtctgactctgttgcccaggctggagtgcagtggtgcaattacggctcactgcagtcttgaactcctggactcaagtgatcctcccacctcaggctcctaagtagctggatctacaggtgtgtgccaccttgcctggctaatttttttatcttactttttatacagatgaggccttactatattgtccaggctggtctcaaactcctggcctcaagcgatcctcccacctcagcctcccaaagcactgggattacaggcacacagcaccacacccagctttgtcatttgaatggctgggccccacttgaagaaagcttatatgttaagaaaa

SEQ ID NO: 342510 - DNA, 419 bp, Homo sapiens
gctcatgggtaaagattaccatttaatttgtagcagtagtgagtcggtgccatttatgaccacttcttgtcaagctcacacttgagacaagtcaagggccaaaaaggcctgacctgtagatacaacaagccacttgtagatttaggtggttaattacttatagagacagagaaaagaagaagaaggcaaagatgccagcttcctgtagttcttgtctagcataccaagaagggtgacactgaaactcacagctgatgaccgtgagccacaggattccggctcctgaggagctagatccagatggcagctaagtgggtttatgttctggacccttatttgaggccaggtgaagggatgcccagaaagccccatgcttcaccagaacccaggaggcaatgaggacctgtctcccgtcggct

SEQ ID NO: 342511 - DNA, 167 bp, Homo sapiens
gctcaaatgtcaggtaattgttagccaaccaatcatatttaaaactgagacaccaagtaattgactggaatctctttgtaccggatttactaagtggtgggttttctcatggagtgagctgttgggagttccactatttcattggaatatggacaaattttagaatg

SEQ ID NO: 342512 - DNA, 699 bp, Homo sapiens
gtggacttttccatcaggggagcaaaatccaaaaacaagtcaaaattacccttgtaggtcttcctgtgggatgtccttatgtctgcataatctctggtgcagtgggcagcagaggaccatctttgtccctggtgaggtctcccctgtgtgtgtgttttgtcacaggaaaggagggagtgatttctaaacactaaatctcagctgggtgcagtggctcacatctggaatcccagctctttgggagggttgggtgggcagatctcaaggtcaggagatcgagaccatcctggccaacatggtaaaaccccatctctagtaaaaatagaaaaattagctgggcctggcagcgcatgcctgtaatcccagctacttaagaggctgaggcaggagaatcactagaaccagggaggcagaggttgcagtgagctgaggtcatgccactgaaccacattcttgtgacagagctagacaccatctcaaaaaaaaaaaaaagaaaaattaaatctcatatttttttacacacaggattgatttccaaagactcatgctatgtaaggaagccaccaagaagggcaaagaaaaggagccagggacggctcttcctcaggtaaagtgatattcctcggtggattcttctgtctccttgttttcttaaataccaggtattgtggtagccagtcttctgtgattctgaagcgt

SEQ ID NO: 342513 - DNA, 204 bp, Homo sapiens
tccagagtgatgagaaaatgtaatttgccataagataaaatgacttttaagtgtggtcattagctaaagttcttctcaatttagtgattctgtaatgtcagccattgcaaatccgtgtctacttgatttattggtttggttttcttttgctttttatttttttatttttcattttttgagacggagtctcaccctgtcaccgag

SEQ ID NO: 342514 - DNA, 205 bp, Homo sapiens
gggacaggcaagacacttacatttgacgtaggctctgccacttgctgacaagttctactcaatttctgctttatagcagtctactttctaacttattaaagcctatcttgacagtcggccttcttatctgaagcaatgagggtaggtggttgattcatcaaaacaagtcggttgaagcaggaaagcattacatgggagacatata

SEQ ID NO: 342515 - DNA, 609 bp, Homo sapiens
cctccacccatccaccgcccaggcagctgcatttgctcaccctccaagtcacctgtgaagtggcctaatactgagaaggcagaggctgctgcccggccctcacatcctcacagtcacaactgcctgctttgggagctagcgagtgttgagaagctgctgtaacccgcctgcaaaaggccccacttgtgacagacactgcgatcctccccctgactctggaaaacactgtctgaaaccacagtgaccctaagactgtcttaaaaaccaaatgagaagggagtcaaagccacgtactgcaaaaaagtcgactacacaccaaggtagcaagggagaacgtgagcgaccagaaacatggcagaagctccccctcagtaactgctttgaaagcgaatggactgatcgctccaaccaaaggcagattggccaagtgggtgaaaagacgatttccatgttgtcaccacacgatctgcaagacgttcaaagacacgaacaggctggaagtgaaaggatgaagaaacccaggcaaagagtaacctaaagagagctgaggcgactcttaaactcacagcagataagttttctattttttgagacggagtcttgctctgt

SEQ ID NO: 342516 - DNA, 659 bp, Homo sapiens
tcacgtcatatagcggtaataatataattgtggggtacgatcaggttcagcgatggagtaggttaaggtcatgtccgtaatctacgcgcacgtgtgttggagattgagactagtagggctaggcccaccgctgcttcgcaggcggcaaagactagtatggcaataggcacaatattggctaagagggagtgggtgttgagaagctgctgtaacccgcctgcaaaaggccccacttgtgacagacactgcgatcctccccctgactctggaaaacactgtctgaaaccacagtgaccctaagactgtcttaaaaaccaaatgagaagggagtcaaagccacgtactgcaaaaaagtcgactacacaccaaggtagcaagggagaacgtgagcgaccagaaacatggcagaagctccccctcagtaactgctttgaaagcgaatggactgatcgctccaaccaaaggcagattggccaagtgggtgaaaagacgatttccatgttgtcaccacacgatctgcaagacgttcaaagacacgaacaggctggaagtgaaaggatgaagaaacccaggcaaagagtaacctaaagagagctgaggcgactcttaaactcacagcagataagttttctattttttgagacggagtcttgctctgt

SEQ ID NO: 342517 - DNA, 348 bp, Homo sapiens
gagattcaatcaaagaaaagatgttcttgaaaagcaaatctcccaccatgattaagagtctgactaagaatatgggaatgaacgtgataggcagtgggctgagagatgtgcaaataaatgctgtgttctaggaaccatgtatagttaaataaggctgagcatagacatgagagagatggggagtggaaggagggcaggctgtaagggtgagaaccataccacaaatgagaccatgctagggaatcagacttgattttacacatgatgggctgcttttggagtgtgtttattttagatgaattattctgtagcaacagtgcagaagagatatttgaaaggggcaacagt

SEQ ID NO: 342518 - DNA, 421 bp, Homo sapiens
ctgctgtctctctgcctttgagttgcattcactcctgtctcctgtctttatgtcattgttttccacttttccctccatctacctttttttcttcctctttctcctccttttgcatctgattttcttcttgaactaggcacaaagtctattttttaaatgttcttttgtgtgttggctagctttaaatccccaggaataaaataagagagacagtttagatttttcattcacgttaaataaagtaaaacttaaacaaaccccaaacaaccaaagtcatgtgaccctggcttgattgcctttttttcgggtcattgactaatgaaggggagaattgtctctttctcggagtccatgcgaggtcagcctgggactctgtgtgtggttttgcagagagggcctctgggatggtcacttgtggatt

SEQ ID NO: 342519 - DNA, 208 bp, Homo sapiens
tcactgtatgttatctcttattgtgcctaatttataaattaaactttattgtgggtctgtgtgtatagaaaaacatatttatagggttcagtacggaggtttcaggcatccactaggggtcttggaacatattccccaaggataaggggggactattgtactgtccccacccagggagccttagctatgtggagtgagtaggggcatg

SEQ ID NO: 342520 - DNA, 233 bp, Homo sapiens
gagaaagacaaagctcttggtctttgggtgagtgattcattggttgattgcctggagttttccacttgggagcaaattccttctgtggtttccaggctttaagagacattagtttgcttttcaatttacatggccattctactgaatccactgcacagctctctgccattgtaatagccctgatacataacttcacatttggaatgtagagtgcaaccattcttaatagttta

SEQ ID NO: 342521 - DNA, 215 bp, Homo sapiens
atataagaaatatattcaatcaataaagaggaaataaaattaaattttagcttctgtgatatatctgaggggatagtttaactcaacatatattagatctcatcaaaccagaatcaaaaagaaccttaaaatattccaagctcataaattttgaaaaaccaatggacacaatcctgctaagcatttaaaatatgtgcccagttgtcatttaggat

SEQ ID NO: 342522 - DNA, 3013 bp, Homo sapiens
ggagtcaccgtgatacctgacatctagcaatcactagagtaggaaatgagtatagatcagcaacaagtccagcctttacagttgcagcagaggtttcctgtggctcgagtgtggcgagtcccggaaacctcggagcccgcagacttcccttcgcgggagcccgcccgaactccatcctttgccggcagccacgccccgcagtgggaaggagggactgaaaagcatttccttgaggctggcacaccttgccctacccaaccctgtcattatttcccctccgactgggccggtgccatcggaaaccggagtgaccagaggagggacacgcatccaatttcactgggctgcaagatatcaataagccttgcctctttaaactacttatgtacaaataaaagtgatggtgagaacctggctcaggaaatgcagtagcaggccatattgcatccaaaggaattactcacagctgtgctgtgtgcattctctgtgggcctagcagggaaggggacagccctgtggcaatgggcatgacacggatgctcctggaatgcagtctcagtgacaagttgtgtgtcatccaggagaagcagtatgaagtgattatcgtcccaactttgttggttactatcttcctcatccttcttggggtcatcctgtggctttttatcagagaacaaagaactcaacagcagcgttctggacctcaaggcattgcccctgttcctccacctagggacctaagctgggaagcaggacatggaggaaatgtggctttgccacttaaggagacatccgtggaaaactttctgggagctaccacacctgccctggctaagctgcaggtgccgcgggagcaactctctgaagttctggagcagatttgcagtggtagctgtgggcccatctttcgagccaatatgaacactggggacccttctaagcccaagagtgttattctcaaggctttaaaagaaccagctgggctccatgaggtacaagatttcttagggcgaatccaattccatcaatacctggggaaacacaaaaacctggtgcagctggaaggctgctgcactgaaaagctgccactctatatggtgttggaggatgtggcccagggggacctgctcggctttctctggacctgtcggcgggatgtgatgactatggatggtcttctctatgatctcacagaaaaacaagtatatcacatcggaaagcaggtccttttggcgctggaattcctgcaggagaagcatttgttccatggggatgtggcagccaggaatattctgatgcaaagtgatctcactgctaagctctgtggattaggcctggcttatgaagtttacacccgaggggccatctcctctactcaaaccatacctctcaagtggcttgccccagaacggcttctcctgagacctgctagcatcagagcagatgtctggtcttttgggatcctgctctatgagatggtgactctaggagcaccaccgtatcctgaagtccctcctaccagcatcctagagcatctccaaagaaggaaaatcatgaagagacccagtagctgcacacataccatgtacagtatcatgaagtcctgctggcgctggcgtgaggctgaccgcccctcacctagagagctgcgcttgcgcctagaagctgccattaaaactgcagatgacgaggctgtgttacaagtaccagagttggtggtacctgaactgtatgcagctgtggccggcatcagagtggagagcctcttctacaactatagcatgctttgaagagtctcgggcaagaaacattcatgcatgagtatatgttcttggaatcaattcctctaagaacagagaatggtctttcccagggacacaaagggagaaatgggacatggattcttgatcttcctttacacatttctcgggaaatctgaaatgatgctggatgggactctacacatcctgagctaagacatactgtcagtctcacttctgctgtcccagtcctagaaatcctgggtagaagtggtggacctgtgcaaaggaggttttagaactctgcagtatttgttggggcatggcacaaataagctcatccctcccgtccgaggctagtttcctctggaaccacatttttatctagatgaaaatttggaatgaaatgaaggaatagaaatccaataaaagagttgaagggaaagaaaatttaaggttcttcttgctcaggattacagatatggaccaacacctccttcaagaaaaggtggtaggacacaaagttcttcagtcctgagccctacatgtggggttggaggagaactataacggaaaaacctctgagtttcaccttaggtatagataaaagaaagatggtccccttttatctgattctgagacaggtaaattctgtttgttactacgtttaattagaaggtggaggagtcatttcatgattaagaacattcaacatgtattgttcattaagctagcttcctagttccgattagactaaggagactaagcctagagagtcaatgttagaacagtgaaaagaattctgtgtgtgtgtgtgtgtgtgtgcacaataaataggaaatgtagaaaccaagcaagaaggcttagtagctcagtctttaacaagggctagaaaagaatgtaatctgatatggaaggatagcagcttctaattttcaatcatctgttgatatactgtgaaacttattttattaaattaatatttattaaatggaaatatgcttttctggtttataactactaaaaatatcatagggaggataaaagtaaataagtgaaagttaatgccaatagaaaaattcaagagataatgtacaatgtcagaaaagggattctttatgtgtaaatggggataatacctatttcacaaggttgttctgaggattgatacgttttgagtatgtatttgtacactatctggcacatatgcgctcaataaacgtgtttctccttttcttttgcccttcctaacc

SEQ ID NO: 342523 - DNA, 2125 bp, Homo sapiens
  misc_feature (2076)..(2076): n is a, c, g, or t
  misc_feature (2083)..(2083): n is a, c, g, or t
ggagtcaccgtgatacctgacatctagcaatcactagagtaggaaatgagtatagatcagcaacaagtccagcctttacagttgcagcagaggtttcctgtggctcgagtgtggcgagtcccggaaacctcggagcccgcagacttcccttcgcgggagcccgcccgaactccatcctttgccggcagccacgccccgcagtgggaaggagggactgaaaagcatttccttgaggctggcacaccttgccctacccaaccctgtcattatttcccctccgactgggccggtgccatcggaaaccggagtgaccagaggagggacacgcatccaatttcactgggctgcaagatatcaataagccttgcctctttaaactacttatgtacaaataaaagtgatggtgagaacctggctcaggaaatgcagtagcaggccatattgcatccaaaggaattactcacagctgtgctgtgtgcattctctgtgggcctagcagggaaggggacagccctgtggcaatgggcatgacacggatgctcctggaatgcagtctcagtgacaagttgtgtgtcatccaggagaagcagtatgaagtgattatcgtcccaactttgttggttactatcttcctcatccttcttggggtcatcctgtggctttttatcagagaacaaagaactcaacagcagcgttctggacctcaaggcattgcccctgttcctccacctagggacctaagctgggaagcaggacatggaggaaatgtggctttgccacttaaggagacatccgtggaaaactttctgggagctaccacacctgccctggctaagctgcaggtgccgcgggagcaactctctgaagttctggagcagatttgcagtggtagctgtgggcccatctttcgagccaatatgaacactggggacccttctaagcccaagagtgttattctcaaggctttaaaagaaccagctgggctccatgaggtacaagatttcttagggcgaatccaattccatcaatacctggggaaacacaaaaacctggtgcagctggaaggctgctgcactgaaaagctgccactctatatggtgttggaggatgtggcccagggggacctgctcggctttctctggacctgtcggcgggatgtgatgactatggatggtcttctctatgatctcacagaaaaacaagtatatcacatcggaaagcaggtccttttggcgctggaattcctgcaggagaagcatttgttccatggggatgtggcagccaggaatattctgatgcaaagtgatctcactgctaagctctgtggattaggcctggcttatgaagtttacacccgaggggccatctcctctactcaaaccatacctctcaagtggcttgccccagaacggcttctcctgagacctgctagcatcagagcagatgtctggtcttttgggatcctgctctatgagatggtgactctaggagcaccaccgtatcctgaagtccctcctaccagcatcctagagcatctccaaagaaggaaaatcatgaagagacccagtagctgcacacataccatgtacagtatcatgaagtcctgctggcgctggcgtgaggctgaccgcccctcacctagagagctgcgcttgcgcctagaagctgccattaaaactgcagatgacgaggctgtgttacaagtaccagagttggtggtacctgaactgtatgcagctgtggccggcatcagagtggagagcctcttctacaactatagcatgctttgaagagtctcgggcaagaaacattcatgcatgagtatatgttcttggaatcaattcctctaagaacagagaatggtctttcccagggacacaaagggagaaatgggacatggattcttgatcttcctttacacatttctcgggaaatctgaaatgatgctggatgggactctacacatcctgagctaagacatactgtcagtctcacttctgctgtcccagtcctagaaatcctgggtagaagtggtggacctgtgcaaaggaggttttgcttatgtgaccatgtgtngcatgcnaggaactgtatggcccactgcactgccgattaccgagttatt

SEQ ID NO: 342524 - DNA, 3031 bp, Homo sapiens
ggagtcaccgtgatacctgacatctagcaatcactagagtaggaaatgagtatagatcagcaacaagtccagcctttacagttgcagcagaggtttcctgtggctcgagtgtggcgagtcccggaaacctcggagcccgcagacttcccttcgcgggagcccgcccgaactccatcctttgccggcagccacgccccgcagtgggaaggagggactgaaaagcatttccttgaggctggcacaccttgccctacccaaccctgtcattatttcccctccgactgggccggtgccatcggaaaccggagtgaccagaggagggacacgcatccaatttcactgggctgcaagatatcaataagccttgcctctttaaactacttatgtacaaataaaagtgatggtgagaacctggctcaggaaatgcagtagcaggccatattgcatccaaaggaattactcacagctgtgctgtgtgcattctctgtgggcctagcagggaaggggacagccctgtggcaatgggcatgacacggatgctcctggaatgcagtctcagtgacaagttgtgtgtcatccaggagaagcagtatgaagtgattatcgtcccaactttgttggttactatcttcctcatccttcttggggtcatcctgtggctttttatcagagaacaaagaactcaacagcagcgttctggacctcaaggcattgcccctgttcctccacctagggacctaagctgggaagcaggacatggaggaaatgtggctttgccacttaaggagacatccgtggaaaactttctgggagctaccacacctgccctggctaagctgcaggtgccgcgggagcaactctctgaagttctggagcagatttgcagtggtagctgtgggcccatctttcgagccaatatgaacactggggacccttctaagcccaagagtgttattctcaaggctttaaaagaaccagctgggctccatgaggtacaagatttcttagggcgaatccaattccatcaatacctggggaaacacaaaaacctggtgcagctggaaggctgctgcactgaaaagctgccactctatatggtgttggaggatgtggcccagggggacctgctcggctttctctggacctgtcggcgggtgagcagtagggcagaggatgtgatgactatggatggtcttctctatgatctcacagaaaaacaagtatatcacatcggaaagcaggtccttttggcgctggaattcctgcaggagaagcatttgttccatggggatgtggcagccaggaatattctgatgcaaagtgatctcactgctaagctctgtggattaggcctggcttatgaagtttacacccgaggggccatctcctctactcaaaccatacctctcaagtggcttgccccagaacggcttctcctgagacctgctagcatcagagcagatgtctggtcttttgggatcctgctctatgagatggtgactctaggagcaccaccgtatcctgaagtccctcctaccagcatcctagagcatctccaaagaaggaaaatcatgaagagacccagtagctgcacacataccatgtacagtatcatgaagtcctgctggcgctggcgtgaggctgaccgcccctcacctagagagctgcgcttgcgcctagaagctgccattaaaactgcagatgacgaggctgtgttacaagtaccagagttggtggtacctgaactgtatgcagctgtggccggcatcagagtggagagcctcttctacaactatagcatgctttgaagagtctcgggcaagaaacattcatgcatgagtatatgttcttggaatcaattcctctaagaacagagaatggtctttcccagggacacaaagggagaaatgggacatggattcttgatcttcctttacacatttctcgggaaatctgaaatgatgctggatgggactctacacatcctgagctaagacatactgtcagtctcacttctgctgtcccagtcctagaaatcctgggtagaagtggtggacctgtgcaaaggaggttttagaactctgcagtatttgttggggcatggcacaaataagctcatccctcccgtccgaggctagtttcctctggaaccacatttttatctagatgaaaatttggaatgaaatgaaggaatagaaatccaataaaagagttgaagggaaagaaaatttaaggttcttcttgctcaggattacagatatggaccaacacctccttcaagaaaaggtggtaggacacaaagttcttcagtcctgagccctacatgtggggttggaggagaactataacggaaaaacctctgagtttcaccttaggtatagataaaagaaagatggtccccttttatctgattctgagacaggtaaattctgtttgttactacgtttaattagaaggtggaggagtcatttcatgattaagaacattcaacatgtattgttcattaagctagcttcctagttccgattagactaaggagactaagcctagagagtcaatgttagaacagtgaaaagaattctgtgtgtgtgtgtgtgtgtgtgcacaataaataggaaatgtagaaaccaagcaagaaggcttagtagctcagtctttaacaagggctagaaaagaatgtaatctgatatggaaggatagcagcttctaattttcaatcatctgttgatatactgtgaaacttattttattaaattaatatttattaaatggaaatatgcttttctggtttataactactaaaaatatcatagggaggataaaagtaaataagtgaaagttaatgccaatagaaaaattcaagagataatgtacaatgtcagaaaagggattctttatgtgtaaatggggataatacctatttcacaaggttgttctgaggattgatacgttttgagtatgtatttgtacactatctggcacatatgcgctcaataaacgtgtttctccttttcttttgcccttcctaacc

SEQ ID NO: 342525 - DNA, 1786 bp, Homo sapiens
ggagtcaccgtgatacctgacatctagcaatcactagagtaggaaatgagtatagatcagcaacaagtccagcctttacagttgcagcagaggtttcctgtggctcgagtgtggcgagtcccggaaacctcggagcccgcagacttcccttcgcgggagcccgcccgaactccatcctttgccggcagccacgccccgcagtgggaaggagggactgaaaagcatttccttgaggctggcacaccttgccctacccaaccctgtcattatttcccctccgactgggccggtgccatcggaaaccggagtgaccagaggagggacacgcatccaatttcactgggctgcaagatatcaataagccttgcctctttaaactacttatgtacaaataaaagtgatggtgagaacctggctcaggaaatgcagtagcaggccatattgcatccaaaggaattactcacagctgtgctgtgtgcattctctgtgggcctagcagggaaggggacagccctgtggcaatgggcatgacacggatgctcctggaatgcagtctcagtgacaagttgtgtgtcatccaggagaagcagtatgaagtgattatcgtcccaactttgttggttactatcttcctcatccttcttggggtcatcctgtggctttttatcagagaacaaagaactcaacagcagcgttctggacctcaaggcattgcccctgttcctccacctagggacctaagctgggaagcaggacatggaggaaatgtggctttgccacttaaggagacatccgtggaaaactttctgggagctaccacacctgccctggctaagctgcaggtgccgcgggagcaactctctgaagttctggagcagatttgcagtggtagctgtgggcccatctttcgagccaatatgaacactggggacccttctaagcccaagagtgttattctcaaggctttaaaagaaccagctgggctccatgaggtacaagatttcttagggcgaatccaattccatcaatacctggggaaacacaaaaacctggtgcagctggaaggctgctgcactgaaaagctgccactctatatggtgttggaggatgtggcccagggggacctgctcggctttctctggacctgtcggcgggatgtgatgactatggatggtcttctctatgatctcacagaaaaacaagtatatcacatcggaaagcaggtccttttggcgctggaattcctgcaggagaagcatttgttccatggggatgtggcagccaggaatattctgatgcaaagtgatctcactgctaagctctgtggattaggcctggcttatgaagtttacacccgaggggccatctcctctactcaaaccatacctctcaagtggcttgccccagaacggcttctcctgagacctgctagcatcagagcagatgtctggtcttttgggatcctgctctatgagatggtgactctaggaagcacaccgtatcctgaagtcctcctaacaagatctagagcatttcaagaagcaaaccagaagaaccagagctggcaataccgtcaggatagagtctgcgcgcgccacatgacgcccaacaagagaccgggccaaggcacagcgacaagcgcccttgcccaaggggaccagagagtaggcgagagaacccataagaagattcctaaaccatatatctcgagaggggggctcgccactcgttccacttctgtcttacacagaagccacaagaacacaatcaacagctagccggcctt

SEQ ID NO: 342526 - DNA, 5590 bp, Homo sapiens
caacaacaaaaggacttggactggccggcctgggcgcacgacccgagggctggagtcggccccgcgcctgccgtctgggtacctgaacgaggtgcagcgcagcccggccccaccgcagctacctcagcagtcccgccccgcccgcgtccttccccgccgagccggcccgctcccttccccgcgcagccccgcacggcccgggcccacgtacaatgactcttcttgcttttcacctaagttgaataagcaccctgtgcactttaatctcctgtcggtaccattgggccaactaaagacaaggttttgaaatctcagctataaaagacatccagccaaactctcagtcttgccttaacaatgttccagaggctgaataaaatgtttgtgggtgaagtcagttcttcctccaaccaagaaccagaattcaatgagaaagaagatgatgaatggattcttgttgacttcatagatacttgcactggtttctcagcagaagaagaagaagaagaggaggacatcagtgaagagtcacctactgagcacccttcagtcttttcctgtttaccggcatctcttgagtgcttggctgatacaagtgattcctgctttctccagtttgagtcatgtccaatggaggagagctggtttatcaccccacccccatgttttactgcaggtggattaaccactatcaaggtggaaacaagtcctatggaaaaccttctcattgaacatcccagcatgtctgtctatgctgtgcataactcctgccctggtctcagtgaggccacccgtgggactgatgaattacatagcccaagtagtcccagagtggaagctcaaaatgaaatggggcagcatattcattgttatgttgcagctcttgctgctcatacaacttttctggaacaacccaagagctttcgcccttcccagtggataaaagaacacagtgaaagacagcctcttaacagaaatagccttcgtcgccaaaatcttaccagggattgccaccctcggcaagtcaagcacaatggctgggttgttcatcagccctgcccgcgtcagtacaattactaatagtttcaagttttgttggttggtttctcttggtttgtgcttacatgtatggatgtgtgtatatgtacagtgaaaatgttgtctctttacaaccaattgataaccaatcacatagttttatcagtgtatttagacactatcttgaaaatcagatttatatgctgtgtatcacataatgccttgcctttaacatttactttttttgtacactttttcagattatttctggaaacatatcaatataattacagtgtttgggggtgtctttaaatatattaggttatacattagtcagcattttaaagacatttcttcccaagtacgagaataggcatctttcattttcattttattttgtattacttaatcttttaagcaagcaaaaatttattctcagggtcagctgtacactttattgaccagtacttgataatctctctgtatatgatgaatacatttttatacactaacattagcattaacaggtgatagttgccatggatataatggaattatggctggactttcttttgaaagaaaacttgatgtattctgtgtgtatggtttttccccagattagtcatacagttcatttggaattcaggtacattaagctttagtgaagagtgcatgcagtaattccaatgtgactgcatgacgtggtacagacattacaggtgttgtagacagaggcacttgtctcgtgcagagggattaaattagacctgtgagattatatttggaaaaattcatgtctgtaactaacccattagtgcagtatttaatttgttactattccttcccgccaattctgtccactcctcacctcgcatcagctataaatttggaagtacttgtccaggcactcaagtgacttcatatttctctctgcccatgggaaaagagataggctttatatttccacagagtgaaaaatcctctgtcatggagcctgtcctgccaagtggcaagagtgtggggactgtctggtgatgatgtctttcatggcatctgagtgaagagtgacaggttggctcaacttttttctttttttttttttaattgccttgtattgtaagtattcttccctgcagtccaagtgacttttcattttttgttttaacttcaggcaaaatctttaaccactctggcctctgtttcccccaccaacggggagcagtgacatttacctccctcacagagtcactgtgaggattctatactgatttgaagtggagctgttcagaactgaaccttgtaggaaattccaagggcctttctactgaatctggtgatggggtggggccgtggcactttctctgccacagctgttcttcacagtgttggtgctaatgaggccagggtgcagggttcgattcacacgtaggccagttaacttagagaaaatctatttccttacctctagccagtcacttcctttttccgcagttgtgatgggttttgctgagccatccactctgactgatttcctctgaagtaaacatatttacaatccaaagcaattctactgacagaagtgttgccttcataatcaaacagcttgtttttccatctcctctgcaaccctaattaaatgagtacaggtctacaaaatgttttcaaggagaaaagcagcatatccttaagtgaagtattatatttttcaataaccctgtagtggcttgatgcagggaaccctgggggactttcagcgaagagctgtgctcttttctgactagattagagcgtttggagtggaagacgtcaaatgtgtagtgagatggaggttttacattgttcttctactggctgtgatgaagtgccagaatgtctctttagaacaagagttagattccccctttctccttattgccccttccgttttgacttcccctttatttatttgttgtctaattaggggccaagtctgtaaagttttgtcaaagtgagttagaagttgttttctcttactatttgtgtttaccagagttgggagataagatagtttccatgaaggtgtgtatgttttatacgatgtttgttatagggccatgcattggtaacttgaaaatagaccagcttaatgtcttcaggatgtaaaactctgaatacacggcgtctctttttcatacattgcatgtaagttgttagtacctcacaagctacagaagttcagccatgagattttgtttggcaacatgaacagatttgtgtataactgcaatggcctttttttccagatttccttattgactttttgtttgccttacctggggctagttttttatgctttgtacctagaaaacaaaaaattacattcgttgggctttttttcaaggttgggattaccacaccacctggaatatcatactgtggtttctgcctaaaattggcacatgtaagtattgaagaaaatggttatataattcagttgaaactcttggttattagatgttaggcatctcctgtatgtaagacacaaggccaaccacaacacagaacgatgttgacctgttaagtattctctgaaacatggccaaaatgcattttatgagcttttttttttttgctattgtaaatattagtggtttacaatgcgctttagacatatttctttaaaatgcaagcagtgagaaataagacctctctgaattagtagctctaaactgttaacatagaatgttacttggaaaaagtctggaatatgtggtgtacacaagcagtgcttcgtgaatgagtttcttagcttttatagtgcgccatgtttctcaaagtttgtttttgttgacaaaacattttataatatatatcttatgtttattttttttctcaactaattgtgtactgcactgtaaggtgaaaattagccatccattatttatcttctgtggcaatgcatttatatggttgattgggtggggaattttttgcagaaagatgcaaagtgattgggttttcgacttcctatcgcagggagcttttaagaaatattaatttcctatacatttttccaatccccatgcaaactgttcctgtttacataccttctctgttgtatcagtactttgagtgagaagacagtttatttaaaacttgagcaggctgttcagcattgtttctgcttctgaaatctgtatagtacactggtttgtaatcattatgtcttcattgaaatccttgctacttctcttcctcctcaatgaaatacattatatattatctttatgtactcttaagaaaaacgagcaaggaagagtatcttcattattctcattttctctgagttggaaacaaaaacatgaaggactccaactagaagacagatatttacatttaaatagattagtgggaaaactttaagagtttccacatattagttttcattttttgagtcaagagactgctccttgtactgggagacactagtagtatatgtttgtaatgttactttaaaattatctttttattttataaggcccataaatactggttaaactctgttaaaagtgggccttctatcttggatggtttcactgccatcagccatgctgatatattagaaatggcatccctatctacttactttaatgcttaaaattatacataaaatgctttatttagaaaacctacatgatacagtggtgtcagccttgccatgtatcagtttcacttgaaatttgagaccaattaaatttcaactgtttagggtggagaaagaggtactggaaaacatgcagatgaggatatcttttatgtgcaacagtatcctttgcatgggaggagagttactcttgaaaggcaggcagcttaagtggacaatgttttgtatatagttgagaattttacgacacttttaaaaattgtgtaattgttaaatgtccagttttgctctgttttgcctgaagttttagtatttgttttctaggtggacctctgaaaaccaaaccagtacctggggaggttagatgtgtgtttcaggcttggagtgtatgagtggttttgcttgtattttcctccagagattttgaactttaataattgcgtgtgtgtttttttttttttaagtggctttgtttttttttctcaagtaaaattgtgaacatatttcctttataggggcagggcatgagttagggagactgaagagtattgtagactgtacatgtgccttcttaatgtgtttctcgacacattttttttcagtaacttgaaaattcaaaagggacatttggttaggttactgtacatcaatctatgcataaatggcagcttgttttcttgagccactgtctaaattttgtttttatagaaattttttatactgattggttcatagatggtcagttttgtacacagactgaacaatacagcactttgccaaaaatgagtgtagcattgtttaaacattgtgtgttaacacctgttctttgtaattgggttgtggtgcattttgcactacctggagttacagttttcaatctgtcagtaaataaagtgtcctttaacttca

SEQ ID NO: 342527 - DNA, 573 bp, Homo sapiens
tgtagaatgtaggccaaggcatatgctttcttctaagggtatgtgtgtatgtgtatgtacttatgtatatatgtgcatgctgatttgaaataacttcctttttctgttttattttaggtacaatgactcttcttgcttttcacctaagttgaataagcaccctgtgcactttaatctcctgtcggtaccattgggccaactaaagacaaggttttgaaatctcagctataaaagacatccagccaaactctcagtcttgccttaacaatgttccagaggctgaataaaatgtttgtgggtgaagtcagttcttcctccaaccaagaaccagaattcaatgagaaagaagatgatgaatggattcttgttgacttcataggtaaggtacacttggttacttggtggttcatcttcacagtaaaaatggaaacttgcatctcagtttttgcataaggaaaccaataactgaggggttttcagccttaaaagtaagcaggagtttgtctttaaaaaattgcaggaaaccatctgtgctagataatgtcagtgaaattgactgacatcagacttttt

SEQ ID NO: 342528 - DNA, 5538 bp, Homo sapiens
tgtagaatgtaggccaaggcatatgctttcttctaagggtatgtgtgtatgtgtatgtacttatgtatatatgtgcatgctgatttgaaataacttcctttttctgttttattttaggtacaatgactcttcttgcttttcacctaagttgaataagcaccctgtgcactttaatctcctgtcggtaccattgggccaactaaagacaaggttttgaaatctcagctataaaagacatccagccaaactctcagtcttgccttaacaatgttccagaggctgaataaaatgtttgtgggtgaagtcagttcttcctccaaccaagaaccagaattcaatgagaaagaagatgatgaatggattcttgttgacttcatagatacttgcactggtttctcagcagaagaagaagaagaagaggaggacatcagtgaagagtcacctactgagcacccttcagtcttttcctgtttaccggcatctcttgagtgcttggctgatacaagtgattcctgctttctccagtttgagtcatgtccaatggaggagagctggtttatcaccccacccccatgttttactgcaggtggattaaccactatcaaggtggaaacaagtcctatggaaaaccttctcattgaacatcccagcatgtctgtctatgctgtgcataactcctgccctggtctcagtgaggccacccgtgggactgatgaattacatagcccaagtagtcccagggccaggaaaagctgcttataagactcacgggcacagaagtggaagctcaaaatgaaatggggcagcatattcattgttatgttgcagctcttgctgctcatacaacttttctggaacaacccaagagctttcgcccttcccagtggataaaagaacacagtgaaagacagcctcttaacagaaatagccttcgtcgccaaaatcttaccagggattgccaccctcggcaagtcaagcacaatggctgggttgttcatcagccctgcccgcgtcagtacaattactaatagtttcaagttttgttggttggtttctcttggtttgtgcttacatgtatggatgtgtgtatatgtacagtgaaaatgttgtctctttacaaccaattgataaccaatcacatagttttatcagtgtatttagacactatcttgaaaatcagatttatatgctgtgtatcacataatgccttgcctttaacatttactttttttgtacactttttcagattatttctggaaacatatcaatataattacagtgtttgggggtgtctttaaatatattaggttatacattagtcagcattttaaagacatttcttcccaagtacgagaataggcatctttcattttcattttattttgtattacttaatcttttaagcaagcaaaaatttattctcagggtcagctgtacactttattgaccagtacttgataatctctctgtatatgatgaatacatttttatacactaacattagcattaacaggtgatagttgccatggatataatggaattatggctggactttcttttgaaagaaaacttgatgtattctgtgtgtatggtttttccccagattagtcatacagttcatttggaattcaggtacattaagctttagtgaagagtgcatgcagtaattccaatgtgactgcatgacgtggtacagacattacaggtgttgtagacagaggcacttgtctcgtgcagagggattaaattagacctgtgagattatatttggaaaaattcatgtctgtaactaacccattagtgcagtatttaatttgttactattccttcccgccaattctgtccactcctcacctcgcatcagctataaatttggaagtacttgtccaggcactcaagtgacttcatatttctctctgcccatgggaaaagagataggctttatatttccacagagtgaaaaatcctctgtcatggagcctgtcctgccaagtggcaagagtgtggggactgtctggtgatgatgtctttcatggcatctgagtgaagagtgacaggttggctcaacttttttctttttttttttttaattgccttgtattgtaagtattcttccctgcagtccaagtgacttttcattttttgttttaacttcaggcaaaatctttaaccactctggcctctgtttcccccaccaacggggagcagtgacatttacctccctcacagagtcactgtgaggattctatactgatttgaagtggagctgttcagaactgaaccttgtaggaaattccaagggcctttctactgaatctggtgatggggtggggccgtggcactttctctgccacagctgttcttcacagtgttggtgctaatgaggccagggtgcagggttcgattcacacgtaggccagttaacttagagaaaatctatttccttacctctagccagtcacttcctttttccgcagttgtgatgggttttgctgagccatccactctgactgatttcctctgaagtaaacatatttacaatccaaagcaattctactgacagaagtgttgccttcataatcaaacagcttgtttttccatctcctctgcaaccctaattaaatgagtacaggtctacaaaatgttttcaaggagaaaagcagcatatccttaagtgaagtattatatttttcaataaccctgtagtggcttgatgcagggaaccctgggggactttcagcgaagagctgtgctcttttctgactagattagagcgtttggagtggaagacgtcaaatgtgtagtgagatggaggttttacattgttcttctactggctgtgatgaagtgccagaatgtctctttagaacaagagttagattccccctttctccttattgccccttccgttttgacttcccctttatttatttgttgtctaattaggggccaagtctgtaaagttttgtcaaagtgagttagaagttgttttctcttactatttgtgtttaccagagttgggagataagatagtttccatgaaggtgtgtatgttttatacgatgtttgttatagggccatgcattggtaacttgaaaatagaccagcttaatgtcttcaggatgtaaaactctgaatacacggcgtctctttttcatacattgcatgtaagttgttagtacctcacaagctacagaagttcagccatgagattttgtttggcaacatgaacagatttgtgtataactgcaatggcctttttttccagatttccttattgactttttgtttgccttacctggggctagttttttatgctttgtacctagaaaacaaaaaattacattcgttgggctttttttcaaggttgggattaccacaccacctggaatatcatactgtggtttctgcctaaaattggcacatgtaagtattgaagaaaatggttatataattcagttgaaactcttggttattagatgttaggcatctcctgtatgtaagacacaaggccaaccacaacacagaacgatgttgacctgttaagtattctctgaaacatggccaaaatgcattttatgagcttttttttttttgctattgtaaatattagtggtttacaatgcgctttagacatatttctttaaaatgcaagcagtgagaaataagacctctctgaattagtagctctaaactgttaacatagaatgttacttggaaaaagtctggaatatgtggtgtacacaagcagtgcttcgtgaatgagtttcttagcttttatagtgcgccatgtttctcaaagtttgtttttgttgacaaaacattttataatatatatcttatgtttattttttttctcaactaattgtgtactgcactgtaaggtgaaaattagccatccattatttatcttctgtggcaatgcatttatatggttgattgggtggggaattttttgcagaaagatgcaaagtgattgggttttcgacttcctatcgcagggagcttttaagaaatattaatttcctatacatttttccaatccccatgcaaactgttcctgtttacataccttctctgttgtatcagtactttgagtgagaagacagtttatttaaaacttgagcaggctgttcagcattgtttctgcttctgaaatctgtatagtacactggtttgtaatcattatgtcttcattgaaatccttgctacttctcttcctcctcaatgaaatacattatatattatctttatgtactcttaagaaaaacgagcaaggaagagtatcttcattattctcattttctctgagttggaaacaaaaacatgaaggactccaactagaagacagatatttacatttaaatagattagtgggaaaactttaagagtttccacatattagttttcattttttgagtcaagagactgctccttgtactgggagacactagtagtatatgtttgtaatgttactttaaaattatctttttattttataaggcccataaatactggttaaactctgttaaaagtgggccttctatcttggatggtttcactgccatcagccatgctgatatattagaaatggcatccctatctacttactttaatgcttaaaattatacataaaatgctttatttagaaaacctacatgatacagtggtgtcagccttgccatgtatcagtttcacttgaaatttgagaccaattaaatttcaactgtttagggtggagaaagaggtactggaaaacatgcagatgaggatatcttttatgtgcaacagtatcctttgcatgggaggagagttactcttgaaaggcaggcagcttaagtggacaatgttttgtatatagttgagaattttacgacacttttaaaaattgtgtaattgttaaatgtccagttttgctctgttttgcctgaagttttagtatttgttttctaggtggacctctgaaaaccaaaccagtacctggggaggttagatgtgtgtttcaggcttggagtgtatgagtggttttgcttgtattttcctccagagattttgaactttaataattgcgtgtgtgtttttttttttttaagtggctttgtttttttttctcaagtaaaattgtgaacatatttcctttataggggcagggcatgagttagggagactgaagagtattgtagactgtacatgtgccttcttaatgtgtttctcgacacattttttttcagtaacttgaaaattcaaaagggacatttggttaggttactgtacatcaatctatgcataaatggcagcttgttttcttgagccactgtctaaattttgtttttatagaaattttttatactgattggttcatagatggtcagttttgtacacagactgaacaatacagcactttgccaaaaatgagtgtagcattgtttaaacattgtgtgttaacacctgttctttgtaattgggttgtggtgcattttgcactacctggagttacagttttcaatctgtcagtaaataaagtgtcctttaacttca

SEQ ID NO: 342529 - DNA, 5574 bp, Homo sapiens
caacaacaaaaggacttggactggccggcctgggcgcacgacccgagggctggagtcggccccgcgcctgccgtctgggtacctgaacgaggtgcagcgcagcccggccccaccgcagctacctcagcagtcccgccccgcccgcgtccttccccgccgagccggcccgctcccttccccgcgcagccccgcacggcccgggcccacgtacaatgactcttcttgcttttcacctaagttgaataagcaccctgtgcactttaatctcctgtcggtaccattgggccaactaaagacaaggttttgaaatctcagctataaaagacatccagccaaactctcagtcttgccttaacaatgttccagaggctgaataaaatgtttgtgggtgaagtcagttcttcctccaaccaagaaccagaattcaatgagaaagaagatgatgaatggattcttgttgacttcatagatacttgcactggtttctcagcagaagaagaagaagaagaggaggacatcagtgaagagtcacctactgagcacccttcagtcttttcctgtttaccggcatctcttgagtgcttggctgatacaagtgattcctgctttctccagtttgagtcatgtccaatggaggagagctggtttatcaccccacccccatgttttactgcaggtggattaaccactatcaaggtggaaacaagtcctatggaaaaccttctcattgaacatcccagcatgtctgtctatgctgtgcataactcctgccctggtctcagtgaggccacccgtgggactgatgaattacatagcccaagtagtcccagggccaggaaaagctgcttataagactcacgggcacagaagtggaagctcaaaatgaaatggggcagcatattcattgttatgttgcagctcttgctgctcatacaacttttctggaacaacccaagagctttcgcccttcccagtggataaaagaacacagtgaaagacagcctcttaacagaaatagccttcgtcgccaaaatcttaccagggattgccaccctcggcaagtcaagcacaatggctgggttgttcatcagccctgcccgcgtcagtacaattactaatagtttcaagttttgttggttggtttctcttggtttgtgcttacatgtatggatgtgtgtatatgtacagtgaaaatgttgtctctttacaaccaattgataaccaatcacatagttttatcagtgtatttagacactatcttgaaaatcagatttatatgctgtgtatcacataatgccttgcctttaacatttactttttttgtacactttttcagattatttctggaaacatatcaatataattacagtgtttgggggtgtctttaaatatattaggttatacattagtcagcattttaaagacatttcttcccaagtacgagaataggcatctttcattttcattttattttgtattacttaatcttttaagcaagcaaaaatttattctcagggtcagctgtacactttattgaccagtacttgataatctctctgtatatgatgaatacatttttatacactaacattagcattaacaggtgatagttgccatggatataatggaattatggctggactttcttttgaaagaaaacttgatgtattctgtgtgtatggtttttccccagattagtcatacagttcatttggaattcaggtacattaagctttagtgaagagtgcatgcagtaattccaatgtgactgcatgacgtggtacagacattacaggtgttgtagacagaggcacttgtctcgtgcagagggattaaattagacctgtgagattatatttggaaaaattcatgtctgtaactaacccattagtgcagtatttaatttgttactattccttcccgccaattctgtccactcctcacctcgcatcagctataaatttggaagtacttgtccaggcactcaagtgacttcatatttctctctgcccatgggaaaagagataggctttatatttccacagagtgaaaaatcctctgtcatggagcctgtcctgccaagtggcaagagtgtggggactgtctggtgatgatgtctttcatggcatctgagtgaagagtgacaggttggctcaacttttttctttttttttttttaattgccttgtattgtaagtattcttccctgcagtccaagtgacttttcattttttgttttaacttcaggcaaaatctttaaccactctggcctctgtttcccccaccaacggggagcagtgacatttacctccctcacagagtcactgtgaggattctatactgatttgaagtggagctgttcagaactgaaccttgtaggaaattccaagggcctttctactgaatctggtgatggggtggggccgtggcactttctctgccacagctgttcttcacagtgttggtgctaatgaggccagggtgcagggttcgattcacacgtaggccagttaacttagagggttttgctgagccatccactctgactgatttcctctgaagtaaacatatttacaatccaaagcaattctactgacagaagtgttgccttcataatcaaacagcttgtttttccatctcctctgcaaccctaattaaatgagtacaggtctacaaaatgttttcaaggagaaaagcagcatatccttaagtgaagtattatatttttcaataaccctgtagtggcttgatgcagggaaccctgggggactttcagcgaagagctgtgctcttttctgactagattagagcgtttggagtggaagacgtcaaatgtgtagtgagatggaggttttacattgttcttctactggctgtgatgaagtgccagaatgtctctttagaacaagagttagattccccctttctccttattgccccttccgttttgacttcccctttatttatttgttgtctaattaggggccaagtctgtaaagttttgtcaaagtgagttagaagttgttttctcttactatttgtgtttaccagagttgggagataagatagtttccatgaaggtgtgtatgttttatacgatgtttgttatagggccatgcattggtaacttgaaaatagaccagcttaatgtcttcaggatgtaaaactctgaatacacggcgtctctttttcatacattgcatgtaagttgttagtacctcacaagctacagaagttcagccatgagattttgtttggcaacatgaacagatttgtgtataactgcaatggcctttttttccagatttccttattgactttttgtttgccttacctggggctagttttttatgctttgtacctagaaaacaaaaaattacattcgttgggctttttttcaaggttgggattaccacaccacctggaatatcatactgtggtttctgcctaaaattggcacatgtaagtattgaagaaaatggttatataattcagttgaaactcttggttattagatgttaggcatctcctgtatgtaagacacaaggccaaccacaacacagaacgatgttgacctgttaagtattctctgaaacatggccaaaatgcattttatgagcttttttttttttgctattgtaaatattagtggtttacaatgcgctttagacatatttctttaaaatgcaagcagtgagaaataagacctctctgaattagtagctctaaactgttaacatagaatgttacttggaaaaagtctggaatatgtggtgtacacaagcagtgcttcgtgaatgagtttcttagcttttatagtgcgccatgtttctcaaagtttgtttttgttgacaaaacattttataatatatatcttatgtttattttttttctcaactaattgtgtactgcactgtaaggtgaaaattagccatccattatttatcttctgtggcaatgcatttatatggttgattgggtggggaattttttgcagaaagatgcaaagtgattgggttttcgacttcctatcgcagggagcttttaagaaatattaatttcctatacatttttccaatccccatgcaaactgttcctgtttacataccttctctgttgtatcagtactttgagtgagaagacagtttatttaaaacttgagcaggctgttcagcattgtttctgcttctgaaatctgtatagtacactggtttgtaatcattatgtcttcattgaaatccttgctacttctcttcctcctcaatgaaatacattatatattatctttatgtactcttaagaaaaacgagcaaggaagagtatcttcattattctcattttctctgagttggaaacaaaaacatgaaggactccaactagaagacagatatttacatttaaatagattagtgggaaaactttaagagtttccacatattagttttcattttttgagtcaagagactgctccttgtactgggagacactagtagtatatgtttgtaatgttactttaaaattatctttttattttataaggcccataaatactggttaaactctgttaaaagtgggccttctatcttggatggtttcactgccatcagccatgctgatatattagaaatggcatccctatctacttactttaatgcttaaaattatacataaaatgctttatttagaaaacctacatgatacagtggtgtcagccttgccatgtatcagtttcacttgaaatttgagaccaattaaatttcaactgtttagggtggagaaagaggtactggaaaacatgcagatgaggatatcttttatgtgcaacagtatcctttgcatgggaggagagttactcttgaaaggcaggcagcttaagtggacaatgttttgtatatagttgagaattttacgacacttttaaaaattgtgtaattgttaaatgtccagttttgctctgttttgcctgaagttttagtatttgttttctaggtggacctctgaaaaccaaaccagtacctggggaggttagatgtgtgtttcaggcttggagtgtatgagtggttttgcttgtattttcctccagagattttgaactttaataattgcgtgtgtgtttttttttttttaagtggctttgtttttttttctcaagtaaaattgtgaacatatttcctttataggggcagggcatgagttagggagactgaagagtattgtagactgtacatgtgccttcttaatgtgtttctcgacacattttttttcagtaacttgaaaattcaaaagggacatttggttaggttactgtacatcaatctatgcataaatggcagcttgttttcttgagccactgtctaaattttgtttttatagaaattttttatactgattggttcatagatggtcagttttgtacacagactgaacaatacagcactttgccaaaaatgagtgtagcattgtttaaacattgtgtgttaacacctgttctttgtaattgggttgtggtgcattttgcactacctggagttacagttttcaatctgtcagtaaataaagtgtcctttaacttca

SEQ ID NO: 342530 - DNA, 2661 bp, Homo sapiens
cgatctaggtccaccaaatctcatcttgaataccacgtgttgtgagagggaccaggtgggaggtaactgagtcggtgggaggtaactgagtcatgaggacgggtcttttccgtgctgttatcatgatagtgaataagtctcatgagatctgatggttttataagtaggtgtgtatgttttatacgatgtttgttatagggccatgcattggtaacttgaaaatagaccagcttaatgtcttcaggatgtaaaactctgaatacacggcgtctctttttcatacattgcatgtaagttgttagtacctcacaagctacagaagttcagccatgagattttgtttggcaacatgaacagatttgtgtataactgcaatggcctttttttccagatttccttattgactttttgtttgccttacctggggctagttttttatgctttgtacctagaaaacaaaaaattacattcgttgggctttttttcaaggttgggattaccacaccacctggaatatcatactgtggtttctgcctaaaattggcacatgtaagtattgaagaaaatggttatataattcagttgaaactcttggttattagatgttaggcatctcctgtatgtaagacacaaggccaaccacaacacagaacgatgttgacctgttaagtattctctgaaacatggccaaaatgcattttatgagcttttttttttttgctattgtaaatattagtggtttacaatgcgctttagacatatttctttaaaatgcaagcagtgagaaataagacctctctgaattagtagctctaaactgttaacatagaatgttacttggaaaaagtctggaatatgtggtgtacacaagcagtgcttcgtgaatgagtttcttagcttttatagtgcgccatgtttctcaaagtttgtttttgttgacaaaacattttataatatatatcttatgtttattttttttctcaactaattgtgtactgcactgtaaggtgaaaattagccatccattatttatcttctgtggcaatgcatttatatggttgattgggtggggaattttttgcagaaagatgcaaagtgattgggttttcgacttcctatcgcagggagcttttaagaaatattaatttcctatacatttttccaatccccatgcaaactgttcctgtttacataccttctctgttgtatcagtactttgagtgagaagacagtttatttaaaacttgagcaggctgttcagcattgtttctgcttctgaaatctgtatagtacactggtttgtaatcattatgtcttcattgaaatccttgctacttctcttcctcctcaatgaaatacattatatattatctttatgtactcttaagaaaaacgagcaaggaagagtatcttcattattctcattttctctgagttggaaacaaaaacatgaaggactccaactagaagacagatatttacatttaaatagattagtgggaaaactttaagagtttccacatattagttttcattttttgagtcaagagactgctccttgtactgggagacactagtagtatatgtttgtaatgttactttaaaattatctttttattttataaggcccataaatactggttaaactctgttaaaagtgggccttctatcttggatggtttcactgccatcagccatgctgatatattagaaatggcatccctatctacttactttaatgcttaaaattatacataaaatgctttatttagaaaacctacatgatacagtggtgtcagccttgccatgtatcagtttcacttgaaatttgagaccaattaaatttcaactgtttagggtggagaaagaggtactggaaaacatgcagatgaggatatcttttatgtgcaacagtatcctttgcatgggaggagagttactcttgaaaggcaggcagcttaagtggacaatgttttgtatatagttgagaattttacgacacttttaaaaattgtgtaattgttaaatgtccagttttgctctgttttgcctgaagttttagtatttgttttctaggtggacctctgaaaaccaaaccagtacctggggaggttagatgtgtgtttcaggcttggagtgtatgagtggttttgcttgtattttcctccagagattttgaactttaataattgcgtgtgtgtttttttttttttaagtggctttgtttttttttctcaagtaaaattgtgaacatatttcctttataggggcagggcatgagttagggagactgaagagtattgtagactgtacatgtgccttcttaatgtgtttctcgacacattttttttcagtaacttgaaaattcaaaagggacatttggttaggttactgtacatcaatctatgcataaatggcagcttgttttcttgagccactgtctaaattttgtttttatagaaattttttatactgattggttcatagatggtcagttttgtacacagactgaacaatacagcactttgccaaaaatgagtgtagcattgtttaaacattgtgtgttaacacctgttctttgtaattgggttgtggtgcattttgcactacctggagttacagttttcaatctgtcagtaaataaagtgtcctttaacttca

SEQ ID NO: 342531 - DNA, 5575 bp, Homo sapiens
caacaacaaaaggacttggactggccggcctgggcgcacgacccgagggctggagtcggccccgcgcctgccgtctgggtacctgaacgaggtgcagcgcagcccggccccaccgcagctacctcagcagtcccgccccgcccgcgtccttccccgccgagccggcccgctcccttccccgcgcagccccgcacggcccgggcccacgtacaatgactcttcttgcttttcacctaagttgaataagcaccctgtgcactttaatctcctgtcggtaccattgggccaactaaagacaaggttttgaaatctcagctataaaagacatccagccaaactctcagtcttgccttaacaatgttccagaggctgaataaaatgtttgtgggtgaagtcagttcttcctccaaccaagaaccagaattcaatgagaaagaagatgatgaatggattcttgttgacttcatagatacttgcactggtttctcagcagaagaagaagaagaagaggaggacatcagtgaagagtcacctactgagcacccttcagtcttttcctgtttaccggcatctcttgagtgcttggctgatacaagtgattcctgctttctccagtttgagtcatgtccaatggaggagagctggtttatcaccccacccccatgttttactgcaggtggattaaccactatcaaggtggaaacaagtcctatggaaaaccttctcattgaacatcccagcatgtctgtctatgctgtgcataactcctgccctggtctcagtgaggccacccgtgggactgatgaattacatagcccaagtagtcccagggccaggaaaagctgcttataagactcacgggcacagaagtggaagctcaaaatgaaatggggcagcatattcattgttatgttgcagctcttgctgctcatacaacttttctggaacaacccaagagctttcgcccttcccagtggataaaagaacacagtgaaagacagcctcttaacagaaatagccttcgtcgccaaaatcttaccagggattgccaccctcggcaagtcaagcacaatggctgggttgttcatcagccctgcccgcgtcagtacaattactaatagtttcaagttttgttggttggtttctcttggtttgtgcttacatgtatggatgtgtgtatatgtacagtgaaaatgttgtctctttacaaccaattgataaccaatcacatagttttatcagtgtatttagacactatcttgaaaatcagatttatatgctgtgtatcacataatgccttgcctttaacatttactttttttgtacactttttcagattatttctggaaacatatcaatataattacagtgtttgggggtgtctttaaatatattaggttatacattagtcagcattttaaagacatttcttcccaagtacgagaataggcatctttcattttcattttattttgtattacttaatcttttaagcaagcaaaaatttattctcagggtcagctgtacactttattgaccagtacttgataatctctctgtatatgatgaatacatttttatacactaacattagcattaacaggtgatagttgccatggatataatggaattatggctggactttcttttgaaagaaaacttgatgtattctgtgtgtatggtttttccccagattagtcatacagttcatttggaattcaggtacattaagctttagtgaagagtgcatgcagtaattccaatgtgactgcatgacgtggtacagacattacaggtgttgtagacagaggcacttgtctcgtgcagagggattaaattagacctgtgagattatatttggaaaaattcatgtctgtaactaacccattagtgcagtatttaatttgttactattccttcccgccaattctgtccactcctcacctcgcatcagctataaatttggaagtacttgtccaggcactcaagtgacttcatatttctctctgcccatgggaaaagagataggctttatatttccacagagtgaaaaatcctctgtcatggagcctgtcctgccaagtggcaagagtgtggggactgtctggtgatgatgtctttcatggcatctgagtgaagagtgacaggttggctcaacttttttctttttttttttttaattgccttgtattgtaagtattcttccctgcagtccaagtgacttttcattttttgttttaacttcaggcaaaatctttaaccactctggcctctgtttcccccaccaacggggagcagtgacatttacctccctcacagagtcactgtgaggattctatactgatttgaagtggagctgttcagaactgaaccttgtaggaaattccaagggcctttctactgaatctggtgatggggtggggccgtggcactttctctgccacagctgttcttcacagtgttggtgctaatgaggccagggtgcagggttcgattcacacgtaggccagttaacttagagaaaatctatttccttacctctagccagtcacttcctttttccgcagttgtgatgggttttgctgagccatccactctgactgatttcctctgaagtaaacatatttacaatccaaagcaattctactgacagaagtgttgccttcataatcaaacagcttgtttttccatctcctctgcaaccctaattaaatgagtacaggtctacaaaatgttttcaaggagaaaagcagcatatccttaagtgaagtattatatttttcaataaccctgtagtggcttgatgcagggaaccctgggggactttcagcgaagagctgtgctcttttctgactagattagagcgtttggagtggaagacgtcaaatgtgtagtgagatggaggttttacattgttcttctactggctgtgatgaagtgccagaatgtctctttagaacaagagttagattccccctttctccttattgccccttccgttttgacttcccctttatttatttgttgtctaattaggggccaagtctgtaaagttttgtcaaagtgagttagaagttgttttctcttactatttgtgtttaccagagttgggagataagatagtttccatgaaggtgtgtatgttttatacgatgtttgttatagggccatgcattggtaacttgaaaatagaccagcttaatgtcttcaggatgtaaaactctgaatacacggcgtctctttttcatacattgcatgtaagttgttagtacctcacaagctacagaagttcagccatgagattttgtttggcaacatgaacagatttgtgtataactgcaatggcctttttttccagatttccttattgactttttgtttgccttacctggggctagttttttatgctttgtacctagaaaacaaaaaattacattcgttgggctttttttcaaggttgggattaccacaccacctggaatatcatactgtggtttctgcctaaaattggcacatgtaagtattgaagaaaatggttatataattcagttgaaactcttggttattagatgttaggcatctcctgtatgtaagacacaaggccaaccacaacacagaacgatgttgacctgttaagtattctctgaaacatggccaaaatgcattttatgagcttttttttttttgctattgtaaatattagtggtttacaatgcgctttagacatatttctttaaaatgcaagcagtgagaaataagacctctctgaattagtagctctaaactgttaacatagaatgttacttggaaaaagtctggaatatgtggtgtacacaagcagtgcttcgtgaatgagtttcttagcttttatagtgcgccatgtttctcaaagtttgtttttgttgacaaaacattttataatatatatcttatgtttattttttttctcaactaattgtgtactgcactgtaaggtgaaaattagccatccattatttatcttctgtggcaatgcatttatatggttgattgggtggggaattttttgcagaaagatgcaaagtgattgggttttcgacttcctatcgcagggagcttttaagaaatattaatttcctatacatttttccaatccccatgcaaactgttcctgtttacataccttctctgttgtatcagtactttgagtgagaagacagtttatttaaaacttgagcaggctgttcagcattgtttctgcttctgaaatctgtatagtacactggtttgtaatcattatgtcttcattgaaatccttgctacttctcttcctcctcaatgaaatacattatatattatctttatgtactcttaagaaaaacgagcaaggaagagtatcttcattattctcattttctctgagttggaaacaaaaacatgaaggactccaactagaagacagatatttacatttaaatagattagtgggaaaactttaagagtttccacatattagttttcattttttgagtcaagagactgctccttgtactgggagacactagtagtatatgtttgtaatgttactttaaaattatctttttattttataaggcccataaatactggttaaactctgttaaaagtgggccttctatcttggatggtttcactgccatcagccatgctgatatattagaaatggcatccctatctacttactttaatgcttaaaattatacataaaatgctttatttagaaaacctacatgatacagtggtgtcagccttgccatgtatcagtttcacttgaaatttgagaccaattaaatttcaactgtttagggtggagaaagaggtactggaaaacatgcagatgaggatatcttttatgtgcaacagtatcctttgcatgggaggagagttactcttgaaaggcaggcagcttaagtggacaatgttttgtatatagttgagaattttacgacacttttaaaaattgtgtaattgttaaatgtccagttttgctctgttttgcctgaagttttagtatttgttttctaggtggacctctgaaaaccaaaccagtacctggggaggttagatgtgtgtttcaggcttggagtgtatgagtggttttgcttgtattttcctccagagattttgaactttaataattgcgtgtgtgtttttttttttttaagtggctttgtttttttttctcaatgaagagtattgtagactgtacatgtgccttcttaatgtgtttctcgacacattttttttcagtaacttgaaaattcaaaagggacatttggttaggttactgtacatcaatctatgcataaatggcagcttgttttcttgagccactgtctaaattttgtttttatagaaattttttatactgattggttcatagatggtcagttttgtacacagactgaacaatacagcactttgccaaaaatgagtgtagcattgtttaaacattgtgtgttaacacctgttctttgtaattgggttgtggtgcattttgcactacctggagttacagttttcaatctgtcagtaaataaagtgtcctttaacttca

SEQ ID NO: 342532 - DNA, 5628 bp, Homo sapiens
caacaacaaaaggacttggactggccggcctgggcgcacgacccgagggctggagtcggccccgcgcctgccgtctgggtacctgaacgaggtgcagcgcagcccggccccaccgcagctacctcagcagtcccgccccgcccgcgtccttccccgccgagccggcccgctcccttccccgcgcagccccgcacggcccgggcccacgtacaatgactcttcttgcttttcacctaagttgaataagcaccctgtgcactttaatctcctgtcggtaccattgggccaactaaagacaaggttttgaaatctcagctataaaagacatccagccaaactctcagtcttgccttaacaatgttccagaggctgaataaaatgtttgtgggtgaagtcagttcttcctccaaccaagaaccagaattcaatgagaaagaagatgatgaatggattcttgttgacttcatagatacttgcactggtttctcagcagaagaagaagaagaagaggaggacatcagtgaagagtcacctactgagcacccttcagtcttttcctgtttaccggcatctcttgagtgcttggctgatacaagtgattcctgctttctccagtttgagtcatgtccaatggaggagagctggtttatcaccccacccccatgttttactgcaggtggattaaccactatcaaggtggaaacaagtcctatggaaaaccttctcattgaacatcccagcatgtctgtctatgctgtgcataactcctgccctggtctcagtgaggccacccgtgggactgatgaattacatagcccaagtagtcccagggccaggaaaagctgcttataagactcacgggcacagaagtggaagctcaaaatgaaatggggcagcatattcattgttatgttgcagctcttgctgctcatacaacttttctggaacaacccaagagctttcgcccttcccagtggataaaagaacacagtgaaagacagcctcttaacagaaatagccttcgtcgccaaaatcttaccagggattgccaccctcggcaagtcaagcacaatggctgggttgttcatcagccctgcccgcgtcagtacaattactaatagtttcaagttttgttggttggtttctcttggtttgtgcttacatgtatggatgtgtgtatatgtacagtgaaaatgttgtctctttacaaccaattgataaccaatcacatagttttatcagtgtatttagacactatcttgaaaatcagatttatatgctgtgtatcacataatgccttgcctttaacatttactttttttgtacactttttcagattatttctggaaacatatcaatataattacagtgtttgggggtgtctttaaatatattaggttatacattagtcagcattttaaagacatttcttcccaagtacgagaataggcatctttcattttcattttattttgtattacttaatcttttaagcaagcaaaaatttattctcagggtcagctgtacactttattgaccagtacttgataatctctctgtatatgatgaatacatttttatacactaacattagcattaacaggtgatagttgccatggatataatggaattatggctggactttcttttgaaagaaaacttgatgtattctgtgtgtatggtttttccccagattagtcatacagttcatttggaattcaggtacattaagctttagtgaagagtgcatgcagtaattccaatgtgactgcatgacgtggtacagacattacaggtgttgtagacagaggcacttgtctcgtgcagagggattaaattagacctgtgagattatatttggaaaaattcatgtctgtaactaacccattagtgcagtatttaatttgttactattccttcccgccaattctgtccactcctcacctcgcatcagctataaatttggaagtacttgtccaggcactcaagtgacttcatatttctctctgcccatgggaaaagagataggctttatatttccacagagtgaaaaatcctctgtcatggagcctgtcctgccaagtggcaagagtgtggggactgtctggtgatgatgtctttcatggcatctgagtgaagagtgacaggttggctcaacttttttctttttttttttttaattgccttgtattgtaagtattcttccctgcagtccaagtgacttttcattttttgttttaacttcaggcaaaatctttaaccactctggcctctgtttcccccaccaacggggagcagtgacatttacctccctcacagagtcactgtgaggattctatactgatttgaagtggagctgttcagaactgaaccttgtaggaaattccaagggcctttctactgaatctggtgatggggtggggccgtggcactttctctgccacagctgttcttcacagtgttggtgctaatgaggccagggtgcagggttcgattcacacgtaggccagttaacttagagaaaatctatttccttacctctagccagtcacttcctttttccgcagttgtgatgggttttgctgagccatccactctgactgatttcctctgaagtaaacatatttacaatccaaagcaattctactgacagaagtgttgccttcataatcaaacagcttgtttttccatctcctctgcaaccctaattaaatgagtacaggtctacaaaatgttttcaaggagaaaagcagcatatccttaagtgaagtattatatttttcaataaccctgtagtggcttgatgcagggaaccctgggggactttcagcgaagagctgtgctcttttctgactagattagagcgtttggagtggaagacgtcaaatgtgtagtgagatggaggttttacattgttcttctactggctgtgatgaagtgccagaatgtctctttagaacaagagttagattccccctttctccttattgccccttccgttttgacttcccctttatttatttgttgtctaattaggggccaagtctgtaaagttttgtcaaagtgagttagaagttgttttctcttactatttgtgtttaccagagttgggagataagatagtttccatgaaggtgtgtatgttttatacgatgtttgttatagggccatgcattggtaacttgaaaatagaccagcttaatgtcttcaggatgtaaaactctgaatacacggcgtctctttttcatacattgcatgtaagttgttagtacctcacaagctacagaagttcagccatgagattttgtttggcaacatgaacagatttgtgtataactgcaatggcctttttttccagatttccttattgactttttgtttgccttacctggggctagttttttatgctttgtacctagaaaacaaaaaattacattcgttgggctttttttcaaggttgggattaccacaccacctggaatatcatactgtggtttctgcctaaaattggcacatgtaagtattgaagaaaatggttatataattcagttgaaactcttggttattagatgttaggcatctcctgtatgtaagacacaaggccaaccacaacacagaacgatgttgacctgttaagtattctctgaaacatggccaaaatgcattttatgagcttttttttttttgctattgtaaatattagtggtttacaatgcgctttagacatatttctttaaaatgcaagcagtgagaaataagacctctctgaattagtagctctaaactgttaacatagaatgttacttggaaaaagtctggaatatgtggtgtacacaagcagtgcttcgtgaatgagtttcttagcttttatagtgcgccatgtttctcaaagtttgtttttgttgacaaaacattttataatatatatcttatgtttattttttttctcaactaattgtgtactgcactgtaaggtgaaaattagccatccattatttatcttctgtggcaatgcatttatatggttgattgggtggggaattttttgcagaaagatgcaaagtgattgggttttcgacttcctatcgcagggagcttttaagaaatattaatttcctatacatttttccaatccccatgcaaactgttcctgtttacataccttctctgttgtatcagtactttgagtgagaagacagtttatttaaaacttgagcaggctgttcagcattgtttctgcttctgaaatctgtatagtacactggtttgtaatcattatgtcttcattgaaatccttgctacttctcttcctcctcaatgaaatacattatatattatctttatgtactcttaagaaaaacgagcaaggaagagtatcttcattattctcattttctctgagttggaaacaaaaacatgaaggactccaactagaagacagatatttacatttaaatagattagtgggaaaactttaagagtttccacatattagttttcattttttgagtcaagagactgctccttgtactgggagacactagtagtatatgtttgtaatgttactttaaaattatctttttattttataaggcccataaatactggttaaactctgttaaaagtgggccttctatcttggatggtttcactgccatcagccatgctgatatattagaaatggcatccctatctacttactttaatgcttaaaattatacataaaatgctttatttagaaaacctacatgatacagtggtgtcagccttgccatgtatcagtttcacttgaaatttgagaccaattaaatttcaactgtttagggtggagaaagaggtactggaaaacatgcagatgaggatatcttttatgtgcaacagtatcctttgcatgggaggagagttactcttgaaaggcaggcagcttaagtggacaatgttttgtatatagttgagaattttacgacacttttaaaaattgtgtaattgttaaatgtccagttttgctctgttttgcctgaagttttagtatttgttttctaggtggacctctgaaaaccaaaccagtacctggggaggttagatgtgtgtttcaggcttggagtgtatgagtggttttgcttgtattttcctccagagattttgaactttaataattgcgtgtgtgtttttttttttttaagtggctttgtttttttttctcaagtaaaattgtgaacatatttcctttataggggcagggcatgagttagggagactgaagagtattgtagactgtacatgtgccttcttaatgtgtttctcgacacattttttttcagtaacttgaaaattcaaaagggacatttggttaggttactgtacatcaatctatgcataaatggcagcttgttttcttgagccactgtctaaattttgtttttatagaaattttttatactgattggttcatagatggtcagttttgtacacagactgaacaatacagcactttgccaaaaatgagtgtagcattgtttaaacattgtgtgttaacacctgttctttgtaattgggttgtggtgcattttgcactacctggagttacagttttcaatctgtcagtaaataaagtgtcctttaacttca

SEQ ID NO: 342533 - DNA, 663 bp, Homo sapiens
caacaacaaaaggacttggactggccggcctgggcgcacgacccgagggctggagtcggccccgcgcctgccgtctgggtacctgaacgaggtgcagcgcagcccggccccaccgcagctacctcagcagtcccgccccgcccgcgtccttccccgccgagccggcccgctcccttccccgcgcagccccgcacggcccgggcccacgtacaatgactcttcttgcttttcacctaagttgaataagcaccctgtgcactttaatctcctgtcggtaccattgggccaactaaagacaaggttttgaaatctcagctataaaagacatccagccaaactctcagtcttgccttaacaatgttccagaggctgaataaaatgtttgtgggtgaagtcagttcttcctccaaccaagaaccagaattcaatgagaaagaagatgatgaatggattcttgttgacttcataggtaaggtacacttggttacttggtggttcatcttcacagtaaaaatggaaacttgcatctcagtttttgcataaggaaaccaataactgaggggttttcagccttaaaagtaagcaggagtttgtctttaaaaaattgcaggaaaccatctgtgctagataatgtcagtgaaattgactgacatcagacttttt

SEQ ID NO: 342534 - DNA, 5574 bp, Homo sapiens
caacaacaaaaggacttggactggccggcctgggcgcacgacccgagggctggagtcggccccgcgcctgccgtctgggtacctgaacgaggtgcagcgcagcccggccccaccgcagctacctcagcagtcccgccccgcccgcgtccttccccgccgagccggcccgctcccttccccgcgcagccccgcacggcccgggcccacgtacaatgactcttcttgcttttcacctaagttgaataagcaccctgtgcactttaatctcctgtcggtaccattgggccaactaaagacaaggttttgaaatctcagctataaaagacatccagccaaactctcagtcttgccttaacaatgttccagaggctgaataaaatgtttgtgggtgaagtcagttcttcctccaaccaagaaccagaattcaatgagaaagaagatgatgaatggattcttgttgacttcatagatacttgcactggtttctcagcagaagaagaagaagaagaggaggacatcagtgaagagtcacctactgagcacccttcagtcttttcctgtttaccggcatctcttgagtgcttggctgatacaagtgattcctgctttctccagtttgagtcatgtccaatggaggagagctggtttatcaccccacccccatgttttactgcaggtggattaaccactatcaaggtggaaacaagtcctatggaaaaccttctcattgaacatcccagcatgtctgtctatgctgtgcataactcctgccctggtctcagtgaggccacccgtgggactgatgaattacatagcccaagtagtcccagggccaggaaaagctgcttataagactcacgggcacagaagtggaagctcaaaatgaaatggggcagcatattcattgttatgttgcagctcttgctgctcatacaacttttctggaacaacccaagagctttcgcccttcccagtggataaaagaacacagtgaaagacagcctcttaacagaaatagccttcgtcgccaaaatcttaccagggattgccaccctcggcaagtcaagcacaatggctgggttgttcatcagccctgcccgcgtcagtacaattactaatagtttcaagttttgttggttggtttctcttggtttgtgcttacatgtatggatgtgtgtatatgtacagtgaaaatgttgtctctttacaaccaattgataaccaatcacatagttttatcagtgtatttagacactatcttgaaaatcagatttatatgctgtgtatcacataatgccttgcctttaacatttactttttttgtacactttttcagattatttctggaaacatatcaatataattacagtgtttgggggtgtctttaaatatattaggttatacattagtcagcattttaaagacatttcttcccaagtacgagaataggcatctttcattttcattttattttgtattacttaatcttttaagcaagcaaaaatttattctcagggtcagctgtacactttattgaccagtacttgataatctctctgtatatgatgaatacatttttatacactaacattagcattaacaggtgatagttgccatggatataatggaattatggctggactttcttttgaaagaaaacttgatgtattctgtgtgtatggtttttccccagattagtcatacagttcatttggaattcaggtacattaagctttagtgaagagtgcatgcagtaattccaatgtgactgcatgacgtggtacagacattacaggtgttgtagacagaggcacttgtctcgtgcagagggattaaattagacctgtgagattatatttggaaaaattcatgtctgtaactaacccattagtgcagtatttaatttgttactattccttcccgccaattctgtccactcctcacctcgcatcagctataaatttggaagtacttgtccaggcactcaagtgacttcatatttctctctgcccatgggaaaagagataggctttatatttccacagagtgaaaaatcctctgtcatggagcctgtcctgccaagtggcaagagtgtggggactgtctggtgatgatgtctttcatggcatctgagtgaagagtgacaggttggctcaacttttttctttttttttttttaattgccttgtattgtaagtattcttccctgcagtccaagtgacttttcattttttgttttaacttcaggcaaaatctttaaccactctggcctctgtttcccccaccaacggggagcagtgacatttacctccctcacagagtcactgtgaggattctatactgatttgaagtggagctgttcagaactgaaccttgtaggaaattccaagggcctttctactgaatctggtgatggggtggggccgtggcactttctctgccacagctgttcttcacagtgttggtgctaatgaggccagggtgcagggttcgattcacacgtaggccagttaacttagagaaaatctatttccttacctctagccagtcacttcctttttccgcagttgtgatgggttttgctgagccatccactctgactgatttcctctgaagtaaacatatttacaatccaaagcaattctactgacagaagtgttgccttcataatcaaacagcttgtttttccatctcctctgcaaccctaattaaatgagtacaggtctacaaaatgttttcaaggagcttgatgcagggaaccctgggggactttcagcgaagagctgtgctcttttctgactagattagagcgtttggagtggaagacgtcaaatgtgtagtgagatggaggttttacattgttcttctactggctgtgatgaagtgccagaatgtctctttagaacaagagttagattccccctttctccttattgccccttccgttttgacttcccctttatttatttgttgtctaattaggggccaagtctgtaaagttttgtcaaagtgagttagaagttgttttctcttactatttgtgtttaccagagttgggagataagatagtttccatgaaggtgtgtatgttttatacgatgtttgttatagggccatgcattggtaacttgaaaatagaccagcttaatgtcttcaggatgtaaaactctgaatacacggcgtctctttttcatacattgcatgtaagttgttagtacctcacaagctacagaagttcagccatgagattttgtttggcaacatgaacagatttgtgtataactgcaatggcctttttttccagatttccttattgactttttgtttgccttacctggggctagttttttatgctttgtacctagaaaacaaaaaattacattcgttgggctttttttcaaggttgggattaccacaccacctggaatatcatactgtggtttctgcctaaaattggcacatgtaagtattgaagaaaatggttatataattcagttgaaactcttggttattagatgttaggcatctcctgtatgtaagacacaaggccaaccacaacacagaacgatgttgacctgttaagtattctctgaaacatggccaaaatgcattttatgagcttttttttttttgctattgtaaatattagtggtttacaatgcgctttagacatatttctttaaaatgcaagcagtgagaaataagacctctctgaattagtagctctaaactgttaacatagaatgttacttggaaaaagtctggaatatgtggtgtacacaagcagtgcttcgtgaatgagtttcttagcttttatagtgcgccatgtttctcaaagtttgtttttgttgacaaaacattttataatatatatcttatgtttattttttttctcaactaattgtgtactgcactgtaaggtgaaaattagccatccattatttatcttctgtggcaatgcatttatatggttgattgggtggggaattttttgcagaaagatgcaaagtgattgggttttcgacttcctatcgcagggagcttttaagaaatattaatttcctatacatttttccaatccccatgcaaactgttcctgtttacataccttctctgttgtatcagtactttgagtgagaagacagtttatttaaaacttgagcaggctgttcagcattgtttctgcttctgaaatctgtatagtacactggtttgtaatcattatgtcttcattgaaatccttgctacttctcttcctcctcaatgaaatacattatatattatctttatgtactcttaagaaaaacgagcaaggaagagtatcttcattattctcattttctctgagttggaaacaaaaacatgaaggactccaactagaagacagatatttacatttaaatagattagtgggaaaactttaagagtttccacatattagttttcattttttgagtcaagagactgctccttgtactgggagacactagtagtatatgtttgtaatgttactttaaaattatctttttattttataaggcccataaatactggttaaactctgttaaaagtgggccttctatcttggatggtttcactgccatcagccatgctgatatattagaaatggcatccctatctacttactttaatgcttaaaattatacataaaatgctttatttagaaaacctacatgatacagtggtgtcagccttgccatgtatcagtttcacttgaaatttgagaccaattaaatttcaactgtttagggtggagaaagaggtactggaaaacatgcagatgaggatatcttttatgtgcaacagtatcctttgcatgggaggagagttactcttgaaaggcaggcagcttaagtggacaatgttttgtatatagttgagaattttacgacacttttaaaaattgtgtaattgttaaatgtccagttttgctctgttttgcctgaagttttagtatttgttttctaggtggacctctgaaaaccaaaccagtacctggggaggttagatgtgtgtttcaggcttggagtgtatgagtggttttgcttgtattttcctccagagattttgaactttaataattgcgtgtgtgtttttttttttttaagtggctttgtttttttttctcaagtaaaattgtgaacatatttcctttataggggcagggcatgagttagggagactgaagagtattgtagactgtacatgtgccttcttaatgtgtttctcgacacattttttttcagtaacttgaaaattcaaaagggacatttggttaggttactgtacatcaatctatgcataaatggcagcttgttttcttgagccactgtctaaattttgtttttatagaaattttttatactgattggttcatagatggtcagttttgtacacagactgaacaatacagcactttgccaaaaatgagtgtagcattgtttaaacattgtgtgttaacacctgttctttgtaattgggttgtggtgcattttgcactacctggagttacagttttcaatctgtcagtaaataaagtgtcctttaacttca

SEQ ID NO: 342535 - DNA, 1111 bp, Homo sapiens
caacaacaaaaggacttggactggccggcctgggcgcacgacccgagggctggagtcggccccgcgcctgccgtctgggtacctgaacgaggtgcagcgcagcccggccccaccgcagctacctcagcagtcccgccccgcccgcgtccttccccgccgagccggcccgctcccttccccgcgcagccccgcacggcccgggcccacgtacaatgactcttcttgcttttcacctaagttgaataagcaccctgtgcactttaatctcctgtcggtaccattgggccaactaaagacaaggttttgaaatctcagctataaaagacatccagccaaactctcagtcttgccttaacaatgttccagaggctgaataaaatgtttgtgggtgaagtcagttcttcctccaaccaagaaccagaattcaatgagaaagaagatgatgaatggattcttgttgacttcatagatacttgcactggtttctcagcagaagaagaagaagaagaggaggacatcagtgaagagtcacctactgagcacccttcagtcttttcctgtttaccggcatctcttgagtgcttggctgatacaagtgattcctgctttctccagtttgagtcatgtccaatggaggagagctggtttatcaccccacccccatgttttactgcaggtggattaaccactatcaaggtggaaacaagtcctatggaaaaccttctcattgaacatcccagcatgtctgtctatgctgtgcataactcctgccctggtctcagtgaggccacccgtgggactgatgaattacatagcccaagtagtcccaggtacgttacaagtatttaactctctgtaggcagtccactgagcatgcattttgtctctactgtaattcaaagctaagttattagaagatgcaaaactaattttgttagagatttatgaaagcatgtgcatagtacacaagatggtccgtaagataacttgttgaccagtcacagtgtctcacacctgtaatcccagcactttgggaggccaaggcaggcagatcacttaagctcaggagttcaagaccaccctgggcaacatggtgaaaccccgtctgtac

SEQ ID NO: 342536 - DNA, 1560 bp, Homo sapiens
gcccagttccaaggctccggcatcctgtgtctcactgagcactgctgcccgatggccatccccaagcactccctgagcccagtgccgtgggaagaggacagcttccttcaagtgaaggtggaggaggaagaggaagccagcctctcccagggcggagaatccagccatgaccacattgctcactctgaggctgcacgcctgcgcttccggcacttccgctatgaggaggcatctggtccacacgaggccctggcccacctccgagcgctgtgctgtcagtggctgcagcccgaggcgcactccaaggagcagatactggagctgctggtgctggagcagttcctgggtgcgctgcccccagagatccaagcctgggtgggagcccagagtcccaagagcggagaggaagccgctgtgctggtggaggatctgactcaggtgctggacaagagaggatgggatccaggagccgagcccacagaggcaagctgcaagcagagtgacctgggagagtcagagccatcaaatgtcactgagaccctcatgggaggtgtttcccttggacccgcctttgtcaaggcatgtgaacctgagggcagctcagagaggtctggactatcaggggagatctggacaaagtctgtcacccaacagatccacttcaagaaaacttcagggccttacaaggatgtccccacagaccagcgtggccgtgaatctggtgcctcgaggaacagttctagtgcgtggccaaacctcacctcccaagagaagcctccttcagaagacaaatttgatctggtggatgcttatgggacagagcctccatacacctactcagggaagaggtcctccaagtgtcgcgagtgtaggaagatgttccagagtgcttcggcgctcgaggcacaccagaagacccattctcggaagaccccatatgcctgcagcgagtgtgggaaagccttcagccggagcactcacctcgcccagcaccaggttgtccacacaggggcgaagccccatgagtgtaaggaatgtgggaaggccttcagccgagtcacccacctgactcagcaccaaaggattcatactggagagaaaccctacaaatgtggggaatgtggtaaaaccttcagccgcagcactcacctcacccagcaccagcgggtgcacacgggggagcggccctacgagtgtgacgcgtgtgggaaagccttcagccagagcacgcacctgactcaacaccagcgcatccacaccggggagaagccctacaagtgtgacgcgtgtggccgagccttcagcgactgctcagccctgatccgacatctgagaatccactctggagagaagccatatcagtgtaaggttgtccgaaggcctttgcacagagctcctccctcattgagcaccagaggatccacacgggagagaagccttataagtgcagcgactgtgggaaggccttcagtcgtagctcagccctgatggttcacttgcggatccacatcacggtgctgcaatgaccggaagtcgcccctgggggcgtagcacagcgtc

SEQ ID NO: 342537 - DNA, 421 bp, Homo sapiens
tctaaaacagaatatgcttatatactgtgaagaattgtattcaccactgtctttgataaattagtgtcagagagcagttatatgaaagttaaatacaatttcatcattatcattaatttttataaataaattctgaaaaccttcttgctcttgaaagcaccaggagtctttgcataattagagaactatcacattttgccacttttattgtctagtaataaatggttttgttagataaatgatataatattctttcataattcaagagactatcaagtgaagggcagttgacttctgctagacatttaaatagtttgcatccaacactctgctgttaaaatagtgaatagattgtattaagcttgagactgccaagtagtgcaggcgatcttggtaatgttaggacttcacgttcaaggaa

SEQ ID NO: 342538 - DNA, 236 bp, Homo sapiens
cagcagtcattactacacaacagggtcaaaagtcctagatcagaatcatcaatctactgctctccataccaagttttataaattataaatctattttatcatctgaaaaaaaagaaaatacccaacctttcaaacaatggttgtaagcattaaaaagacaataaattccccaataaattctgaagcattaactattttatcaatattctagacttggaggtatatagaactcacct

SEQ ID NO: 342539 - DNA, 659 bp, Homo sapiens
aaagtaaaagacaagccaaatatttgtaaatcatatatctgacacgggtcttctatctagtacatataaataactattacaactcactaataagaagaaaaatagctcaattttgaagtacttaaacagacatttctccaaagaagacataccaatgacctaagaagaacatgaaatgttcaacatcattggccattaggcaaatgtaaatcgaaatcacaataagataccacttaacatccagtatgatggctaaaaacaaaaagtcagatgagttttaaggagtgtgtggaaaaactgaaatgctcatagactgatagtgggatgtataatggtgcagccactttggaaaccagtagggaggttcctcaaaaaattaaacacggagtagtaaccatatgctccaacaattctgttccttgatatatttgtaagaaaagtgaaaatatatatctatacaaaacttatatatattcatatccttgtttctaatagtcaaaagacagaaacaatccaaacgtccatcagctgatgaatggataaacaaaaggtgatgtatgcatacaacattcagccataaaaagaaatgaaatactgatacacacaacacaaatgatccttaaaaacattatgctaagtgaaagaaaccagtcacaaaa

SEQ ID NO: 342540 - DNA, 211 bp, Homo sapiens
tcctaatccttctaccatttctttctctttttcttttttgtttgagatggagtctcgctcccattcccattgcacaggctggagtgcagtcgcgctatcttggctcactgcaacctccatctcctgggttcaagcgattcttcttcctcagcctcccgagtagctgggattacagacgtgcgccaccacatctagctaatttttgtatttt

SEQ ID NO: 342541 - DNA, 1446 bp, Homo sapiens
cggtttccatttcagtttgtcttagagtttccatgtctctgcctacagtgggcatcagtttttgaatgtcgtgtagttttttccattaaagcccttagcacattaattatagttactaaattctcacagtgatgattccaaaatctctgccatatatgagtctggttttgatgcccgcgttgtcttttcagactctgttttttgcctttagcatgccttgtaattttttttttttttttgataagctggatgtgacataaggggtaaaaagaactgagataaacaggcctttagtgtggcctagaggcctatctggctaggagttaggctgtgtttactgtttgatgtagctttggtgtcagagattaaaatttcctctcgtgtaactgcttttgtctcctttgttgtctttgggtttccctaataactccttcataagtaggttccgaggcttgtagttatttaagctgtaagtccctgttattacacaggagccctattgatgtggtgtgtgtgtgtgtaaaagtgttctataatcttatgattagctcttagtgagcctgtgtctttggactgtgaccttcatgagtgctttttagctcctgcaacctttacctcccaatacttaagtgagaaagtaggaaggctgggaggcggctggagttttgtatttctcttcccacaagttggttagttggtggataacaaactggaatgtgaaacctcggatgaggggaggctactgtagtttcttttgaggacaggtctttgttattgagaacagagatcgctgggcaatttcagaatggttattttttctctcctattggaagctagagggaatttttctttgatcttcacttgtgaatctctgatggggcacctggaggtaaaactcaggaaagtttcctctgtctctcccccagccagactgcccatcccctgagcttttaattctcaagctagtccacgttgaacctccagcaatttacattacagtgttcctatggatactggctccagctgtttgtttctcttgctggggtttgtgatacccgtagctgtggttttctgtagtcacatctctctccagttttgggagcagcagtttgccctgaacctcaattctctattgggtctaagaagagttaactgattttcggccgggcacggtggctcacgccagtaatcccagcgctttgggaggccgaggtgggcggatcaccaggtcaggagatccagaatatcctggctaacatggtgaggcactgtctctactaaaaatacaaaaaaattagctgggcgtggtggcgggcacctgtattcccagctgcttgggagacagagccaggagaatggcgtgaacctgggaggcggagcttgcagtgagccgagatcctgccactgcattcctgcctgggcgacaaagccagactccgtcccagg

SEQ ID NO: 342542 - DNA, 319 bp, Homo sapiens
cactgcaccccagcctgagttacggagcaagaccctgtcatttgttgttgttttctctctcttcttagataaaatttctgtttgtgacacaaacagccattagagagaaatgattagctattatacttctcagtggtggttagcaatggtctataattattcatttctattaggagccattagccattaattccatgtattagaattttgagagcagcttgaccacattgattcctgggtctacatttaaaatagatgtgagagagagagagagacagagagagagagagagagagagagagagagagagagagagaga

SEQ ID NO: 342543 - DNA, 893 bp, Homo sapiens
tcctgagagcgagggaagcaggggatgtgacctgccctggtatgttgctgtaatctgcctgggactctggctgttctgtggagaaatcattagagcagcatgggtagacagggaggctagttcggaagctttgttgtagtggacaggatttggacatgatctgcatattctggttagtcttggtgctggatggaatgaagaggggctggaagagggcagcgttcaggatgacccctgagcttctggtttgccttactggtgagatggcaatgccattttcagagctggggagccctggaaaggggccaggtctgtaaggtagaccccaagtccagtggtaaaagctgagacatcccaatgcagatggagaagaaacagctgaaggcacagctccagagcacaaggtgagaaattatggagaccagtccagggctccagggggctcccaaatggaaatatggatccagatgttgacaggcttctggggcatttttaggcgaggggatggctgaggacaaaaaaatcaagcccaaggagcaccaacatttggagattagaaaagagaagaagaatcctctgagagcactgaaaagaaagagccgggaggtgtctcagcagaaagacagggtggtcagcagtgggtgtgtgcagagaggtcaggaggaccagggcaatccctgaactactccagtgtgcacctgcacaacctccatggtgcctctggaattgggtagcatggtggccctgctgatgagcaccccaaggggccattgggggacctctgagaatctctgccagagcagtttgggtgggagtcgattaaggaaagaagcagcaagatccaggacttttaatcttaaaagagagagaaatgctggcagatgaacattctg

SEQ ID NO: 342544 - DNA, 311 bp, Homo sapiens
cacttgctgcttccagacaaggttataacaggatgtgtccaagggctgggtttaatggtgagtctgctgattacaaaatgatgttatgtaacactttccattgcttttcagacatccattcattcattcactcattcattcaacaaatacggtctgtgttgagtacttaatagtctgctagcttcagttcttggaactagaaaaacagtagtgaatggaaaatctccttgctccttggggcttacatactagaaagaaagagcaatcctaaatgaataaattacagaaagagagagagagagagagagaga

SEQ ID NO: 342545 - DNA, 446 bp, Homo sapiens
aagcctctgttctagcgtttgtatgccacaaactatctgtgtgacctagagtcttcatctgtcgtcatctttagaatcacttgtcttgtagctctgactcagtgactcagtttattctggtcttattttttaaaaacttatttctactatggccttaaagtcagtttcttgaaaataagccaatgcagtcaccagataggatgaactgggaagtgttgtgaaataagccaccttctgtggcttcagttatttgcttggctatatgttctttctttactctggtagagttacattagattttctacccacaccaggttaggactagataattttttaatttagagacagatttaaacctatcactgaattagcatttattgaatactaatggtattgttaaggaatttagatttgatatggcacttcaagaagccagtgtggaaaga

SEQ ID NO: 342546 - DNA, 352 bp, Homo sapiens
catatcacagctgtgagccaaaataaacctttcttctttataaattatccagtctcaagtattctgttatagcaacagaaaatggactaagacaaaattggtactgagagagtggagttgttgctataacaatacttgaaaatgtagaagcagcttgaaagtgaataatagattgtagagggaagaatttgcaggagcaggctagaaaaagcctgtattgccatgaacagagcgttaagggtaattctggtgaagacaccaagaaatccctaggactaggggaatctggaacttctttgagattacataagtggtcatgagcagaatattgatagaaatatgcgacagtaaa

SEQ ID NO: 342547 - DNA, 419 bp, Homo sapiens
aaccttccttaccacccatacctaagcaatcacgaagtctcaccgaatctaactcacaaatagctcttgaatttaaactctcctccctattacctattatctgttttacatactggctttcatatataattccttttgagagtaggggtacgaagctaattttttttaaagtttgaaagccactgagataaaagataaagcttaagcaccttcacatggtgctttaatggactcgcctcatttcccaccacacctgtctccccgcacgtggtatttcctgcttcccactttgcttgggccacctagttctcccagaacacactgcaacccatctgcttccatcatctgaatatatctactcatccttgaatgtcacctcctccaagaagccagtcctaatcacctcaagctgagacagg

SEQ ID NO: 342548 - DNA, 356 bp, Homo sapiens
atatgcccaaatgttagtccaggcttttctggcccatttttctgtgtatctattcctgtcctggtgctccactgttttattaccatattttatacaaagtcttgttatctggtatattaattctcacaccaccatacccttcttcaaaattgttgtggccattcttggccatttactcatcatatgaattttcagatgagcctatcgggtctcctaaaaaattgtgttgggagctagattgaatttatgttttaatgccagaagttacatctttataatattgtgcctcctaatcttgaacatggtatatcatttcctttacattgggcttcaataaaactttacattattcttta

SEQ ID NO: 342549 - DNA, 717 bp, Homo sapiens
ggtatccacaaaaagcctatagtagcttaactaatgataaaggaacaaattgctttgctccgaagatgctaaggcaaagatatactcttgccaatttcattttgtttgagtttttgttgttttgtttgtttttgttttgttttgttttttaagacagagtctcactctgtcactcaggcaggttggagtgcagcagctcaatcacggctcactgtaacctcaatctcctgggctcaggagatcctcccacctcagccttccaagtagctgggactacacacatgcactgctagtgcgcccagctaatttttttatattttgtagaggcagagtcttcttacccaggctggtcttgaactcctggcttcgagtgatcctctagcctcagtcccagagttctgtgtaatagtgtctagaaaaagactcacatatgctgtccattctcattattcatggtattatgttttacagagtcatactgaattagcaaatactgaacctagggaaaatgcaaagttaagttgctgtgagccttcgatcacacatcagccaatcagtatataaccttgttgtatgtgtgtttctgtttaaagacaccttatttaacatatattgttgattcactaacactgaactcacagctaacagcactataacccatgcccaaatgaagcatatctgatgcacttatttcctccataagggacatcacaactt

SEQ ID NO: 342550 - DNA, 837 bp, Homo sapiens
acagcttaggccagagtggtggcagtgagttattgagaaaagatatatttcgaaggtagagtcagcaggatttcttgatggactggatatgggaggggagagaagagttaaggatgacacatgaatgattgaggttggaagtgcctgagtttagagtttgggagtagtttggccctcattgtcttatgccccagctttagggggtggccaggggcagaaccagaataatgagtggactagtcatatcttgtaaatgtttgtgaagccataaatttcttctttaagttcaagaggagctagtcaacaaagggaaagtttggacttatcagaagtgtctgaagtagagtctaattatggtgccactgaagaggatttaataacatctgcatcaaaaacagaagagaccttgtcaaaaaagagagagtaccagtcttcctcctgtgtctcctccacatcctcttcctattcttcctcttctgaatccagattttctgaatctattggtcgtttggactgggagactcttgtgcacgaaaatctgcccgggctaatggaaatggatcaggatgaccgtgtttggcccagagactcactcttccgatattttgagttgctagaaaagcttcagtataacctagaggaacgtaagaagttacaagagtttgcagtgcaggcactgatgaacttggaagacaagtaaagcaatggatggcttcaatatccttgggcccagcaaaagataatgaagggaattgttggaaatagagaattgaaaatataaacattcagatagaacaatgtctgttcattaaaattaaaaagtataagtgtctaggc

SEQ ID NO: 342551 - DNA, 555 bp, Homo sapiens
gcttcttaatttcccctgtacttcttcttcacttcgggtaagtgtggctgtggccctctttgctcgttgtaaaaagtggtttcttactgatgcaccctttccctccttgcttcctgttacctctttccaccccacctttccacccacaccataggatttaccagctcttacccaacttttacaaatctagacgtgcttttctgaagcattcctccctgcaggtcgtttggactgggagactcttgtgcacgaaaatctgcccgggctaatggaaatggatcaggatgaccgtgtttggcccagagactcactcttccgatattttgagttgctagaaaagcttcagtataacctagaggaacgtaagaagttacaagagtttgcagtgcaggcactgatgaacttggaagacaagtaaagcaatggatggcttcaatatccttgggcccagcaaaagataatgaagggaattgttggaaatagagaattgaaaatataaacattcagatagaacaatgtctgttcattaaaattaaaaagtataagtgtctaggc

SEQ ID NO: 342552 - DNA, 567 bp, Homo sapiens
ccacccgcctcagcctccaaaagtgttgggattacaggtgtgagccatcgtgcccagctgcagatgggttgtagttttaaacagggtagtcacggtgacctcattgaaaaggtaatgtgagcaaagactcgaaggaggtaaggggattaccatgtggatatctgtaagaagattgttaataggcagatgaaacggtgcaaagctccgaagctggaagcatgcttggtttgtttgagaaacagcagaggccattgtgactggagtagagtgagcagggggaagagtgctgggaaatgatgaccgtgtttggcccagagactcactcttccgatattttgagttgctagaaaagcttcagtataacctagaggaacgtaagaagttacaagagtttgcagtgcaggcactgatgaacttggaagacaagtaaagcaatggatggcttcaatatccttgggcccagcaaaagataatgaagggaattgttggaaatagagaattgaaaatataaacattcagatagaacaatgtctgttcattaaaattaaaaagtataagtgtctaggc

SEQ ID NO: 342553 - DNA, 350 bp, Homo sapiens
ccacccgcctcagcctccaaaagtgttgggattacaggtgtgagccatcgtgcccagctgcagatgggttgtagttttaaacagggtagtcacggtgacctcattgaaaaggtaatgtgagcaaagactcgaaggaggtaaggggattaccatgtggatatctgtaagaagattgttaataggcagatgaaacggtgcaaagctccgaagctggaagcatgcttggtttgtttgagaaacagcagaggccattgtgactggagtagagtgagcagggggaagagtgctgggaaatcgggcggagcgcaacaccgggcggagcgcaacaccgggcgggagcacaccgggcg

SEQ ID NO: 342554 - DNA, 3201 bp, Homo sapiens
gttcaggctgaggagctggggcgagcttttcgctgcatgtaccctggaggacagggtgactatgctggcttccctggttgtgggctgcttcgtctccatagcactttccgccacgatctcaagatctatgcctctgatgagggtcgtgttcagatgactgctgctgccttcgccaagggccttctggctctagaaggggagctgacacccattttggtgcaaatggtgaagagtgccaacatgaatgggctactggacagcgatggggattccttgagcagctgccagcaccgggtgaaggctcggctgcaccatattctacagcaggatgcgccctttggccctgaggactacgatcagctggctcccaccagaagtacttccctgctcaactccatgactatcatccagaatcctgtgaaggtctgtgatcaggtatttgccctgatcgaaaacctcacccaccagatccgggaacgaatgcaggaccccaggtctgtagacctgcagctctaccacagtgagacactagagctaatgctacagcgttggagcaagctggagcgtgactttcgacagaagagtgggcgctatgatatcagtaagatccctgacatctatgactgtgtcaagtatgatgtgcagcacaatgggagtctgggacttcaaggcacagcagagttgctccgtctctctaaggcactggctgatgtggtcattccccaggagtacgggatcagtcgggaggagaaactggaaattgctgtgggcttctgtcttccactgttgcggaagatactacttgacctgcagagaacccacgaggatgagtctgtcaacaagctgcatcccctgtactcccgaggcgtgctctccccaggtcgccacgttcgaacgcgtctctatttcaccagtgagagccatgtccactccctgctcagtgtcttccgttatggaggacttcttgatgagacccaggatgcacaatggcagcgagctttggattatcttagtgccatctcagagcttaactacatgacccagattgtcatcatgctttatgaggacaacacacaggatcccttatcagaggaacggttccatgtggagctacacttcagccccggagtgaaaggtgttgaggaagaaggcagtgccccggctggctgtggattccgtccagcctcttctgagaatgaggagatgaaaaccaaccaaggcagtatggagaacctgtgtccaggaaaggcatcagatgaaccagaccgggcattgcagacttcaccccagcctcctgagggccctggcctcccgaggagatcacccctcattcgtaaccgaaaagctggttccatggaggtactttctgagacttcatcctcgaggcctggtggctaccggctcttttcatcttcacggccacccacagaaatgaagcagagtggcctaggctcacagtgcacagggctgttcagcaccacagtgctgggtggctcctccagtgccccgaatcttcaggactacgcccgcagccatggcaaaaagctaccacctgccagtctgaagcaccgagatggtactcttttcgtttggacagaggtatctgccggtactgagatgtaagtgatcagctgaagggagaaactgtacaccatgtgacggacaaattgcctgcctcaagaaagcacttaggaccattctgcagccactcagtgaccttggctagaaaccaatggctgtgcggcgtgagagacatggccgcttaccaacaagaagagcagatgcagcttccccgagctgatgccattcgttcacgtctcatcgatactttctctctcattgagcatttgcaaggcttgagccaagctgtgccgcggcacactatcagggagttacttgatccttcccgccagaagaaacttgtattgggagatcaacaccagctagtgcgtttctctataaagcctcagcgtatagaacagatttcacatgcccagaggctgttgagcaggcttcatgtgcgctgcagtcagaggccacctctttctttgtgggccggatgggtccttgagtgtcctctcttcaaaaacttcatcatcttcctggtctttttgaatacgatcatattgatggttgaaatagaattgctggaatccacaaataccaaactatggccattgaagctgaccttggaggtggcagcttggtttatcttgcttattttcatcctggagatccttcttaagtggctatccaacttttctgttttctggaagagtgcctggaatgtctttgactttgttgttaccatgttggtaaggatagagatcctgagggttcgtttagtgggatgaagaatgtgcctaggtgaatcgaaagaacaagttaacatgataataggaagaaacaaaaatttacttaacttctttcttttgattttttttccctaaaactaaacatcaatcattgcaggagttgttggtattaggagcaaagtagactaactacaacatcaatgccaacaagagcatctgccggttactgagcacttactaagtgccaagcattattttaagtgttttccttacattatctcatttatgctccacaacaacccaattaaataaccatgaattttatccccctttttatatctgaacaagtttaagtatagtgtttaagcaacttaatatagaaaggctgaatagtaagcacttctcagagaatgctattcaagggataacgcccagggaacaatgaagaggataagatgaagaagctgcaattctgcctgggtgccttggggtgtattttacttataacctgtgtgttttccacagtccctgcttcccgaggttgtggtattggtaggggtaacaggccaatcggtgtggcttcagcttctgaggatctgccgggtgctgaggtctctcaaactccttgcacaattccgtcaaattcaaattattattttggtcctggtcagggccctcaaggtgatttgactgttgcaagctaaagcagggggcaaggtagataaatgtgagggcttaacatagaatatgaaacaaattggccgggtgcggtggctcacgcctgtaatcccagcactttgggaagccgagggggatgggtcatgaggtcaggagttcgagaccagcctgaccaacatggtgaaaccctgtctctactaaaaatacc

SEQ ID NO: 342555 - DNA, 3177 bp, Homo sapiens
gttcaggctgaggagctggggcgagcttttcgctgcatgtaccctggaggacagggtgactatgctggcttccctggttgtgggctgcttcgtctccatagcactttccgccacgatctcaagatctatgcctctgatgagggtcgtgttcagatgactgctgctgccttcgccaagggccttctggctctagaaggggagctgacacccattttggtgcaaatggtgaagagtgccaacatgaatgggctactggacagcgatggggattccttgagcagctgccagcaccgggtgaaggctcggctgcaccatattctacagcaggatgcgccctttggccctgaggactacgatcagctggctcccaccagaagtacttccctgctcaactccatgactatcatccagaatcctgtgaaggtctgtgatcaggtatttgccctgatcgaaaacctcacccaccagatccgggaacgaatgcaggaccccaggtctgtagacctgcagctctaccacagtgagacactagagctaatgctacagcgttggagcaagctggagcgtgactttcgacagaagagtgggcgctatgatatcagtaagatccctgacatctatgactgtgtcaagtatgatgtgcagcacaatgggagtctgggacttcaaggcacagcagagttgctccgtctctctaaggcactggctgatgtggtcattccccaggagtacgggatcagtcgggaggagaaactggaaattgctgtgggcttctgtcttccactgttgcggaagatactacttgacctgcagagaacccacgaggatgagtactcccgaggcgtgctctccccaggtcgccacgttcgaacgcgtctctatttcaccagtgagagccatgtccactccctgctcagtgtcttccgttatggaggacttcttgatgagacccaggatgcacaatggcagcgagctttggattatcttagtgccatctcagagcttaactacatgacccagattgtcatcatgctttatgaggacaacacacaggatcccttatcagaggaacggttccatgtggagctacacttcagccccggagtgaaaggtgttgaggaagaaggcagtgccccggctggctgtggattccgtccagcctcttctgagaatgaggagatgaaaaccaaccaaggcagtatggagaacctgtgtccaggaaaggcatcagatgaaccagaccgggcattgcagacttcaccccagcctcctgagggccctggcctcccgaggagatcacccctcattcgtaaccgaaaagctggttccatggaggtactttctgagacttcatcctcgaggcctggtggctaccggctcttttcatcttcacggccacccacagaaatgaagcagagtggcctaggctcacagtgcacagggctgttcagcaccacagtgctgggtggctcctccagtgccccgaatcttcaggactacgcccgcagccatggcaaaaagctaccacctgccagtctgaagcaccgagatggtactcttttcgtttggacagaggtatctgccggtactgagatgtaagtgatcagctgaagggagaaactgtacaccatgtgacggacaaattgcctgcctcaagaaagcacttaggaccattctgcagccactcagtgaccttggctagaaaccaatggctgtgcggcgtgagagacatggccgcttaccaacaagaagagcagatgcagcttccccgagctgatgccattcgttcacgtctcatcgatactttctctctcattgagcatttgcaaggcttgagccaagctgtgccgcggcacactatcagggagttacttgatccttcccgccagaagaaacttgtattgggagatcaacaccagctagtgcgtttctctataaagcctcagcgtatagaacagatttcacatgcccagaggctgttgagcaggcttcatgtgcgctgcagtcagaggccacctctttctttgtgggccggatgggtccttgagtgtcctctcttcaaaaacttcatcatcttcctggtctttttgaatacgatcatattgatggttgaaatagaattgctggaatccacaaataccaaactatggccattgaagctgaccttggaggtggcagcttggtttatcttgcttattttcatcctggagatccttcttaagtggctatccaacttttctgttttctggaagagtgcctggaatgtctttgactttgttgttaccatgttggtaaggatagagatcctgagggttcgtttagtgggatgaagaatgtgcctaggtgaatcgaaagaacaagttaacatgataataggaagaaacaaaaatttacttaacttctttcttttgattttttttccctaaaactaaacatcaatcattgcaggagttgttggtattaggagcaaagtagactaactacaacatcaatgccaacaagagcatctgccggttactgagcacttactaagtgccaagcattattttaagtgttttccttacattatctcatttatgctccacaacaacccaattaaataaccatgaattttatccccctttttatatctgaacaagtttaagtatagtgtttaagcaacttaatatagaaaggctgaatagtaagcacttctcagagaatgctattcaagggataacgcccagggaacaatgaagaggataagatgaagaagctgcaattctgcctgggtgccttggggtgtattttacttataacctgtgtgttttccacagtccctgcttcccgaggttgtggtattggtaggggtaacaggccaatcggtgtggcttcagcttctgaggatctgccgggtgctgaggtctctcaaactccttgcacaattccgtcaaattcaaattattattttggtcctggtcagggccctcaaggtgatttgactgttgcaagctaaagcagggggcaaggtagataaatgtgagggcttaacatagaatatgaaacaaattggccgggtgcggtggctcacgcctgtaatcccagcactttgggaagccgagggggatgggtcatgaggtcaggagttcgagaccagcctgaccaacatggtgaaaccctgtctctactaaaaatacc

SEQ ID NO: 342556 - DNA, 3075 bp, Homo sapiens
gttcaggctgaggagctggggcgagcttttcgctgcatgtaccctggaggacagggtgactatgctggcttccctggttgtgggctgcttcgtctccatagcactttccgccacgatctcaagatctatgcctctgatgagggtcgtgttcagatgactgctgctgccttcgccaagggccttctggctctagaaggggagctgacacccattttggtgcaaatggtgaagagtgccaacatgaatgggctactggacagcgatggggattccttgagcagctgccagcaccgggtgaaggctcggctgcaccatattctacagcaggatgcgccctttggccctgaggactacgatcagctggctcccaccagaagtacttccctgctcaactccatgactatcatccagaatcctgtgaaggtctgtgatcaggtatttgccctgatcgaaaacctcacccaccagatccgggaacgaatgcaggaccccaggtctgtagacctgcagctctaccacagtgagacactagagctaatgctacagcgttggagcaagctggagcgtgactttcgacagaagagtgggcgctatgatatcagtaagatccctgacatctatgactgtgtcaagtatgatgtgcagcacaatgggagtctgggacttcaaggcacagcagagttgctccgtctctctaaggcactggctgatgtggtcattccccaggagtacgggatcagtcgggaggagaaactggaaattgctgtgggcttctgtcttccactgttgcggaagatactacttgacctgcagagaacccacgaggatgagtctgtcaacaagctgcatcccctgtactcccgaggcgtgctctccccaggtcgccacgttcgaacgcgtctctatttcaccagtgagagccatgtccactccctgctcagtgtcttccgttatggaggacttcttgatgagacccaggatgcacaatggcagcgagctttggattatcttagtgccatctcagagcttaactacatgacccagattgtcatcatgctttatgaggacaacacacaggatcccttatcagaggaacggttccatgtggagctacacttcagccccggagtgaaaggtgttgaggaagaaggcagtgccccggctggctgtggattccgtccagcctcttctgagaatgaggagatgaaaaccaaccaaggcagtatggagaacctgtgtccaggaaaggcatcagatgaaccagaccgggcattgcagacttcaccccagcctcctgagggccctggcctcccgaggagatcacccctcattcgtaaccgaaaagctggttccatggaggtactttctgagacttcatcctcgaggcctggtggctaccggctcttttcatcttcacggccacccacagaaatgaagcagagtggcctaggtactcttttcgtttggacagaggtatctgccggtactgagatgtaagtgatcagctgaagggagaaactgtacaccatgtgacggacaaattgcctgcctcaagaaagcacttaggaccattctgcagccactcagtgaccttggctagaaaccaatggctgtgcggcgtgagagacatggccgcttaccaacaagaagagcagatgcagcttccccgagctgatgccattcgttcacgtctcatcgatactttctctctcattgagcatttgcaaggcttgagccaagctgtgccgcggcacactatcagggagttacttgatccttcccgccagaagaaacttgtattgggagatcaacaccagctagtgcgtttctctataaagcctcagcgtatagaacagatttcacatgcccagaggctgttgagcaggcttcatgtgcgctgcagtcagaggccacctctttctttgtgggccggatgggtccttgagtgtcctctcttcaaaaacttcatcatcttcctggtctttttgaatacgatcatattgatggttgaaatagaattgctggaatccacaaataccaaactatggccattgaagctgaccttggaggtggcagcttggtttatcttgcttattttcatcctggagatccttcttaagtggctatccaacttttctgttttctggaagagtgcctggaatgtctttgactttgttgttaccatgttggtaaggatagagatcctgagggttcgtttagtgggatgaagaatgtgcctaggtgaatcgaaagaacaagttaacatgataataggaagaaacaaaaatttacttaacttctttcttttgattttttttccctaaaactaaacatcaatcattgcaggagttgttggtattaggagcaaagtagactaactacaacatcaatgccaacaagagcatctgccggttactgagcacttactaagtgccaagcattattttaagtgttttccttacattatctcatttatgctccacaacaacccaattaaataaccatgaattttatccccctttttatatctgaacaagtttaagtatagtgtttaagcaacttaatatagaaaggctgaatagtaagcacttctcagagaatgctattcaagggataacgcccagggaacaatgaagaggataagatgaagaagctgcaattctgcctgggtgccttggggtgtattttacttataacctgtgtgttttccacagtccctgcttcccgaggttgtggtattggtaggggtaacaggccaatcggtgtggcttcagcttctgaggatctgccgggtgctgaggtctctcaaactccttgcacaattccgtcaaattcaaattattattttggtcctggtcagggccctcaaggtgatttgactgttgcaagctaaagcagggggcaaggtagataaatgtgagggcttaacatagaatatgaaacaaattggccgggtgcggtggctcacgcctgtaatcccagcactttgggaagccgagggggatgggtcatgaggtcaggagttcgagaccagcctgaccaacatggtgaaaccctgtctctactaaaaatacc

SEQ ID NO: 342557 - DNA, 2812 bp, Homo sapiens
gttcaggctgaggagctggggcgagcttttcgctgcatgtaccctggaggacagggtgactatgctggcttccctggttgtgggctgcttcgtctccatagcactttccgccacgatctcaagatctatgcctctgatgagggtcgtgttcagatgactgctgctgccttcgccaagggccttctggctctagaaggggagctgacacccattttggtgcaaatggtgaagagtgccaacatgaatgggctactggacagcgatggggattccttgagcagctgccagcaccgggtgaaggctcggctgcaccatattctacagcaggatgcgccctttggccctgaggactacgatcagctggctcccaccagaagtacttccctgctcaactccatgactatcatccagaatcctgtgaaggtctgtgatcaggtatttgccctgatcgaaaacctcacccaccagatccgggaacgaatgcaggaccccaggtctgtagacctgcagctctaccacagtgagacactagagctaatgctacagcgttggagcaagctggagcgtgactttcgacagaagagtgggcgctatgatatcagtaagatccctgacatctatgactgtgtcaagtatgatgtgcagcacaatgggagtctgggacttcaaggcacagcagagttgctccgtctctctaaggcactggctgatgtggtcattccccaggagtacgggatcagtcgggaggagaaactggaaattgctgtgggcttctgtcttccactgttgcggaagatactacttgacctgcagagaacccacgaggatgagtctgtcaacaagctgcatcccctgtactcccgaggcgtgctctccccaggtcgccacgttcgaacgcgtctctatttcaccagtgagagccatgtccactccctgctcagtgtcttccgttatggaggacttcttgatgagacccaggatgcacaatggcagcgagctttggattatcttagtgccatctcagagcttaactacatgacccagattgtcatcatgctttatgaggacaacacacaggatcccttatcagaggaacggttccatgtggagctacacttcagccccggagtgaaaggtgttgaggaagaaggcagtgccccggctggctgtggattccgtccagcctcttctgagaatgaggagatgaaaaccaaccaaggcagtatggagaacctgtgtccaggaaaggcatcagatgaaccagaccgggcattgcagacttcaccccagcctcctgagggccctggcctcccgaggagatcacccctcattcgtaaccgaaaagctggttccatggaggtactttctgagacttcatcctcgaggcctggtggctaccggctcttttcatcttcacggccacccacagaaatgaagcagagtggcctaggctcacagtgcacagggctgttcagcaccacagtgctgggtggctcctccagtgccccgaatcttcaggactacgcccgcagccatggcaaaaagctaccacctgccagtctgaagcaccgagatggtactcttttcgtttggacagaggtatctgccggtactgagatgtaagtgatcagctgaagggagaaactgtacaccatgtgacggacaaattgcctgcctcaagaaagcacttaggaccattctgcagccactcagtgaccttggctagaaaccaatggctgtgcggcgtgagagacatggccgcttaccaacaagaagagcagatgcagcttccccgagctgatgccattcgttcacgtctcatcgatactttctctctcattgagcatttgcaaggcttgagccaagctgtgccgcggcacactatcagggagttacttgatccttcccgccagaagaaacttgtattgggagatcaacaccagctagtgcgtttctctataaagcctcagcgtatagaacagatttcacatgcccagaggctgttgagcaggcttcatgtgcgctgcagtcagaggccacctctttctttgtgggccggatgggtccttgagtgtcctctcttcaaaaacttcatcatcttcctggtctttttgaatacgatcatattgatggttgaaatagaattgctggaatccacaaataccaaactatggccattgaagctgaccttggaggtggcagcttggtttatcttgcttattttcatcctggagatccttcttaagtggctatccaacttttctgttttctggaagagtgcctggaatgtctttgactttgttgttaccatgttgtccctgcttcccgaggttgtggtattggtaggggtaacaggccaatcggtgtggcttcagcttctgaggatctgccgggtgctgaggtctctcaaactccttgcacaattccgtcaaattcaaattattattttggtcctggtcagggccctcaagagcatgaccttcctcttgatgttgctgctcatcttcttctacatttttgctgtgactggtgtctacgtcttctcagagtacacccgttcacctcgtcaggacctggagtaccatgtgttcttctcgtaagcagagctggggacagctgggtgaggggagaaaatttggctaagagaccaggaagcttgtccaaagtatagtaatataaaaagtgcagtctattccaagaaactgaaatagaacacaatagggagagtctccgtcgaactggtccacacacattttacatctgattcattttatgttttatcattttatatctagagagtctccgtcgaact

SEQ ID NO: 342558 - DNA, 1973 bp, Homo sapiens
gttcaggctgaggagctggggcgagcttttcgctgcatgtaccctggaggacagggtgactatgctggcttccctggttgtgggctgcttcgtctccatagcactttccgccacgatctcaagatctatgcctctgatgagggtcgtgttcagatgactgctgctgccttcgccaagggccttctggctctagaaggggagctgacacccattttggtgcaaatggtgaagagtgccaacatgaatgggctactggacagcgatggggattccttgagcagctgccagcaccgggtgaaggctcggctgcaccatattctacagcaggatgcgccctttggccctgaggactacgatcagctggctcccaccagaagtacttccctgctcaactccatgactatcatccagaatcctgtgaaggtctgtgatcaggtatttgccctgatcgaaaacctcacccaccagatccgggaacgaatgcaggaccccaggtctgtagacctgcagctctaccacagtgagacactagagctaatgctacagcgttggagcaagctggagcgtgactttcgacagaagagtgggcgctatgatatcagtaagatccctgacatctatgactgtgtcaagtatgatgtgcagcacaatgggagtctgggacttcaaggcacagcagagttgctccgtctctctaaggcactggctgatgtggtcattccccaggagtacgggatcagtcgggaggagaaactggaaattgctgtgggcttctgtcttccactgttgcggaagatactacttgacctgcagagaacccacgaggatgagtctgtcaacaagctgcatcccctgtactcccgaggcgtgctctccccaggtcgccacgttcgaacgcgtctctatttcaccagtgagagccatgtccactccctgctcagtgtcttccgttatggaggacttcttgatgagacccaggatgcacaatggcagcgagctttggattatcttagtgccatctcagagcttaactacatgacccagattgtcatcatgctttatgaggacaacacacaggatcccttatcagaggaacggttccatgtggagctacacttcagccccggagtgaaaggtgttgaggaagaaggcagtgccccggctggctgtggattccgtccagcctcttctgagaatgaggagatgaaaaccaaccaaggcagtatggagaacctgtgtccaggaaaggcatcagatgaaccagaccgggcattgcagacttcaccccagcctcctgagggccctggcctcccgaggagatcacccctcattcgtaaccgaaaagctggttccatggaggtactttctgagacttcatcctcgaggcctggtggctaccggctcttttcatcttcacggccacccacagaaatgaagcagagtggcctaggctcacagtgcacagggctgttcagcaccacagtgctgggtggctcctccagtgccccgaatcttcaggactacgcccgcagccatggcaaaaagctaccacctgccagtctgaagcaccgagatgagctcttgtttgtcccggccgtaaaacgattttctgtgtcgtttgcaaagcatccgactaacggtcgtttggactgggagactcttgtgcacgaaaatctgcccgggctaatggaaatggatcaggatgaccgtgtttggcccagagactcactcttccgatattttgagttgctagaaaagcttcagtataacctagaggaacgtaagaagttacaagagtttgcagtgcaggcactgatgaacttggaagacaagtaaagcaatggatggcttcaatatccttgggcccagcaaaagataatgaagggaattgttggaaatagagaattgaaaatataaacattcagatagaacaatgtctgttcattaaaattaaaaagtataagtgtctaggc

SEQ ID NO: 342559 - DNA, 1990 bp, Homo sapiens
gttcaggctgaggagctggggcgagcttttcgctgcatgtaccctggaggacagggtgactatgctggcttccctggttgtgggctgcttcgtctccatagcactttccgccacgatctcaagatctatgcctctgatgagggtcgtgttcagatgactgctgctgccttcgccaagggccttctggctctagaaggggagctgacacccattttggtgcaaatggtgaagagtgccaacatgaatgggctactggacagcgatggggattccttgagcagctgccagcaccgggtgaaggctcggctgcaccatattctacagcaggatgcgccctttggccctgaggactacgatcagctggctcccaccagaagtacttccctgctcaactccatgactatcatccagaatcctgtgaaggtctgtgatcaggtatttgccctgatcgaaaacctcacccaccagatccgggaacgaatgcaggaccccaggtctgtagacctgcagctctaccacagtgagacactagagctaatgctacagcgttggagcaagctggagcgtgactttcgacagaagagtgggcgctatgatatcagtaagatccctgacatctatgactgtgtcaagtatgatgtgcagcacaatgggagtctgggacttcaaggcacagcagagttgctccgtctctctaaggcactggctgatgtggtcattccccaggagtacgggatcagtcgggaggagaaactggaaattgctgtgggcttctgtcttccactgttgcggaagatactacttgacctgcagagaacccacgaggatgagtctgtcaacaagctgcatcccctgtactcccgaggcgtgctctccccaggtcgccacgttcgaacgcgtctctatttcaccagtgagagccatgtccactccctgctcagtgtcttccgttatggaggacttcttgatgagacccaggatgcacaatggcagcgagctttggattatcttagtgccatctcagagcttaactacatgacccagattgtcatcatgctttatgaggacaacacacaggatcccttatcagaggaacggttccatgtggagctacacttcagccccggagtgaaaggtgttgaggaagaaggcagtgccccggctggctgtggattccgtccagcctcttctgagaatgaggagatgaaaaccaaccaaggcagtatggagaacctgtgtccaggaaaggcatcagatgaaccagaccgggcattgcagacttcaccccagcctcctgagggccctggcctcccgaggagatcacccctcattcgtaaccgaaaagctggttccatggaggtactttctgagacttcatcctcgaggcctggtggctaccggctcttttcatcttcacggccacccacagaaatgaagcagagtggcctaggctcacagtgcacagggctgttcagcaccacagtgctgggtggctcctccagtgccccgaatcttcaggactacgcccgcagccatggcaaaaagctaccacctgccagtctgaagcaccgagatggtactcttttcgtttggacagaggtatctgccggtactgagatgtaagtgatcagctgaagggagaaactgtacaccatgtgacggacaaattgcctgcctcaagaaagcacttaggaccattctgcagccactcagtgaccttggctagaaaccaatggctgtgcggcgtgaggtaagatgaaaggaaataccctagggatccaggacttctgcatttggtgaaacgtccgcttccactacaaggctttgggatgtctagtctgtagactggagtaacattaatactgactcatgcagaaacaatatagctacatattgaactgggggaaggggtggcaaaaccctctgcaaataggaagtgccacaagagcaccgagataaggatgaggccctgcgtgagcgcagccttcgg

SEQ ID NO: 342560 - DNA, 1670 bp, Homo sapiens
agcgttgctccgcatggtcctgggctgtgggtaggggctagggccgggtcccggggtgagccgaaacctgggggtcgagcggggcggggaatggggcgcagtgaggctgggagccggccctgagctcgtcttgcataggggtagccaggctcggggcacctgagctggaggcggaagcgtgaaataaggactgagtgggcaaagagaacctgggctgagagacatggccgcttaccaacaagaagagcagatgcagcttccccgagctgatgccattcgttcacgtctcatcgatactttctctctcattgagcatttgcaaggcttgagccaagctgtgccgcggcacactatcagggagttacttgatccttcccgccagaagaaacttgtattgggagatcaacaccagctagtgcgtttctctataaagcctcagcgtatagaacagatttcacatgcccagaggctgttgagcaggcttcatgtgcgctgcagtcagaggccacctctttctttgtgggccggatgggtccttgagtgtcctctcttcaaaaacttcatcatcttcctggtctttttgaatacgatcatattgatggttgaaatagaattgctggaatccacaaataccaaactatggccattgaagctgaccttggaggtggcagcttggtttatcttgcttattttcatcctggagatccttcttaagtggctatccaacttttctgttttctggaagagtgcctggaatgtctttgactttgttgttaccatgttggtaaggatagagatcctgagggttcgtttagtgggatgaagaatgtgcctaggtgaatcgaaagaacaagttaacatgataataggaagaaacaaaaatttacttaacttctttcttttgattttttttccctaaaactaaacatcaatcattgcaggagttgttggtattaggagcaaagtagactaactacaacatcaatgccaacaagagcatctgccggttactgagcacttactaagtgccaagcattattttaagtgttttccttacattatctcatttatgctccacaacaacccaattaaataaccatgaattttatccccctttttatatctgaacaagtttaagtatagtgtttaagcaacttaatatagaaaggctgaatagtaagcacttctcagagaatgctattcaagggataacgcccagggaacaatgaagaggataagatgaagaagctgcaattctgcctgggtgccttggggtgtattttacttataacctgtgtgttttccacagtccctgcttcccgaggttgtggtattggtaggggtaacaggccaatcggtgtggcttcagcttctgaggatctgccgggtgctgaggtctctcaaactccttgcacaattccgtcaaattcaaattattattttggtcctggtcagggccctcaaggtgatttgactgttgcaagctaaagcagggggcaaggtagataaatgtgagggcttaacatagaatatgaaacaaattggccgggtgcggtggctcacgcctgtaatcccagcactttgggaagccgagggggatgggtcatgaggtcaggagttcgagaccagcctgaccaacatggtgaaaccctgtctctactaaaaatacc

SEQ ID NO: 342561 - DNA, 801 bp, Homo sapiens
gcctgaagtcagtcgcatcttcagcagcatctatttcatcctttggttgttgcttggctccattatctttcgaagtatcatagtagccatgatggttactaactttcagaatatcaggaaagagctgaatgaggagatggcgcgtcgggaggttcagctcaaagctgacatgttcaagcggcagatcatccagaggagaaaaaacatgtcacatgaagcactgacgtcaagccatagcaaaatagaggacagaagaggagctagtcaacaaagggaaagtttggacttatcagaagtgtctgaagtagagtctaattatggtgccactgaagaggatttaataacatctgcatcaaaaacagaagagaccttgtcaaaaaagagagagtaccagtcttcctcctgtgtctcctccacatcctcttcctattcttcctcttctgaatccagattttctgaatctattggtcgtttggactgggagactcttgtgcacgaaaatctgcccgggctaatggaaatggatcaggatgaccgtgtttggcccagagactcactcttccgatattttgagttgctagaaaagcttcagtataacctagaggaacgtaagaagttacaagagtttgcagtgcaggcactgatgaacttggaagacaagtaaagcaatggatggcttcaatatccttgggcccagcaaaagataatgaagggaattgttggaaatagagaattgaaaatataaacattcagatagaacaatgtctgttcattaaaattaaaaagtataagtgtctaggc

SEQ ID NO: 342562 - DNA, 665 bp, Homo sapiens
gcctgaagtcagtcgcatcttcagcagcatctatttcatcctttggttgttgcttggctccattatctttcgaagtatcatagtagccatgatggttactaactttcagaatatcaggaaagagctgaatgaggagatggcgcgtcgggaggttcagctcaaagctgacatgttcaagcggcagatcatccagaggagaaaaaacatgtcacatgaagcactgacgtcaagccatagcaaaatagaggacagatcctaagttaaggatcttgagatgagatcatcctagattatccaggtaggtcctaaatccaatggcaagggtccttataaaagatgaaagaggagaagacacagagaataggagaaggcgatgtgaagacggagatagaggttggggctaatgccaccgcaagccaagggaagctgaggaatgccaggcagctgccagaaggtagaagaggcaaggaacttctcccctaaagcctccagagggaatatggccctgccaacaccttcatttcagactctagcctctagaattgtgacggaatatatttctgtcattttaagctaccaagtttatagtaatttgttatggcagccacaggacactaatacaaataccttccatgaaacagatatgattctagaccccaagtgtt

SEQ ID NO: 342563 - DNA, 586 bp, Homo sapiens
ttgcttggctttgtagggacaggaatccaggacctgagttttatactttggggttgaggtggcaaaatgattaatatagagtcctttttctgcaggtactttctgagacttcatcctcgaggcctggtggctaccggctcttttcatcttcacggccacccacagaaatgaagcagagtggcctaggtatggttttgccagcatttctcacctattgttggaaaagttgtctgtctgttcttcagagttttattgtgggaaacctttgtcatgggatttgggaccgtccaatcagtggaatatcatcaggtggaggtagggaggatgaagtgggagaagccatagttagatgtgaacttggatctcagatgattattccatcccaggaaggtgtttatctcttggttttctataccaaccacatttccctggccaaagggcgtttttctggctttccctctcattccttatctgtccctccagtctagcccagaccttaaggggccatggagactctgaaccttcagagttatcaaagacagagctataaatagaggtacttgcaaccctcataaatgtcgtattc

SEQ ID NO: 342564 - DNA, 266 bp, Homo sapiens
atgcagcttccccgagctgatgccattcgttcacgtctcatcgatactttctctctcattgagcatttgcaaggcttgagccaagctgtgccgcggcacactatcagggagttacttggtcagcagcctatttcttcactaatttaaatttaagactcctatccacatcctctacatttaagagtggaaaattctggggaggtttagttgctggtttaccaaacttgataaatcaagggcttgtaaataaaactgaagagatagaa

SEQ ID NO: 342565 - DNA, 423 bp, Homo sapiens
gaactccactctgtacatttccttaagagacaacaggtcctctcttcaaaaacttcatcatcttcctggtctttttgaatacgatcatattgatggttgaaataggtgagaactgaccttgtatgaaagaggaagtgaggccgggcacgccggctcacacgtgtaatcctagcactttgggaggccggggcgtgtggattgccggagctcaggagttggagaccagcctgggcaacatggtgaaaccctgtctctactaaaaaatacaaaaaattagccgggcttggtagcacgcgcttgtagtcccagctacttgggaggctgaggcaggagaatcgcttaaacccaggaggcgtaggtttcagtgagccgagattgtgccactgcatttcagcctgggcgacagagtacaactctgtctca

SEQ ID NO: 342566 - DNA, 415 bp, Homo sapiens
gtgagcttgactgggctgttggtggagatcagcctagtttggcccacatctgacatgagagttatggcctctagagcatgaccttcctcttgatgttgctgctcatcttcttctacatttttgctgtgactggtgtctacgtcttctcagagtacacccgttcacctcgtcaggacctggagtaccatgtgttcttctcgtaagcagagctggggacagctgggtgaggggagaaaatttggctaagagaccaggaagcttgtccaaagtatagtaatataaaaagtgcagtctattccaagaaactgaaatagaacacaatagggagagtctccgtcgaactggtccacacacattttacatctgattcattttatgttttatcattttatatctagagagtctccgtcgaact

SEQ ID NO: 342567 - DNA, 3300 bp, Homo sapiens
tcattgactgttactgtcctacaagcctgagtcagaacccagttttgaggcagcatttctactctaggctcaggctagcatcttgtttagaggaagaagataatgttatctgtgatctctactcatgaaaacattctgtggagattttgagggattttggttcaatctttattctccagtattttccatgtgtattctagagccctcaagaaaagaacttaggtctgttttattttctctggactcttaaaatcaatccctcttagacgactatatgctagagcagtgcccttacctgaaggcctagaactgctagtatgcccagtaacctaagaatgctcactggagtgaaccaacatacagagctgtattgtgagtagtctctgtgtaataaactcacaggaatctgggcaattagtgccgagcctgtcttgcttttcttctctctattcttcatagctggctcccaccagaagtacttccctgctcaactccatgactatcatccagaatcctgtgaaggtctgtgatcaggtatttgccctgatcgaaaacctcacccaccagatccgggaacgaatgcaggaccccaggtctgtagacctgcagctctaccacagtgagacactagagctaatgctacagcgttggagcaagctggagcgtgactttcgacagaagagtgggcgctatgatatcagtaagatccctgacatctatgactgtgtcaagtatgatgtgcagcacaatgggagtctgggacttcaaggcacagcagagttgctccgtctctctaaggcactggctgatgtggtcattccccaggagtacgggatcagtcgggaggagaaactggaaattgctgtgggcttctgtcttccactgttgcggaagatactacttgacctgcagagaacccacgaggatgagtctgtcaacaagctgcatcccctgtactcccgaggcgtgctctccccaggtcgccacgttcgaacgcgtctctatttcaccagtgagagccatgtccactccctgctcagtgtcttccgttatggaggacttcttgatgagacccaggatgcacaatggcagcgagctttggattatcttagtgccatctcagagcttaactacatgacccagattgtcatcatgctttatgaggacaacacacaggatcccttatcagaggaacggttccatgtggagctacacttcagccccggagtgaaaggtgttgaggaagaaggcagtgccccggctggctgtggattccgtccagcctcttctgagaatgaggagatgaaaaccaaccaaggcagtatggagaacctgtgtccaggaaaggcatcagatgaaccagaccgggcattgcagacttcaccccagcctcctgagggccctggcctcccgaggagatcacccctcattcgtaaccgaaaagctggttccatggaggtactttctgagacttcatcctcgaggcctggtggctaccggctcttttcatcttcacggccacccacagaaatgaagcagagtggcctaggctcacagtgcacagggctgttcagcaccacagtgctgggtggctcctccagtgccccgaatcttcaggactacgcccgcagccatggcaaaaagctaccacctgccagtctgaagcaccgagatggtactcttttcgtttggacagaggtatctgccggtactgagatgtaagtgatcagctgaagggagaaactgtacaccatgtgacggacaaattgcctgcctcaagaaagcacttaggaccattctgcagccactcagtgaccttggctagaaaccaatggctgtgcggcgtgagagacatggccgcttaccaacaagaagagcagatgcagcttccccgagctgatgccattcgttcacgtctcatcgatactttctctctcattgagcatttgcaaggcttgagccaagctgtgccgcggcacactatcagggagttacttgatccttcccgccagaagaaacttgtattgggagatcaacaccagctagtgcgtttctctataaagcctcagcgtatagaacagatttcacatgcccagaggctgttgagcaggcttcatgtgcgctgcagtcagaggccacctctttctttgtgggccggatgggtccttgagtgtcctctcttcaaaaacttcatcatcttcctggtctttttgaatacgatcatattgatggttgaaatagaattgctggaatccacaaataccaaactatggccattgaagctgaccttggaggtggcagcttggtttatcttgcttattttcatcctggagatccttcttaagtggctatccaacttttctgttttctggaagagtgcctggaatgtctttgactttgttgttaccatgttggtaaggatagagatcctgagggttcgtttagtgggatgaagaatgtgcctaggtgaatcgaaagaacaagttaacatgataataggaagaaacaaaaatttacttaacttctttcttttgattttttttccctaaaactaaacatcaatcattgcaggagttgttggtattaggagcaaagtagactaactacaacatcaatgccaacaagagcatctgccggttactgagcacttactaagtgccaagcattattttaagtgttttccttacattatctcatttatgctccacaacaacccaattaaataaccatgaattttatccccctttttatatctgaacaagtttaagtatagtgtttaagcaacttaatatagaaaggctgaatagtaagcacttctcagagaatgctattcaagggataacgcccagggaacaatgaagaggataagatgaagaagctgcaattctgcctgggtgccttggggtgtattttacttataacctgtgtgttttccacagtccctgcttcccgaggttgtggtattggtaggggtaacaggccaatcggtgtggcttcagcttctgaggatctgccgggtgctgaggtctctcaaactccttgcacaattccgtcaaattcaaattattattttggtcctggtcagggccctcaaggtgatttgactgttgcaagctaaagcagggggcaaggtagataaatgtgagggcttaacatagaatatgaaacaaattggccgggtgcggtggctcacgcctgtaatcccagcactttgggaagccgagggggatgggtcatgaggtcaggagttcgagaccagcctgaccaacatggtgaaaccctgtctctactaaaaatacc

SEQ ID NO: 342568 - DNA, 2505 bp, Homo sapiens
aggtatttattcctggcctgtggcccctaggagtacgggatcagtcgggaggagaaactggaaattgctgtgggcttctgtcttccactgttgcggaagatactacttgacctgcagagaacccacgaggatgagtctgtcaacaagctgcatcccctgtactcccgaggcgtgctctccccaggtcgccacgttcgaacgcgtctctatttcaccagtgagagccatgtccactccctgctcagtgtcttccgttatggaggacttcttgatgagacccaggatgcacaatggcagcgagctttggattatcttagtgccatctcagagcttaactacatgacccagattgtcatcatgctttatgaggacaacacacaggatcccttatcagaggaacggttccatgtggagctacacttcagccccggagtgaaaggtgttgaggaagaaggcagtgccccggctggctgtggattccgtccagcctcttctgagaatgaggagatgaaaaccaaccaaggcagtatggagaacctgtgtccaggaaaggcatcagatgaaccagaccgggcattgcagacttcaccccagcctcctgagggccctggcctcccgaggagatcacccctcattcgtaaccgaaaagctggttccatggaggtactttctgagacttcatcctcgaggcctggtggctaccggctcttttcatcttcacggccacccacagaaatgaagcagagtggcctaggctcacagtgcacagggctgttcagcaccacagtgctgggtggctcctccagtgccccgaatcttcaggactacgcccgcagccatggcaaaaagctaccacctgccagtctgaagcaccgagatggtactcttttcgtttggacagaggtatctgccggtactgagatgtaagtgatcagctgaagggagaaactgtacaccatgtgacggacaaattgcctgcctcaagaaagcacttaggaccattctgcagccactcagtgaccttggctagaaaccaatggctgtgcggcgtgagagacatggccgcttaccaacaagaagagcagatgcagcttccccgagctgatgccattcgttcacgtctcatcgatactttctctctcattgagcatttgcaaggcttgagccaagctgtgccgcggcacactatcagggagttacttgatccttcccgccagaagaaacttgtattgggagatcaacaccagctagtgcgtttctctataaagcctcagcgtatagaacagatttcacatgcccagaggctgttgagcaggcttcatgtgcgctgcagtcagaggccacctctttctttgtgggccggatgggtccttgagtgtcctctcttcaaaaacttcatcatcttcctggtctttttgaatacgatcatattgatggttgaaatagaattgctggaatccacaaataccaaactatggccattgaagctgaccttggaggtggcagcttggtttatcttgcttattttcatcctggagatccttcttaagtggctatccaacttttctgttttctggaagagtgcctggaatgtctttgactttgttgttaccatgttggtaaggatagagatcctgagggttcgtttagtgggatgaagaatgtgcctaggtgaatcgaaagaacaagttaacatgataataggaagaaacaaaaatttacttaacttctttcttttgattttttttccctaaaactaaacatcaatcattgcaggagttgttggtattaggagcaaagtagactaactacaacatcaatgccaacaagagcatctgccggttactgagcacttactaagtgccaagcattattttaagtgttttccttacattatctcatttatgctccacaacaacccaattaaataaccatgaattttatccccctttttatatctgaacaagtttaagtatagtgtttaagcaacttaatatagaaaggctgaatagtaagcacttctcagagaatgctattcaagggataacgcccagggaacaatgaagaggataagatgaagaagctgcaattctgcctgggtgccttggggtgtattttacttataacctgtgtgttttccacagtccctgcttcccgaggttgtggtattggtaggggtaacaggccaatcggtgtggcttcagcttctgaggatctgccgggtgctgaggtctctcaaactccttgcacaattccgtcaaattcaaattattattttggtcctggtcagggccctcaaggtgatttgactgttgcaagctaaagcagggggcaaggtagataaatgtgagggcttaacatagaatatgaaacaaattggccgggtgcggtggctcacgcctgtaatcccagcactttgggaagccgagggggatgggtcatgaggtcaggagttcgagaccagcctgaccaacatggtgaaaccctgtctctactaaaaatacc

SEQ ID NO: 342569 - DNA, 1639 bp, Homo sapiens
gttcaggctgaggagctggggcgagcttttcgctgcatgtaccctggaggacagggtgactatgctggcttccctggttgtgggctgcttcgtctccatagcactttccgccacgatctcaagatctatgcctctgatgagggtcgtgttcagatgactgctgctgccttcgccaagggccttctggctctagaaggggagctgacacccattttggtgcaaatggtgaagagtgccaacatgaatgggctactggacagcgatggggattccttgagcagctgccagcaccgggtgaaggctcggctgcaccatattctacagcaggatgcgccctttggccctgaggactacgatcagctggctcccaccagaagtacttccctgctcaactccatgactatcatccagaatcctgtgaaggtctgtgatcaggtatttgccctgatcgaaaacctcacccaccagatccgggaacgaatgcaggaccccaggtctgtagacctgcagctctaccacagtgagacactagagctaatgctacagcgttggagcaagctggagcgtgactttcgacagaagagtgggcgctatgatatcagtaagatccctgacatctatgactgtgtcaagtatgatgtgcagcacaatgggagtctgggacttcaaggcacagcagagttgctccgtctctctaaggcactggctgatgtggtcattccccaggagtacgggatcagtcgggaggagaaactggaaattgctgtgggcttctgtcttccactgttgcggaagatactacttgacctgcagagaacccacgaggatgagtctgtcaacaagctgcatcccctgtactcccgaggcgtgctctccccaggtcgccacgttcgaacgcgtctctatttcaccagtgagagccatgtccactccctgctcagtgtcttccgttatggaggacttcttgatgagacccaggatgcacaatggcagcgagctttggattatcttagtgccatctcagagcttaactacatgacccagattgtcatcatgctttatgaggacaacacacaggatcccttatcagaggaacggttccatgtggagctacacttcagccccggagtgaaaggtgttgaggaagaaggcagtgccccggctggctgtggattccgtccagcctcttctgagaatgaggagatgaaaaccaaccaaggcagtatggagaacctgtgtccaggaaaggcatcagatgaaccagaccgggcattgcagacttcaccccagcctcctgagggccctggcctcccgaggagatcacccctcattcgtaaccgaaaagctggttccatggaggtactttctgagacttcatcctcgaggcctggtggctaccggctcttttcatcttcacggccacccacagaaatgaagcagagtggcctaggctcacagtgcacagggctgttcagcaccacagtgctgggtggctcctccagtgccccgaatcttcaggactacgcccgcagccatggcaaaaagctaccacctgccagtctgaagcaccgagatgggtttgaagggtgttccatggtgcctaccatctaccctctggaaacactgcataatgcccttt

SEQ ID NO: 342570 - DNA, 1702 bp, Homo sapiens
gttcaggctgaggagctggggcgagcttttcgctgcatgtaccctggaggacagggtgactatgctggcttccctggttgtgggctgcttcgtctccatagcactttccgccacgatctcaagatctatgcctctgatgagggtcgtgttcagatgactgctgctgccttcgccaagggccttctggctctagaaggggagctgacacccattttggtgcaaatggtgaagagtgccaacatgaatgggctactggacagcgatggggattccttgagcagctgccagcaccgggtgaaggctcggctgcaccatattctacagcaggatgcgccctttggccctgaggactacgatcagctggctcccaccagaagtacttccctgctcaactccatgactatcatccagaatcctgtgaaggtctgtgatcaggtatttgccctgatcgaaaacctcacccaccagatccgggaacgaatgcaggaccccaggtctgtagacctgcagctctaccacagtgagacactagagctaatgctacagcgttggagcaagctggagcgtgactttcgacagaagagtgggcgctatgatatcagtaagatccctgacatctatgactgtgtcaagtatgatgtgcagcacaatgggagtctgggacttcaaggcacagcagagttgctccgtctctctaaggcactggctgatgtggtcattccccaggagtacgggatcagtcgggaggagaaactggaaattgctgtgggcttctgtcttccactgttgcggaagatactacttgacctgcagagaacccacgaggatgagtctgtcaacaagctgcatcccctgtactcccgaggcgtgctctccccaggtcgccacgttcgaacgcgtctctatttcaccagtgagagccatgtccactccctgctcagtgtcttccgttatggaggacttcttgatgagacccaggatgcacaatggcagcgagctttggattatcttagtgccatctcagagcttaactacatgacccagattgtcatcatgctttatgaggacaacacacaggatcccttatcagaggaacggttccatgtggagctacacttcagccccggagtgaaaggtgttgaggaagaaggcagtgccccggctggctgtggattccgtccagcctcttctgagaatgaggagatgaaaaccaaccaaggcagtatggagaacctgtgtccaggaaaggcatcagatgaaccagaccgggcattgcagacttcaccccagcctcctgagggccctggcctcccgaggagatcacccctcattcgtaaccgaaaagctggttccatggaggtactttctgagacttcatcctcgaggcctggtggctaccggctcttttcatcttcacggccacccacagaaatgaagcagagtggcctaggctcacagtgcacagggctgttcagcaccacagtgctgggtggctcctccagtgccccgaatcttcaggactacgcccgcagccatggcaaaaagctaccacctgccagtctgaagcaccgagatgagctcttgtttgtcccggccgtaaaacgattttctgtgtcgtttgcaaagcatccgactaacgggtttgaagggtgttccatggtgcctaccatctaccctctggaaacactgcataatgcccttt

SEQ ID NO: 342571 - DNA, 1287 bp, Homo sapiens
gttcaggctgaggagctggggcgagcttttcgctgcatgtaccctggaggacagggtgactatgctggcttccctggttgtgggctgcttcgtctccatagcactttccgccacgatctcaagatctatgcctctgatgagggtcgtgttcagatgactgctgctgccttcgccaagggccttctggctctagaaggggagctgacacccattttggtgcaaatggtgaagagtgccaacatgaatgggctactggacagcgatggggattccttgagcagctgccagcaccgggtgaaggctcggctgcaccatattctacagcaggatgcgccctttggccctgaggactacgatcagctggctcccaccagaagtacttccctgctcaactccatgactatcatccagaatcctgtgaaggtctgtgatcaggtatttgccctgatcgaaaacctcacccaccagatccgggaacgaatgcaggaccccaggtctgtagacctgcagctctaccacagtgagacactagagctaatgctacagcgttggagcaagctggagcgtgactttcgacagaagagtgggcgctatgatatcagtaagatccctgacatctatgactgtgtcaagtatgatgtgcagcacaatgggagtctgggacttcaaggcacagcagagttgctccgtctctctaaggcactggctgatgtggtcattccccaggagtacgggatcagtcgggaggagaaactggaaattgctgtgggcttctgtcttccactgttgcggaagatactacttgacctgcagagaacccacgaggatgagtctgtcaacaagctgcatcccctgtactcccgaggcgtgctctccccaggtcgccacgttcgaacgcgtctctatttcaccagtgagagccatgtccactccctgctcagtgtcttccgttatggaggacttcttgatgagacccaggatgcacaatggcagcgagctttggattatcttagtgccatctcagagcttaactacatgacccagattgtcatcatgctttatgaggacaacacacaggatcccttatcagaggaacggttccatgtggagctacacttcagccccggagtgaaaggtgttgaggaagaaggcagtgccccggctggctgtggattccgtccagcctcttctgagatgaccgagaagaataaagaggcgagatcttgctggaaaaagaagcggagttcccccgcatgcaagagaagatggtctatggactgcagggaa

SEQ ID NO: 342572 - DNA, 847 bp, Homo sapiens
gcctgaagtcagtcgcatcttcagcagcatctatttcatcctttggttgttgcttggctccattatctttcgaagtatcatagtagccatgatggttactaactttcagaatatcaggaaagagctgaatgaggagatggcgcgtcgggaggttcagctcaaagctgacatgttcaagcggcagatcatccagaggagaaaaaacatgtcacatgaagcactgacgtcaagccatagcaaaatagaggacagatcctaagttaaggatcttgagatgagatcatcctagattatccagaagaggagctagtcaacaaagggaaagtttggacttatcagaagtgtctgaagtagagtctaattatggtgccactgaagaggatttaataacatctgcatcaaaaacagaagagaccttgtcaaaaaagagagagtaccagtcttcctcctgtgtctcctccacatcctcttcctattcttcctcttctgaatccagattttctgaatctattggtcgtttggactgggagactcttgtgcacgaaaatctgcccgggctaatggaaatggatcaggatgaccgtgtttggcccagagactcactcttccgatattttgagttgctagaaaagcttcagtataacctagaggaacgtaagaagttacaagagtttgcagtgcaggcactgatgaacttggaagacaagtaaagcaatggatggcttcaatatccttgggcccagcaaaagataatgaagggaattgttggaaatagagaattgaaaatataaacattcagatagaacaatgtctgttcattaaaattaaaaagtataagtgtctaggc

SEQ ID NO: 342573 - DNA, 807 bp, Homo sapiens
aggaaaaggaagcaaagcagatgaccaatgaaggaatcatagttaggctcatagcagacttcttgtcagcaacaatagatatcagatgacagtacagtaatatcttcaaagtgttgagataaaaaaattgtgaacctggaattttatacccagctaaacaatcattccactggcctttttcagacacagagagtttcctacttactgagttcattaaaagcattattaaaagatgaattatgggggaaattaaggtacaagggcataaaaagcaacagtgaacagagctgttgagtaaaacaatgttagtaaaatgagttgaatattaagtgttaaaagttgtttgtatgttaaaaaaagattacaattaggcaactttaaaaaggtgagtggtgtttaatggataaagttgctaaaattcatctccgatttggaggaatataagaaaaccaaattacttcatgctttattagaaaaaatttaatcaagtttgaatgttaaaaaaaatttaatgacttttccatttacttatctttctcatcatctatttacaaatgaatttttaaaattctttgcccttcctcagactctctcagtaatgaaagtatcttaagctcctttgttatttttattttcttaaattgtaagagtcatccatgtgtttgaaaaaaaatcttacaatgttaaaaaaaaaatgtaagggtaaaatgtaatccttagattctaaagcagtagaggacagggaagggatattattaaaaactctattaaaccaacagaagacatgaaaagaaaaaagatgcagga

SEQ ID NO: 342574 - DNA, 547 bp, Homo sapiens
cgtcgcactgtgtaaggcctattttgatctctgaaatcaggtttgtctaagaaatacagaacttagagtacatcttgagtacttatggcaagtctagcgctattcaaggcactttagatgcacaaactcattgtgttctctcaacagccatgtgagattaagtaatattactttgtttgatagaagaagaaactgagggtctggacaattggtagtaaagggcaaagttaggaactctgaacagatcagacaaagccgtgtacttcaagtgttctcctaatgtctgcaatagaaatgtggatggagaggcttctggtcagctattctggaagctaaaaaaccttgtcaatagaataacattggaaattgtgaccacatagccagacaaagccatgagagaaattcagtcagtcaaggatcagaaatatctggaagagttgattgttctacgagacaatgtgaaagaatatgacattctgccaaattcaaaggtatttagatttagatataaaagacagctacatattctaaaaggttacgagtgcaa

SEQ ID NO: 342575 - DNA, 1074 bp, Homo sapiens
  misc_feature (681)..(681): n is a, c, g, or t
  misc_feature (704)..(704): n is a, c, g, or t
  misc_feature (709)..(709): n is a, c, g, or t
  misc_feature (713)..(713): n is a, c, g, or t
  misc_feature (737)..(737): n is a, c, g, or t
  misc_feature (986)..(986): n is a, c, g, or t
  misc_feature (1065)..(1065): n is a, c, g, or t
ggaatatatctctcacagtgtcctcttctcatgctcaggagacagatgttcctgttttaggattggacagtggattgttgcatgaataggggaatagacttaatgtgtctgtccctgtctgactttgttgcagacattgaaaaaaatcaagaagaagaagaagaccaagacccacaatgccccaggctgagcccggatctgccagaggtggaggaacaggacgtcccacaggactccctggatgaagtttacttgactccttcactcccccatgacctgtctgactgccagcaaccttacaacagcacgttgtactcattggaggatcagctcacctgctttgctctcgatgtagcctgatcttagtgcaacattgctctgcaaacttggaccagggcagagtgagatagcagaggagctgtgccagcgtctacagcgaaaggaaaggatgctgcaggaccttctaagtgatcaaaacaaagaagtggtagaagatgaaatggagattcaaggcctgctttggtctatgcgcaccggggagcaggaaagccaaggttcaatgcagataccttccagagatgatagcacttcatcgactgccaaagaggatgccagcatacccagatgcacattagataagtatcaaatttcatttcattaagggactttgtttccttagtntctatagtatgtcgtatatagtnggcangctnttattgctactaatgacaacagtngaatcttgaagctagactgctactatgtagtaggatgcttgtacattgcaggaccttattctcctacaagtgcggtacatgcgagcatctgcacactgatacttcggtttaagtggctctgatgctctctgacttgaggagggactgttcacttcaccgggttactcaggttttcaagcctcaggaaggggttatttctaaactccgtgtgaaaaccgagaaggggtctttccataccacttttacaangtcccgtcaaatttactaagtcatataaatttaacgcctatccgggggaaattttttttaagggctttgtctctctctngtgtttcct

SEQ ID NO: 342576 - DNA, 274 bp, Homo sapiens
agcatgcctatgaacatcccagcttgctccttttattattaatcacacttattttcagaaggtttgtgtagatgcagatatctgttagctaattatcaatgcactgctagtgactgttacctgcaaaatattctacagtttgagaattaaatgtcttgtgtaaatttaaaaaatgcccctttgaaaggaccaaatgtagtgatttaatctcagaggaggaagattagagatgggggtcataataaactggcctttcaggtgggtattatcattg

SEQ ID NO: 342577 - DNA, 386 bp, Homo sapiens
caatagctcattcactgccttgattccttttgccaacaatttaaccagtgattattcctaacatattatgcaattttctcttggtgctacctgatggaattcctgcacttaaagttctggctgactaaacaagatatgtcaacattttctttcttctctttttgtttggaaaatcaagtacttctttgaatgatgatttctttctttcattactgacatgattgtcagtaaaacaatcatgttagacttcagacctccagggattctttccatgtcctgaaagagaattgtttaattatttaataagaaaaaaatttatattaatgattgtttcctttagtaatttattgctgtgtactgatatttaaataaagagttatatttcc

SEQ ID NO: 342578 - DNA, 261 bp, Homo sapiens
attctcccaacatcagcttcattattttgtttattacactttcagaagagagaatttgacatacatattaccagtagcacactatcaacagtgttggttctttaattactgaatgccatgaggcattctccctagtggctgggctgtcttcctgttgggtacctctttctgtttggaaggatagaaacaacaacatacctgttggtttgttttctgagtagagtcagttcccaacatatataatacatgtcatgtgtaaag

SEQ ID NO: 342579 - DNA, 835 bp, Homo sapiens
ctatagctcttttagaatttgtccagcaggctttctagttttcccacactaagaaacaaaaaaacctgtagaaacaaatacaaataaatacaataggcaaaatacacttttatattatttaaagtttttaaaatggaaaaagaaaagcatttggccctttgagtatagctgaattcggctcagtgaaacgagggtatggctgggtggcacacgcctgccgtcccagctactcaggaggctcaggtgggaggattgattgagcccaggagtttgagaccaacctgggcaacatagggagacccctgtctctaaacaaaaaataaaaaagaaaatgagggtacagaggaatcccattgtatgtttgatgcactgagggcatcttcggaatgtgctaagttgtcttgatacccagtgggggtgttacctgtgtatgtgtgattatccgagggtctctcatgcttgagtgtgataaccttggagagagtttctggatgtctagttgtctgctgtgagagacagagtggacagagggagacagcctttcttgacctggtgaggccaaaataaataaatagataaataaataaagcagagtctttttggttaccgcagcccctagaattaggccccttctgactttgtcattgttcctgcacgtctcaaatctgcagttgaaggccccatccaggagttgatctgaaagggcttcggcctcctgggcctttggatttgatcccatagtccttgaggccctgcctgagtggacctgtctcagaataaatgaggaataaacgaggtatgacctttgaacgtcccccactgtcccccatgatca

SEQ ID NO: 342580 - DNA, 570 bp, Homo sapiens
tatttcatcagtaggttgccatagaacataatagttatataatcaaacagcagaataattttatatgaggtttattgatacagaaatgtttggttcagtgtttgtcttccagttttgcagattttcttttcgattttaaaactggagaatacattaaaaccagaaactttcagcctctataatgccctcaaaactcagcaggttttgaaaatgcctcttccttctcttctcctccccataatcctgcttatttttggcattaagtgagtcaggggttccaaacccaaatacgtttttcaaggctatgtagtcagtgtgaatgagagaagtaaatctgttgggtcctgtgccacactggagtttccaaggctggtctaaatgagttcaacttcagtttttttgtgtttttttagagatggagtcttgctgtgttgcttgagctggtcttgaactcccgggctcaagtgatcttccagccttggcctcccaaggtgctagaattataggcatgagccactgtgctggccaatttttttttttttagcccactgtgctaccagtttgtgatct

SEQ ID NO: 342581 - DNA, 920 bp, Homo sapiens
tcagtggatgacctcagaaaagatacagatatatcattatgtctcatttttattttcaggtgttcagattaaaactattgctttaaattggatattagagctcaagaaatattgagacacgtttgaccacttttgtttccttggttcatttacttgtccacatactgaagactactgtaaaaacagggaaaacatttttaaatgacaacttgttcaaaatctaaactttaaaaactaagctctagaaattcaaggaaaataataagatgacattttgttttgcctcaagccctgaacacatcattggtataatcatttagctaatgtcaaacaacatagtgtctggcaagattttagctagagtcaactatcaactctccacagcttatcactgaaataacaagcttcgtgtgaccatattaaaaattatcagttttacatttgaaaggcccagtgccaacctggaaaaaattgcttgcattgatgagtaataaattctacattttgcatattctcacaactgcatgaattcatttcacaatgttggcaaataatctgaattcttggtggcacgggtcctccgtatgctgagcgccggtcccctgggcccacttttctttctctatactttgtgtctctttcttttctcagtctctcgtcccacccgactggaaacacccacaggtgtggaggggcaggccaccccttcatctggtgcccaacgtgggtgcttttctctaggttgaaggtatgctcgagcatgatcattgaggacaagtcgacgagattcccgagtacgtctacagtcagccttgtgacatttgaagttctacaatgaacccgtcggagatgcaaagaaaagcacctccacggagacagagacaccgcagtcgagcaccatcggctcacaagatgaacag

SEQ ID NO: 342582 - DNA, 182 bp, Homo sapiens
acacttttttcctttagagtttcagcatttttaaagaaaaagagattcccccaatttttattatgtgtttttgagccatttcttcatacatgaaagcaaagttttcaatattaaataaaccattcattccattcaaattttaaaatcattaggcatgttaccctttacgtttaaatgtggta

SEQ ID NO: 342583 - DNA, 275 bp, Homo sapiens
cctgggcaacaagagtgaaactccatctcaaaaaaagaaaaaaaaaagaaagaaagaaaagaaaaaaagaaattctcaatattccaaatactgacgagaatgaagagcaaatagaactttcaggtattgctggtagaaatgtaaaatgataaagcaattttgaaaaacagtttgtcagtttcttataaatataaatatgtactcaacatagaacccaccaatcccactcatatgtatttacccaagtaaattgaaaacatgttcacaaaaaacct

SEQ ID NO: 342584 - DNA, 426 bp, Homo sapiens
tgttagttttggttatcataattgtttatctactacagcctctaggaggacattgtacctagggagattttaaaaaatcaaacttagtatgaggccagaatacgaataattttatcattaattacatttcatttcccctaatgcttcttatgtgtgagagtagtacttgttcttaagtgaccaacatatttaatgtactatgtccatatattaaaagaatagaaactagtcttggcagacactgaaatagttaattggcttttacagccaagatagttttataaaactttgtgaaaattaagaaacgggaagaaaagtatttttctatgcactaatggcatattttattaaccctttaccttaggctataacattttttttttttgcagcattctttcattagataagcagctggaggaaggaggc

SEQ ID NO: 342585 - DNA, 201 bp, Homo sapiens
aaaaggggatggagcgagagaaggtggtgaaagcgctcaagcctccgtgaagttctgaccctgtgaaatgggggaaggcaggagcactggcagtggggaagaagtgtcttactgttcagtgtagatctgacgtccaggctgatgggagacactgagccaacgtggccagctgaggtatctgtcttttaggaatggacctac

SEQ ID NO: 342586 - DNA, 852 bp, Homo sapiens
gtagagatgggggagctctcactatgttgctcaggctggccttgaactcctgggctcaagcaagcctcctgccttggcctcccaaaatgctgagattacaggcaagagcaaccacactcggcctaaagctgatgtttttttccactgtaccacatttttttaggtgctgaaagggaatataagagaagctgtctagagattttacgtcttaattgtccttcctttatgttttttattgaaacctcattgagatataacaggagttattttaaatgtcctgtgattgtcaaaatgttttttacatttaaattttgaagatgcaagatagagaatgaaagaaaaatgccttgagtacaaattacatgtttgtcttctgttctccacaaaaatttaaactttctaggtgcgagcaaaaaagaagaaaagcagtgaagaacgagaaaaagcaacagcaagtatctcttaacgtttttacagacaatagaataggtgttttggtttaatataaaatgagtcatggtaaagcttgattggatttactgggaccaaataagtatttgttgggaaaggtgtggtgtgttcagcagcttcacttaatgggtaggagaaagtcaaaatggttcaggaaaaataaaaaataccctggtagcaagcatgtcctgtttccatttcagtattttactgttagaaatataagctcagggctgggcgctgtgtctcacgcctgtaatcccagcactttgagaggctgaggcaggtggatcatgaggtcaggagctcgagaccatcctggctaacacggtgaaaccccgtctctactaaaaatacaaaaaattagccgggcatggtggc

SEQ ID NO: 342587 - DNA, 467 bp, Homo sapiens
taggcggagtggggaggcggcaagaggacctgcggcaggccctcttcggcagtctctccggcccggtttccctcggcgtgctactgtgcgctcgatccagcaccatggggaagcgggacaatcgggtggcctatatgaacccaatagcaatggcgagatcaaggggtccaatccagtcttcagggccaacaatacaggattatctgaatcgaccaaggcctacctgggaagaagtaaaagagcaactagaaaagaaaaagaaaggctccaaggctttggctgaatttgaagaaaaaatgaatgaggtttgtaaaaagtacctgttaaaaaaatagactaatttggccagttatggtggctcatacctataattccagcactttgggaggccgaaacgggaggccaggagttcatgaccagcctgggcaacaaagtaaggcccccccccgccgcccttgtctccatta

SEQ ID NO: 342588 - DNA, 2439 bp, Homo sapiens
taggcggagtggggaggcggcaagaggacctgcggcaggccctcttcggcagtctctccggcccggtttccctcggcgtgctactgtgcgctcgatccagcaccatggggaagcgggacaatcgggtggtactgccaaaattatgacatgataccaaggaaattagaatgtgatcaatattgttgaaaacaaaaacaaaaacctgagaccagttaaatttaacaaaggcctatatgaacccaatagcaatggcgagatcaaggggtccaatccagtcttcagggccaacaatacaggattatctgaatcgaccaaggcctacctgggaagaagtaaaagagcaactagaaaagaaaaagaaaggctccaaggctttggctgaatttgaagaaaaaatgaatgagaactggaagaaagaactggaaaaacacagggagaaattgttaagtggaagtgagagctcatccaaaaaaagacagagaaagaaaaaagaaaagaagaaatctggtaggtattcatcttcttcttcatcaagctctgattcttccagcagttcttctgattctgaagatgaggataagaaacaaggaaaacggagaaagaaaaagaagaaccgttcacataaatcttctgaaagctccatgtcagaaactgaatcagacagtaaggatagtttaaaaaagaaaaagaagtcaaaagatggaactgagaaagaaaaggatattaaaggactcagcaaaaagagaaagatgtattctgaagataaacctttatcatctgagtccttgtcagaatcagagtatattgaggaggtgcgagcaaaaaagaagaaaagcagtgaagaacgagaaaaagcaacagaaaaaacaaaaaagaaaaagaagcataagaaacacagtaagaagaagaaaaagaaggctgctagttcaagtcctgactcaccataacattaagaaaaatcaggattcccttataaagaaagtgcaatgtctgaggaaatttcaactgtgaaaactacaacatatttactaaaatgcatgaattttcttgtttttggaattattcctggactattcagtagccactcagatgccactgtgtgaaagggccataaatgttgcctgctgcttgaacatctatttttttctcttccagtgcttgataactctgggagataatacactgcagtcgtactagtggttaagatatttgggaataaaattaatacttttgactagaagcgtctaaggataaaccaacagaaattgaatctggatacatctttaagatgtaatcagaaatgaccagatgactctagttagaatttttgaaggagggattacattaatatttcaaaacccttactctgtagataagtgtattttaattttttcccctcgtatacttttatttacctggggaaggagcttttagggttggggggtggtttgctatctctttagctagcagaatagtgtgcctttgatcctcacacatcctgtattatggacacagtagccatgcttcacggggaggtcagagctggctaccagcagtcttgccctttactgagcttagtgtcatctttggatgctgtcatatgctgctttgagtgaaccagagaaacagccatttgcagcatgagaaagccccaaaagctctgggatttacctccactttagtaataatgaatattttttagcattagaatgtgttatgtcatttgaattaattttgactacactttggcttgggagaggaattattttaaatagacattggtactttttgaacttgatagctaaagattctaaaatgcatgttttatactaagttttaaccagtcaggaaaattttatgtaactagtgatagtttatttttttgtatgaattttgtttaggctgcaatgtttagcttttgttaactcctcactcttgctgtcttaagttcattactatgtttaatggcctacttgccaagatatttagcatgtaaaaagcagggttttgattaaaaaaaaaaaacggcttcatattgaagctgagacttacaataacaagttgagtggcaagcctggtatgctgtgtcttattgccagaatcttagtaaatgtaatgttttaaaagtttgttgtctttgtatattaataacaaattatgacaagttaagtttaaataagagttacattattgctctccctgtgtcatattttactaagattttgtgcctcatgtctactgctgaattgtttactaggaatgttaaaaggaattgataattcattttcattttacatttttatataatcaggtaacatgacatacaacttgatgtacaattttgcctgttacaaagggtgtgctaattatagtggtatatgcacagaacatgttggcatgacaacaggctgaataaatagctattttacttaaaaaaag

SEQ ID NO: 342589 - DNA, 2311 bp, Homo sapiens
taggcggagtggggaggcggcaagaggacctgcggcaggccctcttcggcagtctctccggcccggtttccctcggcgtgctactgtgcgctcgatccagcaccatggggaagcgggacaatcgggtggcctatatgaacccaatagcaatggcgagatcaaggggtccaatccagtcttcagggccaacaatacaggattatctgaatcgaccaaggcctacctgggaagaagtaaaagagcaactagaaaagaaaaagaaaggctccaaggctttggctgaatttgaagaaaaaatgaatgagaactggaagaaagaactggaaaaacacagggagaaattgttaagtggaagtgagagctcatccaaaaaaagacagagaaagaaaaaagaaaagaagaaatctggtaggtattcatcttcttcttcatcaagctctgattcttccagcagttcttctgattctgaagatgaggataagaaacaaggaaaacggagaaagaaaaagaagaaccgttcacataaatcttctgaaagctccatgtcagaaactgaatcagacagtaaggatagtttaaaaaagaaaaagaagtcaaaagatggaactgagaaagaaaaggatattaaaggactcagcaaaaagagaaagatgtattctgaagataaacctttatcatctgagtccttgtcagaatcagagtatattgaggaggtgcgagcaaaaaagaagaaaagcagtgaagaacgagaaaaagcaacagaaaaaacaaaaaagaaaaagaagcataagaaacacagtaagaagaagaaaaagaaggctgctagttcaagtcctgactcaccataacattaagaaaaatcaggattcccttataaagaaagtgcaatgtctgaggaaatttcaactgtgaaaactacaacatatttactaaaatgcatgaattttcttgtttttggaattattcctggactattcagtagccactcagatgccactgtgtgaaagggccataaatgttgcctgctgcttgaacatctatttttttctcttccagtgcttgataactctgggagataatacactgcagtcgtactagtggttaagatatttgggaataaaattaatacttttgactagaagcgtctaaggataaaccaacagaaattgaatctggatacatctttaagatgtaatcagaaatgaccagatgactctagttagaatttttgaaggagggattacattaatatttcaaaacccttactctgtagataagtgtattttaattttttcccctcgtatacttttatttacctggggaaggagcttttagggttggggggtggtttgctatctctttagctagcagaatagtgtgcctttgatcctcacacatcctgtattatggacacagtagccatgcttcacggggaggtcagagctggctaccagcagtcttgccctttactgagcttagtgtcatctttggatgctgtcatatgctgctttgagtgaaccagagaaacagccatttgcagcatgagaaagccccaaaagctctgggatttacctccactttagtaataatgaatattttttagcattagaatgtgttatgtcatttgaattaattttgactacactttggcttgggagaggaattattttaaatagacattggtactttttgaacttgatagctaaagattctaaaatgcatgttttatactaagttttaaccagtcaggaaaattttatgtaactagtgatagtttatttttttgtatgaattttgtttaggctgcaatgtttagcttttgttaactcctcactcttgctgtcttaagttcattactatgtttaatggcctacttgccaagatatttagcatgtaaaaagcagggttttgattaaaaaaaaaaaacggcttcatattgaagctgagacttacaataacaagttgagtggcaagcctggtatgctgtgtcttattgccagaatcttagtaaatgtaatgttttaaaagtttgttgtctttgtatattaataacaaattattttaaatagacattgattggtactttttgaacttgatagctaaagattctaaaatgcatattttatactaagttttaaccagtcaggaaaattttatgtaactagtgatagtttatttttttgtatgaattttgtttaggctgcaatgtttagcttttgttaactcctcactcttgctgtcttaagttcattactatgtttaatggcctacttgccaagatatttagcatgtaaaaagcagggttttgatt

SEQ ID NO: 342590 - DNA, 2299 bp, Homo sapiens
taggcggagtggggaggcggcaagaggacctgcggcaggccctcttcggcagtctctccggcccggtttccctcggcgtgctactgtgcgctcgatccagcaccatggggaagcgggacaatcgggtggcctatatgaacccaatagcaatggcgagatcaaggggtccaatccagtcttcagggccaacaatacaggattatctgaatcgaccaaggcctacctgggaagaagtaaaagagcaactagaaaagaaaaagaaaggctccaaggctttggctgaatttgaagaaaaaatgaatgagaactggaagaaagaactggaaaaacacagggagaaattgttaagtggaagtgagagctcatccaaaaaaagacagagaaagaaaaaagaaaagaagaaatctggtaggttcttctgattctgaagatgaggataagaaacaaggaaaacggagaaagaaaaagaagaaccgttcacataaatcttctgaaagctccatgtcagaaactgaatcagacagtaaggatagtttaaaaaagaaaaagaagtcaaaagatggaactgagaaagaaaaggatattaaaggactcagcaaaaagagaaagatgtattctgaagataaacctttatcatctgagtccttgtcagaatcagagtatattgaggaggtgcgagcaaaaaagaagaaaagcagtgaagaacgagaaaaagcaacagaaaaaacaaaaaagaaaaagaagcataagaaacacagtaagaagaagaaaaagaaggctgctagttcaagtcctgactcaccataacattaagaaaaatcaggattcccttataaagaaagtgcaatgtctgaggaaatttcaactgtgaaaactacaacatatttactaaaatgcatgaattttcttgtttttggaattattcctggactattcagtagccactcagatgccactgtgtgaaagggccataaatgttgcctgctgcttgaacatctatttttttctcttccagtgcttgataactctgggagataatacactgcagtcgtactagtggttaagatatttgggaataaaattaatacttttgactagaagcgtctaaggataaaccaacagaaattgaatctggatacatctttaagatgtaatcagaaatgaccagatgactctagttagaatttttgaaggagggattacattaatatttcaaaacccttactctgtagataagtgtattttaattttttcccctcgtatacttttatttacctggggaaggagcttttagggttggggggtggtttgctatctctttagctagcagaatagtgtgcctttgatcctcacacatcctgtattatggacacagtagccatgcttcacggggaggtcagagctggctaccagcagtcttgccctttactgagcttagtgtcatctttggatgctgtcatatgctgctttgagtgaaccagagaaacagccatttgcagcatgagaaagccccaaaagctctgggatttacctccactttagtaataatgaatattttttagcattagaatgtgttatgtcatttgaattaattttgactacactttggcttgggagaggaattattttaaatagacattggtactttttgaacttgatagctaaagattctaaaatgcatgttttatactaagttttaaccagtcaggaaaattttatgtaactagtgatagtttatttttttgtatgaattttgtttaggctgcaatgtttagcttttgttaactcctcactcttgctgtcttaagttcattactatgtttaatggcctacttgccaagatatttagcatgtaaaaagcagggttttgattaaaaaaaaaaaacggcttcatattgaagctgagacttacaataacaagttgagtggcaagcctggtatgctgtgtcttattgccagaatcttagtaaatgtaatgttttaaaagtttgttgtctttgtatattaataacaaattatgacaagttaagtttaaataagagttacattattgctctccctgtgtcatattttactaagattttgtgcctcatgtctactgctgaattgtttactaggaatgttaaaaggaattgataattcattttcattttacatttttatataatcaggtaacatgacatacaacttgatgtacaattttgcctgttacaaagggtgtgctaattatagtggtatatgcacagaacatgttggcatgacaacaggctgaataaatagctattttacttaaaaaaag

SEQ ID NO: 342591 - DNA, 2773 bp, Homo sapiens
taggcggagtggggaggcggcaagaggacctgcggcaggccctcttcggcagtctctccggcccggtttccctcggcgtgctactgtgcgctcgatccagcaccatggggaagcgggacaatcgggtggcctatatgaacccaatagcaatggcgagatcaaggggtccaatccagtcttcagggccaacaatacaggattatctgaatcgaccaaggcctacctgggaagaagtaaaagagcaactagaaaagaaaaagaaaggctccaaggctttggctgaatttgaagaaaaaatgaatgagaactggaagaaagaactggaaaaacacagggagaaattgttaagtggaagtgagagctcatccaaaaaaagacagagaaagaaaaaagaaaagaagaaatctggtagggtgagcaaaaattttccatttttctaaacgttacaattaagagccaacaaaaaaagtaagaataatttgtttaacctgtatgctaaaggtagcttaaactccagatgagtcaaggaacttagaggttctttgattgtgaagagtgattttgttctatcactgacataaaaaacggtgccaaccaccttataacgtagtacattttctgttgctatttaaagagaaagattggtgaccatggccacatatgttaacttgttgagcttttgtacagggaacaagtgtgacattttatattttcatatttatgacttatgaatatggcatctgtttctcagacactagattgatttcactaagtatttgagagactttgtaaaagaaaaacattctcgcatctcacaagctttaattgttttgtgcttggtcaagttattcatcttcttcttcatcaagctctgattcttccagcagttcttctgattctgaagatgaggataagaaacaaggaaaacggagaaagaaaaagaagaaccgttcacataaatcttctgaaagctccatgtcagaaactgaatcagacagtaaggatagtttaaaaaagaaaaagaagtcaaaagatggaactgagaaagaaaaggatattaaaggactcagcaaaaagagaaagatgtattctgaagataaacctttatcatctgagtccttgtcagaatcagagtatattgaggaggtgcgagcaaaaaagaagaaaagcagtgaagaacgagaaaaagcaacagaaaaaacaaaaaagaaaaagaagcataagaaacacagtaagaagaagaaaaagaaggctgctagttcaagtcctgactcaccataacattaagaaaaatcaggattcccttataaagaaagtgcaatgtctgaggaaatttcaactgtgaaaactacaacatatttactaaaatgcatgaattttcttgtttttggaattattcctggactattcagtagccactcagatgccactgtgtgaaagggccataaatgttgcctgctgcttgaacatctatttttttctcttccagtgcttgataactctgggagataatacactgcagtcgtactagtggttaagatatttgggaataaaattaatacttttgactagaagcgtctaaggataaaccaacagaaattgaatctggatacatctttaagatgtaatcagaaatgaccagatgactctagttagaatttttgaaggagggattacattaatatttcaaaacccttactctgtagataagtgtattttaattttttcccctcgtatacttttatttacctggggaaggagcttttagggttggggggtggtttgctatctctttagctagcagaatagtgtgcctttgatcctcacacatcctgtattatggacacagtagccatgcttcacggggaggtcagagctggctaccagcagtcttgccctttactgagcttagtgtcatctttggatgctgtcatatgctgctttgagtgaaccagagaaacagccatttgcagcatgagaaagccccaaaagctctgggatttacctccactttagtaataatgaatattttttagcattagaatgtgttatgtcatttgaattaattttgactacactttggcttgggagaggaattattttaaatagacattggtactttttgaacttgatagctaaagattctaaaatgcatgttttatactaagttttaaccagtcaggaaaattttatgtaactagtgatagtttatttttttgtatgaattttgtttaggctgcaatgtttagcttttgttaactcctcactcttgctgtcttaagttcattactatgtttaatggcctacttgccaagatatttagcatgtaaaaagcagggttttgattaaaaaaaaaaaacggcttcatattgaagctgagacttacaataacaagttgagtggcaagcctggtatgctgtgtcttattgccagaatcttagtaaatgtaatgttttaaaagtttgttgtctttgtatattaataacaaattatgacaagttaagtttaaataagagttacattattgctctccctgtgtcatattttactaagattttgtgcctcatgtctactgctgaattgtttactaggaatgttaaaaggaattgataattcattttcattttacatttttatataatcaggtaacatgacatacaacttgatgtacaattttgcctgttacaaagggtgtgctaattatagtggtatatgcacagaacatgttggcatgacaacaggctgaataaatagctattttacttaaaaaaag

SEQ ID NO: 342592 - DNA, 2095 bp, Homo sapiens
tgattttaatttaataatttaataattaatgacagcaacttcaagtagtgctgccagtctgagcagtacacaatgcctgtgtacctatttacttaaaactggcaaatttaatatctctgttctgtctgaaaactattttacaaaaacaattatgtttttatttggttactccattccagtaactgcaattactttacctttagaagttatatagcatgaaataatagtgattggtagcatgattcaattgaatttatttcctacaggaaattttgttagaagttatgttaatatgctaatgacttaagagtttctccctatctttttgaaaatcgacaagaactgttttagtcctcatatgatactggttgttgagactttttgaggaatgttttgagtagttttcttggttgtgtggattgtttggaattatgtggtagcttagaagcatggtaaagatgcttttaatttgcgtatttttatatagtaatgtctaacatggaattatctttacaggaaaaaacaaaaaagaaaaagaagcataagaaacacagtaagaagaagaaaaagaaggctgctagttcaagtcctgactcaccataacattaagaaaaatcaggattcccttataaagaaagtgcaatgtctgaggaaatttcaactgtgaaaactacaacatatttactaaaatgcatgaattttcttgtttttggaattattcctggactattcagtagccactcagatgccactgtgtgaaagggccataaatgttgcctgctgcttgaacatctatttttttctcttccagtgcttgataactctgggagataatacactgcagtcgtactagtggttaagatatttgggaataaaattaatacttttgactagaagcgtctaaggataaaccaacagaaattgaatctggatacatctttaagatgtaatcagaaatgaccagatgactctagttagaatttttgaaggagggattacattaatatttcaaaacccttactctgtagataagtgtattttaattttttcccctcgtatacttttatttacctggggaaggagcttttagggttggggggtggtttgctatctctttagctagcagaatagtgtgcctttgatcctcacacatcctgtattatggacacagtagccatgcttcacggggaggtcagagctggctaccagcagtcttgccctttactgagcttagtgtcatctttggatgctgtcatatgctgctttgagtgaaccagagaaacagccatttgcagcatgagaaagccccaaaagctctgggatttacctccactttagtaataatgaatattttttagcattagaatgtgttatgtcatttgaattaattttgactacactttggcttgggagaggaattattttaaatagacattggtactttttgaacttgatagctaaagattctaaaatgcatgttttatactaagttttaaccagtcaggaaaattttatgtaactagtgatagtttatttttttgtatgaattttgtttaggctgcaatgtttagcttttgttaactcctcactcttgctgtcttaagttcattactatgtttaatggcctacttgccaagatatttagcatgtaaaaagcagggttttgattaaaaaaaaaaaacggcttcatattgaagctgagacttacaataacaagttgagtggcaagcctggtatgctgtgtcttattgccagaatcttagtaaatgtaatgttttaaaagtttgttgtctttgtatattaataacaaattatgacaagttaagtttaaataagagttacattattgctctccctgtgtcatattttactaagattttgtgcctcatgtctactgctgaattgtttactaggaatgttaaaaggaattgataattcattttcattttacatttttatataatcaggtaacatgacatacaacttgatgtacaattttgcctgttacaaagggtgtgctaattatagtggtatatgcacagaacatgttggcatgacaacaggctgaataaatagctattttacttaaaaaaag

SEQ ID NO: 342593 - DNA, 2030 bp, Homo sapiens
gtagagatgggggagctctcactatgttgctcaggctggccttgaactcctgggctcaagcaagcctcctgccttggcctcccaaaatgctgagattacaggcaagagcaaccacactcggcctaaagctgatgtttttttccactgtaccacatttttttaggtgctgaaagggaatataagagaagctgtctagagattttacgtcttaattgtccttcctttatgttttttattgaaacctcattgagatataacaggagttattttaaatgtcctgtgattgtcaaaatgttttttacatttaaattttgaagatgcaagatagagaatgaaagaaaaatgccttgagtacaaattacatgtttgtcttctgttctccacaaaaatttaaactttctaggtgcgagcaaaaaagaagaaaagcagtgaagaacgagaaaaagcaacagaaaaaacaaaaaagaaaaagaagcataagaaacacagtaagaagaagaaaaagaaggctgctagttcaagtcctgactcaccataacattaagaaaaatcaggattcccttataaagaaagtgcaatgtctgaggaaatttcaactgtgaaaactacaacatatttactaaaatgcatgaattttcttgtttttggaattattcctggactattcagtagccactcagatgccactgtgtgaaagggccataaatgttgcctgctgcttgaacatctatttttttctcttccagtgcttgataactctgggagataatacactgcagtcgtactagtggttaagatatttgggaataaaattaatacttttgactagaagcgtctaaggataaaccaacagaaattgaatctggatacatctttaagatgtaatcagaaatgaccagatgactctagttagaatttttgaaggagggattacattaatatttcaaaacccttactctgtagataagtgtattttaattttttcccctcgtatacttttatttacctggggaaggagcttttagggttggggggtggtttgctatctctttagctagcagaatagtgtgcctttgatcctcacacatcctgtattatggacacagtagccatgcttcacggggaggtcagagctggctaccagcagtcttgccctttactgagcttagtgtcatctttggatgctgtcatatgctgctttgagtgaaccagagaaacagccatttgcagcatgagaaagccccaaaagctctgggatttacctccactttagtaataatgaatattttttagcattagaatgtgttatgtcatttgaattaattttgactacactttggcttgggagaggaattattttaaatagacattggtactttttgaacttgatagctaaagattctaaaatgcatgttttatactaagttttaaccagtcaggaaaattttatgtaactagtgatagtttatttttttgtatgaattttgtttaggctgcaatgtttagcttttgttaactcctcactcttgctgtcttaagttcattactatgtttaatggcctacttgccaagatatttagcatgtaaaaagcagggttttgattaaaaaaaaaaaacggcttcatattgaagctgagacttacaataacaagttgagtggcaagcctggtatgctgtgtcttattgccagaatcttagtaaatgtaatgttttaaaagtttgttgtctttgtatattaataacaaattatgacaagttaagtttaaataagagttacattattgctctccctgtgtcatattttactaagattttgtgcctcatgtctactgctgaattgtttactaggaatgttaaaaggaattgataattcattttcattttacatttttatataatcaggtaacatgacatacaacttgatgtacaattttgcctgttacaaagggtgtgctaattatagtggtatatgcacagaacatgttggcatgacaacaggctgaataaatagctattttacttaaaaaaag

SEQ ID NO: 342594 - DNA, 1326 bp, Homo sapiens
taggcggagtggggaggcggcaagaggacctgcggcaggccctcttcggcagtctctccggcccggtttccctcggcgtgctactgtgcgctcgatccagcaccatggggaagcgggacaatcgggtggcctatatgaacccaatagcaatggcgagatcaaggggtccaatccagtcttcagggccaacaatacaggattatctgaatcgaccaaggcctacctgggaagaagtaaaagagcaactagaaaagaaaaagaaaggctccaaggctttggctgaatttgaagaaaaaatgaatgagaactggaagaaagaactggaaaaacacagggagaaattgttaagtggaagtgagagctcatccaaaaaaagacagagaaagaaaaaagaaaagaagaaatctggtaggtattcatcttcttcttcatcaagctctgattcttccagcagttcttctgattctgaagatgaggataagaaacaaggaaaacggagaaagaaaaagaagaaccgttcacataaatcttctgaaagctccatgtcagaaactgaatcagacagtaaggatagtttaaaaaagaaaaagaagtcaaaagatggaactgagaaagaaaaggatattaaaggactcagcaaaaagagaaagatgtattctgaagataaacctttatcatctgagtccttgtcagaatcagagtatattgaggaggtaagtatatgatcaaatccattttctctattttaaaatgcttagttattgatttaataaatatgacttagaaaaagaaatacttcatatttaatttattcacctttctagtatgaaaaaacaaaatgaaagttatttcatttcagaatgagttttgcttttttccagaagataattatctattattttttataattaactgtatttccacatacctttctaatctgagatatttttagtcttctaatatttcctttttattgtgctaccattcttgttacatgaaagaagctgtgtaacatacagcatgttgaaaccaaacattctcttacattgttaaaatagaacattgcatatactatctcagtttagttgatatttagctgtgttttgagctacttttcggggagtatgaaaggtgatgaagtggagaagaaatgttggcaggaaacatatcatattacttcgttgtgagaactaaatgagatgataaattacgaaaggcattgcatcatacctgagacagagtaaatggtggctaaagctcggaatcatcgtggggtccccgaatattttataacccagttgtccccaaaaactttgttttataaaa

SEQ ID NO: 342595 - DNA, 1049 bp, Homo sapiens
gactagatgctaggcattacatgtgattcaaatcacttgatctttataacaggaaagtgatgtattaagtattaagaaaaaaatatagaaactgatccttttgtgaaattttgttcactgataaaagttttatattaataaatgtgtaaattagatttttgagacagaaagcaaatgtttctaaaaatattttatgtaggataagaaacaaggaaaacggagaaagaaaaagaagaaccgttcacataaatcttctgaaagctccatgtcagaaactgaatcagacagtaaggatagtttaaaaaagaaaaagaagtcaaaagatggaactgagaaagaaaaggatattaaaggactcagcaaaaagagaaagatgtattctgaagataaacctttatcatctgagtccttgtcagaatcagagtatattgaggaggtaagtatatgatcaaatccattttctctattttaaaatgcttagttattgatttaataaatatgacttagaaaaagaaatacttcatatttaatttattcacctttctagtatgaaaaaacaaaatgaaagttatttcatttcagaatgagttttgcttttttccagaagataattatctattattttttataattaactgtatttccacatacctttctaatctgagatatttttagtcttctaatatttcctttttattgtgctaccattcttgttacatgaaagaagctgtgtaacatacagcatgttgaaaccaaacattctcttacattgttaaaatagaacattgcatatactatctcagtttagttgatatttagctgtgttttgagctacttttcggggagtatgaaaggtgatgaagtggagaagaaatgttggcaggaaacatatcatattacttcgttgtgagaactaaatgagatgataaattacgaaaggcattgcatcatacctgagacagagtaaatggtggctaaagctcggaatcatcgtggggtccccgaatattttataacccagttgtccccaaaaactttgttttataaaa

SEQ ID NO: 342596 - DNA, 2340 bp, Homo sapiens
taggcggagtggggaggcggcaagaggacctgcggcaggccctcttcggcagtctctccggcccggtttccctcggcgtgctactgtgcgctcgatccagcaccatggggaagcgggacaatcgggtggcctatatgaacccaatagcaatggcgagatcaaggggtccaatccagtcttcagggccaacaatacaggattatctgaatcgaccaaggcctacctgggaagaagtaaaagagcaactagaaaagaaaaagaaaggctccaaggctttggctgaatttgaagaaaaaatgaatgagaactggaagaaagaactggaaaaacacagggagaaattgttaagtggaagtgagagctcatccaaaaaaagacagagaaagaaaaaagaaaagaagaaatctggtaggtattcatcttcttcttcatcaagctctgattcttccagcagttcttctgattctgaagatgaggataagaaacaaggaaaacggagaaagaaaaagaagaaccgttcacataaatcttctgaaagctccatgtcagaaactgaatcagacagtaaggatagtttaaaaaagaaaaagaagtcaaaagatggaactgagaaagaaaaggatattaaaggactcagcaaaaagagaaagatgtattctgaagataaacctttatcatctgagtccttgtcagaatcagagtatattgaggaggtgcgagcaaaaaagaagaaaagcagtgaagaacgagaaaaagcaacagaaaaaacaaaaaagaaaaagaagcataagaaacacagtaagaagaagaaaaagaaggctgctagttcaagtcctgactcaccataacattaagaaaaatcaggattcccttataaagaaagtgcaatgtctgaggaaatttcaactgtgaaaactacaacatatttactaaaatgcatgaattttcttgtttttggaattattcctggactattcagtagccactcagatgccactgtgtgaaagggccataaatgttgcctgctgcttgaacatctatttttttctcttccagtgcttgataactctgggagataatacactgcagtcgtactagtggttaagatatttgggaataaaattaatacttttgactagaagcgtctaaggataaaccaacagaaattgaatctggatacatctttaagatgtaatcagaaatgaccagatgactctagttagaatttttgaaggagggattacattaatatttcaaaacccttactctgtagataagtgtattttaattttttcccctcgtatacttttatttacctggggaaggagcttttagggttggggggtggtttgctatctctttagctagcagaatagtgtgcctttgatcctcacacatcctgtattatggacacagtagccatgcttcacggggaggtcagagctggctaccagcagtcttgccctttactgagcttagtgtcatctttggatgctgtcatatgctgctttgagtgaaccagagaaacagccatttgcagcatgagaaagccccaaaagctctgggatttacctccactttagtaataatgaatattttttagcattagaatgtgttatgtcatttgaattaattttgactacactttggcttgggagaggaattattttaaatagacattggtactttttgaacttgatagctaaagattctaaaatgcatgttttatactaagttttaaccagtcaggaaaattttatgtaactagtgatagtttatttttttgtatgaattttgtttaggctgcaatgtttagcttttgttaactcctcactcttgctgtcttaagttcattactatgtttaatggcctacttgccaagatatttagcatgtaaaaagcagggttttgattaaaaaaaaaaaacggcttcatattgaagctgagacttacaataacaagttgagtggcaagcctggtatgctgtgtcttattgccagaatcttagtaaatgtaatgttttaaaagtttgttgtctttgtatattaataacaaattatgacaagttaagtttaaataagagttacattattgctctccctgtgtcatattttactaagattttgtgcctcatgtctactgctgaattgtttactaggaatgttaaaaggaattgataattcattttcattttacatttttatataatcaggtaacatgacatacaacttgatgtacaattttgcctgttacaaagggtgtgctaattatagtggtatatgcacagaacatgttggcatgacaacaggctgaataaatagctattttacttaaaaaaag

SEQ ID NO: 342597 - DNA, 2415 bp, Homo sapiens
cacacacacacaattttctcccaaacttttaagacttaaaagaggattaaattaatttttttagaataaagagttggttagtcagattgcatatacttagctggatatattatgcatttatagtaaagattacttgatgagtaagtgaggttttgcatgtttaatgattgctttaatggattaattgttgttctttccccaaggcctatatgaacccaatagcaatggcgagatcaaggggtccaatccagtcttcagggccaacaatacaggattatctgaatcgaccaaggcctacctgggaagaagtaaaagagcaactagaaaagaaaaagaaaggctccaaggctttggctgaatttgaagaaaaaatgaatgagaactggaagaaagaactggaaaaacacagggagaaattgttaagtggaagtgagagctcatccaaaaaaagacagagaaagaaaaaagaaaagaagaaatctggtaggtattcatcttcttcttcatcaagctctgattcttccagcagttcttctgattctgaagatgaggataagaaacaaggaaaacggagaaagaaaaagaagaaccgttcacataaatcttctgaaagctccatgtcagaaactgaatcagacagtaaggatagtttaaaaaagaaaaagaagtcaaaagatggaactgagaaagaaaaggatattaaaggactcagcaaaaagagaaagatgtattctgaagataaacctttatcatctgagtccttgtcagaatcagagtatattgaggaggtgcgagcaaaaaagaagaaaagcagtgaagaacgagaaaaagcaacagaaaaaacaaaaaagaaaaagaagcataagaaacacagtaagaagaagaaaaagaaggctgctagttcaagtcctgactcaccataacattaagaaaaatcaggattcccttataaagaaagtgcaatgtctgaggaaatttcaactgtgaaaactacaacatatttactaaaatgcatgaattttcttgtttttggaattattcctggactattcagtagccactcagatgccactgtgtgaaagggccataaatgttgcctgctgcttgaacatctatttttttctcttccagtgcttgataactctgggagataatacactgcagtcgtactagtggttaagatatttgggaataaaattaatacttttgactagaagcgtctaaggataaaccaacagaaattgaatctggatacatctttaagatgtaatcagaaatgaccagatgactctagttagaatttttgaaggagggattacattaatatttcaaaacccttactctgtagataagtgtattttaattttttcccctcgtatacttttatttacctggggaaggagcttttagggttggggggtggtttgctatctctttagctagcagaatagtgtgcctttgatcctcacacatcctgtattatggacacagtagccatgcttcacggggaggtcagagctggctaccagcagtcttgccctttactgagcttagtgtcatctttggatgctgtcatatgctgctttgagtgaaccagagaaacagccatttgcagcatgagaaagccccaaaagctctgggatttacctccactttagtaataatgaatattttttagcattagaatgtgttatgtcatttgaattaattttgactacactttggcttgggagaggaattattttaaatagacattggtactttttgaacttgatagctaaagattctaaaatgcatgttttatactaagttttaaccagtcaggaaaattttatgtaactagtgatagtttatttttttgtatgaattttgtttaggctgcaatgtttagcttttgttaactcctcactcttgctgtcttaagttcattactatgtttaatggcctacttgccaagatatttagcatgtaaaaagcagggttttgattaaaaaaaaaaaacggcttcatattgaagctgagacttacaataacaagttgagtggcaagcctggtatgctgtgtcttattgccagaatcttagtaaatgtaatgttttaaaagtttgttgtctttgtatattaataacaaattatgacaagttaagtttaaataagagttacattattgctctccctgtgtcatattttactaagattttgtgcctcatgtctactgctgaattgtttactaggaatgttaaaaggaattgataattcattttcattttacatttttatataatcaggtaacatgacatacaacttgatgtacaattttgcctgttacaaagggtgtgctaattatagtggtatatgcacagaacatgttggcatgacaacaggctgaataaatagctattttacttaaaaaaag

SEQ ID NO: 342598 - DNA, 2286 bp, Homo sapiens
taggcggagtggggaggcggcaagaggacctgcggcaggccctcttcggcagtctctccggcccggtttccctcggcgtgctactgtgcgctcgatccagcaccatggggaagcgggacaatcgggtggcctatatgaacccaatagcaatggcgagatcaaggggtccaatccagtcttcagggccaacaatacaggattatctgaatcgaccaaggcctacctgggaagaagtaaaagagcaactagaaaagaaaaagaaaggctccaaggctttggctgaatttgaagaaaaaatgaatgagaactggaagaaagaactggaaaaacacagggagaaattgttaagtggaagtgagagctcatccaaaaaaagacagagaaagaaaaaagaaaagaagaaatctggtaggtattcatcttcttcttcatcaagctctgattcttccagcagttcttctgattctgaagatgaggataagaaacaaggaaaacggagaaagaaaaagaagaaccgttcacataaatcttctgaaagctccatgtcagaaactgaatcagacagtaaggatagtttaaaaaagaaaaagaagtcaaaagatggaactgagaaagaaaaggatattaaaggactcagcaaaaagagaaagatgtattctgaagataaacctttatcatctgagtccttgtcagaatcagagtatattgaggaggtgcgagcaaaaaagaagaaaagcagtgaagaacgagaaaaagcaacagaaaaaacaaaaaagaaaaagaagcataagaaacacagtaagaagaagaaaaagaaggctgctagttcaagtcctgactcaccataacattaagaaaaatcaggattcccttataaagaaagtgcaatgtctgaggaaatttcaactgtgaaaactacaacatatttactaaaatgcatgaattttcttgtttttggaattattcctggactattcagtagccactcagatgccactgtgtgaaagggccataaatgttgcctgctgcttgaacatctatttttttctcttccagtgcttgataactctgggagataatacactgcagtcgtactagtggttaagatatttgggaataaaattaatacttttgactagaagcgtctaaggataaaccaacagaaattgaatctggatacatctttaagatgtaatcagaaatgaccagatgactctagttagaatttttgaaggagggattacattaatatttcaaaacccttactctgtagataagtgtattttaattttttcccctcgtatacttttatttacctggggaaggagcttttagggttggggggtggtttgctatctctttagctagcagaatagtgtgcctttgatcctcacacatcctgtattatggacacagtagccatgcttcacggggaggtcagagctggctaccagcagtcttgccctttactgagcttagtgtcatctttggatgctgtcatatgctgctttgagtgaaccagagaaacagccatttgcagcatgagaaagccccaaatgtgttatgtcatttgaattaattttgactacactttggcttgggagaggaattattttaaatagacattggtactttttgaacttgatagctaaagattctaaaatgcatgttttatactaagttttaaccagtcaggaaaattttatgtaactagtgatagtttatttttttgtatgaattttgtttaggctgcaatgtttagcttttgttaactcctcactcttgctgtcttaagttcattactatgtttaatggcctacttgccaagatatttagcatgtaaaaagcagggttttgattaaaaaaaaaaaacggcttcatattgaagctgagacttacaataacaagttgagtggcaagcctggtatgctgtgtcttattgccagaatcttagtaaatgtaatgttttaaaagtttgttgtctttgtatattaataacaaattatgacaagttaagtttaaataagagttacattattgctctccctgtgtcatattttactaagattttgtgcctcatgtctactgctgaattgtttactaggaatgttaaaaggaattgataattcattttcattttacatttttatataatcaggtaacatgacatacaacttgatgtacaattttgcctgttacaaagggtgtgctaattatagtggtatatgcacagaacatgttggcatgacaacaggctgaataaatagctattttacttaaaaaaag

SEQ ID NO: 342599 - DNA, 1804 bp, Homo sapiens
atttaaaattgatacatatatttctttgtttaggatagtttaaaaaagaaaaagaagtcaaaagatggaactgagaaagaaaaggatattaaaggactcagcaaaaagagaaagatgtattctgaagataaacctttatcatctgagtccttgtcagaatcagagtatattgaggaggtgcgagcaaaaaagaagaaaagcagtgaagaacgagaaaaagcaacagaaaaaacaaaaaagaaaaagaagcataagaaacacagtaagaagaagaaaaagaaggctgctagttcaagtcctgactcaccataacattaagaaaaatcaggattcccttataaagaaagtgcaatgtctgaggaaatttcaactgtgaaaactacaacatatttactaaaatgcatgaattttcttgtttttggaattattcctggactattcagtagccactcagatgccactgtgtgaaagggccataaatgttgcctgctgcttgaacatctatttttttctcttccagtgcttgataactctgggagataatacactgcagtcgtactagtggttaagatatttgggaataaaattaatacttttgactagaagcgtctaaggataaaccaacagaaattgaatctggatacatctttaagatgtaatcagaaatgaccagatgactctagttagaatttttgaaggagggattacattaatatttcaaaacccttactctgtagataagtgtattttaattttttcccctcgtatacttttatttacctggggaaggagcttttagggttggggggtggtttgctatctctttagctagcagaatagtgtgcctttgatcctcacacatcctgtattatggacacagtagccatgcttcacggggaggtcagagctggctaccagcagtcttgccctttactgagcttagtgtcatctttggatgctgtcatatgctgctttgagtgaaccagagaaacagccatttgcagcatgagaaagccccaaaagctctgggatttacctccactttagtaataatgaatattttttagcattagaatgtgttatgtcatttgaattaattttgactacactttggcttgggagaggaattattttaaatagacattggtactttttgaacttgatagctaaagattctaaaatgcatgttttatactaagttttaaccagtcaggaaaattttatgtaactagtgatagtttatttttttgtatgaattttgtttaggctgcaatgtttagcttttgttaactcctcactcttgctgtcttaagttcattactatgtttaatggcctacttgccaagatatttagcatgtaaaaagcagggttttgattaaaaaaaaaaaacggcttcatattgaagctgagacttacaataacaagttgagtggcaagcctggtatgctgtgtcttattgccagaatcttagtaaatgtaatgttttaaaagtttgttgtctttgtatattaataacaaattatgacaagttaagtttaaataagagttacattattgctctccctgtgtcatattttactaagattttgtgcctcatgtctactgctgaattgtttactaggaatgttaaaaggaattgataattcattttcattttacatttttatataatcaggtaacatgacatacaacttgatgtacaattttgcctgttacaaagggtgtgctaattatagtggtatatgcacagaacatgttggcatgacaacaggctgaataaatagctattttacttaaaaaaag

SEQ ID NO: 342600 - DNA, 989 bp, Homo sapiens
taggcggagtggggaggcggcaagaggacctgcggcaggccctcttcggcagtctctccggcccggtttccctcggcgtgctactgtgcgctcgatccagcaccatggggaagcgggacaatcgggtggcctatatgaacccaatagcaatggcgagatcaaggggtccaatccagtcttcagggccaacaatacaggattatctgaatcgaccaaggcctacctgggaagaagtaaaagagcaactagaaaagaaaaagaaaggctccaaggctttggctgaatttgaagaaaaaatgaatgagaactggaagaaagaactggaaaaacacagggagaaattgttaagtggaagtgagagctcatccaaaaaaagacagagaaagaaaaaagaaaagaagaaatctggtagggtgagcaaaaattttccatttttctaaacgttacaattaagagccaacaaaaaaagtaagaataatttgtttaacctgtatgctaaaggtagcttaaactccagatgagtcaaggaacttagaggttctttgattgtgaagagtgattttgttctatcactgacataaaaaacggtgccaaccaccttataacgtagtacattttctgttgctatttaaagagaaagattggtgaccatggccacatatgttaacttgttgagcttttgtacagggaacaagtgtgacattttatattttcatatttatgacttatgaatatggcatctgtttctcagacactagattgatttcactaagtatttgagagactttgtaaaagatattcatcttcttcttcatcaagctctgattcttccagcagttcttctgattctgaagatgaggtaaggtttgcttataatggttcatgaaataatatctcttaatttctttaatgtcaagtggaaacccattgtgaaatatctgttagaaatgttgacttccaggttttgattaattatccataacttagag

SEQ ID NO: 342601 - DNA, 1501 bp, Homo sapiens
cgcagtgattctgagagtgtgagtgagaagctgcagggaggccgcagaggtctgtgcgggaatgcagccgtcagtcttctcagtcttcccgattttctcaccaaagcagtttgtgttgacaggtcacgtcaaagcaaaaagacttcctcagttttgatccccttctaattaattcctcatccatgtcactttacttctgccagcacttgctttctggtgacagcgcacgtgacatatctagaaggaacatgggttttaaaaacgtcaaggcttctgagctatttatgtgcatcaggtactaggacagtacatctaagtttagttggaagagagagaattttagttaggggtatgagctcccttagtgtgtgggcctctcctgttcatcttttcgttttaagcttttagttagagctatatgcatagagttgcagagaataaaatagtgcaggggaaaactcttcctagttccagtttacacggctcattctggtccttctgttacctccttactaataaataatgtacttggctatacctctatttcttgacttcatcattagatattatttgttgacttcgagctttaaaagatgagagttactcttctcttcctcttcccacactactgaggttgctattttatgtgctaccttgctccagtgaaacacttgcctccttagctcttttgttctgtctgctacagacagtatctcttgacccctcttttggcagtccatcttctccttacctctcccacccctgtcatagccaggcttcccacctgtcctgtgactttccccgttgtcaaggttgagaacatgtgcattctgtcctataactgcagttaagcctcactcttgtctgttggcttagtctaaaaagttgcagtgtgacaattctttcttgtatgattatgaccatatcattcatggcagagtcacatagtgtactgtgattatattccattcttttatagcctttttcctggagtttctattttttctcttgatcttactttcaattgttttcctatgaagcttctcacggtatcagctgtttacggagactcctttcatatcactgttttttgactctgatttcagaggtgatttgttggtgtgctaccatcgtagctgagaatttagcttacttgccacctcatctggagccccttccttagtcctcctcatcacgtgtgccttctccatcctctcctccctattctgttatcactgtgggcagttgatgagttattgccttaaattgtctggctttctcgggtgctgccttcaaccttagcacgtttctagtgcctgcctccgtttcccatggttgaattaggctattggcagagctagtggttgaaaatttgtggcttacaaaatgctgagttgcttttatgtcattgtataccttatttcctacctgtaatgctgtgctgtgtccagtgatgctgtttgtggtttgatatgcatttttaaagagacttagtctcctg

SEQ ID NO: 342602 - DNA, 328 bp, Homo sapiens
tcatctgtttctacatgggtttctacaaaaagtgagagattcactgttgttaaagttgaagtgttagattaacaggaagagtgtaccacaatggagaggagcatgagattcagaagccacccgtcaccaagaattaatttcctttaacccctctttgattgcaggcaacattaaaaagcacagactttgggtcaaggaagtggctcatgcctgtaatcccagcactctgggaggctgaagtgggaggatcacatgagcccaggagttcaagaccagcccaggcaacaaagcgcaagaccccatctctacaaaaaatgcaaaaattagc

SEQ ID NO: 342603 - DNA, 430 bp, Homo sapiens
ctgaaaccctcccctatttttaagcctggtttcttcctctttagtctttcatggacataaaaaattactcaccatctgctgaaaaaattcttcacctttgaaaatttggtctttataagggaaaaatgaagcaaaataaaaacaaaacaaaaagaaaatttggtcttttcctcagttgtttcaaagatagcaatgaaaataaaatttgcagcagaggagaggaaaaaagcaatgtgggccagagctgagtcatgatgaatgaatgggatttagataggagaacagaagaaaagggtagcattccaaacataggagagtggggagaatggaaggatatcatcaaaagtctgaaaataggagctaatgtgttttaggaaagtaagaaggtaactgtctataccttaaaagcagaggagtttcaatttgatag

SEQ ID NO: 342604 - DNA, 737 bp, Homo sapiens
ttctcctgcctcagcctccgaagtagctgggattacaggcatgcaccaccactcgtggctaattttgtatttttagtagagatggggtttctccatgttggtcaggctggtctcgaactcctgacctcaagtgatccacccgccttggcctcccaaagtgctgggattacaggcgtgagctaccacgcctggccaagaggcagtttttgaattccaaaattatggagtgatatctgggagtcagccttcatcagtgatgctgcttgtgctttctccagcttcttgggagactgggcaccaggagacttggaggttcttccctatcttacctactcccaagtatgcatgtttttgaaaaaaatatttaagatttctagagaagatcacaatcttctccagtgtctgtgtaatccattgtggagcagtttattacagctgacctactgtctcctgtctgttttaggagcggtgacttaggttatcaccccttagtgttttcctgtcatctgccttctcatctccacctaaaatttagtttttggtaaaagatcatgctatctaaccttgtcatcattgcaaaacaaacttatttatgtttatcatgatgctgacattagcaagctgactcatggtttaatgttagtgtttcttactactggtcactggctgacagtcggaaaagtgatgccctattttttttttttttttttgagatggaatcttgctctgttgcccag

SEQ ID NO: 342605 - DNA, 481 bp, Homo sapiens
ttaaaacttgatagtcaacaattcctttagttgtggtgaatctgctcttaaaccattcattatgttatatatttcaataattaaatttcatacctaagttgtctttggttctttttaatatctgccttttaacacatctctcatttcatgttcgttttaattcatacattatttaaacatataactgttattctacttctgctaattgcaatacctgaattccttgaatatctaaatctactgtttctcaatgcaaatggtgtgtttccttgcatgtttgattaatctagaagcattaattagggaggctttccttcggaggggattttcatccacttcttagagtaaccaccagagtccactgacttaggactactttaatgctttaaagcattcctggttttatgaaggaatcttaggttcactttctttactttgcctggagtccatggcttaagtctcagaggcacagttttcctgt

SEQ ID NO: 342606 - DNA, 506 bp, Homo sapiens
aaactttttcttcaaatgctacacagtaaataattttggctctgcgggcatttagtctctgtcaggaatgctcagctctgtggttctgacaggacagctgtccctccagacccttggaggattatttccaggaactcccgggatgccaaaattcccagatgctcaatcccagatataaaatggtgtagtattagcatacaacctacgtacatccttccatatgctttagtgagtcacctctagattacttataatactccataaaatgtaaatgctacataaacagctgttatactatagttttatttgtattattttatgttgtattgttttttccattattttccttcaaaaaaaatttttttttttaagacccagagtcttgctctgtcacccaggctggagtggagtggcgcggcacaatctcagctcactgcaacctctgcctctggggttcaagcaattctcctgctccgtttccgacctgggccggttcacccctcctt

SEQ ID NO: 342607 - DNA, 3056 bp, Homo sapiens
atggggctgcagcccctggagttcagcgactgctacctcgacagcccgtggttccgggagaggatccgcgctcacgaagcggaactcgagaggaccaacaagttcatcaaagagctcattaaggacgggaagaacctcatcgctgcgacgaaaagtctgtcagtggcccagcggaagtttgctcattcactcagagactttaagtttgagtttatcggtgatgctgtgacagatgatgaacgatgcatagatgcttccttacgtgaattttcaaattttttgaagaatctggaggaacagagagaaattatggcattaagtgtaactgaaaccctgattaaacccttggaaaaattcagaaaagagcaacttggagctgtaaaggaagaaaaaaagaagtttgacaaagagacagaaaagaattatagtctaattgataaacatttgaatttatcagcaaaaaagaaagactcacatttacaagaggcagatatccaagtagagcagaaccggcaacacttctatgaactgtctctcgagtatgtgtgtaagctgcaggaaatccaagaaagaaagaagtttgagtttgtggaacctatgctgtcattttttcaggggatgtttaccttctatcatcagggccatgaacttgccaaagacttcaatcactacaaaatggaactacagatcaacattcagaatacacggaatcgatttgaaggaacaaggtcagaagtggaagagctcatgaacaaaatcagacagaatcccaaggaccacaaacgagcaagtcagtttacagccgaaggctacctgtatgtccaggaaaaaaggcctgctccgtttggttccagttgggtcaaacactattgcatgtatcgaaaagcagcaaagaagttcaacatgatcccatttgagcacagatctggagggaaacttggggacggagaggtgttctttttgaaagaatgtaccaagaggcatactgactccattgacagaaggttttgttttgacatagaagctgctgatcggcctggcgtttccttgaccatgcaggcattttccgaagaggaaaggaagcagtggttggaagctctgggtggaaaggaagctctgtcccatagttttaatacagccatcatcccaagaccagaaggaaatgcacagttggataagatggggttcacaattatcagaaaatgcatcagtgccgttgaaacacgaggtataaatgaccaaggattgtacagagttgtgggggtgagttcaaaggtccagagacttctgagtatgttgatggatgtaaaaacatgcaatgaggtggacctggagaattctgcagattgggaagtgaagacaataacaagtgccttgaaacagtatttgaggagtcttccagagcctctcatgacctatgagttacatggagatttcattgttccagccaaaagcggcagcccagaatctcgtgttaatgcgatccatttcttggtacacaaactgccagagaagaataaagagatgttggatattttggtgaaacacttaacaaatgtttcaaatcactccaagcagaacctgatgactgtggcaaacttaggagtggtgtttggaccaactctgatgaggccacaggaagaaactgtcgctgccctcatggacttgaagtttcagaatattgttgtggaaatcttaattgaaaaccatgaaaagatttttcggacgccgcccgatactacattccctgagcccacctgcctgtcagcatcacccccaaatgcgccaccaaggcagtcgaagagacaaggccagagaaccaagaggcccgtggccgtctacaatctttgtctggagctggaagatggtgacaatccttacccttccaaggaggacacccctaccagcagtctggactcactttcctccccgtctcccgtgactacagctgtccctgggcctcctggaccagacaaaaaccaccttctggcagatggagggagctttggagactgggcatccactatcccaggccagacccgatcgtctatggtccagtggcttaacccacagtctccaaccacaacaagctccaactcagctgtgacacctctttcacccgggtcgtcccctttccccttttctcctcctgctactgtagcggacaagccacctgaaagcatccgcagtcggaaggctcgagccgtgtatccgtgtgaagcagaacacagctcggaattatcttttgaaataggagcaatttttgaggatgtacaaacctccagggaacctggctggctagaagggactctgaacggcaagagggggctgattccacagaactacgtcaagctgctgtagctcctggcctcagagcccctgctgaccctggcacccagggacctgcctgggggcagagagctgtcttcctcctccgaggctctgggctgcacccacaggtacctccacacttgggagttaccatcatcacagtcagccctgggggtggggggtggtgggcagggatgggacgcaccacacagaactgtgattgtggatcaggaggggaatgtcaggattcgcaaaatggacttttcatttgtcaagtattgggacttgtgatttttaattatccagcatatagaatgagagggagggcagccttctgccacctgtgtcgcctccactggcagtcacgccaccagagccaccctggctccctctcctccctgagcacctgctgctgcgattttaaagggaactgtactactcgcagtgataggtttgcagagtgtgtgcttggctgtggcagcctagcttggagaagctgctgttggtgcaagggagatggtctcaagtcagagggaagcagagacgcgcgtctcaagcctgcccttcctagacggccacctgcaggaccccacactcactgcactggcagcgtgcactggcgtatttgtaacaggcttctcggtgctcctcacccgtgtgctgttttccaaacaccacctttttgcctcaaggtctctgtaaatgaaataaactgtaatttacta

SEQ ID NO: 342608 - DNA, 3065 bp, Homo sapiens
atggggctgcagcccctggagttcagcgactgctacctcgacagcccgtggttccgggagaggatccgcgctcacgaagcggaactcgagaggaccaacaagttcatcaaagagctcattaaggacgggaagaacctcatcgctgcgacgaaaagtctgtcagtggcccagcggaagtttgctcattcactcagagactttaagtttgagtttatcggtgatgctgtgacagatgatgaacgatgcatagatgcttccttacgtgaattttcaaattttttgaagaatctggaggaacagagagaaattatggcattaagtgtaactgaaaccctgattaaacccttggaaaaattcagaaaagagcaacttggagctgtaaaggaagaaaaaaagaagtttgacaaagagacagaaaagaattatagtctaattgataaacatttgaatttatcagcaaaaaagaaagactcacatttacaagaggcagatatccaagtagagcagaaccggcaacacttctatgaactgtctctcgagtatgtgtgtaagctgcaggaaatccaagaaagaaagaagtttgagtttgtggaacctatgctgtcattttttcaggggatgtttaccttctatcatcagggccatgaacttgccaaagacttcaatcactacaaaatggaactacagatcaacattcagaatacacggaatcgatttgaaggaacaaggtcagaagtggaagagctcatgaacaaaatcagacagaatcccaaggaccacaaacgagcaagtcagtttacagccgaaggctacctgtatgtccaggaaaaaaggcctgctccgtttggttccagttgggtcaaacactattgcatgtatcgaaaagcagcaaagaagttcaacatgatcccatttgagcacagatctggagggaaacttggggacggagaggtgttctttttgaaagaatgtaccaagaggcatactgactccattgacagaaggttttgttttgacatagaagctgctgatcggcctggcgtttccttgaccatgcaggcattttccgaagaggaaaggaagcagtggttggaagctctgggtggaaaggaagctctgtcccatagttttaatacagccatcatcccaagaccagaaggaaatgcacagttggataagatggggttcacaattatcagaaaatgcatcagtgccgttgaaacacgaggtataaatgaccaaggattgtacagagttgtgggggtgagttcaaaggtccagagacttctgagtatgttgatggatgtaaaaacatgcaatgaggtggacctggagaattctgcagattgggaagtgaagacaataacaagtgccttgaaacagtatttgaggagtcttccagagcctctcatgacctatgagttacatggagatttcattgttccagccaaaagcggcagcccagaatctcgtgttaatgcgatccatttcttggtacacaaactgccagagaagaataaagagatgttggatattttggtgaaacacttaacaaatgtttcaaatcactccaagcagaacctgatgactgtggcaaacttaggagtggtgtttggaccaactctgatgaggccacaggaagaaactgtcgctgccctcatggacttgaagtttcagaatattgttgtggaaatcttaattgaaaaccatgaaaagatttttcggacgccgcccgatactacattccctgagcccacctgcctgtcagcatcacccccaaatgcgccaccaaggcagtcgaagagacaaggccagagaaccaagaggcccgtggccgtctacaatctttgtctggagctggaagatggtgacaatccttacccttccaaggaggacacccctaccagcagtctggactcactttcctccccgtctcccgtgactacagctgtccctgggcctcctggaccagacaaaaaccaccttctggcagatggagggagctttggagactgggcatccactatcccaggccagacccgatcgtctatggtccagtggcttaacccacagtctccaaccacaacaagctccaactcagctgtgacacctctttcacccgggtcgtcccctttccccttttctcctcctgctactgtagcggacaagccacctgaaagcatccgcagtcggaaggctcgagccgtgtatccgtgtgaagcagaacacagctcggaattatcttttgaaataggagcaatttttgaggatgtacaaacctccagggaacctggctggctagaagggactctgaacggcaagagggggctgattccacagaactacgtcaagctgctgtagctcctggcctcagagcccctgctgaccctggcacccagggacctgcctgggggcagagagctgtcttcctcctccgaggctctgggctgcacccacaggtacctccacacttgggagttaccatcatcacagtcagccctgggggtggggggtggtgggcagggatgggacgcaccacacagaactgtgattgtggatcaggaggggaatgtcaggattcgcaaaatggacttttcatttgtcaagtattgggacttgtgatttttaattatccagcatatagaatgagagggagggcagccttctgccacctgtgtcgcctccactggcagtcacgccaccagagccaccctggctccctctcctccctgagcacctgctgctgcgattttaaagggaactgtactactcgcagtgataggtttgcagagtgtgtgcttggctgtggcagcctagcttggagaagctgctgttggtgcaagggagatggtctcaagtcagagggaagcagagacgcgcgtctcaagcctgcccttcctagacggccacctgcaggaccccacactcactgcactggcagcgtgcactggcgtatttgtaacaggcttctcggtgctcctcacccgtgtgctgttttccaaacaccaacccaccctttgtaatttacaatcacacggtggctcctgtaaattaacctatatttt

SEQ ID NO: 342609 - DNA, 1922 bp, Homo sapiens
gcttcgtctgttaatcctgtccgcaggattaataagtctgcagcacggagtgagcagtcagcgatggtgctgttgtcgggagggcgagtctcccccttgatgctttggactggattaagcggctgcgttaggctcccagaccccaatgccaggggcctgttgttgatggctggaatgccactatgctcgcttcttgattactctctgacccatctcatcttgtgggtcttcgttcaggtcatctctctcctgacgggaagaagctagtgtcacttggacttaagaaatgtttctgatttgcacactttattttctttgttctcccagagttgctaaccaagtcctttaaatgcttcgggtttaccaactctgagtcaacagaggatactactgtccttaaaaatttttgatttctatttctcttaccatttttgtgctttacatttttgctgatttgaacagtgtgtgagtctccagattcgggtattgactttgcatattgaaacaagggtgtagcttttgaggatttaatattcatacacaagcatttaggagctatgcctggttaaatatttcaaaaagttctcttatggctcagtgtctttttttctcctgctcttgctttcttccctccccagtcctgctcattatgaaatgcattagttgctgtggaaaccgtgatgtcgtgtgtgggtggagctcctcagaagagttccagggaagcagtaggaaccttagctgcttggaatggaatggttgattatccagaatgtttgggatatgtggaatgtatcaacacgaggcacagtggtgtactgtcagtaatgcagcatttgctgacgattgttttttagaaagcaagttgcctcatttagaatagatttctatatgcgtgtgatatgtactcttcagagacagagactcctggtagtgtcagaaaacaaacaacaacaacaaaaccccacatggaacagaattagactttgtggagaaattttgttcttggaatagaagcaagatcattcctccatcaccataacatacatgcagttttgccaagagaatgtggaacgtagctgccctgccccaggcctgtctcatgttggcacaccatatggctgaaggggaggatgcgatgtacaaacctccagggaacctggctggctagaagggactctgaacggcaagagggggctgattccacagaactacgtcaagctgctgtagctcctggcctcagagcccctgctgaccctggcacccagggacctgcctgggggcagagagctgtcttcctcctccgaggctctgggctgcacccacaggtacctccacacttgggagttaccatcatcacagtcagccctgggggtggggggtggtgggcagggatgggacgcaccacacagaactgtgattgtggatcaggaggggaatgtcaggattcgcaaaatggacttttcatttgtcaagtattgggacttgtgatttttaattatccagcatatagaatgagagggagggcagccttctgccacctgtgtcgcctccactggcagtcacgccaccagagccaccctggctccctctcctccctgagcacctgctgctgcgattttaaagggaactgtactactcgcagtgataggtttgcagagtgtgtgcttggctgtggcagcctagcttggagaagctgctgttggtgcaagggagatggtctcaagtcagagggaagcagagacgcgcgtctcaagcctgcccttcctagacggccacctgcaggaccccacactcactgcactggcagcgtgcactggcgtatttgtaacaggcttctcggtgctcctcacccgtgtgctgttttccaaacaccacctttttgcctcaaggtctctgtaaatgaaataaactgtaatttacta

SEQ ID NO: 342610 - DNA, 320 bp, Homo sapiens
gtgagtattgccaagttgtttgctggtggatttttgcaatgtaagataagtatttattttcctagatctgatttatggtttatagttactagaggccatagtgcataaacatgaaagagacatattaaaaagggcagacacagatagccatgaagtcaaggaattgcctctaaatcagtggttctcagctgtatttgcactgataatacacgtaatattcccattgctacatgatctcaaggaaggcaaccatgtgcaatttctgccaccttagcctatagctctatcttttaaaaatttctctgaaataatttatacta

SEQ ID NO: 342611 - DNA, 670 bp, Homo sapiens
gatctgggccagtggtttctcacctgtggagtgtggctgtgccgcctccttctgccggctggccgtgtgtctccaggtgcgtgtgcttttcctaatagaccaactgaagtgcttggagataaacatgtcctgtggttctaacagtgctgaatggtaggaaagggcatcccaccaggtagggaggagaattaggtgaagtggttcagtgacagctcctcagagaggctccctgaggaaaggcttgaattggaaacccatcatttacttgaaaatcaagtactgttcttagcctgatgttcacttccacgttaatttctcttttgggaggagttgccctactggtgacatcagtgagatttggggaaggggggttggggggtgaagtttctctctgttttccacattttcattggtgtcttttgtattctctttcttttcagcatccgcagtcggaaggctcgagccgtgtatccgtgtgaagcagaacacagctcggaattatcttttgaaataggagcaatttttgaggatggtaagtgttagtgggagcttcgtctgttaatcctgtccgcaggattaataagtctgcagcacggagtgagcagtcagcgatggtgctgttgtcgggagggcgagtctcccccttgatgctttggactggattaagcgg

SEQ ID NO: 342612 - DNA, 457 bp, Homo sapiens
tggaatagaagcaagatcattcctccatcaccataacatacatgcagttttgccaagagaatgtggaacgtagctgccctgccccaggcctgtctcatgttggcacaccatatggctgaaggggaggatgcgatggtagtattgaaacgcactcatttgagaaatgtgatgaatttttattttgtgtgattggatttgtttagaagactctgaactccctcctgcagtatggtttgtgagatagttaccttggtagaaggtgtatctactaggataccttaggctgcaggtaacaaaaattgacacaactgtttgaatcaatcatgaagatggattaaagtcaggtgcagtggtgcacacctgttgtgccagctactgcagaggctgaggcaggaggatcacttgtgcccaggagttcgaggccagcctggataacacagtgagaccccatctcaaa

SEQ ID NO: 342613 - DNA, 2903 bp, Homo sapiens
atggggctgcagcccctggagttcagcgactgctacctcgacagcccgtggttccgggagaggatccgcgctcacgaagcggaactcgagaggaccaacaagttcatcaaagagctcattaaggacgggaagaacctcatcgctgcgacgaaaagtctgtcagtggcccagcggaagtttgctcattcactcagagactttaagtttgagtttatcggtgatgctgtgacagatgatgaacgatgcatagatgcttccttacgtgaattttcaaattttttgaagaatctggaggaacagagagaaattatggcattaagtgtaactgaaaccctgattaaacccttggaaaaattcagaaaagagcaacttggagctgtaaaggaagaaaaaaagaagtttgacaaagagacagaaaagaattatagtctaattgataaacatttgaatttatcagcaaaaaagaaagactcacatttacaagaggcagatatccaagtagagcagaaccggcaacacttctatgaactgtctctcgagtatgtgtgtaagctgcaggaaatccaagaaagaaagaagtttgagtttgtggaacctatgctgtcattttttcaggggatgtttaccttctatcatcagggccatgaacttgccaaagacttcaatcactacaaaatggaactacagatcaacattcagaatacacggaatcgatttgaaggaacaaggtcagaagtggaagagctcatgaacaaaatcagacagaatcccaaggaccacaaacgagcaagtcagtttacagccgaaggctacctgtatgtccaggaaaaaaggcctgctccgtttggttccagttgggtcaaacactattgcatgtatcgaaaagcagcaaagaagttcaacatgatcccatttgagcacagatctggagggaaacttggggacggagaggtgttctttttgaaagaatgtaccaagaggcatactgactccattgacagaaggttttgttttgacatagaagctgctgatcggcctggcgtttccttgaccatgcaggcattttccgaagaggaaaggaagcagtggttggaagctctgggtggaaaggaagctctgtcccatagttttaatacagccatcatcccaagaccagaaggaaatgcacagttggataagatggggttcacaattatcagaaaatgcatcagtgccgttgaaacacgaggtataaatgaccaaggattgtacagagttgtgggggtgagttcaaaggtccagagacttctgagtatgttgatggatgtaaaaacatgcaatgaggtggacctggagaattctgcagattgggaagtgaagacaataacaagtgccttgaaacagtatttgaggagtcttccagagcctctcatgacctatgagttacatggagatttcattgttccagccaaaagcggcagcccagaatctcgtgttaatgcgatccatttcttggtacacaaactgccagagaagaataaagagatgttggatattttggtgaaacacttaacaaatgtttcaaatcactccaagcagaacctgatgactgtggcaaacttaggagtggtgtttggaccaactctgatgaggccacaggaagaaactgtcgctgccctcatggacttgaagtttcagaatattgttgtggaaatcttaattgaaaaccatgaaaagatttttcggacgccgcccgatactacattccctgagcccacctgcctgtcagcatcacccccaaatgcgccaccaaggcagtcgaagagacaaggccagagaaccaagaggcccgtggccgtctacaatctttgtctggagctggaagatggtgacaatccttacccttccaaggaggacacccctaccagcagtctggactcactttcctccccgtctcccgtgactacagctgtccctgggcctcctggaccagacaaaaaccaccttctggcagatggagggagctttggagactgggcatccactatcatccgcagtcggaaggctcgagccgtgtatccgtgtgaagcagaacacagctcggaattatcttttgaaataggagcaatttttgaggatgtacaaacctccagggaacctggctggctagaagggactctgaacggcaagagggggctgattccacagaactacgtcaagctgctgtagctcctggcctcagagcccctgctgaccctggcacccagggacctgcctgggggcagagagctgtcttcctcctccgaggctctgggctgcacccacaggtacctccacacttgggagttaccatcatcacagtcagccctgggggtggggggtggtgggcagggatgggacgcaccacacagaactgtgattgtggatcaggaggggaatgtcaggattcgcaaaatggacttttcatttgtcaagtattgggacttgtgatttttaattatccagcatatagaatgagagggagggcagccttctgccacctgtgtcgcctccactggcagtcacgccaccagagccaccctggctccctctcctccctgagcacctgctgctgcgattttaaagggaactgtactactcgcagtgataggtttgcagagtgtgtgcttggctgtggcagcctagcttggagaagctgctgttggtgcaagggagatggtctcaagtcagagggaagcagagacgcgcgtctcaagcctgcccttcctagacggccacctgcaggaccccacactcactgcactggcagcgtgcactggcgtatttgtaacaggcttctcggtgctcctcacccgtgtgctgttttccaaacaccacctttttgcctcaaggtctctgtaaatgaaataaactgtaatttacta

SEQ ID NO: 342614 - DNA, 1496 bp, Homo sapiens
gggagatcgggagctcgagaccagcctgaccaatatgatgaaaccccgtctctactaaaaatacataaattagctgggcatggtggcatgcacctgtaatcccagctacttgggaggctgagacaggagaattgcttgaacccgggaggcagaggttgcagtgagccgagattgcgcaattgcatgccagcctgggtaacgagcaaaactccatcttaaaaaaacccacaaaaggtcctggcctgcagtcaatccctggaatcattgtaccttcccttgagacccgaagtggactattccaacagaaccccctcatccttgagtctatggcacaacccactggaatggcactacaggatcttttctgtgaatgtcctccaacccccctttccgtggtgggaaatttgatcctaactagggctaatccagcctgtccttcagcctcagccccctattttcctgtcctcagagtccctggagcttgtactgtgtggcatgtcctttcttgccttccccaccttgctcagtagcatttctcagggacccagtcgaatccaagcccatggattcaattgtcacatccttcatcttccatccgtgtctcctaatctgtgtgctcttgctttctttcctcggagctctggactgacccgacagcctgtcttcatgtagcagtaccctcctgcctccatagcccccggtcccacccccatcctaccaattaggccagcagttggccttaactgcttgattaatttccttggactgccataacagatcaccattgggtggtgaacttgatggcttaagtccaacaggaatttaattcacacagttctggagtccagaagtctgaaaccaaggtgctgacagggacacactccctcttccagctcctggtgattccaggccttccttggctctgcctgcagcttcacatggccttttccctcttctattttgtctcttacaagaacacctgtcattgcatttagggcccatcttaagttcaggatgatcccacctcaagacccttaattacatctgaaaaaacactttttccaaataaactgtcataagcacaggtcctgggggttagtatgtggacttgtctgttgggggcacaccattcaagccattcagcccactattcctcctcaccccaagagtacgctggcgtccaggtgcagtggctcacacctgtaatcccagcactttgggagaccaggcaggagggatctctttgagcccaggagctgaagaccagcctgggcaacatagtgagaccccatctctacaaaagtaaaataaaaaattagccaggtgcggtgatgcatgcctgtagtcccagctacttgggaggctgaggcaggaggatcacctgagccctggaggtcgaggctgcagcgagccgtgatcgcgccactacactccagcctggatgacagagtgagaccctttctcagaaaaaaagtaccctgggactcctgccaacc

SEQ ID NO: 342615 - DNA, 855 bp, Homo sapiens
gggagatcgggagctcgagaccagcctgaccaatatgatgaaaccccgtctctactaaaaatacataaattagctgggcatggtggcatgcacctgtaatcccagctacttgggaggctgagacaggagaattgcttgaacccgggaggcagaggttgcagtgagccgagattgcgcaattgcatgccagcctgggtaacgagcaaaactccatcttaaaaaaacccacaaaaggtcctggcctgcagtcaatccctggaatcattgtaccttcccttgagacccgaagtggactattccaacagaaccccctcatccttgagtctatggcacaacccactggaatggcactacaggatcttttctgtgaatgtcctccaacccccctttccgtggtgggaaatttgatcctaactagggctaatccagcctgtccttcagcctcagccccctattttcctgtcctcagagtccctggagcttgtactgtgtggcatgtcctttcttgccttccccaccttgctcagtagcatttctcagggacccagtcgaatccaagcccatggattcaattgtcacatccttcatcttccatccgtgtctcctaatctgtgtgctcttgctttctttcctcggagctctggactgacccgacagcctgtcttcatgtagcagtaccctcctgcctcacacctgcaatcccagcactttggaaggtcgaggtgggcgggtcatttgaagtcgggaggtcgggagatcgggagatcgagaccagcctggccaacatggcaaaaccccgtctctactaaaaatacaaaaattagccgggcatgttggcacattcctgaatcccag

SEQ ID NO: 342616 - DNA, 373 bp, Homo sapiens
tcaatttctgacaataatcacaataataatgaccctggacaagtaaccttaacctcttgcctcattttcttcataagaaaaaaaaaaggtactttcgctgcttatcttacagatttgttgtgacaatttaatgagagccaattagcatgctttaaaaaccatatggagctctatacaaatacaaagccttagttttgccgcatgttttggtgaaaagagaaagaagtgggaggagaagtgcttatcataagtaaggcctcttctctatcaaactaggaaactaatgcaggtgagggttgaacaagggcaagaggaatctgaaatggttacgtaggcatctaagcctattttcaatactttggtaatcccatgg

SEQ ID NO: 342617 - DNA, 307 bp, Homo sapiens
gtatgtgcaccttcatcctgagccccagagcttagttaaatccacccccagtatcctcaggccccactggcagccttccctgcccccaccaccagtgagccacttaatgatttgtgacatcccaaagtcccgaactgtcttgtcaccccagtcactggttcaggcccttccttgcccctccttctagagaaagagccctccagctcacctcagagaagatacaagatccctacagacaccattgtagggaccagccccacagggtcggtgggtctctacctgtgtgagacgacgagagagtgtagaa

SEQ ID NO: 342618 - DNA, 1160 bp, Homo sapiens
ggctgccactctcactgccagaccatgccatcaactgcgtgcgcatgggcctggacatgtgccgggccatcaggaaactgcgggcagccactggcgtggacatcaacatgcgtgtgggcgtgcactcaggcagcgtactgtgtggagtcatcgggctgcagaagtggcagtacgacgtttggtcacatgatgtcacactggctaaccacatggaggcaggcggtgtaccagggtgagacctagggccctaggcagctacagcagaaggccaaccaggcctaccacaggctgccatcctttcattagttccttaagataagcacaagatgagtaccttaagataagtcccatatggggcttgggagatcctagggtgcagggaggggagctgggaggcacctcctgtaacacaggctctttcttgaagtcagacatccaggaacgatctttaaaagacatgagatgtttgtcagttctaggagccatgggggtgatggggcaggaaataggagatttgaaggccctccctgctgacccctactgcctccctccttccaggcgagtgcacatcacaggggctaccctggccctgctggcaggggcttatgctgtggaggacgcaggcatggagcatcgggacccctaccttcgggagctaggggagcctacctatctggtcatcgatccacgggcagaggaggaggatgagaagggcactgcaggaggcttgctgtcctcgcttgagggcctcaagatgcgtccatcactgctgatgacccgttacctggagtcctggggcgcagccaagccttttgcccacctgagccacggagacagccctgtgtccacctccacccctctcccggagaagaccctggcttccttcagcacccagtggagcctggatcggagccgtaccccccggggactagatgatgaactggacaccggggatgccaagttcttccaggtcattgagcagctcaactcgcagaaacagtggaagcagtcgaaggacttcaacccactgacactgtacttcagagagaaggagatggagaaagagtaccgactctctgcaatccccgccttcaaatactatgaagcctgcaccttcctggtttttctctccaacttcatcatccagatgctagtgacaa

SEQ ID NO: 342619 - DNA, 1134 bp, Homo sapiens
ggctgccactctcactgccagaccatgccatcaactgcgtgcgcatgggcctggacatgtgccgggccatcaggaaactgcgggcagccactggcgtggacatcaacatgcgtgtgggcgtgcactcaggcagcgtactgtgtggagtcatcgggctgcagaagtggcagtacgacgtttggtcacatgatgtcacactggctaaccacatggaggcaggcggtgtaccagggtgagacctagggccctaggcagctacagcagaaggccaaccaggcctaccacaggctgccatcctttcattagttccttaagataagcacaagatgagtaccttaagataagtcccatatggggcttgggagatcctagggtgcagggaggggagctgggaggcacctcctgtaacacaggctctttcttgaagtcagacatccaggaacgatctttaaaagacatgagatgtttgtcagttctaggagccatgggggtgatggggcaggaaataggagatttgaaggccctccctgctgacccctactgcctccctccttccaggcgagtgcacatcacaggggctaccctggccctgctggcaggggcttatgctgtggaggacgcaggcatggagcatcgggacccctaccttcgggagctaggggagcctacctatctggtcatcgatccacgggcagaggaggaggatgagaagggcactgcaggaggcttgctgtcctcgcttgagggcctcaagatgcgtccatcactgctgatgacccgttacctggagtcctggggcgcagccaagccttttgcccacctgagccacggagacagccctgtgtccacctccacccctctcccggagaagaccctggcttccttcagcacccagtggagcctggatcggagccgtaccccccggggactagatgatgaactggacaccggggatgccaagttcttccagacagtggaagcagtcgaaggacttcaacccactgacactgtacttcagagagaaggagatggagaaagagtaccgactctctgcaatccccgccttcaaatactatgaagcctgcaccttcctggtttttctctccaacttcatcatccagatgctagtgacaa

SEQ ID NO: 342620 - DNA, 541 bp, Homo sapiens
agcccagcaacctgcttagactccagggatgcctccaagcaaccaattcttggattccccccaacctctcaatcctgagaccactaccacgtactcaactctgggtacccccttcaacatgccaaaagtggaaagagccacagccatccagcccttggggaaactcttctgagaaagagatctgtatgaaagacagttagccccatatcaagtgaaaggagtccctagatctgatctagacactaccccaccttggaagttcttcaggaataccccgctcgctgcccacttttcccaactccctcctacccttctgacctctaaccaggttcctctgcacacccacatacacactcccaggagcatgaatgcatgcggatcaagatcctgggggactgttactactgtgtctctgggctgccactctcactgccagaccatgccatcaactgcgtgcgcatgggcctggacatgtgccgggccatcaggtcagctcaggcggtggtcaagaggaatgctgagggtggatgtggggggcagc

SEQ ID NO: 342621 - DNA, 834 bp, Homo sapiens
ggctgccactctcactgccagaccatgccatcaactgcgtgcgcatgggcctggacatgtgccgggccatcaggaaactgcgggcagccactggcgtggacatcaacatgcgtgtgggcgtgcactcaggcagcgtactgtgtggagtcatcgggctgcagaagtggcagtacgacgtttggtcacatgatgtcacactggctaaccacatggaggcaggcggtgtaccagggcgagtgcacatcacaggggctaccctggccctgctggcaggggcttatgctgtggaggacgcaggcatggagcatcgggacccctaccttcgggagctaggggagcctacctatctggtcatcgatccacgggcagaggaggaggatgagaagggcactgcaggaggcttgctgtcctcgcttgagggcctcaagatgcgtccatcactgctgatgacccgttacctggagtcctggggcgcagccaagccttttgcccacctgagccacggagacagccctgtgtccacctccacccctctcccggagaagaccctggcttccttcagcacccagtggagcctggatcggagccgtaccccccggggactagatgatgaactggacaccggggatgccaagttcttccaggtcattgagcagctcaactcgcagaaacagtggaagcagtcgaaggacttcaacccactgacactgtacttcagagagaaggagatggagaaagagtaccgactctctgcaatccccgccttcaaatactatgaagcctgcaccttcctggtttttctctccaacttcatcatccagatgctagtgacaa

SEQ ID NO: 342622 - DNA, 1240 bp, Homo sapiens
ggctgccactctcactgccagaccatgccatcaactgcgtgcgcatgggcctggacatgtgccgggccatcaggaaactgcgggcagccactggcgtggacatcaacatgcgtgtgggcgtgcactcaggcagcgtactgtgtggagtcatcgggctgcagaagtggcagtacgacgtttggtcacatgatgtcacactggctaaccacatggaggcaggcggtgtaccagggtgagacctagggccctaggcagctacagcagaaggccaaccaggcctaccacaggctgccatcctttcattagttccttaagataagcacaagatgagtaccttaagataagtcccatatggggcttgggagatcctagggtgcagggaggggagctgggaggcacctcctgtaacacaggctctttcttgaagtcagacatccaggaacgatctttaaaagacatgagatgtttgtcagttctaggagccatgggggtgatggggcaggaaataggagatttgaaggccctccctgctgacccctactgcctccctccttccaggcgagtgcacatcacaggggctaccctggccctgctggcaggggcttatgctgtggaggacgcaggcatggagcatcgggacccctaccttcgggagctaggggagcctacctatctggtcatcgatccacgggcagaggaggaggatgagaagggcactgcaggaggcttgctgtcctcgcttgagggcctcaagatgcgtccatcactgctgatgacccgttacctggagtcctggggcgcagccaagccttttgcccacctgagccacggagacagccctgtgtccacctccacccctctcccgagaaagagccctccagctcacctcagagaagatacaagatccctacagacaccattgtagggaccagccccacagggtcggagaagaccctggcttccttcagcacccagtggagcctggatcggagccgtaccccccggggactagatgatgaactggacaccggggatgccaagttcttccaggtcattgagcagctcaactcgcagaaacagtggaagcagtcgaaggacttcaacccactgacactgtacttcagagagaaggagatggagaaagagtaccgactctctgcaatccccgccttcaaatactatgaagcctgcaccttcctggtttttctctccaacttcatcatccagatgctagtgacaa

SEQ ID NO: 342623 - DNA, 277 bp, Homo sapiens
gataaagatctctaaattagaggagagaaaaagaattttagattgcaagttttagattacattcctatgttcatggagtaatgtctagtagaactttgagatgtgactggcattacagaaataggtcagaaatggagaacagtttaggaatattccaaatagtagtgacaccatgtcatcagagttgatgagttctcaggcaacgcagccacctaaagtgaagaacagagacctgaggacgaaatccttggaaaagactcccactaagcaagcctga

SEQ ID NO: 342624 - DNA, 4039 bp, Homo sapiens
  misc_feature (2568)..(2568): n is a, c, g, or t
taggggcaagattagaagctgggagaccatggatattaggcaagaaattatgagtatttgttggcaagatacagtgctattaattggaaagagttatttaggagattagcaaataattacatattgggtgacatggttgggagacagctcagtgcagagataagagaaagaagttttggtgaattgcatggttttgccccaggcaactgggtggacggtggaactgtaaattgagaatgattacaataatgctaacatttaaggggtatttagtatgttccaagcactgtgctgtatgctttacacaaagtaacttattcctcataataacctgtgaagtcggtaaactattacccccattttatagatggggaagctgagacctggagacaaaacggaagtcccacttagctaagattctaaaccagacattctgactccagaacccagcgcatagactctatattacggcaatattatagcccataccattgtcaataatagtatgaaatttgacatctcctaatcaactttatatctcacacatatggagtgatgacaaataatgccttaggtcaccacattagttggagaaatgtagcattaaattaccgtctcttatagtaaattaccatcaaataatgaatttgtgccaagtacaagagcactgaatttcccaacaatagatttataaataacaattggaggaaagtttagaagtaggcagtattttgaaaatttggcagttgctttttatattgcttgttttacatttttaatacaaatgtagggggaattctcagcatcttagtacttctcttcacatagctaacctagtgtcttacagtggaaacgcatgtattccgttggaaacaggaagacaggaagtagaggcagtggataaagacaaccctttgaagaatttttttctttctttttttaatgggagcagtgcacaagtgcagggacttgagatgggagtactggcagcggagcggtgggagcggtagggaagctcagtacgtgaggggtgcagctgcagagagttgatcagtgtggtgttggagcgtgtgcttccgtattttcaaggaaataaaagaaatgaggttatgaggccttcccttccactagtcctttgggaccgttcttgtcaagaaccctggtgatgcccatactgctagactcccggtcagttcaccattctcctcctcctccatttgacagttcgtgattccctcctcttttctgaaatgctttcttcacttgctggtgaccattctcttttcccttctgcctcaccgccacttcttctcagcctcatttgcctcttgcctctttatcttctggacttcaaggtccagtgcacagtagatggactgcctttttctctgtttgcagccgctccccaggggacctcatgaagcccggtgattctgaatgccgtggatctgccgaggattcccagatgcgtatttctcctccgtacttccccacaggacagcaggcttgaatagctgattgcctatgcaggacaacaggcttgaatagctgactgcctatgcattctctttgcttgccagttttttggacatcaaacttgacagatccaagattattactttgatcttccccacacccctcccacccccgagtctactatggtcccatcatagtattctgaaaatcagtgaatggccactctaccagttatttctaccagtttttaggttctaaacctcaggcattctggactcttctgttcattatcatattttgaaggcattatcttcaaaatctatctagactctgaccctttctcccatctccaccattactgccgtggctcttctgctggtcggctctctcctggtggatcgtaataacctgcagtcagctatcctggtccagagggagcccgttaaaccctgtggaatcttatcacgcttctgctcagaacgagccagtgtctttctgtctcactcagagtgtaagctacagtccttattgtggccatcaggtgctgtgtgttctccagccccctccccaccaccgcagtcctgccggtgatcttagctgctctcccctcggcaccccctgcggccccctctgccgcagcactcgtggcctgctgttccttgaacatgcttggtgttttctctcctcaaaggcttctttctgtttacctgaaatgtactttcctagggaatctatctggctcactcgcttactttttccacatctttgcttaagtattgccttattggagaggcaccctaccataaactagaatcccttgccccagctgctctttgtcctccgtattgggctttgtttttgttcttaccagttagaaccacttgacacacgatacatgtgtttgttacccttttctaccactagaacagacgctccatggtggtatagacttatttccgcaaaccaccccccccaactttttttacacaatggttaaataacacacatatttttaatgcaatgcctgatatcacaaagcctaaaataacaatgtttggcacattatagctgtttagtaaaaggttattaaangaattgactatatgaatgaatgcttagtaaatagcttttccatttatctgtagttgctctataaatcagtattgatgtaattgagtgtttttcttcctccacagtacaatggtcagttccgttcaaggaaacacatatcccagccaggcgccagtatatagtcctcctcctgccgctactgctgctgctgcaactgccgatgtcactctgtaccagaatgcaggacctaatatgccccaggtgccaaactataacttaacatcatcaactctgcctcagcccggaggcagccaacagccacctcagccacagcaaccatattctcagaaggctctgctataggacccggtgttcctcttggtggcagatacctgctaaatgccactgacaatgttatgagattcattactatcttaagatgtgtttatcctcagcttataggaatctctccaggtcaacaggttcaaatattcaagaaggtagaactctcctcaatttacactgactttttagaggttcttccccccccgcccctgcagaggaatgaaactacttacaacatttaattcctttcataatatgaaagaattgatacaaggctatttgtctcgtaaacctggtctgcagaaagtcaaacttacaaaaactgttgtgacaaatgttatgtacatatattgatatgtaactgcattagtggccattttgaatcacagtggtgatcgtgtgaatatatttaacactgtgttaaattaatttacgttgctattttattttaatcataaacaactaccatgtttcttaatgttttgtgtaaatttaaggtaattatactatccttttaaacttcaagaaaacaaagttgttagcgtatttacatgaaggcgcattatgttgtcgtgtgtttcagtttcacattaaactgaaccttttactaattgtgagctaaagagatatatatatatatgtgtgtgtatatatatatatctacatgtctttctgtagcctctgcatactactggctgtcatcacaccagcgtacagtagctaaatttttggtgcaattatagcaaatgataatgttcccttttgaacttttacattttggcatgacatttcagagtattgtgggaccatgagacaaaattaagtacgatcacattctttatttctcattttaaagaaatgatgttggtttaccttttcctagttgaagatagtaattaggtttctaagctgtatactgtgtttattggtggcagtgacaccaaagatagaggcaatggatagaaatttttaaactggaaagaaaacctgaattacactacattttcgaagtctcttgtaattatttgggatatcaacaaaatttgattcgtctgtctaatcccttgctagtattttaaatatgtctttaacacattgtatcctttaattcttcattaaaatggaaataagtagatgtttcaaagta

SEQ ID NO: 342625 - DNA, 518 bp, Homo sapiens
  misc_feature (147)..(147): n is a, c, g, or t
  misc_feature (166)..(167): n is a, c, g, or t
  misc_feature (170)..(170): n is a, c, g, or t
gaacagagtgacatcgccagttcagcaagcacagtatgcggcagcagcaggcttatatactggcgcctggctataatatgtgtttctttgaacggaactgcccattgtttttgggtgagcggcctgagtctgctgactaggaagggntgggttggcggatggtggnnccnctgcctggcatgagacaaaattaagtacgatcacattctttatttctcattttaaagaaatgatgttggtttaccttttcctagttgaagatagtaattaggtttctaagctgtatactgtgtttattggtggcagtgacaccaaagatagaggcaatggatagaaatttttaaactggaaagaaaacctgaattacactacattttcgaagtctcttgtaattatttgggatatcaacaaaatttgattcgtctgtctaatcccttgctagtattttaaatatgtctttaacacattgtatcctttaattcttcattaaaatggaaataagtagatgtttcaaagta

SEQ ID NO: 342626 - DNA, 776 bp, Homo sapiens
  misc_feature (736)..(736): n is a, c, g, or t
  misc_feature (772)..(772): n is a, c, g, or t
taggggcaagattagaagctgggagaccatggatattaggcaagaaattatgagtatttgttggcaagatacagtgctattaattggaaagagttatttaggagattagcaaataattacatattgggtgacatggttgggagacagctcagtgcagagataagagaaagaagttttggtgaattgcatggttttgccccaggcaactgggtggacggtggaactgtaaattgagaatgattacaataatgctaacatttaaggggtatttagtatgttccaagcactgtgctgtatgctttacacaaagtaacttattcctcataataacctgtgaagtcggtaaactattacccccattttatagatggggaagctgagacctggagacaaaacggaagtcccacttagctaagattctaaaccagacattctgactccagaacccagcgcatagactctatattacggcaatattatagcccataccattgtcaataatagtatgaaatttgacatctcctaatcaactttatatctcacacatatggagtgatgacaaataatgccttaggtcaccacattagttggagaaatgtagcattaaattaccgtctcttatagtaaattaccatcaaataatgaatttgtgccaagtacaagagcactgaatttcccaacaatagatttataaataacaattggagaagttaaatagcagatttgaattgcagtntttaatgtgttctttatcaatgagggatctacttancttt

SEQ ID NO: 342627 - DNA, 569 bp, Homo sapiens
ctaaaatgcaggatatttttgttataagtgaaatttttaataatgtctactagtactactttttgccatttttgatattttgatgtatcattatttagagcattatatcattttagtaacagctatgcttcaaattattgtgtcatgtttcagaaaacattcagaactctcagaacttaatgtgaaagtgatggaggccctttccttatataccaagttaatgaacgaagatccgatgtattccatgtatgcaaagttacagaatcagccatattatatgcagtcatctggtgtttctggttctcaggtgtatgcagggcctcctccaagtggtgcctacctggttgcagggaacgcgcagatgagccacctccagagctacagtcttcccccggagcagctgtcttctctcagccaggcagtggtcccaccatccgcaaacccagcccttcctagtcagcagactcaggccgcttacccaaagtaattttactgttgattcttgtttggagttagtgctgttacagctgtttaagtgcccccagttatctataactataaaatctggc

SEQ ID NO: 342628 - DNA, 2598 bp, Homo sapiens
tacctgccacaattgagcccctttaacttctgattttgtgcttttagcttctaggagcatgtgtatcaaactgtggcaaaatttttcatttagaagtatgttcaagagattttgctagtgaagtaagcaacgtattaaataagggtcatcctaaagtatgtgaaaaattaaaggctcttatggttgaatggacagatgaatttaagaatgatccacagcttagtctaatatcagcaatgattaagaaccttaaggaacaaggagttacgttcccagctattggctctcaggctgcagaacaagcaaaagcaagcccagctcttgtagccaaggatcctggtactgtggctaacaaaaaagaagaagaagatttagcaaaagccattgagttgtctctcaaggaacaaaggcagcagtcaaccaccctttccactttgtatccaagcacatccagtctcttaactaaccaccaacatgaaggccgaaaagttcgtgctatatatgactttgaagctgctgaagacaatgaacttacttttaaagctggagaaattattacagttcttgatgacagtgatcctaactggtggaaaggtgaaacccatcaaggcatagggttatttccttctaattttgtgactgcagatctcactgctgaaccagaaatgattaaaacagagaagaagacggtacaatttagtgatgatgttcaggtagagacaatagaaccagagccggaaccagcctttattgatgaagataaaatggaccagttgctacagatgctgcaaagtacagaccccagtgatgatcagccagacctaccagagctgcttcatcttgaagcaatgtgtcaccagatgggacctctcattgatgaaaagctggaagatattgatagaaaacattcagaactctcagaacttaatgtgaaagtgatggaggccctttccttatataccaagttaatgaacgaagatccgatgtattccatgtatgcaaagttacagaatcagccatattatatgcagtcatctggtgtttctggttctcaggtgtatgcagggcctcctccaagtggtgcctacctggttgcagggaacgcgcagatgagccacctccagagctacagtcttcccccggagcagctgtcttctctcagccaggcagtggtcccaccatccgcaaacccagcccttcctagtcagcagactcaggccgcttacccaaatacaatggtcagttccgttcaaggaaacacatatcccagccaggcgccagtatatagtcctcctcctgccgctactgctgctgctgcaactgccgatgtcactctgtaccagaatgcaggacctaatatgccccaggtgccaaactataacttaacatcatcaactctgcctcagcccggaggcagccaacagccacctcagccacagcaaccatattctcagaaggctctgctataggacccggtgttcctcttggtggcagatacctgctaaatgccactgacaatgttatgagattcattactatcttaagatgtgtttatcctcagcttataggaatctctccaggtcaacaggttcaaatattcaagaaggtagaactctcctcaatttacactgactttttagaggttcttccccccccgcccctgcagaggaatgaaactacttacaacatttaattcctttcataatatgaaagaattgatacaaggctatttgtctcgtaaacctggtctgcagaaagtcaaacttacaaaaactgttgtgacaaatgttatgtacatatattgatatgtaactgcattagtggccattttgaatcacagtggtgatcgtgtgaatatatttaacactgtgttaaattaatttacgttgctattttattttaatcataaacaactaccatgtttcttaatgttttgtgtaaatttaaggtaattatactatccttttaaacttcaagaaaacaaagttgttagcgtatttacatgaaggcgcattatgttgtcgtgtgtttcagtttcacattaaactgaaccttttactaattgtgagctaaagagatatatatatatatgtgtgtgtatatatatatatctacatgtctttctgtagcctctgcatactactggctgtcatcacaccagcgtacagtagctaaatttttggtgcaattatagcaaatgataatgttcccttttgaacttttacattttggcatgacatttcagagtattgtgggaccatgagacaaaattaagtacgatcacattctttatttctcattttaaagaaatgatgttggtttaccttttcctagttgaagatagtaattaggtttctaagctgtatactgtgtttattggtggcagtgacaccaaagatagaggcaatggatagaaatttttaaactggaaagaaaacctgaattacactacattttcgaagtctcttgtaattatttgggatatcaacaaaatttgattcgtctgtctaatcccttgctagtattttaaatatgtctttaacacattgtatcctttaattcttcattaaaatggaaataagtagatgtttcaaagta

SEQ ID NO: 342629 - DNA, 2796 bp, Homo sapiens
aagctccgcgcgggggcttcctcggctccttgctgttgccgccgccgcagctgctgccgcggttggtggggttgggtgagaggaggagctgtcgcggaccctgtagagtcggtctctgttgctctttttgcctgaggagtcttccatcctacgtcgagctctgactcccgtgctgtcgagagggagtccccggggacacctcggcacgcagcggagatgcctctttttgccaccaatcccttcgatcaggatgttgagaaagcaaccagcgagatgaatactgctgaggactggggcctcattttggatatctgtgataaagttggtcagtctcgcactggggtcatcctaaagtatgtgaaaaattaaaggctcttatggttgaatggacagatgaatttaagaatgatccacagcttagtctaatatcagcaatgattaagaaccttaaggaacaaggagttacgttcccagctattggctctcaggctgcagaacaagcaaaagcaagcccagctcttgtagccaaggatcctggtactgtggctaacaaaaaagaagaagaagatttagcaaaagccattgagttgtctctcaaggaacaaaggcagcagtcaaccaccctttccactttgtatccaagcacatccagtctcttaactaaccaccaacatgaaggccgaaaagttcgtgctatatatgactttgaagctgctgaagacaatgaacttacttttaaagctggagaaattattacagttcttgatgacagtgatcctaactggtggaaaggtgaaacccatcaaggcatagggttatttccttctaattttgtgactgcagatctcactgctgaaccagaaatgattaaaacagagaagaagacggtacaatttagtgatgatgttcaggtagagacaatagaaccagagccggaaccagcctttattgatgaagataaaatggaccagttgctacagatgctgcaaagtacagaccccagtgatgatcagccagacctaccagagctgcttcatcttgaagcaatgtgtcaccagatgggacctctcattgatgaaaagctggaagatattgatagaaaacattcagaactctcagaacttaatgtgaaagtgatggaggccctttccttatataccaagttaatgaacgaagatccgatgtattccatgtatgcaaagttacagaatcagccatattatatgcagtcatctggtgtttctggttctcaggtgtatgcagggcctcctccaagtggtgcctacctggttgcagggaacgcgcagatgagccacctccagagctacagtcttcccccggagcagctgtcttctctcagccaggcagtggtcccaccatccgcaaacccagcccttcctagtcagcagactcaggccgcttacccaaatacaatggtcagttccgttcaaggaaacacatatcccagccaggcgccagtatatagtcctcctcctgccgctactgctgctgctgcaactgccgatgtcactctgtaccagaatgcaggacctaatatgccccaggtgccaaactataacttaacatcatcaactctgcctcagcccggaggcagccaacagccacctcagccacagcaaccatattctcagaaggctctgctataggacccggtgttcctcttggtggcagatacctgctaaatgccactgacaatgttatgagattcattactatcttaagatgtgtttatcctcagcttataggaatctctccaggtcaacaggttcaaatattcaagaaggtagaactctcctcaatttacactgactttttagaggttcttccccccccgcccctgcagaggaatgaaactacttacaacatttaattcctttcataatatgaaagaattgatacaaggctatttgtctcgtaaacctggtctgcagaaagtcaaacttacaaaaactgttgtgacaaatgttatgtacatatattgatatgtaactgcattagtggccattttgaatcacagtggtgatcgtgtgaatatatttaacactgtgttaaattaatttacgttgctattttattttaatcataaacaactaccatgtttcttaatgttttgtgtaaatttaaggtaattatactatccttttaaacttcaagaaaacaaagttgttagcgtatttacatgaaggcgcattatgttgtcgtgtgtttcagtttcacattaaactgaaccttttactaattgtgagctaaagagatatatatatatatgtgtgtgtatatatatatatctacatgtctttctgtagcctctgcatactactggctgtcatcacaccagcgtacagtagctaaatttttggtgcaattatagcaaatgataatgttcccttttgaacttttacattttggcatgacatttcagagtattgtgggaccatgagacaaaattaagtacgatcacattctttatttctcattttaaagaaatgatgttggtttaccttttcctagttgaagatagtaattaggtttctaagctgtatactgtgtttattggtggcagtgacaccaaagatagaggcaatggatagaaatttttaaactggaaagaaaacctgaattacactacattttcgaagtctcttgtaattatttgggatatcaacaaaatttgattcgtctgtctaatcccttgctagtattttaaatatgtctttaacacattgtatcctttaattcttcattaaaatggaaataagtagatgtttcaaagta

SEQ ID NO: 342630 - DNA, 3006 bp, Homo sapiens
aagctccgcgcgggggcttcctcggctccttgctgttgccgccgccgcagctgctgccgcggttggtggggttgggtgagaggaggagctgtcgcggaccctgtagagtcggtctctgttgctctttttgcctgaggagtcttccatcctacgtcgagctctgactcccgtgctgtcgagagggagtccccggggacacctcggcacgcagcggagatgcctctttttgccaccaatcccttcgatcaggatgttgagaaagcaaccagcgagatgaatactgctgaggactggggcctcattttggatatctgtgataaagttggtcagtctcgcactggacctaaggattgtcttcggtctattatgagaagagtgaaccacaaagatcctcacgttgctatgcaggctttgactcttctaggagcatgtgtatcaaactgtggcaaaatttttcatttagaagtatgttcaagagattttgctagtgaagtaagcaacgtattaaataagggtcatcctaaagtatgtgaaaaattaaaggctcttatggttgaatggacagatgaatttaagaatgatccacagcttagtctaatatcagcaatgattaagaaccttaaggaacaaggagttacgttcccagctattggctctcaggctgcagaacaagcaaaagcaagcccagctcttgtagccaaggatcctggtactgtggctaacaaaaaagaagaagaagatttagcaaaagccattgagttgtctctcaaggaacaaaggcagcagtcaaccaccctttccactttgtatccaagcacatccagtctcttaactaaccaccaacatgaaggccgaaaagttcgtgctatatatgactttgaagctgctgaagacaatgaacttacttttaaagctggagaaattattacagttcttgatgacagtgatcctaactggtggaaaggtgaaacccatcaaggcatagggttatttccttctaattttgtgactgcagatctcactgctgaaccagaaatgattaaaacagagaagaagacggtacaatttagtgatgatgttcaggtagagacaatagaaccagagccggaaccagcctttattgatgaagataaaatggaccagttgctacagatgctgcaaagtacagaccccagtgatgatcagccagacctaccagagctgcttcatcttgaagcaatgtgtcaccagatgggacctctcattgatgaaaagctggaagatattgatagaaaacattcagaactctcagaacttaatgtgaaagtgatggaggccctttccttatataccaagttaatgaacgaagatccgatgtattccatgtatgcaaagttacagaatcagccatattatatgcagtcatctggtgtttctggttctcaggtgtatgcagggcctcctccaagtggtgcctacctggttgcagggaacgcgcagatgagccacctccagagctacagtcttcccccggagcagctgtcttctctcagccaggcagtggtcccaccatccgcaaacccagcccttcctagtcagcagactcaggccgcttacccaaatacaatggtcagttccgttcaaggaaacacatatcccagccaggcgccagtatatagtcctcctcctgccgctactgctgctgctgcaactgccgatgtcactctgtaccagaatgcaggacctaatatgccccaggtgccaaactataacttaacatcatcaactctgcctcagcccggaggcagccaacagccacctcagccacagcaaccatattctcagaaggctctgctataggacccggtgttcctcttggtggcagatacctgctaaatgccactgacaatgttatgagattcattactatcttaagatgtgtttatcctcagcttataggaatctctccaggtcaacaggttcaaatattcaagaaggtagaactctcctcaatttacactgactttttagaggttcttccccccccgcccctgcagaggaatgaaactacttacaacatttaattcctttcataatatgaaagaattgatacaaggctatttgtctcgtaaacctggtctgcagaaagtcaaacttacaaaaactgttgtgacaaatgttatgtacatatattgatatgtaactgcattagtggccattttgaatcacagtggtgatcgtgtgaatatatttaacactgtgttaaattaatttacgttgctattttattttaatcataaacaactaccatgtttcttaatgttttgtgtaaatttaaggtaattatactatccttttaaacttcaagaaaacaaagttgttagcgtatttacatgaaggcgcattatgttgtcgtgtgtttcagtttcacattaaactgaaccttttactaattgtgagctaaagagatatatatatatatgtgtgtgtatatatatatatctacatgtctttctgtagcctctgcatactactggctgtcatcacaccagcgtacagtagctaaatttttggtgcaattatagcaaatgataatgttcccttttgaacttttacattttggcatgacatttcagagtattgtgggaccatgagacaaaattaagtacgatcacattctttatttctcattttaaagaaatgatgttggtttaccttttcctagttgaagatagtaattaggtttctaagctgtatactgtgtttattggtggcagtgacaccaaagatagaggcaatggatagaaatttttaaactggaaagaaaacctgaattacactacattttcgaagtctcttgtaattatttgggatatcaacaaaatttgattcgtctgtctaatcccttgctagtattttaaatatgtctttaacacattgtatcctttaattcttcattaaaatggaaataagtagatgtttcaaagtaatctacattcctggctttgcttaacgtttatataggta

SEQ ID NO: 342631 - DNA, 2399 bp, Homo sapiens
ggcgtatgttggctagattaggattgtaaaccctgtaccaaaagtgcttgcctagacaaataaatgttgagcgtctggaactggcagaatgttttagagaaagcaaccagcgagatgaatactgctgaggactggggcctcattttggatatctgtgataaagttggtcagtctcgcactggccattgagttgtctctcaaggaacaaaggcagcagtcaaccaccctttccactttgtatccaagcacatccagtctcttaactaaccaccaacatgaaggccgaaaagttcgtgctatatatgactttgaagctgctgaagacaatgaacttacttttaaagctggagaaattattacagttcttgatgacagtgatcctaactggtggaaaggtgaaacccatcaaggcatagggttatttccttctaattttgtgactgcagatctcactgctgaaccagaaatgattaaaacagagaagaagacggtacaatttagtgatgatgttcaggtagagacaatagaaccagagccggaaccagcctttattgatgaagataaaatggaccagttgctacagatgctgcaaagtacagaccccagtgatgatcagccagacctaccagagctgcttcatcttgaagcaatgtgtcaccagatgggacctctcattgatgaaaagctggaagatattgatagaaaacattcagaactctcagaacttaatgtgaaagtgatggaggccctttccttatataccaagttaatgaacgaagatccgatgtattccatgtatgcaaagttacagaatcagccatattatatgcagtcatctggtgtttctggttctcaggtgtatgcagggcctcctccaagtggtgcctacctggttgcagggaacgcgcagatgagccacctccagagctacagtcttcccccggagcagctgtcttctctcagccaggcagtggtcccaccatccgcaaacccagcccttcctagtcagcagactcaggccgcttacccaaatacaatggtcagttccgttcaaggaaacacatatcccagccaggcgccagtatatagtcctcctcctgccgctactgctgctgctgcaactgccgatgtcactctgtaccagaatgcaggacctaatatgccccaggtgccaaactataacttaacatcatcaactctgcctcagcccggaggcagccaacagccacctcagccacagcaaccatattctcagaaggctctgctataggacccggtgttcctcttggtggcagatacctgctaaatgccactgacaatgttatgagattcattactatcttaagatgtgtttatcctcagcttataggaatctctccaggtcaacaggttcaaatattcaagaaggtagaactctcctcaatttacactgactttttagaggttcttccccccccgcccctgcagaggaatgaaactacttacaacatttaattcctttcataatatgaaagaattgatacaaggctatttgtctcgtaaacctggtctgcagaaagtcaaacttacaaaaactgttgtgacaaatgttatgtacatatattgatatgtaactgcattagtggccattttgaatcacagtggtgatcgtgtgaatatatttaacactgtgttaaattaatttacgttgctattttattttaatcataaacaactaccatgtttcttaatgttttgtgtaaatttaaggtaattatactatccttttaaacttcaagaaaacaaagttgttagcgtatttacatgaaggcgcattatgttgtcgtgtgtttcagtttcacattaaactgaaccttttactaattgtgagctaaagagatatatatatatatgtgtgtgtatatatatatatctacatgtctttctgtagcctctgcatactactggctgtcatcacaccagcgtacagtagctaaatttttggtgcaattatagcaaatgataatgttcccttttgaacttttacattttggcatgacatttcagagtattgtgggaccatgagacaaaattaagtacgatcacattctttatttctcattttaaagaaatgatgttggtttaccttttcctagttgaagatagtaattaggtttctaagctgtatactgtgtttattggtggcagtgacaccaaagatagaggcaatggatagaaatttttaaactggaaagaaaacctgaattacactacattttcgaagtctcttgtaattatttgggatatcaacaaaatttgattcgtctgtctaatcccttgctagtattttaaatatgtctttaacacattgtatcctttaattcttcattaaaatggaaataagtagatgtttcaaagta

SEQ ID NO: 342632 - DNA, 2493 bp, Homo sapiens
aagctccgcgcgggggcttcctcggctccttgctgttgccgccgccgcagctgctgccgcggttggtggggttgggtgagaggaggagctgtcgcggaccctgtagagtcggtctctgttgctctttttgcctgaggagtcttccatcctacgtcgagctctgactcccgtgctgtcgagagggagtccccggggacacctcggcacgcagcggagatgcctctttttgccaccaatcccttcgatcaggatgttgagaaagcaaccagcgagatgaatactgctgaggactggggcctcattttggatatctgtgataaagttggtcagtctcgcactggacctaaggattgtcttcggtctattatgagaagagtgaaccacaaagatcctcacgttgctatgcaggctttgactcttctaggagcatgtgtatcaaactgtggcaaaatttttcatttagaagtatgttcaagagattttgctagtgaagtaagcaacgtattaaataagggtcatcctaaagtatgtgaaaaattaaaggctcttatggttgaatggacagatgaatttaagaatgatccacagcttagtctaatatcagcaatgattaagaaccttaaggaacaaggagttacgttcccagctattggctctcaggctgcagaacaagcaaaagcaagcccagctcttgtagccaaggatcctggtactgtggctaacaaaaaagaagaagaagatttagcaaaagccattgagttgtctctcaaggaacaaaggcagcagtcaaccaccctttccactttgtatccaagcacatccagtctcttaactaaccaccaacatgaaggccgaaaagttcgtgctatatatgactttgaagctgctgaagacaatgaacttacttttaaagctggagaaattattacagttcttgatgacagtgatcctaactggtggaaaggtgaaacccatcaaggcatagggttatttccttctaattttgtgactgcagatctcactgctgaaccagaaatgattaaaacagagaagaagacggtacaatttagtgatgatgttcaggtagagacaatagaaccagagccggaaccagcctttattgatgaagataaaatggaccagttgctacagatgctgcaaagtacagaccccagtgatgatcagccagacctaccagagctgcttcatcttgaagcaatgtgtcaccagatgggacctctcattgatgaaaagctggaagatattgatagaaaacattcagaactctcagaacttaatgtgaaagtgatggaggccctttccttatataccaagttaatgaacgaagatccgatgtattccatgtatgcaaagttacagaatcagccatattatatgcagtcatctggtgtttctggttctcaggtgtatgcagggcctcctccaagtggtgcctacctggttgcagggaacgcgcagatgagccacctccagagctacagtcttcccccggagcagctgtcttctctcagccaggcagtggtcccaccatccgcaaacccagcccttcctagtcagcagactcaggccgcttacccaaatacaatggtcagttccgttcaaggaaacacatatcccagccaggcgccagtatatagtcctcctcctgccgctactgctgctgctgcaactgccgatgtcactctgtaccagaatgcaggacctaatatgccccaggtgccaaactataacttaacatcatcaactctgcctcagcccggaggcagccaacagccacctcagccacagcaaccatattctcagaaggctctgctataggacccggtgttcctcttggtggcagatacctgctaaatgccactgacaatgttatgagattcattactatcttaagatgtgtttatcctcagcttataggaatctctccaggtcaacaggttcaaatattcaagaaggtagaactctcctcaatttacactgactttttagaggttcttccccccccgcccctgcagaggaatgaaactacttacaacatttaattcctttcataatatgaaagaattgatacaaggctatttgtctcgtaaacctggtctgcagaaagtcaaacttacaaaaactgttgtgacaaatgttatgtacatatattgatatgtaactgcattagtggccattttgaatcacagtggtgatcgtgtgaatatatttaacactgtgttaaattaatttacgttgctattttattttaatcataaacaactaccatgtttcttaatgttttgtgtaaatttttaaactggaaagaaaacctgaattacactacattttcgaagtctcttgtaattatttgggatatcaacaaaatttgattcgtctgtctaatcccttgctagtattttaaatatgtctttaacacattgtatcctttaattcttcattaaaatggaaataagtagatgtttcaaagta

SEQ ID NO: 342633 - DNA, 780 bp, Homo sapiens
aagctccgcgcgggggcttcctcggctccttgctgttgccgccgccgcagctgctgccgcggttggtggggttgggtgagaggaggagctgtcgcggaccctgtagagtcggtctctgttgctctttttgcctgaggagtcttccatcctacgtcgagctctgactcccgtgctgtcgagagggagtccccggggacacctcggcacgcagcggagatgcctctttttgccaccaatcccttcgatcaggatgttgagaaagcaaccagcgagatgaatactgctgaggactggggcctcattttggatatctgtgataaagttggtcagtctcgcactggacctaaggattgtcttcggtctattatgagaagagtgaaccacaaagatcctcacgttgctatgcaggctttgactcttctaggagcatgtgtatcaaactgtggcaaaatttttcatttagaagtatgttcaagagattttgctagtgaagtaagcaacgtattaaataagtgtctctctttgtcacccaggctggagtacagtggcgtgatctcagctgactatagcctctgcctcccgggttcaagtgattctcctgcctcagcctcctgagtagctgggattaccggcatgcgccaccacgcctggctggtttttgtagtgttagcagagatggggtttcaccatggggatggtcaggccagtctcgaactcctgaccttgtgattgcccacctcggccttccaaagtgctgggattacaggcatgagccaccgc

SEQ ID NO: 342634 - DNA, 2968 bp, Homo sapiens
aagctccgcgcgggggcttcctcggctccttgctgttgccgccgccgcagctgctgccgcggttggtggggttgggtgagaggaggagctgtcgcggaccctgtagagtcggtctctgttgctctttttgcctgaggagtcttccatcctacgtcgagctctgactcccgtgctgtcgagagggagtccccggggacacctcggcacgcagcggagatgcctctttttgccaccaatcccttcgatcaggatgttgagaaagcaaccagcgagatgaatactgctgaggactggggcctcattttggatatctgtgataaagttggtcagtctcgcactggacctaaggattgtcttcggtctattatgagaagagtgaaccacaaagatcctcacgttgctatgcaggctttgactcttctaggagcatgtgtatcaaactgtggcaaaatttttcatttagaagtatgttcaagagattttgctagtgaagtaagcaacgtattaaataagggtcatcctaaagtatgtgaaaaattaaaggctcttatggttgaatggacagatgaatttaagaatgatccacagcttagtctaatatcagcaatgattaagaaccttaaggaacaaggagttacgttcccagctattggctctcaggctgcagaacaagcaaaagcaagcccagctcttgtagccaaggatcctggtactgtggctaacaaaaaagaagaagaagatttagcaaaagccattgagttgtctctcaaggaacaaaggcagcagtcaaccaccctttccactttgtatccaagcacatccagtctcttaactaaccaccaacatgaaggccgaaaagttcgtgctatatatgactttgaagctgctgaagacaatgaacttacttttaaagctggagaaattattacagttcttgatgacagtgatcctaactggtggaaaggtgaaacccatcaaggcatagggttatttccttctaattttgtgactgcagatctcactgctgaaccagaaatgattaaaacagagaagaagacggtacaatttagtgatgatgttcaggtagagacaatagaaccagagccggaaccagcctttattgatgaagataaaatggaccagttgctacagatgctgcaaagtacagaccccagtgatgatcagccagacctaccagagctgcttcatcttgaagcaatgtgtcaccagatgggacctctcattgatgaaaagctggaagatattgatagaaaacattcagaactctcagaacttaatgtgaaagtgatggaggccctttccttatataccaagttaatgaacgaagatccgatgtattccatgtatgcaaagttacagaatcagccatattatatgcagtcatctggtgtttctggttctcaggtgtatgcagggcctcctccaagtggtgcctacctggttgcagggaacgcgcagatgagccacctccagagctacagtcttcccccggagcagctgtcttctctcagccaggcagtggtcccaccatccgcaaacccagcccttcctagtcagcagactcaggccgcttacccaaatacaatggtcagttccgttcaaggaaacacatatcccagccaggcgccagtatatagtcctcctcctgccgctactgctgctgctgcaactgccgatgtcactctgtaccagaatgcaggacctaatatgccccaggtgccaaactataacttaacatcatcaactctgcctcagcccggaggcagccaacagccacctcagccacagcaaccatattctcagaaggctctgctataggacccggtgttcctcttggtggcagatacctgctaaatgccactgacaatgttatgagattcattactatcttaagatgtgtttatcctcagcttataggaatctctccaggtcaacaggttcaaatattcaagaaggtagaactctcctcaatttacactgactttttagaggttcttccccccccgcccctgcagaggaatgaaactacttacaacatttaattcctttcataatatgaaagaattgatacaaggctatttgtctcgtaaacctggtctgcagaaagtcaaacttacaaaaactgttgtgacaaatgttatgtacatatattgatatgtaactgcattagtggccattttgaatcacagtggtgatcgtgtgaatatatttaacactgtgttaaattaatttacgttgctattttattttaatcataaacaactaccatgtttcttaatgttttgtgtaaatttaaggtaattatactatccttttaaacttcaagaaaacaaagttgttagcgtatttacatgaaggcgcattatgttgtcgtgtgtttcagtttcacattaaactgaaccttttactaattgtgagctaaagagatatatatatatatgtgtgtgtatatatatatatctacatgtctttctgtagcctctgcatactactggctgtcatcacaccagcgtacagtagctaaatttttggtgcaattatagcaaatgataatgttcccttttgaacttttacattttggcatgacatttcagagtattgtgggaccatgagacaaaattaagtacgatcacattctttatttctcattttaaagaaatgatgttggtttaccttttcctagttgaagatagtaattaggtttctaagctgtatactgtgtttattggtggcagtgacaccaaagatagaggcaatggatagaaatttttaaactggaaagaaaacctgaattacactacattttcgaagtctcttgtaattatttgggatatcaacaaaatttgattcgtctgtctaatcccttgctagtattttaaatatgtctttaacacattgtatcctttaattcttcattaaaatggaaataagtagatgtttcaaagta

SEQ ID NO: 342635 - DNA, 3072 bp, Homo sapiens
aagctccgcgcgggggcttcctcggctccttgctgttgccgccgccgcagctgctgccgcggttggtggggttgggtgagaggaggagctgtcgcggaccctgtagagtcggtctctgttgctctttttgcctgaggagtcttccatcctacgtcgagctctgactcccgtgctgtcgagagggagtccccggggacacctcggcacgcagcggagatgcctctttttgccaccaatcccttcgatcaggatgttgagaaagcaaccagcgagatgaatactgctgaggactggggcctcattttggatatctgtgataaagttggtcagtctcgcactggataaggaaaagagaggatgtgtcttacaaaaagttttaaaataccaaaatggggttttaagaagctttttgagagagatgaggatttgcccaccctttaaacagacctaaggattgtcttcggtctattatgagaagagtgaaccacaaagatcctcacgttgctatgcaggctttgactcttctaggagcatgtgtatcaaactgtggcaaaatttttcatttagaagtatgttcaagagattttgctagtgaagtaagcaacgtattaaataagggtcatcctaaagtatgtgaaaaattaaaggctcttatggttgaatggacagatgaatttaagaatgatccacagcttagtctaatatcagcaatgattaagaaccttaaggaacaaggagttacgttcccagctattggctctcaggctgcagaacaagcaaaagcaagcccagctcttgtagccaaggatcctggtactgtggctaacaaaaaagaagaagaagatttagcaaaagccattgagttgtctctcaaggaacaaaggcagcagtcaaccaccctttccactttgtatccaagcacatccagtctcttaactaaccaccaacatgaaggccgaaaagttcgtgctatatatgactttgaagctgctgaagacaatgaacttacttttaaagctggagaaattattacagttcttgatgacagtgatcctaactggtggaaaggtgaaacccatcaaggcatagggttatttccttctaattttgtgactgcagatctcactgctgaaccagaaatgattaaaacagagaagaagacggtacaatttagtgatgatgttcaggtagagacaatagaaccagagccggaaccagcctttattgatgaagataaaatggaccagttgctacagatgctgcaaagtacagaccccagtgatgatcagccagacctaccagagctgcttcatcttgaagcaatgtgtcaccagatgggacctctcattgatgaaaagctggaagatattgatagaaaacattcagaactctcagaacttaatgtgaaagtgatggaggccctttccttatataccaagttaatgaacgaagatccgatgtattccatgtatgcaaagttacagaatcagccatattatatgcagtcatctggtgtttctggttctcaggtgtatgcagggcctcctccaagtggtgcctacctggttgcagggaacgcgcagatgagccacctccagagctacagtcttcccccggagcagctgtcttctctcagccaggcagtggtcccaccatccgcaaacccagcccttcctagtcagcagactcaggccgcttacccaaatacaatggtcagttccgttcaaggaaacacatatcccagccaggcgccagtatatagtcctcctcctgccgctactgctgctgctgcaactgccgatgtcactctgtaccagaatgcaggacctaatatgccccaggtgccaaactataacttaacatcatcaactctgcctcagcccggaggcagccaacagccacctcagccacagcaaccatattctcagaaggctctgctataggacccggtgttcctcttggtggcagatacctgctaaatgccactgacaatgttatgagattcattactatcttaagatgtgtttatcctcagcttataggaatctctccaggtcaacaggttcaaatattcaagaaggtagaactctcctcaatttacactgactttttagaggttcttccccccccgcccctgcagaggaatgaaactacttacaacatttaattcctttcataatatgaaagaattgatacaaggctatttgtctcgtaaacctggtctgcagaaagtcaaacttacaaaaactgttgtgacaaatgttatgtacatatattgatatgtaactgcattagtggccattttgaatcacagtggtgatcgtgtgaatatatttaacactgtgttaaattaatttacgttgctattttattttaatcataaacaactaccatgtttcttaatgttttgtgtaaatttaaggtaattatactatccttttaaacttcaagaaaacaaagttgttagcgtatttacatgaaggcgcattatgttgtcgtgtgtttcagtttcacattaaactgaaccttttactaattgtgagctaaagagatatatatatatatgtgtgtgtatatatatatatctacatgtctttctgtagcctctgcatactactggctgtcatcacaccagcgtacagtagctaaatttttggtgcaattatagcaaatgataatgttcccttttgaacttttacattttggcatgacatttcagagtattgtgggaccatgagacaaaattaagtacgatcacattctttatttctcattttaaagaaatgatgttggtttaccttttcctagttgaagatagtaattaggtttctaagctgtatactgtgtttattggtggcagtgacaccaaagatagaggcaatggatagaaatttttaaactggaaagaaaacctgaattacactacattttcgaagtctcttgtaattatttgggatatcaacaaaatttgattcgtctgtctaatcccttgctagtattttaaatatgtctttaacacattgtatcctttaattcttcattaaaatggaaataagtagatgtttcaaagta

SEQ ID NO: 342636 - DNA, 2883 bp, Homo sapiens
aagctccgcgcgggggcttcctcggctccttgctgttgccgccgccgcagctgctgccgcggttggtggggttgggtgagaggaggagctgtcgcggaccctgtagagtcggtctctgttgctctttttgcctgaggagtcttccatcctacgtcgagctctgactcccgtgctgtcgagagggagtccccggggacacctcggcacgcagcggagatgcctctttttgccaccaatcccttcgatcaggatgttgacctaaggattgtcttcggtctattatgagaagagtgaaccacaaagatcctcacgttgctatgcaggctttgactcttctaggagcatgtgtatcaaactgtggcaaaatttttcatttagaagtatgttcaagagattttgctagtgaagtaagcaacgtattaaataagggtcatcctaaagtatgtgaaaaattaaaggctcttatggttgaatggacagatgaatttaagaatgatccacagcttagtctaatatcagcaatgattaagaaccttaaggaacaaggagttacgttcccagctattggctctcaggctgcagaacaagcaaaagcaagcccagctcttgtagccaaggatcctggtactgtggctaacaaaaaagaagaagaagatttagcaaaagccattgagttgtctctcaaggaacaaaggcagcagtcaaccaccctttccactttgtatccaagcacatccagtctcttaactaaccaccaacatgaaggccgaaaagttcgtgctatatatgactttgaagctgctgaagacaatgaacttacttttaaagctggagaaattattacagttcttgatgacagtgatcctaactggtggaaaggtgaaacccatcaaggcatagggttatttccttctaattttgtgactgcagatctcactgctgaaccagaaatgattaaaacagagaagaagacggtacaatttagtgatgatgttcaggtagagacaatagaaccagagccggaaccagcctttattgatgaagataaaatggaccagttgctacagatgctgcaaagtacagaccccagtgatgatcagccagacctaccagagctgcttcatcttgaagcaatgtgtcaccagatgggacctctcattgatgaaaagctggaagatattgatagaaaacattcagaactctcagaacttaatgtgaaagtgatggaggccctttccttatataccaagttaatgaacgaagatccgatgtattccatgtatgcaaagttacagaatcagccatattatatgcagtcatctggtgtttctggttctcaggtgtatgcagggcctcctccaagtggtgcctacctggttgcagggaacgcgcagatgagccacctccagagctacagtcttcccccggagcagctgtcttctctcagccaggcagtggtcccaccatccgcaaacccagcccttcctagtcagcagactcaggccgcttacccaaatacaatggtcagttccgttcaaggaaacacatatcccagccaggcgccagtatatagtcctcctcctgccgctactgctgctgctgcaactgccgatgtcactctgtaccagaatgcaggacctaatatgccccaggtgccaaactataacttaacatcatcaactctgcctcagcccggaggcagccaacagccacctcagccacagcaaccatattctcagaaggctctgctataggacccggtgttcctcttggtggcagatacctgctaaatgccactgacaatgttatgagattcattactatcttaagatgtgtttatcctcagcttataggaatctctccaggtcaacaggttcaaatattcaagaaggtagaactctcctcaatttacactgactttttagaggttcttccccccccgcccctgcagaggaatgaaactacttacaacatttaattcctttcataatatgaaagaattgatacaaggctatttgtctcgtaaacctggtctgcagaaagtcaaacttacaaaaactgttgtgacaaatgttatgtacatatattgatatgtaactgcattagtggccattttgaatcacagtggtgatcgtgtgaatatatttaacactgtgttaaattaatttacgttgctattttattttaatcataaacaactaccatgtttcttaatgttttgtgtaaatttaaggtaattatactatccttttaaacttcaagaaaacaaagttgttagcgtatttacatgaaggcgcattatgttgtcgtgtgtttcagtttcacattaaactgaaccttttactaattgtgagctaaagagatatatatatatatgtgtgtgtatatatatatatctacatgtctttctgtagcctctgcatactactggctgtcatcacaccagcgtacagtagctaaatttttggtgcaattatagcaaatgataatgttcccttttgaacttttacattttggcatgacatttcagagtattgtgggaccatgagacaaaattaagtacgatcacattctttatttctcattttaaagaaatgatgttggtttaccttttcctagttgaagatagtaattaggtttctaagctgtatactgtgtttattggtggcagtgacaccaaagatagaggcaatggatagaaatttttaaactggaaagaaaacctgaattacactacattttcgaagtctcttgtaattatttgggatatcaacaaaatttgattcgtctgtctaatcccttgctagtattttaaatatgtctttaacacattgtatcctttaattcttcattaaaatggaaataagtagatgtttcaaagta

SEQ ID NO: 342637 - DNA, 2711 bp, Homo sapiens
aagctccgcgcgggggcttcctcggctccttgctgttgccgccgccgcagctgctgccgcggttggtggggttgggtgagaggaggagctgtcgcggaccctgtagagtcggtctctgttgctctttttgcctgaggagtcttccatcctacgtcgagctctgactcccgtgctgtcgagagggagtccccggggacacctcggcacgcagcggagatgcctctttttgccaccaatcccttcgatcaggatgttgggtcatcctaaagtatgtgaaaaattaaaggctcttatggttgaatggacagatgaatttaagaatgatccacagcttagtctaatatcagcaatgattaagaaccttaaggaacaaggagttacgttcccagctattggctctcaggctgcagaacaagcaaaagcaagcccagctcttgtagccaaggatcctggtactgtggctaacaaaaaagaagaagaagatttagcaaaagccattgagttgtctctcaaggaacaaaggcagcagtcaaccaccctttccactttgtatccaagcacatccagtctcttaactaaccaccaacatgaaggccgaaaagttcgtgctatatatgactttgaagctgctgaagacaatgaacttacttttaaagctggagaaattattacagttcttgatgacagtgatcctaactggtggaaaggtgaaacccatcaaggcatagggttatttccttctaattttgtgactgcagatctcactgctgaaccagaaatgattaaaacagagaagaagacggtacaatttagtgatgatgttcaggtagagacaatagaaccagagccggaaccagcctttattgatgaagataaaatggaccagttgctacagatgctgcaaagtacagaccccagtgatgatcagccagacctaccagagctgcttcatcttgaagcaatgtgtcaccagatgggacctctcattgatgaaaagctggaagatattgatagaaaacattcagaactctcagaacttaatgtgaaagtgatggaggccctttccttatataccaagttaatgaacgaagatccgatgtattccatgtatgcaaagttacagaatcagccatattatatgcagtcatctggtgtttctggttctcaggtgtatgcagggcctcctccaagtggtgcctacctggttgcagggaacgcgcagatgagccacctccagagctacagtcttcccccggagcagctgtcttctctcagccaggcagtggtcccaccatccgcaaacccagcccttcctagtcagcagactcaggccgcttacccaaatacaatggtcagttccgttcaaggaaacacatatcccagccaggcgccagtatatagtcctcctcctgccgctactgctgctgctgcaactgccgatgtcactctgtaccagaatgcaggacctaatatgccccaggtgccaaactataacttaacatcatcaactctgcctcagcccggaggcagccaacagccacctcagccacagcaaccatattctcagaaggctctgctataggacccggtgttcctcttggtggcagatacctgctaaatgccactgacaatgttatgagattcattactatcttaagatgtgtttatcctcagcttataggaatctctccaggtcaacaggttcaaatattcaagaaggtagaactctcctcaatttacactgactttttagaggttcttccccccccgcccctgcagaggaatgaaactacttacaacatttaattcctttcataatatgaaagaattgatacaaggctatttgtctcgtaaacctggtctgcagaaagtcaaacttacaaaaactgttgtgacaaatgttatgtacatatattgatatgtaactgcattagtggccattttgaatcacagtggtgatcgtgtgaatatatttaacactgtgttaaattaatttacgttgctattttattttaatcataaacaactaccatgtttcttaatgttttgtgtaaatttaaggtaattatactatccttttaaacttcaagaaaacaaagttgttagcgtatttacatgaaggcgcattatgttgtcgtgtgtttcagtttcacattaaactgaaccttttactaattgtgagctaaagagatatatatatatatgtgtgtgtatatatatatatctacatgtctttctgtagcctctgcatactactggctgtcatcacaccagcgtacagtagctaaatttttggtgcaattatagcaaatgataatgttcccttttgaacttttacattttggcatgacatttcagagtattgtgggaccatgagacaaaattaagtacgatcacattctttatttctcattttaaagaaatgatgttggtttaccttttcctagttgaagatagtaattaggtttctaagctgtatactgtgtttattggtggcagtgacaccaaagatagaggcaatggatagaaatttttaaactggaaagaaaacctgaattacactacattttcgaagtctcttgtaattatttgggatatcaacaaaatttgattcgtctgtctaatcccttgctagtattttaaatatgtctttaacacattgtatcctttaattcttcattaaaatggaaataagtagatgtttcaaagta

SEQ ID NO: 342638 - DNA, 2890 bp, Homo sapiens
actcttgcctctacaatcagttctcatttacaaagagaaagcaaccagcgagatgaatactgctgaggactggggcctcattttggatatctgtgataaagttggtcagtctcgcactggacctaaggattgtcttcggtctattatgagaagagtgaaccacaaagatcctcacgttgctatgcaggctttgactcttctaggagcatgtgtatcaaactgtggcaaaatttttcatttagaagtatgttcaagagattttgctagtgaagtaagcaacgtattaaataagggtcatcctaaagtatgtgaaaaattaaaggctcttatggttgaatggacagatgaatttaagaatgatccacagcttagtctaatatcagcaatgattaagaaccttaaggaacaaggagttacgttcccagctattggctctcagatgaggaaactgagactcagaatggttaagtgacttgcccagggacacagctcatagttgacagctggaactagaacacaggcatgctgattctcagtccagtgttcttttcgctgcccgagtctgccttctttgttagagaggctgcagaacaagcaaaagcaagcccagctcttgtagccaaggatcctggtactgtggctaacaaaaaagaagaagaagatttagcaaaagccattgagttgtctctcaaggaacaaaggcagcagtcaaccaccctttccactttgtatccaagcacatccagtctcttaactaaccaccaacatgaaggccgaaaagttcgtgctatatatgactttgaagctgctgaagacaatgaacttacttttaaagctggagaaattattacagttcttgatgacagtgatcctaactggtggaaaggtgaaacccatcaaggcatagggttatttccttctaattttgtgactgcagatctcactgctgaaccagaaatgattaaaacagagaagaagacggtacaatttagtgatgatgttcaggtagagacaatagaaccagagccggaaccagcctttattgatgaagataaaatggaccagttgctacagatgctgcaaagtacagaccccagtgatgatcagccagacctaccagagctgcttcatcttgaagcaatgtgtcaccagatgggacctctcattgatgaaaagctggaagatattgatagaaaacattcagaactctcagaacttaatgtgaaagtgatggaggccctttccttatataccaagttaatgaacgaagatccgatgtattccatgtatgcaaagttacagaatcagccatattatatgcagtcatctggtgtttctggttctcaggtgtatgcagggcctcctccaagtggtgcctacctggttgcagggaacgcgcagatgagccacctccagagctacagtcttcccccggagcagctgtcttctctcagccaggcagtggtcccaccatccgcaaacccagcccttcctagtcagcagactcaggccgcttacccaaatacaatggtcagttccgttcaaggaaacacatatcccagccaggcgccagtatatagtcctcctcctgccgctactgctgctgctgcaactgccgatgtcactctgtaccagaatgcaggacctaatatgccccaggtgccaaactataacttaacatcatcaactctgcctcagcccggaggcagccaacagccacctcagccacagcaaccatattctcagaaggctctgctataggacccggtgttcctcttggtggcagatacctgctaaatgccactgacaatgttatgagattcattactatcttaagatgtgtttatcctcagcttataggaatctctccaggtcaacaggttcaaatattcaagaaggtagaactctcctcaatttacactgactttttagaggttcttccccccccgcccctgcagaggaatgaaactacttacaacatttaattcctttcataatatgaaagaattgatacaaggctatttgtctcgtaaacctggtctgcagaaagtcaaacttacaaaaactgttgtgacaaatgttatgtacatatattgatatgtaactgcattagtggccattttgaatcacagtggtgatcgtgtgaatatatttaacactgtgttaaattaatttacgttgctattttattttaatcataaacaactaccatgtttcttaatgttttgtgtaaatttaaggtaattatactatccttttaaacttcaagaaaacaaagttgttagcgtatttacatgaaggcgcattatgttgtcgtgtgtttcagtttcacattaaactgaaccttttactaattgtgagctaaagagatatatatatatatgtgtgtgtatatatatatatctacatgtctttctgtagcctctgcatactactggctgtcatcacaccagcgtacagtagctaaatttttggtgcaattatagcaaatgataatgttcccttttgaacttttacattttggcatgacatttcagagtattgtgggaccatgagacaaaattaagtacgatcacattctttatttctcattttaaagaaatgatgttggtttaccttttcctagttgaagatagtaattaggtttctaagctgtatactgtgtttattggtggcagtgacaccaaagatagaggcaatggatagaaatttttaaactggaaagaaaacctgaattacactacattttcgaagtctcttgtaattatttgggatatcaacaaaatttgattcgtctgtctaatcccttgctagtattttaaatatgtctttaacacattgtatcctttaattcttcattaaaatggaaataagtagatgtttcaaagta

SEQ ID NO: 342639 - DNA, 2605 bp, Homo sapiens
aagctccgcgcgggggcttcctcggctccttgctgttgccgccgccgcagctgctgccgcggttggtggggttgggtgagaggaggagctgtcgcggaccctgtagagtcggtctctgttgctctttttgcctgaggagtcttccatcctacgtcgagctctgactcccgtgctgtcgagagggagtccccggggacacctcggcacgcagcggagatgcctctttttgccaccaatcccttcgatcaggatgttgagaaagcaaccagcgagatgaatactgctgaggactggggcctcattttggatatctgtgataaagttggtcagtctcgcactggacctaaggattgtcttcggtctattatgagaagagtgaaccacaaagatcctcacgttgctatgcaggctttgactcttctaggagcatgtgtatcaaactgtggcaaaatttttcatttagaagtatgttcaagagattttgctagtgaagtaagcaacgtattaaataagggtcatcctaaagtatgtgaaaaattaaaggctcttatggttgaatggacagatgaatttaagaatgatccacagcttagtctaatatcagcaatgattaagaaccttaaggaacaaggagttacgttcccagctattggctctcaggctgcagaacaagcaaaagcaagcccagctcttgtagccaaggatcctggtactgtggctaacaaaaaagaagaagaagatttagcaaaagccattgagttgtctctcaaggaacaaaggcagcagtcaaccaccctttccactttgtatccaagcacatccagtctcttaactaaccaccaacatgaaggccgaaaagttcgtgctatatatgactttgaagctgctgaagacaatgaacttacttttaaagctggagaaattattacagttcttgatgacagtgatcctaactggtggaaaggtgaaacccatcaaggcatagggttatttccttctaattttgtgactgcagatctcactgctgaaccagaaatgattaaaacagagaagaagacggtacaatttagtgatgatgttcaggtagagacaatagaaccagagccggaaccagcctttattgatgaagataaaatggaccagttgctacagatgctgcaaagtacagaccccagtgatgatcagccagacctaccagagctgcttcatcttgaagcaatgtgtcaccagatgggacctctcattgatgaaaagctggaagatattgatagaaaacattcagaactctcagaacttaatgtgaaagtgatggaggccctttccttatataccaagttaatgaacgaagatccgatgtattccatgtatgcaaagttacagaatcagccatattatatgcagtcatctggtgtttctggttctcaggtgtatgcagggcctcctccaagtggtgcctacctggttgcagggaacgcgcagatgagccacctccagagctacagtcttcccccggagcagctgtcttctctcagccaggcagtggtcccaccatccgcaaacccagcccttcctagtcagcagactcaggccgcttacccaaatacaatggtcagttccgttcaaggaaacacatatcccagccaggcgccagtatatagtcctcctcctgccgctactgctgctgctgcaactgccgatgtcactctgtaccagaatgcaggacctaatatgccccaggtgccaaactataacttaacatcatcaactctgcctcagcccggaggcagccaacagccacctcagccacagcaaccatattctcagaaggctctgctataggacccggtgttcctcttggtggcagatacctgctaaatgccactgacaatgttatgagattcattactatcttaagatgtgtttatcctcagcttataggaatctctccaggtcaacaggttcaaatattcaagaaggtagaactctcctcaatttacactgactttttagaggttcttccccccccgcccctgcagaggaatgaaactacttacaacatttaattcctttcataatatgaaagaattgatacaaggctatttgtctcgtaaacctggtctgcagaaagtcaaacttacaaaaactgttgtgacaaatgttatgtacatatattgatatgtaactgcattagtggccattttgaatcacagtggtgatcgtgtgaatatatttaacactgtgttaaattaatttacgttgctattttattttaatcataaacaactaccatgtttcttaatgttttgtgtaaatttaaggtaattatactatccttttaaacttcaagaaaacaaagttgttagcgtatttacatgaaggcgcattatgttgtcgtgtgtttcagtttcacattaaactgaaccttactaatggagcctagacagaaatcataaaccggggactcacttcgacggcctcggaacccgcaaacgggggccccccgcagcccacatagggggcaaacaataagtcctgaacaccgggggcccgccgggccaaaagaacccccccgaagaggccccacacgacgcgcggcgaccggccc

SEQ ID NO: 342640 - DNA, 1298 bp, Homo sapiens
  misc_feature (1239)..(1239): n is a, c, g, or t
  misc_feature (1249)..(1249): n is a, c, g, or t
  misc_feature (1269)..(1269): n is a, c, g, or t
  misc_feature (1274)..(1274): n is a, c, g, or t
aagctccgcgcgggggcttcctcggctccttgctgttgccgccgccgcagctgctgccgcggttggtggggttgggtgagaggaggagctgtcgcggaccctgtagagtcggtctctgttgctctttttgcctgaggagtcttccatcctacgtcgagctctgactcccgtgctgtcgagagggagtccccggggacacctcggcacgcagcggagatgcctctttttgccaccaatcccttcgatcaggatgttgagaaagcaaccagcgagatgaatactgctgaggactggggcctcattttggatatctgtgataaagttggtcagtctcgcactggacctaaggattgtcttcggtctattatgagaagagtgaaccacaaagatcctcacgttgctatgcaggctttgactcttctaggagcatgtgtatcaaactgtggcaaaatttttcatttagaagtatgttcaagagattttgctagtgaagtaagcaacgtattaaataagggtcatcctaaagtatgtgaaaaattaaaggctcttatggttgaatggacagatgaatttaagaatgatccacagcttagtctaatatcagcaatgattaagaaccttaaggaacaaggagttacgttcccagctattggctctcaggctgcagaacaagcaaaagcaagcccagctcttgtagccaaggatcctggtactgtggctaacaaaaaagaagaagaagatttagcaaaagccattgagttgtctctcaaggaacaaaggcagcagtcaaccaccctttccactttgtatccaagcacatccagtctcttaactaaccaccaacatgaaggccgaaaagttcgtgctatatatgactttgaagctgctgaagacaatgaacttacttttaaagctggagaaattattacagttcttgatgacagtgatcctaactggtggaaaggtgaaacccatcaaggcatagggttatttccttctaattttgtgactgcagatctcactgctgaaccagaaatgattaaaacagagaagaagacggtacaatttagtgatgatgttcaggtagagacaatagaaccagagccggaaccagcctttattgatgaagataaaatggaccagttgctacagatgctgcaaagtacagaccccagtgatgatcagccagacctaccagagctgcttcatcttgaaggcaatgtgttcaccaggtggggncctctccttngatggaaaagctgggaggtntttgnttgggaaactttcaggactcttcc

SEQ ID NO: 342641 - DNA, 494 bp, Homo sapiens
cttctgaagaggttgtgtaaggcgctgggttcggaatcacggaaggcccaggtgcaaacctcagcagtcccgggtaccagctgtgcagcgcagagcatccaggatgtgaggagtgatgacgaggattatgaagaggaagaggaagaggaagaagaagaggctaccaaaggcaaagagatggattgtttaaagaacggcctcggggctgagaggcacctcattcccaatggccagcatggccattagctggaagcctacaggactcccatggcacagcatgctgcaagtactgttggcagcctggcttccaggccccacaccgaccccacattctgcccttccctctttctcaccaccgccttccctcccacctaagatgtgtttaccaaaatgttgttaacttgtgttaaaatgttaaatataagcatgcccatggatttttactgcagttaggactcagactggtcaaagatttcaaagatttctccacagaa

SEQ ID NO: 342642 - DNA, 2049 bp, Homo sapiens
cgagagagggcccgtgtccccgcggaggtcaaggccgagagagggcccgtgtccccgcgcaggtcaaggcccagagtccccgtgctcgcacagatggtgtcctggggcccagtcgcgctccccgctcgcggcagcccccgtgtactgggccttgcaaagtccgttaggagcgctccagggcgacagtgcccagcggttaacaagtttgtaattactttcgtgggtttctacgttgcaaattgagaagagggttgctgggttgggcccccctcctctggacgctaaccccacccaggtggtgaaacaggaagcaacatcccatcaggaagaacctgagggtgccatccagtagcttcgcctcacgtcactgactgccctcagtcagaaatcttgactcgcaactttggagggtgggtctctgaaggaatttcaggtcttacacagagatgagttgtgctgctctctgaggagaacgaagctggttggaacgttggaagctgctctctgactacacttcacaagcaaggggcaccttttgtggactgacatttcagaaagggatgttgtgaaacaaaagctgacatttatatatatatacatatatacagtatttgagttcctcagtagaaagctatcatatatactcagaatgttttggacgtttaaagaatggttctggttggaaagattctggcttcctccaacaataaagtggtcagatcttgaggatcacgatggactcgtctttgtaaaaccttctcatttatacgtgacaattccatatgcttttctcttgctgattatcaggcgtgtatttgaaaaatttgttgcttcacctctagcaaaatcatttggcattaaagagacagttcgaaaggttacaccaaatactgtcttagagaattttttcaaacattccacaaggcaaccattgcaaactgatatttatggactggcaaagaagtgtaacttgacggagcgccaggtggaaagatggtttaggagtcggcggaatcaagagaggccttccaggctgaagaaattccaggaagcttgctggagatttgcattttacttaatgatcactgttgctggaattgcgtttctttatgataaaccttggctatatgacttatgggaggtttggaatggctatcccaaacagcccctgctgccatcccagtactggtactacattttagaaatgagtttttattggtctctgttatttagacttggctttgatgtcaagagaaaggattttctagctcatatcatccaccacctggctgctattagtctgatgagcttctcttggtgtgctaattatattcgcagtgggaccctcgtgatgattgtacacgatgtggctgacatttggctggagtctgctaagatgttttcttatgctggatggacgcagacctgtaacaccctgtttttcatcttctccaccatatttttcatcagccgcctcattgtttttcctttctggattttatattgcacgctgatcttgcctatgtatcacctcgagcctttcttttcatacatcttcctcaacctacagctcatgatcttgcaggtccttcacctttactggggttattacatcttgaagatgctcaacagatgtatattcatgaagagcatccaggatgtgaggagtgatgacgaggattatgaagaggaagaggaagaggaagaagaagaggctaccaaaggcaaagagatggattgtttaaagaacggcctcggggctgagaggcacctcattcccaatggccagcatggccattagctggaagcctacaggactcccatggcacagcatgctgcaagtactgttggcagcctggcttccaggccccacaccgaccccacattctgcccttccctctttctcaccaccgccttccctcccacctaagatgtgtttaccaaaatgttgttaacttgtgttaaaatgttaaatataagcatgcccatggatttttactgcagttaggactcagactggtcaaagatttcaaagatttctccacagaa

SEQ ID NO: 342643 - DNA, 1826 bp, Homo sapiens
cccgggatgcaccgctgcggggaccccccgcccggcctcgcggacccgcctcggcccaggacggaggaggaggtggtgaaacaggaagcaacatcccatcaggaagaacctgagggtgccatccagtagcttcgcctcacgtcactgactgccctcagtcagaaatcttgactcgcaactttggagggtgggtctctgaaggaatttcaggtcttacacagagatgagttgtgctgctctctgaggagaacgaagctggttggaacgttggaagctgctctctgactacacttcacaagcaaggggcaccttttgtggactgacatttcagaaagggatgttgtgaaacaaaagctgacatttatatatatatacatatatacagtatttgagttcctcagtagaaagctatcatatatactcagaatgttttggacgtttaaagaatggttctggttggaaagattctggcttcctccaacaataaagtggtcagatcttgaggatcacgatggactcgtctttgtaaaaccttctcatttatacgtgacaattccatatgcttttctcttgctgattatcaggcgtgtatttgaaaaatttgttgcttcacctctagcaaaatcatttggcattaaagagacagttcgaaaggttacaccaaatactgtcttagagaattttttcaaacattccacaaggcaaccattgcaaactgatatttatggactggcaaagaagtgtaacttgacggagcgccaggtggaaagatggtttaggagtcggcggaatcaagagaggccttccaggctgaagaaattccaggaagcttgctggagatttgcattttacttaatgatcactgttgctggaattgcgtttctttatgataaaccttggctatatgacttatgggaggtttggaatggctatcccaaacagcccctgctgccatcccagtactggtactacattttagaaatgagtttttattggtctctgttatttagacttggctttgatgtcaagagaaaggattttctagctcatatcatccaccacctggctgctattagtctgatgagcttctcttggtgtgctaattatattcgcagtgggaccctcgtgatgattgtacacgatgtggctgacatttggctggagtctgctaagatgttttcttatgctggatggacgcagacctgtaacaccctgtttttcatcttctccaccatatttttcatcagccgcctcattgtttttcctttctggattttatattgcacgctgatcttgcctatgtatcacctcgagcctttcttttcatacatcttcctcaacctacagctcatgatcttgcaggtccttcacctttactggggttattacatcttgaagatgctcaacagatgtatattcatgaagagcatccaggatgtgaggagtgatgacgaggattatgaagaggaagaggaagaggaagaagaagaggctaccaaaggcaaagagatggattgtttaaagaacggcctcggggctgagaggcacctcattcccaatggccagcatggccattagctggaagcctacaggactcccatggcacagcatgctgcaagtactgttggcagcctggcttccaggccccacaccgaccccacattctgcccttccctctttctcaccaccgccttccctcccacctaagatgtgtttaccaaaatgttgttaacttgtgttaaaatgttaaatataagcatgcccatggatttttactgcagttaggactcagactggtcaaagatttcaaagatttctccacagaa

SEQ ID NO: 342644 - DNA, 1514 bp, Homo sapiens
cgagagagggcccgtgtccccgcggaggtcaaggccgagagagggcccgtgtccccgcgcaggtcaaggcccagagtccccgtgctcgcacagatggtgtcctggggcccagtcgcgctccccgctcgcggcagcccccgtgtactgggccttgcaaagtccgttaggagcgctccagggcgacagtgcccagcggttaacaagtttgtaattactttcgtgggtttctacgttgcaaattgagaagagggttgctgggttgggcccccctcctctggacgctaaccccacccaggtggtgaaacaggaagcaacatcccatcaggaagaacctgagggtgccatccagtagcttcgcctcacgtcactgactgccctcagtcagaaatcttgactcgcaactttggagggtgggtctctgaaggaatttcaggtcttacacagagatgagttgtgctgctctctgaggagaacgaagctggttggaacgttggaagctgctctctgactacacttcacaagcaaggggcaccttttgtggactgacatttcagaaagggatgttgtgaaacaaaagctgacatttatatatatatacatatatacagtatttgagttcctcagtagaaagctatcatatatactcagaatgttttggacgtttaaagaatggttctggttggaaagattctggcttcctccaacaataaagtggtcagatcttgaggatcacgatggactcgtctttgtaaaaccttctcatttatacgtgacaattccatatgcttttctcttgctgattatcaggcgtgtatttgaaaaatttgttgcttcacctctagcaaaatcatttggcattaaagagacagttcgaaaggttacaccaaatactgtcttagagaattttttcaaacattccacaaggcaaccattgcaaactgatatttatggactggcaaagaagtgtaacttgacggagcgccaggtggaaagatggtttaggagtcggcggaatcaagagaggccttccaggctgaagaaattccaggaagcttgctggagatttgcattttacttaatgatcactgttgctggaattgcgtttctttatgataaaccttggctatatgacttatgggaggtttggaatggctatcccaaacagcccctgctgccatcccagtactggtactacattttagaaatgagtttttattggtctctgttatttagacttggctttgatgtcaagagaaaggtaagtgtcttatttacaaagcttctttatcaatttcttcaaaaattgccatctccctgccccaaattctaatctttaagttgtatttttctgtgtttttgggtccagttcattgcttttgtgtgctttatagtacataaaatattgctaattatactcatgctttggtgccttggtaaacatttgtagtgaaacattataaaaactttaactttgaagctccacctctgttcaataagaaaaaaaacatttcctt

SEQ ID NO: 342645 - DNA, 2097 bp, Homo sapiens
cgagagagggcccgtgtccccgcggaggtcaaggccgagagagggcccgtgtccccgcgcaggtcaaggcccagagtccccgtgctcgcacagatggtgtcctggggcccagtcgcgctccccgctcgcggcagcccccgtgtactgggccttgcaaagtccgttaggagcgctccagggcgacagtgcccagcggttaacaagtggtgaaacaggaagcaacatcccatcaggaagaacctgagggtgccatccagtagcttcgcctcacgtcactgactgccctcagtcagaaatcttgactcgcaactttggagggtgggtctctgaaggaatttcaggtcttacacagagatgagttgtgctgctctctgaggagaacgaagctggttggaacgttggaagctgctctctgactacacttcacaagcaaggggcaccttttgtggactgacatttcagaaagggatgttgtgaaacaaaagctgacatttatatatatatacatatatacagtatttgagttcctcagtagaaagctatcatatatactcagatggcgttattccctctggtccccactgctctggccaaaccttctctctgctgactgcatctattgctgtgagctgattgtcctctagtttctccatctcctgaggcatgcttcacaccactgccagaaagagctgccagaatgttttggacgtttaaagaatggttctggttggaaagattctggcttcctccaacaataaagtggtcagatcttgaggatcacgatggactcgtctttgtaaaaccttctcatttatacgtgacaattccatatgcttttctcttgctgattatcaggcgtgtatttgaaaaatttgttgcttcacctctagcaaaatcatttggcattaaagagacagttcgaaaggttacaccaaatactgtcttagagaattttttcaaacattccacaaggcaaccattgcaaactgatatttatggactggcaaagaagtgtaacttgacggagcgccaggtggaaagatggtttaggagtcggcggaatcaagagaggccttccaggctgaagaaattccaggaagcttgctggagatttgcattttacttaatgatcactgttgctggaattgcgtttctttatgataaaccttggctatatgacttatgggaggtttggaatggctatcccaaacagcccctgctgccatcccagtactggtactacattttagaaatgagtttttattggtctctgttatttagacttggctttgatgtcaagagaaaggattttctagctcatatcatccaccacctggctgctattagtctgatgagcttctcttggtgtgctaattatattcgcagtgggaccctcgtgatgattgtacacgatgtggctgacatttggctggagtctgctaagatgttttcttatgctggatggacgcagacctgtaacaccctgtttttcatcttctccaccatatttttcatcagccgcctcattgtttttcctttctggattttatattgcacgctgatcttgcctatgtatcacctcgagcctttcttttcatacatcttcctcaacctacagctcatgatcttgcaggtccttcacctttactggggttattacatcttgaagatgctcaacagatgtatattcatgaagagcatccaggatgtgaggagtgatgacgaggattatgaagaggaagaggaagaggaagaagaagaggctaccaaaggcaaagagatggattgtttaaagaacggcctcggggctgagaggcacctcattcccaatggccagcatggccattagctggaagcctacaggactcccatggcacagcatgctgcaagtactgttggcagcctggcttccaggccccacaccgaccccacattctgcccttccctctttctcaccaccgccttccctcccacctaagatgtgtttaccaaaatgttgttaacttgtgttaaaatgttaaatataagcatgcccatggatttttactgcagttaggactcagactggtcaaagatttcaaagatttctccacagaa

SEQ ID NO: 342646 - DNA, 1957 bp, Homo sapiens
cgagagagggcccgtgtccccgcggaggtcaaggccgagagagggcccgtgtccccgcgcaggtcaaggcccagagtccccgtgctcgcacagatggtgtcctggggcccagtcgcgctccccgctcgcggcagcccccgtgtactgggccttgcaaagtccgttaggagcgctccagggcgacagtgcccagcggttaacaagtggtgaaacaggaagcaacatcccatcaggaagaacctgagggtgccatccagtagcttcgcctcacgtcactgactgccctcagtcagaaatcttgactcgcaactttggagggtgggtctctgaaggaatttcaggtcttacacagagatgagttgtgctgctctctgaggagaacgaagctggttggaacgttggaagctgctctctgactacacttcacaagcaaggggcaccttttgtggactgacatttcagaaagggatgttgtgaaacaaaagctgacatttatatatatatacatatatacagtatttgagttcctcagtagaaagctatcatatatactcagaatgttttggacgtttaaagaatggttctggttggaaagattctggcttcctccaacaataaagtggtcagatcttgaggatcacgatggactcgtctttgtaaaaccttctcatttatacgtgacaattccatatgcttttctcttgctgattatcaggcgtgtatttgaaaaatttgttgcttcacctctagcaaaatcatttggcattaaagagacagttcgaaaggttacaccaaatactgtcttagagaattttttcaaacattccacaaggcaaccattgcaaactgatatttatggactggcaaagaagtgtaacttgacggagcgccaggtggaaagatggtttaggagtcggcggaatcaagagaggccttccaggctgaagaaattccaggaagcttgctggagatttgcattttacttaatgatcactgttgctggaattgcgtttctttatgataaaccttggctatatgacttatgggaggtttggaatggctatcccaaacagcccctgctgccatcccagtactggtactacattttagaaatgagtttttattggtctctgttatttagacttggctttgatgtcaagagaaaggattttctagctcatatcatccaccacctggctgctattagtctgatgagcttctcttggtgtgctaattatattcgcagtgggaccctcgtgatgattgtacacgatgtggctgacatttggctggagtctgctaagatgttttcttatgctggatggacgcagacctgtaacaccctgtttttcatcttctccaccatatttttcatcagccgcctcattgtttttcctttctggattttatattgcacgctgatcttgcctatgtatcacctcgagcctttcttttcatacatcttcctcaacctacagctcatgatcttgcaggtccttcacctttactggggttattacatcttgaagatgctcaacagatgtatattcatgaagagcatccaggatgtgaggagtgatgacgaggattatgaagaggaagaggaagaggaagaagaagaggctaccaaaggcaaagagatggattgtttaaagaacggcctcggggctgagaggcacctcattcccaatggccagcatggccattagctggaagcctacaggactcccatggcacagcatgctgcaagtactgttggcagcctggcttccaggccccacaccgaccccacattctgcccttccctctttctcaccaccgccttccctcccacctaagatgtgtttaccaaaatgttgttaacttgtgttaaaatgttaaatataagcatgcccatggatttttactgcagttaggactcagactggtcaaagatttcaaagatttctccacagaa

SEQ ID NO: 342647 - DNA, 306 bp, Homo sapiens
ttcctttctttctctctttctttctctttctttctttctttctttctttctttctttctttctttctttctttctttctttctttctttctttctttctttcctctctctctctctctcttccttccttccttcctctctttctctctttctatctgtctgtctatctgtctttccttccttccttcctccttttctctctttctttctttttttttttttcctggatggaattccactctgtcacccacgctggagtgcagcaccacacatcggggcccatggcaacagggtccctcaggggatc

SEQ ID NO: 342648 - DNA, 379 bp, Homo sapiens
  misc_feature (56)..(56): n is a, c, g, or t
cactccagcttgggtgacagaccaagaccctgtctcaaaaaaaaaaaaaaaaaaangaaaagaaaaagaaaatgaggagggattagagtgggagaaatgggtccattaatagctcttttgtttcagagttgtaaaatcctattgtagtacacttcattcactctaggttttcctgttagtgtattagaatttctttctattgaaaattactggccgggcacggtggctcatgcttgtaatcatcactttgggaggctgaggtgggtggattacttgaggtcgggagtttgagaccagcctggccagcatggtgaaactctgtctttactatacgcaggagtcgcttgaaccagtgcagtgagctgagattgtgccactt

SEQ ID NO: 342649 - DNA, 533 bp, Homo sapiens
ggaattcaataactatcatacaaataataagtgagtaatatttttataggtaacttggaaatgaaatgttccattcctgatacaagtttccagctaatttttatccgcacaccagatgataatgtatcaccctttcctttcctcagatcctcaaaagaaaagcatagtcttagcttcaatagatgttcacttatggtaaaattcaagcaccacagtagaatgtttgtcaaccttgaaaagccaaacatcataaatgagaattggttttcatagctgtaatacaaaccactgtgcaactaactgttttgattcatcacattttggtacagcttgcttctgggaaagttgagtcataccatatctggcttggcaatttgagcataaacttgcagtgtgcatacagctttttatatgttatcctgagaaacctgaaacagctgcactgctggcaggaaaacagaggaccaccagtaaaatattcaaaacagttgcatcttttaatttatggccatgtttccataaagagtatataa

SEQ ID NO: 342650 - DNA, 1900 bp, Homo sapiens
  misc_feature (3)..(4): n is a, c, g, or t
gannagagaaagcgagtgtccctctcgcgccccaggccggtgtacccccgcactccgcgccccggcctagaagctctctctccccgctccccggcccggcccccgccccgccccgccccagcccgctgggccgccatggagcgctggccttggccgtcgggcggcgcctggctgctcgtggctgcccgcgcgctgctgcagctgctgcgctcagacctgcgtctgggccgcccgctgctggcggcgctggcgctgctggccgcgctcgactggctgtgccagcgcctgctgcccccgccggccgcactcgccgtgctggccgccgccggctggatcgcgttgtcccgcctggcgcgcccgcagcgcctgccggtggccactcgcgcggtgctcatcaccggctgtgactctggttttggcaaggagacggccaagaaactggactccatgggcttcacggtgctggccaccgtattggagttgaacagccccggtgccatcgagctgcgtacctgctgctcccctcgcctaaggctgctgcagatggacctgaccaaaccaggagacattagccgcgtgctagagttcaccaaggcccacaccaccagcaccggcctgtggggcctcgtcaacaacgcaggccacaatgaagtagttgctgatgcggagctgtctccagtggccactttccgtagctgcatggaggtgaatttctttggcgcgctcgagctgaccaagggcctcctgcccctgctgcgcagctcaaggggccgcatcgtgactgtggggagcccagcgggggacatgccatatccgtgcttgggggcctatggaacctccaaagcggccgtggcgctactcatggacacattcagctgtgaactccttccctggggggtcaaggtcagcatcatccagcctggctgcttcaagacagagtcagtgagaaacgtgggtcagtgggaaaagcgcaagcaattgctgctggccaacctgcctcaagagctgctgcaggcctacggcaaggactacatcgagcacttgcatgggcagttcctgcactcgctacgcctggccatgtccgacctcaccccagttgtagatgccatcacagatgcgctgctggcagctcggccccgccgccgctattaccccggccagggcctggggctcatgtacttcatccactactacctgcctgaaggcctgcggcgccgcttcctgcaggccttcttcatcagtcactgtctgcctcgagcactgcagcctggccagcctggcactaccccaccacaggacgcagcccaggacccaaacctgagccccggcccttccccagcagtggctcggtgagccatgtgcacctatggcccagccactgcagcacaggaggctccgtgagcccttggttcctccccgaaaacccccagcattacgatcccccaagtgtcctggaccctggcctaaagaatcccacccccacttcatgcccactgccgatgcccaatccaggcccggtgaggccaaggtttcccagtgagcctctgcgcctctccactgtttcatgagcccaaacaccctcctggcacaacgctctaccctgcagcttggagaactccgctggatggggagtctcatgcaagacttcactgcagcctttcacaggactctgcagatagtgcctctgcaaactaaggagtgactaggtgggttggggaccccctcaggattgtttctcggcaccagtgcctcagtgctgcaattgagggctaaatcccaagtgtctcttgactggctcaagaattagggccccaactacacacccccaagccacagggaagcatgtactgtacttcccaattgccacattttaaataaagacaaatttttatttcttcta

SEQ ID NO: 342651 - DNA, 382 bp, Homo sapiens
aaggatgctttctctaacttgggctcctccaatctctggttgcaaagctggggttgggggagagaggaccacccaacctaccctgcagcttggagaactccgctggatggggagtctcatgcaagacttcactgcagcctttcacaggactctgcagatagtgcctctgcaaactaaggagtgactaggtgggttggggaccccctcaggattgtttctcggcaccagtgcctcagtgctgcaattgagggctaaatcccaagtgtctcttgactggctcaagaattagggccccaactacacacccccaagccacagggaagcatgtactgtacttcccaattgccacattttaaataaagacaaatttttatttcttcta

SEQ ID NO: 342652 - DNA, 1125 bp, Homo sapiens
gccccactcccaatccatccgcaggggacatgccatatccgtgcttgggggcctatggaacctccaaagcggccgtggcgctactcatggacacattcagctgtgaactccttccctggggggtcaaggtcagcatcatccagcctggctgcttcaagacagagtcagtgagaaacgtgggtcagtgggaaaagcgcaagcaattgctgctggccaacctgcctcaagagctgctgcaggcctacggcaaggactacatcgagcacttgcatgggcagttcctgcactcgctacgcctggccatgtccgacctcaccccagttgtagatgccatcacagatgcgctgctggcagctcggccccgccgccgctattaccccggccagggcctggggctcatgtacttcatccactactacctgcctgaaggcctgcggcgccgcttcctgcaggccttcttcatcagtcactgtctgcctcgagcactgcagcctggccagcctggcactaccccaccacaggacgcagcccaggacccaaacctgagccccggcccttccccagcagtggctcggtgagccatgtgcacctatggcccagccactgcagcacaggaggctccgtgagcccttggttcctccccgaaaacccccagcattacgatcccccaagtgtcctggaccctggcctaaagaatcccacccccacttcatgcccactgccgatgcccaatccaggcccggtgaggccaaggtttcccagtgagcctctgcgcctctccactgtttcatgagcccaaacaccctcctggcacaacgctctaccctgcagcttggagaactccgctggatggggagtctcatgcaagacttcactgcagcctttcacaggactctgcagatagtgcctctgcaaactaaggagtgactaggtgggttggggaccccctcaggattgtttctcggcaccagtgcctcagtgctgcaattgagggctaaatcccaagtgtctcttgactggctcaagaattagggccccaactacacacccccaagccacagggaagcatgtactgtacttcccaattgccacattttaaataaagacaaatttttatttcttcta

SEQ ID NO: 342653 - DNA, 1042 bp, Homo sapiens
ccgagtagatctagaggatcccgaggctctctctgatggggtccgtcagcatcatccagccgggtctgcttcaagacagagtcagtgagaaacgtgggtcagtgggaaaagcgcaagcaattgctgctggccaacctgcctcaagagctgctgcaggcctacggcaaggactacatcgagcacttgcatgggcagttcctgcactcgctacgcctggccatgtccgacctcaccccagttgtagatgccatcacagatgcgctgctggcagctcggccccgccgccgctattaccccggccagggcctggggctcatgtacttcatccactactacctgcctgaaggcctgcggcgccgcttcctgcaggccttcttcatcagtcactgtctgcctcgagcactgcagcctggccagcctggcactaccccaccacaggacgcagcccaggacccaaacctgagccccggcccttccccagcagtggctcggtgagccatgtgcacctatggcccagccactgcagcacaggaggctccgtgagcccttggttcctccccgaaaacccccagcattacgatcccccaagtgtcctggaccctggcctaaagaatcccacccccacttcatgcccactgccgatgcccaatccaggcccggtgaggccaaggtttcccagtgagcctctgcgcctctccactgtttcatgagcccaaacaccctcctggcacaacgctctaccctgcagcttggagaactccgctggatggggagtctcatgcaagacttcactgcagcctttcacaggactctgcagatagtgcctctgcaaactaaggagtgactaggtgggttggggaccccctcaggattgtttctcggcaccagtgcctcagtgctgcaattgagggctaaatcccaagtgtctcttgactggctcaagaattagggccccaactacacacccccaagccacagggaagcatgtactgtacttcccaattgccacattttaaataaagacaaatttttatttcttcta

SEQ ID NO: 342654 - DNA, 1992 bp, Homo sapiens
  misc_feature (3)..(4): n is a, c, g, or t
gannagagaaagcgagtgtccctctcgcgccccaggccggtgtacccccgcactccgcgccccggcctagaagctctctctccccgctccccggcccggcccccgccccgccccgccccagcccgctgggccgccatggagcgctggccttggccgtcgggcggcgcctggctgctcgtggctgcccgcgcgctgctgcagctgctgcgctcagacctgcgtctgggccgcccgctgctggcggcgctggcgctgctggccgcgctcgactggctgtgccagcgcctgctgcccccgccggccgcactcgccgtgctggccgccgccggctggatcgcgttgtcccgcctggcgcgcccgcagcgcctgccggtggccactcgcgcggtgctcatcaccggctgtgactctggttttggcaaggagacggccaagaaactggactccatgggcttcacggtgctggccaccgtattggagttgaacagccccggtgccatcgagctgcgtacctgctgctcccctcgcctaaggctgctgcagatggacctgaccaaaccaggagacattagccgcgtgctagagttcaccaaggcccacaccaccagcaccggcctgtggggcctcgtcaacaacgcaggccacaatgaagtagttgctgatgcggagctgtctccagtggccactttccgtagctgcatggaggtgaatttctttggcgcgctcgagctgaccaagggcctcctgcccctgctgcgcagctcaaggggccgcatcgtgactgtggggagcccagcgggggacatgccatatccgtgcttgggggcctatggaacctccaaagcggccgtggcgctactcatggacacattcagctgtgaactccttccctggggggtcaaggtcagcatcatccagcctggctgcttcaagacagagtcagtgagaaacgtgggtcagtgggaaaagcgcaagcaattgctgctggccaacctgcctcaagagctgctgcaggcctacggcaaggactacatcgagcacttgcatgggcagttcctgcactcgctacgcctggccatgtccgacctcaccccagttgtagatgccatcacagatgcgctgctggcagctcggccccgccgccgctattaccccggccagggcctggggctcatgtacttcatccactactacctgcctgaaggcctgcggcgccgcttcctgcaggccttcttcatcagtcactgtctgcctcgagcactgcagcctggccagcctggcactaccccaccacaggacgcagcccaggacccaaacctgagccccggcccttccccagcagtggctcggtgagccatgtgcacctatggcccagccactgcagcacaggaggctccgtgagcccttggttcctccccgaaaacccccagcattacgatcccccaagtgtcctggaccctggcctaaagaatcccacccccacttcatgcccactgccgatgcccaatccaggcccggtgaggccaaggtttcccagtgagcctctgcgcctctccactgtttcatgagcccaaacaccctcctggcacaacgctctaccctgcagcttggagaactccgctggatggggagtctcatgcaagacttcactgcagcctttcacaggactctgcagatagtgcctctgcaaactaaggagtgactaggtgggttggggaccccctcaggattgtttctcggcaccagtgcctcagtgctgcaattgagggctaaatcccaagtgtctcttgactggctcaagaattagggccccaactacacacccccaagccacagggaagcatgtactgtacttcccaattgccacattttaaataaagacaaatttttatttcttctaaaatgcggcaggtgctgtttggagggggtcactgactggctggctgagtgacacagtgtggccgtgtgacagggtggcaactcctggggctc

SEQ ID NO: 342655 - DNA, 342 bp, Homo sapiens
aagtaggggccaggttgtgggctctgcctctggggacagggcagatcccttcctgctttatttgtgagccacctcaacaggacccaggccatctgcaggtactagtggcctagctgggtagtctttcctgaggtctcacctcaggcctttgtgctgctgctgttgcttctggccttgagcctgagagagaggtgagaggaaggatgctttctctaacttgggctcctccaatctctggttgcaaagctggggttgggggagagaggaccacccaacctgccctgtacaagcatcagtaagactccaagtttcccagggcccgaacacttgggggttgtctct

SEQ ID NO: 342656 - DNA, 1628 bp, Homo sapiens
cagcggagaccgggtgagcaccggctggttcctcgcggtgttcctgcaggcttggcggccgcggtggtgcgatcagcaaagggcaccgggatgccggttgtgcgtgtcctcaggtgtcccgaacaagcgctgtgactctggttttggcaaggagacggccaagaaactggactccatgggcttcacggtgctggccaccgtattggagttgaacagccccggtgccatcgagctgcgtacctgctgctcccctcgcctaaggctgctgcagatggacctgaccaaaccaggagacattagccgcgtgctagagttcaccaaggcccacaccaccagcaccggcctgtggggcctcgtcaacaacgcaggccacaatgaagtagttgctgatgcggagctgtctccagtggccactttccgtagctgcatggaggtgaatttctttggcgcgctcgagctgaccaagggcctcctgcccctgctgcgcagctcaaggggccgcatcgtgactgtggggagcccagcgggggacatgccatatccgtgcttgggggcctatggaacctccaaagcggccgtggcgctactcatggacacattcagctgtgaactccttccctggggggtcaaggtcagcatcatccagcctggctgcttcaagacagagtcagtgagaaacgtgggtcagtgggaaaagcgcaagcaattgctgctggccaacctgcctcaagagctgctgcaggcctacggcaaggactacatcgagcacttgcatgggcagttcctgcactcgctacgcctggccatgtccgacctcaccccagttgtagatgccatcacagatgcgctgctggcagctcggccccgccgccgctattaccccggccagggcctggggctcatgtacttcatccactactacctgcctgaaggcctgcggcgccgcttcctgcaggccttcttcatcagtcactgtctgcctcgagcactgcagcctggccagcctggcactaccccaccacaggacgcagcccaggacccaaacctgagccccggcccttccccagcagtggctcggtgagccatgtgcacctatggcccagccactgcagcacaggaggctccgtgagcccttggttcctccccgaaaacccccagcattacgatcccccaagtgtcctggaccctggcctaaagaatcccacccccacttcatgcccactgccgatgcccaatccaggcccggtgaggccaaggtttcccagtgagcctctgcgcctctccactgtttcatgagcccaaacaccctcctggcacaacgctctaccctgcagcttggagaactccgctggatggggagtctcatgcaagacttcactgcagcctttcacaggactctgcagatagtgcctctgcaaactaaggagtgactaggtgggttggggaccccctcaggattgtttctcggcaccagtgcctcagtgctgcaattgagggctaaatcccaagtgtctcttgactggctcaagaattagggccccaactacacacccccaagccacagggaagcatgtactgtacttcccaattgccacattttaaataaagacaaatttttatttcttcta

SEQ ID NO: 342657 - DNA, 1135 bp, Homo sapiens
ggtggggaatggggctgggaatggtcttatgggggcaggtcaggtttgatgaatggtcatggttttggttgggggtgtagttttggctgcagacctggcgcgggttaaacagtcctaattggctttggctcccctagctgatcccactctgaccttgccactccttccccagagtcagtgagaaacgtgggtcagtgggaaaagcgcaagcaattgctgctggccaacctgcctcaagagctgctgcaggcctacggcaaggactacatcgagcacttgcatgggcagttcctgcactcgctacgcctggccatgtccgacctcaccccagttgtagatgccatcacagatgcgctgctggcagctcggccccgccgccgctattaccccggccagggcctggggctcatgtacttcatccactactacctgcctgaaggcctgcggcgccgcttcctgcaggccttcttcatcagtcactgtctgcctcgagcactgcagcctggccagcctggcactaccccaccacaggacgcagcccaggacccaaacctgagccccggcccttccccagcagtggctcggtgagccatgtgcacctatggcccagccactgcagcacaggaggctccgtgagcccttggttcctccccgaaaacccccagcattacgatcccccaagtgtcctggaccctggcctaaagaatcccacccccacttcatgcccactgccgatgcccaatccaggcccggtgaggccaaggtttcccagtgagcctctgcgcctctccactgtttcatgagcccaaacaccctcctggcacaacgctctaccctgcagcttggagaactccgctggatggggagtctcatgcaagacttcactgcagcctttcacaggactctgcagatagtgcctctgcaaactaaggagtgactaggtgggttggggaccccctcaggattgtttctcggcaccagtgcctcagtgctgcaattgagggctaaatcccaagtgtctcttgactggctcaagaattagggccccaactacacacccccaagccacagggaagcatgtactgtacttcccaattgccacattttaaataaagacaaatttttatttcttcta

SEQ ID NO: 342658 - DNA, 120 bp, Homo sapiens
acctactgtgtgcaaaatacagattttagtattgtgggtgcacaattgacaagatctggttcctgctcttgcattactcccaatctatataaaaatgattaaagaaattatctcagttca

SEQ ID NO: 342659 - DNA, 455 bp, Homo sapiens
ggactatgaaaaatcaatataagagtgagaaaaattcaaaaatgtgatgattggaaaaaataagatgtttaaaagtgaggttacagaactcaggagggaattagaataaatgaaaagttatttcagaaatgaagtctattctagaagtttcactagcaaaaatgacaatggataatatcttcagacaaatagaagattaaatggaggtgatctgccctctttggcctcccaaaatgttgggattgcaggtgtgagccaccgcaccagccatggaggattttaaaaaaatatatttttaaagaagaaagagataaaaaaggatttgggagaaagtgatcaaaaaacaaaacaaaaaacaagataggcagaagatctaacatatgtatgacaggatttcctgaagaggaaagggaaagcaacagaacagaacatacactaaaactatactttcatac

SEQ ID NO: 342660 - DNA, 181 bp, Homo sapiens
aaaacaaaaaaaacaaaaaaaggtccagccccacacggttagaaaaattctgttgatattaataaggtctggtaatacactttgaacaaattcttgatggctacagagagactaatcaaagtatgtgcttttgtgcatgtcaagtactgagctcccttctactcttctcacctgcttttca

SEQ ID NO: 342661 - DNA, 247 bp, Homo sapiens
cagcgtgagctgctacaacatcaactatggaattcgtaggtcctaacttccctcctgacacattaataaccaggctctgctgcctccacaaaaccaagtgtattctaccaaaggtcccataagcagaaaattgtactctgtttcaataaatggtatattttttaaagctgcctttagattacccccttagcaccttgaaactgtatttattatcatctgaagctggtgacatagataaataatgaat

SEQ ID NO: 342662 - DNA, 381 bp, Homo sapiens
tcccaaggtaaccctactgccagtcaaataactaatgccatctatcatcacaacatgcaccttttacatttctaaagatgtctttaatatttctccaggaacctataagcaattattaaccatattacccacaaacagcatcttctcctgtctcccactgcttctgatgagttgtttttttaatcccatggattcctgtcttacagtgatatactgtgttcttcagaggcccagctgaccccatttatgaccagggcacattttaagaatgacatgctacagcatctccctagaagcatcactgggccgtaaaagatacctataagctgttcatttcaattgctgtttgacttgggtggttgggtaaggagatatacagca

SEQ ID NO: 342663 - DNA, 116 bp, Homo sapiens
tgagcctctttgtgaagccacattagtcttcctttcccttgaccctggggaccccggggaccccgggaggacttaaagagttttaatgtgatttctggaatgtgcttgattttcag

SEQ ID NO: 342664 - DNA, 381 bp, Homo sapiens
aaaaaggctgggcacagtggctcaccatcaatcccagcactttgggaggtcaagtttcactcccagagtgctgggattacaagcgtgagccaccacgcccagtatgatttgtattttttataaatattttaatgttgtagaagaaaaaatattgccaagcatagcatttttctccccaccccttcttacctgtttaatgacacggcacaatattggccataggcaagaagggtgaggctgagctcacttgctgtttttttttttgaggaatgggtaccaaatttatttgttaatttcttgcatttgaagtacacagtcacatccttggcctgaaattctttgctgtagcccttcactgtgacacaactgcaaccaaccact

SEQ ID NO: 342665 - DNA, 309 bp, Homo sapiens
catgattatgatattaactatagtgtgttgggaaagctgtttgtaaatgtttactgtgcctttggttattgttattatctttgctctcttccaagacaactaatctgactgctggatggagccatagtgtaacccaaaccacaattcccaggggcccacacagcagaacggggctgcatcctctcatatttatccccacaacagccaaacacctcagtctgcaccttccaatggtgggcttcaggaatcttccatatgagcaaggaaaagtgacttttcctctcacacagctccccaggcagatggctg

SEQ ID NO: 342666 - DNA, 615 bp, Homo sapiens
  misc_feature (545)..(545): n is a, c, g, or t
agcgggtctcctctctgcctgcctggcaccagccagaccctgctctgcccggggggctctgagccccccaggcattcccttcactgcatccctctccattgggggggtgtctaaggaccctttccccttgggcatggcccagccaggggtctctgtcaagtccctggtgtcgtcttatgagacccgagtggtggggatggctccggggctgccccgaaaaaggggctgtgcctcttccccttgctctccccggggtgcatcccccatccgagggacatctgggcccccgccccaccggggcctgggaggccctgggcagcggccttcaacccgcagggggatggacaaaaccctcctctccctcattctctactgtcacagtggctccggaagcctggttggcattgacaacaaaatcgagcaagccatggactagtgttggctagtgtgataagcatcagagtctcaagagactctttggggaggggcacattattctcatttaacacagcactgtttgtggcagcatcctgaacattggcatntttatgacttaataagctatcttcttttgtaaccttatgcactgcttctacttgagccttcaaaatgtta

SEQ ID NO: 342667 - DNA, 2399 bp, Homo sapiens
agcctaagcagtggctgcagcaactgcaacagcagcggctgtggcaggcctggccccgggccagctggcgggaagccccaggagggagggagggaggaggaaggggaggaagaggggaaggaggaggaggaggaggagaggagcagtcagcaggcccgaggaggcaggacttcctggtgtgggggttgtcaacagcccagaaagagaaagacggagaggcagagacccaggggagccgaggagcggagacacggacccagcagggtcacgcgggaggagactcgggacacccactcgctggctgccaccgggagcagaggggggctcggccgccccctcccacatcagtctccagacccttggggcttcagaggccgctcctaggctcctcggaggaggcgcgggtttcttcttttccggagagcaaactttcctcggagatgcctggcaggatgagccgcggcccccggagaggacgggacagcctctgatcgccgcctgcgtgccccgccactgcccatggccaggaggccccagggaacggacagcccgacctcttaggcgccgggaccctcaggctcagatcagtggccgaggccccagagcaggcacccccggttcccgccaggccctcctgccatgtcggacccagacgtccccaggggctcggatgtccccgccatgtggcccccttgttccaggggtgcctgagccccttcaaggagccccaacccacccccaaccttggcccagccctgagccccagggaccatgagcgggggcaagaagaagagtagtttccaaatcaccagcgtcaccacggactatgagggccctgggagcccaggggcttcggatccccctaccccacagcccccaaccgggcccccgccccgcctgcccaatggggagcccagccccgatccggggggcaagggcaccccccggaatggctccccaccacctggggccccttcctcccgtttccgggtggtgaagctgccccacggcctgggagagccttatcgccgcggtcgctggacgtgtgtggatgtttatgagcgagacctggagccccacagcttcggcggactcctggagggaattcgaggggcctcagggggcgccgggggcagatctttggattccaggttggagctggccagcctcggcctgggcgcccccaccccaccgtcaggcctgtctcagggccccacctcctggctccgtccaccccccacctctcctggacctcaggcccgctccttcactgggggactgggccagctggtggtgcccagcaaagccaaggcagagaaacccccactgtcggcctcctcaccccagcagcgccccccagagcctgagaccggtgagagtgcgggcacatcccgggctgccacgcccctgccctctctgagggtggaagcggaggctgggggctcaggggccaggacccctccactgtcccggaggaaagctgtagacatgcggctgcggatggagttgggtgctccagaagagatggggcaggtgcccccacttgactctcgccccagctccccagccctctacttcacccacgatgccagcctggttcacaaatctccagaccccttcggagcagtagcagctcagaagttcagcctggcccactccatgttggccatcagtggtcacctagacagcgacgatgatagtggctccggaagcctggttggcattgacaacaaaatcgagcaagccatggacttggtgaagtcccacctcatgtttgcggtccgggaggaggtggaggtgctgaaggagcagatccgggaactggcggagcggaacgctgcgctggagcaggagaatgggctgctgcgcgccctggccagcccggagcagctggctcagctgccctcctcgggggtcccacggcttgggccccctgcgcccaatgggccctccgtctgagcctcccttcccttacaatgtgcctttggggctgcccggccttgcgtcagccgcctgccccctcttcctatgcagctttaatgtccccgtgtccccggggtgggagttcaaggctcagtaatggcctggtcccccggcccctgccccatctcctcatcatccccagccttgatggaggagggagggcttcaggacggggcgtcagagggagccccctctgggagggaaccaacccccaccctccctcctgggaccccccagcagtagacggcttgggggagtcggaggctccccggcagacaccccacccccatcttgttcccttgaggtgcctcctctcctctgcccaggggagggagtgtggacagtatctggaagttctgggattcaggttgttattaaaataataataataattaaaaactctgaagaaacttgaa

SEQ ID NO: 342668 - DNA, 1509 bp, Homo sapiens
  misc_feature (53)..(53): n is a, c, g, or t
taaacacatccaccaacaatacgacgcgcagattgtactatgaaccgtgttanagcaggtgtacggccggaattttgggatccaggggagccgaggagcggagacacggacccagcagggtcacgcgggaggagactcgggacacccactcgctggctgccaccgggagcagaggggggctcggccgccccctcccacatcagtctccagacccttggggcttcagaggccgctcctaggctcctcggaggaggcgcgggtttcttcttttccggagagcaaactttcctcggagatgcctggcaggatgagccgcggcccccggagaggacgggacagcctctgatcgccgcctgcgtgccccgccactgcccatggccaggaggccccagggaacggacagcccgacctcttaggcgccgggaccctcaggctcagatcagtggccgaggccccagagcgccccccagagcctgagaccggtgagagtgcgggcacatcccgggctgccacgcccctgccctctctgagggtggaagcggaggctgggggctcaggggccaggacccctccactgtcccggaggaaagctgtagacatgcggctgcggatggagttgggtgctccagaagagatggggcaggtgcccccacttgactctcgccccagctccccagccctctacttcacccacgatgccagcctggttcacaaatctccagaccccttcggagcagtagcagctcagaagttcagcctggcccactccatgttggccatcagtggtcacctagacagcgacgatgatagtggctccggaagcctggttggcattgacaacaaaatcgagcaagccatggacttggtgaagtcccacctcatgtttgcggtccgggaggaggtggaggtgctgaaggagcagatccgggaactggcggagcggaacgctgcgctggagcaggagaatgggctgctgcgcgccctggccagcccggagcagctggctcagctgccctcctcgggggtcccacggcttgggccccctgcgcccaatgggccctccgtctgagcctcccttcccttacaatgtgcctttggggctgcccggccttgcgtcagccgcctgccccctcttcctatgcagctttaatgtccccgtgtccccggggtgggagttcaaggctcagtaatggcctggtcccccggcccctgccccatctcctcatcatccccagccttgatggaggagggagggcttcaggacggggcgtcagagggagccccctctgggagggaaccaacccccaccctccctcctgggaccccccagcagtagacggcttgggggagtcggaggctccccggcagacaccccacccccatcttgttcccttgaggtgcctcctctcctctgcccaggggagggagtgtggacagtatctggaagttctgggattcaggttgttattaaaataataataataattaaaaactctgaagaaacttgaa

SEQ ID NO: 342669 - DNA, 1080 bp, Homo sapiens
agcgggtctcctctctgcctgcctggcaccagccagaccctgctctgcccggggggctctgagccccccaggcattcccttcactgcatccctctccattgggggggtgtctaaggaccctttccccttgggcatggcccagccaggggtctctgtcaagtccctggtgtcgtcttatgagacccgagtggtggggatggctccggggctgccccgaaaaaggggctgtgcctcttccccttgctctccccggggtgcatcccccatccgagggacatctgggcccccgccccaccggggcctgggaggccctgggcagcggccttcaacccgcagggggatggacaaaaccctcctctccctcattctctactgtcacagtggctccggaagcctggttggcattgacaacaaaatcgagcaagccatggacttggtgaagtcccacctcatgtttgcggtccgggaggaggtggaggtgctgaaggagcagatccgggaactggcggagcggaacgctgcgctggagcaggagaatgggctgctgcgcgccctggccagcccggagcagctggctcagctgccctcctcgggggtcccacggcttgggccccctgcgcccaatgggccctccgtctgagcctcccttcccttacaatgtgcctttggggctgcccggccttgcgtcagccgcctgccccctcttcctatgcagctttaatgtccccgtgtccccggggtgggagttcaaggctcagtaatggcctggtcccccggcccctgccccatctcctcatcatccccagccttgatggaggagggagggcttcaggacggggcgtcagagggagccccctctgggagggaaccaacccccaccctccctcctgggaccccccagcagtagacggcttgggggagtcggaggctccccggcagacaccccacccccatcttgttcccttgaggtgcctcctctcctctgcccaggggagggagtgtggacagtatctggaagttctgggattcaggttgttattaaaataataataataattaaaaactctgaagaaacttgaa

SEQ ID NO: 342670 - DNA, 1174 bp, Homo sapiens
agcgggtctcctctctgcctgcctggcaccagccagaccctgctctgcccggggggctctgagccccccaggcattcccttcactgcatccctctccattgggggggtgtctaaggaccctttccccttgggcatggcccagccaggggtctctgtcaagtccctggtgtcgtcttatgagacccgagtggtggggatggctccggggctgccccgaaaaaggggctgtgcctcttccccttgctctccccggggtgcatcccccatccgagggacatctgggcccccgccccaccggggcctgggaggccctgggcagcggccttcaacccgcagggggatggacaaaaccctcctctccctcattctctactgtcacaggtacaggggggtgtgggcgggaggctgtggtccaagaaaccagcacctgggaaggcttctcctctcctcccctcaccttcctgtgtctctccagtggctccggaagcctggttggcattgacaacaaaatcgagcaagccatggacttggtgaagtcccacctcatgtttgcggtccgggaggaggtggaggtgctgaaggagcagatccgggaactggcggagcggaacgctgcgctggagcaggagaatgggctgctgcgcgccctggccagcccggagcagctggctcagctgccctcctcgggggtcccacggcttgggccccctgcgcccaatgggccctccgtctgagcctcccttcccttacaatgtgcctttggggctgcccggccttgcgtcagccgcctgccccctcttcctatgcagctttaatgtccccgtgtccccggggtgggagttcaaggctcagtaatggcctggtcccccggcccctgccccatctcctcatcatccccagccttgatggaggagggagggcttcaggacggggcgtcagagggagccccctctgggagggaaccaacccccaccctccctcctgggaccccccagcagtagacggcttgggggagtcggaggctccccggcagacaccccacccccatcttgttcccttgaggtgcctcctctcctctgcccaggggagggagtgtggacagtatctggaagttctgggattcaggttgttattaaaataataataataattaaaaactctgaagaaacttgaa

SEQ ID NO: 342671 - DNA, 2264 bp, Homo sapiens
agcctaagcagtggctgcagcaactgcaacagcagcggctgtggcaggcctggccccgggccagctggcgggaagccccaggagggagggagggaggaggaaggggaggaagaggggaaggaggaggaggaggaggagaggagcagtcagcaggcccgaggaggcaggacttcctggtgtgggggttgtcaacagcccagaaagagaaagacggagaggcagagacccaggggagccgaggagcggagacacggacccagcagggtcacgcgggaggagactcgggacacccactcgctggctgccaccgggagcagaggggggctcggccgccccctcccacatcagtctccagacccttggggcttcagaggccgctcctaggctcctcggaggaggcgcgggtttcttcttttccggagagcaaactttcctcggagatgcctggcaggatgagccgcggcccccggagaggacgggacagcctctgatcgccgcctgcgtgccccgccactgcccatggccaggaggccccagggaacggacagcccgacctcttaggcgccgggaccctcaggctcagatcagtggccgaggccccagagtttgcaaactcagctctggagttcagcagcaacagcagcaggaaaaacctgcccctgctcccccctcccgccacctcccctctcctcttctcccctcacccagcaggcacccccggttcccgccaggccctcctgccatgtcggacccagacgtccccaggggctcggatgtccccgccatgtggcccccttgttccaggggtgcctgagccccttcaaggagccccaacccacccccaaccttggcccagccctgagccccagggaccatgagcgggggcaagaagaagagtagtttccaaatcaccagcgtcaccacggactatgagggccctgggagcccaggggcttcggatccccctaccccacagcccccaaccgggcccccgccccgcctgcccaatggggagcccagccccgatccggggggcaagggcaccccccggaatggctccccaccacctggggccccttcctcccgtttccgggtggtgaagctgccccacggcctgggagagccttatcgccgcggtcgctggacgtgtgtggatgtttatgagcgagacctggagccccacagcttcggcggactcctggagggaattcgaggggcctcagggggcgccgggggcagatctttggattccaggttggagctggccagcctcggcctgggcgcccccaccccaccgtcaggcctgtctcagggccccacctcctggctccgtccaccccccacctctcctggacctcaggcccgctccttcactgggggactgggccagctggtggtgcccagcaaagccaaggcagagaaacccccactgtcggcctcctcaccccagcagcgccccccagagcctgagaccggtgagagtgcgggcacatcccgggctgccacgcccctgccctctctgagggtggaagcggaggctgggggctcaggggccaggacccctccactgtcccggaggaaagctgtagacatgcggctgcggatggagttgggtgctccagaagagatggggcaggtgcccccacttgactctcgccccagctccccagccctctacttcacccacgatgccagcctggttcacaaatctccagaccccttcggagcagtagcagctcagaagttcagcctggcccactccatgttggccatcagtggtcacctagacagcgacgatgatagtggctccggaagcctggttggcattgacaacaaaatcgagcaagccatggacttggtgaagtcccacctcatgtttgcggtccgggaggaggtggaggtgctgaaggagcagatccgggaactggcggagcggaacgctgcgctggagcaggagaatgggctgctgcgcgccctggccagcccggagcagctggctcagctgccctcctcgggggtcccacggcttgggccccctgcgcccaatgggccctccgtctgagcctcccttcccttacaatgtgcctttggggctgcccggccttgcgtcagccgcctgccccctcttcctatgcagctttaatgtccccgtgtccccggggtgggagttcaaggctcagtaatggcctggtcccccggcccggtacatgcaagctcccatcagggctgaggaagaatatgaggctttcgagtgatgagcccac

SEQ ID NO: 342672 - DNA, 2291 bp, Homo sapiens
agcctaagcagtggctgcagcaactgcaacagcagcggctgtggcaggcctggccccgggccagctggcgggaagccccaggagggagggagggaggaggaaggggaggaagaggggaaggaggaggaggaggaggagaggagcagtcagcaggcccgaggaggcaggacttcctggtgtgggggttgtcaacagcccagaaagagaaagacggagaggcagagacccaggggagccgaggagcggagacacggacccagcagggtcacgcgggaggagactcgggacacccactcgctggctgccaccgggagcagaggggggctcggccgccccctcccacatcagtctccagacccttggggcttcagaggccgctcctaggctcctcggaggaggcgcgggtttcttcttttccggagagcaaactttcctcggagatgcctggcaggatgagccgcggcccccggagaggacgggacagcctctgatcgccgcctgcgtgccccgccactgcccatggccaggaggccccagggaacggacagcccgacctcttaggcgccgggaccctcaggctcagatcagtggccgaggccccagagtttgcaaactcagctctggagttcagcagcaacagcagcaggaaaaacctgcccctgctcccccctcccgccacctcccctctcctcttctcccctcacccagcaggcacccccggttcccgccaggccctcctgccatgtcggacccagacgtccccaggggctcggatgtccccgccatgtggcccccttgttccaggggtgcctgagccccttcaaggagccccaacccacccccaaccttggcccagccctgagccccagggaccatgagcgggggcaagaagaagagtagtttccaaatcaccagcgtcaccacggactatgagggccctgggagcccaggggcttcggatccccctaccccacagcccccaaccgggcccccgccccgcctgcccaatggggagcccagccccgatccggggggcaagggcaccccccggaatggctccccaccacctggggccccttcctcccgtttccgggtggtgaagctgccccacggcctgggagagccttatcgccgcggtcgctggacgtgtgtggatgtttatgagcgagacctggagccccacagcttcggcggactcctggagggaattcgaggggcctcagggggcgccgggggcagatctttggattccaggttggagctggccagcctcggcctgggcgcccccaccccaccgtcaggcctgtctcagggccccacctcctggctccgtccaccccccacctctcctggacctcaggcccgctccttcactgggggactgggccagctggtggtgcccagcaaagccaaggcagagaaacccccactgtcggcctcctcaccccagcagcgccccccagagcctgagaccggtgagagtgcgggcacatcccgggctgccacgcccctgccctctctgagggtggaagcggaggctgggggctcaggggccaggacccctccactgtcccggaggaaagctgtagacatgcggctgcggatggagttgggtgctccagaagagatggggcaggtgcccccacttgactctcgccccagctccccagccctctacttcacccacgatgccagcctggttcacaaatctccagaccccttcggagcagtagcagctcagaagttcagcctggcccactccatgttggccatcagtggtcacctagacagcgacgatgataggtaggtgggcttcgtggggtggtggggcgtggggttcaggttccccgcccagcacccggggtagctgtaagaaagtgcctggtaggcatccttcccccaggttgaacttggagaggacctcttagagaaacctggcctgggcatagccactgcacacagttgatttcggacccactccctctctgtggagagggctgggtgggactccctggctcagaactgtcaggtcacagacttttttagagtctgaagggagtcattgttgtcagattccagagctcttgcagatttagagatcatctggccaacccaggaacccactggcaaatgcatgctctagacagaatagcaaatcaggccggggcacagtggctcccgcctgtactcatagtgctttgggaggcccaggcaggaaaattgcttgaggccaggagttcaagaccaagccctggcaatgtagcgagacctcatctctaaaaagaaaaaga

SEQ ID NO: 342673 - DNA, 2078 bp, Homo sapiens
agcctaagcagtggctgcagcaactgcaacagcagcggctgtggcaggcctggccccgggccagctggcgggaagccccaggagggagggagggaggaggaaggggaggaagaggggaaggaggaggaggaggaggagaggagcagtcagcaggcccgaggaggcaggacttcctggtgtgggggttgtcaacagcccagaaagagaaagacggagaggcagagacccaggggagccgaggagcggagacacggacccagcagggtcacgcgggaggagactcgggacacccactcgctggctgccaccgggagcagaggggggctcggccgccccctcccacatcagtctccagacccttggggcttcagaggccgctcctaggctcctcggaggaggcgcgggtttcttcttttccggagagcaaactttcctcggagatgcctggcaggatgagccgcggcccccggagaggacgggacagcctctgatcgccgcctgcgtgccccgccactgcccatggccaggaggccccagggaacggacagcccgacctcttaggcgccgggaccctcaggctcagatcagtggccgaggccccagagtttgcaaactcagctctggagttcagcagcaacagcagcaggaaaaacctgcccctgctcccccctcccgccacctcccctctcctcttctcccctcacccagcaggcacccccggttcccgccaggccctcctgccatgtcggacccagacgtccccaggggctcggatgtccccgccatgtggcccccttgttccaggggtgcctgagccccttcaaggagccccaacccacccccaaccttggcccagccctgagccccagggaccatgagcgggggcaagaagaagagtagtttccaaatcaccagcgtcaccacggactatgagggccctgggagcccaggggcttcggatccccctaccccacagcccccaaccgggcccccgccccgcctgcccaatggggagcccagccccgatccggggggcaagggcaccccccggaatggctccccaccacctggggccccttcctcccgtttccgggtggtgaagctgccccacggcctgggagagccttatcgccgcggtcgctggacgtgtgtggatgtttatgagcgagacctggagccccacagcttcggcggactcctggagggaattcgaggggcctcagggggcgccgggggcagatctttggattccaggttggagctggccagcctcggcctgggcgcccccaccccaccgtcaggcctgtctcagggccccacctcctggctccgtccaccccccacctctcctggacctcaggcccgctccttcactgggggactgggccagctggtggtgcccagcaaagccaaggcagagaaacccccactgtcggcctcctcaccccagcagcgccccccagagcctgagaccggtgagagtgcgggcacatcccgggctgccacgcccctgccctctctgagggtggaagcggaggctgggggctcaggggccaggacccctccactgtcccggaggaaagctgtagacatgcggctgcggatggagttgggtgctccagaagagatggggcaggtgcccccacttgactctcgccccagctccccagccctctacttcacccacgatgccagcctggttcacaaatctccagaccccttcggagcagtagcagctcagaagttcagcctggcccactccatgttggccatcagtggtcacctagacagcgacgatgataggtaggtgggcttcgtggggtggtggggcgtggggttcaggttccccgcccagcacccggggtagctgtaagaaagtgcctggtaggcatccttcccccaggttgaacttggagaggacctcttagagaaacctggcctgggcatagccactgcacacagttgatttcggacccactccctctctgtggagagggctgggtgggactccctggctcagaactgtcaggaagagacccggagtcaggaagagacccgcagtcaggaagagacccgca

SEQ ID NO: 342674 - DNA, 1115 bp, Homo sapiens
  misc_feature (53)..(53): n is a, c, g, or t
taaacacatccaccaacaatacgacgcgcagattgtactatgaaccgtgttanagcaggtgtacggccggaattttgggatccaggggagccgaggagcggagacacggacccagcagggtcacgcgggaggagactcgggacacccactcgctggctgccaccgggagcagaggggggctcggccgccccctcccacatcagtctccagacccttggggcttcagaggccgctcctaggctcctcggaggaggcgcgggtttcttcttttccggagagcaaactttcctcggagatgcctggcaggatgagccgcggcccccggagaggacgggacagcctctgatcgccgcctgcgtgccccgccactgcccatggccaggaggccccagggaacggacagcccgacctcttaggcgccgggaccctcaggctcagatcagtggccgaggccccagaggtgcccccacttgactctcgccccagctccccagccctctacttcacccacgatgccagcctggttcacaaatctccagaccccttcggagcagtagcagctcagaagttcagcctggcccactccatgttggccatcagtggtcacctagacagcgacgatgataggtaggtgggcttcgtggggtggtggggcgtggggttcaggttccccgcccagcacccggggtagctgtaagaaagtgcctggtaggcatccttcccccaggttgaacttggagaggacctcttagagaaacctggcctgggcatagccactgcacacagttgatttcggacccactccctctctgtggagagggctgggtgggactccctggctcagaactgtcaggtcacagacttttttagagtctgaagggagtcattgttgtcagattccagagctcttgcagatttagagatcatctggccaacccaggaacccactggcaaatgcatgctctagacagaatagcaaatcaggccggggcacagtggctcccgcctgtactcatagtgctttgggaggcccaggcaggaaaattgcttgaggccaggagttcaagaccaagccctggcaatgtagcgagacctcatctctaaaaagaaaaaga

SEQ ID NO: 342675 - DNA, 2502 bp, Homo sapiens
agcctaagcagtggctgcagcaactgcaacagcagcggctgtggcaggcctggccccgggccagctggcgggaagccccaggagggagggagggaggaggaaggggaggaagaggggaaggaggaggaggaggaggagaggagcagtcagcaggcccgaggaggcaggacttcctggtgtgggggttgtcaacagcccagaaagagaaagacggagaggcagagacccaggggagccgaggagcggagacacggacccagcagggtcacgcgggaggagactcgggacacccactcgctggctgccaccgggagcagaggggggctcggccgccccctcccacatcagtctccagacccttggggcttcagaggccgctcctaggctcctcggaggaggcgcgggtttcttcttttccggagagcaaactttcctcggagatgcctggcaggatgagccgcggcccccggagaggacgggacagcctctgatcgccgcctgcgtgccccgccactgcccatggccaggaggccccagggaacggacagcccgacctcttaggcgccgggaccctcaggctcagatcagtggccgaggccccagagtttgcaaactcagctctggagttcagcagcaacagcagcaggaaaaacctgcccctgctcccccctcccgccacctcccctctcctcttctcccctcacccagcaggcacccccggttcccgccaggccctcctgccatgtcggacccagacgtccccaggggctcggatgtccccgccatgtggcccccttgttccaggggtgcctgagccccttcaaggagccccaacccacccccaaccttggcccagccctgagccccagggaccatgagcgggggcaagaagaagagtagtttccaaatcaccagcgtcaccacggactatgagggccctgggagcccaggggcttcggatccccctaccccacagcccccaaccgggcccccgccccgcctgcccaatggggagcccagccccgatccggggggcaagggcaccccccggaatggctccccaccacctggggccccttcctcccgtttccgggtggtgaagctgccccacggcctgggagagccttatcgccgcggtcgctggacgtgtgtggatgtttatgagcgagacctggagccccacagcttcggcggactcctggagggaattcgaggggcctcagggggcgccgggggcagatctttggattccaggttggagctggccagcctcggcctgggcgcccccaccccaccgtcaggcctgtctcagggccccacctcctggctccgtccaccccccacctctcctggacctcaggcccgctccttcactgggggactgggccagctggtggtgcccagcaaagccaaggcagagaaacccccactgtcggcctcctcaccccagcagcgccccccagagcctgagaccggtgagagtgcgggcacatcccgggctgccacgcccctgccctctctgagggtggaagcggaggctgggggctcaggggccaggacccctccactgtcccggaggaaagctgtagacatgcggctgcggatggagttgggtgctccagaagagatggggcaggtgcccccacttgactctcgccccagctccccagccctctacttcacccacgatgccagcctggttcacaaatctccagaccccttcggagcagtagcagctcagaagttcagcctggcccactccatgttggccatcagtggtcacctagacagcgacgatgatagtggctccggaagcctggttggcattgacaacaaaatcgagcaagccatggacttggtgaagtcccacctcatgtttgcggtccgggaggaggtggaggtgctgaaggagcagatccgggaactggcggagcggaacgctgcgctggagcaggagaatgggctgctgcgcgccctggccagcccggagcagctggctcagctgccctcctcgggggtcccacggcttgggccccctgcgcccaatgggccctccgtctgagcctcccttcccttacaatgtgcctttggggctgcccggccttgcgtcagccgcctgccccctcttcctatgcagctttaatgtccccgtgtccccggggtgggagttcaaggctcagtaatggcctggtcccccggcccctgccccatctcctcatcatccccagccttgatggaggagggagggcttcaggacggggcgtcagagggagccccctctgggagggaaccaacccccaccctccctcctgggaccccccagcagtagacggcttgggggagtcggaggctccccggcagacaccccacccccatcttgttcccttgaggtgcctcctctcctctgcccaggggagggagtgtggacagtatctggaagttctgggattcaggttgttattaaaataataataataattaaaaactctgaagaaacttgaa

SEQ ID NO: 342676 - DNA, 2357 bp, Homo sapiens
  misc_feature (53)..(53): n is a, c, g, or t
taaacacatccaccaacaatacgacgcgcagattgtactatgaaccgtgttanagcaggtgtacggccggaattttgggatccaggggagccgaggagcggagacacggacccagcagggtcacgcgggaggagactcgggacacccactcgctggctgccaccgggagcagaggggggctcggccgccccctcccacatcagtctccagacccttggggcttcagaggccgctcctaggctcctcggaggaggcgcgggtttcttcttttccggagagcaaactttcctcggagatgcctggcaggatgagccgcggcccccggagaggacgggacagcctctgatcgccgcctgcgtgccccgccactgcccatggccaggaggccccagggaacggacagcccgacctcttaggcgccgggaccctcaggctcagatcagtggccgaggccccagagtttgcaaactcagctctggagttcagcagcaacagcagcaggaaaaacctgcccctgctcccccctcccgccacctcccctctcctcttctcccctcacccagcaggcacccccggttcccgccaggccctcctgccatgtcggacccagacgtccccaggggctcggatgtccccgccatgtggcccccttgttccaggggtgcctgagccccttcaaggagccccaacccacccccaaccttggcccagccctgagccccagggaccatgagcgggggcaagaagaagagtagtttccaaatcaccagcgtcaccacggactatgagggccctgggagcccaggggcttcggatccccctaccccacagcccccaaccgggcccccgccccgcctgcccaatggggagcccagccccgatccggggggcaagggcaccccccggaatggctccccaccacctggggccccttcctcccgtttccgggtggtgaagctgccccacggcctgggagagccttatcgccgcggtcgctggacgtgtgtggatgtttatgagcgagacctggagccccacagcttcggcggactcctggagggaattcgaggggcctcagggggcgccgggggcagatctttggattccaggttggagctggccagcctcggcctgggcgcccccaccccaccgtcaggcctgtctcagggccccacctcctggctccgtccaccccccacctctcctggacctcaggcccgctccttcactgggggactgggccagctggtggtgcccagcaaagccaaggcagagaaacccccactgtcggcctcctcaccccagcagcgccccccagagcctgagaccggtgagagtgcgggcacatcccgggctgccacgcccctgccctctctgagggtggaagcggaggctgggggctcaggggccaggacccctccactgtcccggaggaaagctgtagacatgcggctgcggatggagttgggtgctccagaagagatggggcaggtgcccccacttgactctcgccccagctccccagccctctacttcacccacgatgccagcctggttcacaaatctccagaccccttcggagcagtagcagctcagaagttcagcctggcccactccatgttggccatcagtggtcacctagacagcgacgatgatagtggctccggaagcctggttggcattgacaacaaaatcgagcaagccatggacttggtgaagtcccacctcatgtttgcggtccgggaggaggtggaggtgctgaaggagcagatccgggaactggcggagcggaacgctgcgctggagcaggagaatgggctgctgcgcgccctggccagcccggagcagctggctcagctgccctcctcgggggtcccacggcttgggccccctgcgcccaatgggccctccgtctgagcctcccttcccttacaatgtgcctttggggctgcccggccttgcgtcagccgcctgccccctcttcctatgcagctttaatgtccccgtgtccccggggtgggagttcaaggctcagtaatggcctggtcccccggcccctgccccatctcctcatcatccccagccttgatggaggagggagggcttcaggacggggcgtcagagggagccccctctgggagggaaccaacccccaccctccctcctgggaccccccagcagtagacggcttgggggagtcggaggctccccggcagacaccccacccccatcttgttcccttgaggtgcctcctctcctctgcccaggggagggagtgtggacagtatctggaagttctgggattcaggttgttattaaaataataataataattaaaaactctgaagaaacttgaa

SEQ ID NO: 342677 - DNA, 2885 bp, Homo sapiens
agcctaagcagtggctgcagcaactgcaacagcagcggctgtggcaggcctggccccgggccagctggcgggaagccccaggagggagggagggaggaggaaggggaggaagaggggaaggaggaggaggaggaggagaggagcagtcagcaggcccgaggaggcaggacttcctggtgtgggggttgtcaacagcccagaaagagaaagacggagaggcagagacccaggggagccgaggagcggagacacggacccagcagggtcacgcgggaggagactcgggacacccactcgctggctgccaccgggagcagaggggggctcggccgccccctcccacatcagtctccagacccttggggcttcagaggccgctcctaggctcctcggaggaggcgcgggtttcttcttttccggagagcaaactttcctcggagatgcctggcaggatgagccgcggcccccggagaggacgggacagcctctgatcgccgcctgcgtgccccgccactgcccatggccaggaggccccagggaacggacagcccgacctcttaggcgccgggaccctcaggctcagatcagtggccgaggccccagagtttgcaaactcagctctggagttcagcagcaacagcagcaggaaaaacctgcccctgctcccccctcccgccacctcccctctcctcttctcccctcacccagcaggcacccccggttcccgccaggccctcctgccatgtcggacccagacgtccccaggggctcggatgtccccgccatgtggcccccttgttccaggggtgcctgagccccttcaaggagccccaacccacccccaaccttggcccagccctgagccccagggaccatgagcgggggcaagaagaagagtagtttccaaatcaccagcgtcaccacggactatgagggccctgggagcccaggggcttcggatccccctaccccacagcccccaaccgggcccccgccccgcctgcccaatggggagcccagccccgatccggggggcaagggcaccccccggaatggctccccaccacctggggccccttcctcccgtttccgggtggtgaagctgccccacggcctgggagagccttatcgccgcggtcgctggacgtgtgtggatgtttatgagcgagacctggagccccacagcttcggcggactcctggagggaattcgaggggcctcagggggcgccgggggcagatctttggattccaggttggagctggccagcctcggcctgggcgcccccaccccaccgtcaggcctgtctcagggccccacctcctggctccgtccaccccccacctctcctggacctcaggcccgctccttcactgggggactgggccagctggtggtgcccagcaaagccaaggcagagaaacccccactgtcggcctcctcaccccagcagcgccccccagagcctgagaccggtgagagtgcgggcacatcccgggctgccacgcccctgccctctctgagggtggaagcggaggctgggggctcaggggccaggacccctccactgtcccggaggaaagctgtagacatgcggctgcggatggagttgggtgctccagaagagatggggcaggtgcccccacttgactctcgccccagctccccagccctctacttcacccacgatgccagcctggttcacaaatctccagaccccttcggagcagtagcagctcagaagttcagcctggcccactccatgttggccatcagtggtcacctagacagcgacgatgatagtggctccggaagcctggttggcattgacaacaaaatcgagcaagccatggtaagagaagccatcttggtcccaggaggtcctggcccccttaagccatccctctgccccagccctgtcctcttccttaccagggaacaccaactcccagctcctccgtccctctccctgctgggctgctgggcatcctctgccccctcctgccaccacctccacccttgactttgcccagcctctagtctggctactggtccccatctctgtctttgagccctgactctgcctctgtccctcgtccttttcccctgtcccttccctgctttgtccctcatcctctggacactggggactgtctcccaccccagccctcaaggcactgggcaggggatgaggcacccaccccgttgacgctgtgcctgtcccggggcccccaggacttggtgaagtcccacctcatgtttgcggtccgggaggaggtggaggtgctgaaggagcagatccgggaactggcggagcggaacgctgcgctggagcaggagaatgggctgctgcgcgccctggccagcccggagcagctggctcagctgccctcctcgggggtcccacggcttgggccccctgcgcccaatgggccctccgtctgagcctcccttcccttacaatgtgcctttggggctgcccggccttgcgtcagccgcctgccccctcttcctatgcagctttaatgtccccgtgtccccggggtgggagttcaaggctcagtaatggcctggtcccccggcccctgccccatctcctcatcatccccagccttgatggaggagggagggcttcaggacggggcgtcagagggagccccctctgggagggaaccaacccccaccctccctcctgggaccccccagcagtagacggcttgggggagtcggaggctccccggcagacaccccacccccatcttgttcccttgaggtgcctcctctcctctgcccaggggagggagtgtggacagtatctggaagttctgggattcaggttgttattaaaataataataataattaaaaactctgaagaaacttgaa

SEQ ID NO: 342678 - DNA, 1326 bp, Homo sapiens
  misc_feature (53)..(53): n is a, c, g, or t
taaacacatccaccaacaatacgacgcgcagattgtactatgaaccgtgttanagcaggtgtacggccggaattttgggatccaggggagccgaggagcggagacacggacccagcagggtcacgcgggaggagactcgggacacccactcgctggctgccaccgggagcagaggggggctcggccgccccctcccacatcagtctccagacccttggggcttcagaggccgctcctaggctcctcggaggaggcgcgggtttcttcttttccggagagcaaactttcctcggagatgcctggcaggatgagccgcggcccccggagaggacgggacagcctctgatcgccgcctgcgtgccccgccactgcccatggccaggaggccccagggaacggacagcccgacctcttaggcgccgggaccctcaggctcagatcagtggccgaggccccagaggtgcccccacttgactctcgccccagctccccagccctctacttcacccacgatgccagcctggttcacaaatctccagaccccttcggagcagtagcagctcagaagttcagcctggcccactccatgttggccatcagtggtcacctagacagcgacgatgatagtggctccggaagcctggttggcattgacaacaaaatcgagcaagccatggacttggtgaagtcccacctcatgtttgcggtccgggaggaggtggaggtgctgaaggagcagatccgggaactggcggagcggaacgctgcgctggagcaggagaatgggctgctgcgcgccctggccagcccggagcagctggctcagctgccctcctcgggggtcccacggcttgggccccctgcgcccaatgggccctccgtctgagcctcccttcccttacaatgtgcctttggggctgcccggccttgcgtcagccgcctgccccctcttcctatgcagctttaatgtccccgtgtccccggggtgggagttcaaggctcagtaatggcctggtcccccggcccctgccccatctcctcatcatccccagccttgatggaggagggagggcttcaggacggggcgtcagagggagccccctctgggagggaaccaacccccaccctccctcctgggaccccccagcagtagacggcttgggggagtcggaggctccccggcagacaccccacccccatcttgttcccttgaggtgcctcctctcctctgcccaggggagggagtgtggacagtatctggaagttctgggattcaggttgttattaaaataataataataattaaaaactctgaagaaacttgaa

SEQ ID NO: 342679 - DNA, 1557 bp, Homo sapiens
agcgggtctcctctctgcctgcctggcaccagccagaccctgctctgcccggggggctctgagccccccaggcattcccttcactgcatccctctccattgggggggtgtctaaggaccctttccccttgggcatggcccagccaggggtctctgtcaagtccctggtgtcgtcttatgagacccgagtggtggggatggctccggggctgccccgaaaaaggggctgtgcctcttccccttgctctccccggggtgcatcccccatccgagggacatctgggcccccgccccaccggggcctgggaggccctgggcagcggccttcaacccgcagggggatggacaaaaccctcctctccctcattctctactgtcacaggtacaggggggtgtgggcgggaggctgtggtccaagaaaccagcacctgggaaggcttctcctctcctcccctcaccttcctgtgtctctccagtggctccggaagcctggttggcattgacaacaaaatcgagcaagccatggtaagagaagccatcttggtcccaggaggtcctggcccccttaagccatccctctgccccagccctgtcctcttccttaccagggaacaccaactcccagctcctccgtccctctccctgctgggctgctgggcatcctctgccccctcctgccaccacctccacccttgactttgcccagcctctagtctggctactggtccccatctctgtctttgagccctgactctgcctctgtccctcgtccttttcccctgtcccttccctgctttgtccctcatcctctggacactggggactgtctcccaccccagccctcaaggcactgggcaggggatgaggcacccaccccgttgacgctgtgcctgtcccggggcccccaggacttggtgaagtcccacctcatgtttgcggtccgggaggaggtggaggtgctgaaggagcagatccgggaactggcggagcggaacgctgcgctggagcaggagaatgggctgctgcgcgccctggccagcccggagcagctggctcagctgccctcctcgggggtcccacggcttgggccccctgcgcccaatgggccctccgtctgagcctcccttcccttacaatgtgcctttggggctgcccggccttgcgtcagccgcctgccccctcttcctatgcagctttaatgtccccgtgtccccggggtgggagttcaaggctcagtaatggcctggtcccccggcccctgccccatctcctcatcatccccagccttgatggaggagggagggcttcaggacggggcgtcagagggagccccctctgggagggaaccaacccccaccctccctcctgggaccccccagcagtagacggcttgggggagtcggaggctccccggcagacaccccacccccatcttgttcccttgaggtgcctcctctcctctgcccaggggagggagtgtggacagtatctggaagttctgggattcaggttgttattaaaataataataataattaaaaactctgaagaaacttgaa

SEQ ID NO: 342680 - DNA, 2237 bp, Homo sapiens
agcctaagcagtggctgcagcaactgcaacagcagcggctgtggcaggcctggccccgggccagctggcgggaagccccaggagggagggagggaggaggaaggggaggaagaggggaaggaggaggaggaggaggagaggagcagtcagcaggcccgaggaggcaggacttcctggtgtgggggttgtcaacagcccagaaagagaaagacggagaggcagagacccaggggagccgaggagcggagacacggacccagcagggtcacgcgggaggagactcgggacacccactcgctggctgccaccgggagcagaggggggctcggccgccccctcccacatcagtctccagacccttggggcttcagaggccgctcctaggctcctcggaggaggcgcgggtttcttcttttccggagagcaaactttcctcggagatgcctggcaggatgagccgcggcccccggagaggacgggacagcctctgatcgccgcctgcgtgccccgccactgcccatggccaggaggccccagggaacggacagcccgacctcttaggcgccgggaccctcaggctcagatcagtggccgaggccccagagtttgcaaactcagctctggagttcagcagcaacagcagcaggaaaaacctgcccctgctcccccctcccgccacctcccctctcctcttctcccctcacccagcaggcacccccggttcccgccaggccctcctgccatgtcggacccagacgtccccaggggctcggatgtccccgccatgtggcccccttgttccaggggtgcctgagccccttcaaggagccccaacccacccccaaccttggcccagccctgagccccagggaccatgagcgggggcaagaagaagagtagtttccaaatcaccagcgtcaccacggactatgagggccctgggagcccaggggcttcggatccccctaccccacagcccccaaccgggcccccgccccgcctgcccaatggggagcccagccccgatccggggggcaagggcaccccccggaatggctccccaccacctggggccccttcctcccgtttccgggtggtgaagctgccccacggcctgggagagccttatcgccgcggtcgctggacgtgtgtggatgtttatgagcgagacctggagccccacagcttcggcggactcctggagggaattcgaggggcctcagggggcgccgggggcagatctttggattccaggttggagctggccagcctcggcctgggcgcccccaccccaccgtcaggcctgtctcagggccccacctcctggctccgtccaccccccacctctcctggacctcaggcccgctccttcactgggggactgggccagctggtggtgcccagcaaagccaaggcagagaaacccccactgtcggcctcctcaccccagcagcgccccccagagcctgagaccggtgagagtgcgggcacatcccgggctgccacgcccctgccctctctgagggtggaagcggaggctgggggctcaggggccaggacccctccactgtcccggaggaaagctgtagacatgcggctgcggatggagttgggtgctccagaagagatggggcaggtgcccccacttgactctcgccccagctccccagccctctacttcacccacgatgccagcctggttcacaaatctccagaccccttcggagcagtagcagctcagaagttcagcctggcccactccatgttggccatcagtggtcacctagacagcgacgatgatagtggctccggaagcctggttggcattgacaacaaaatcgagcaagccatggacttggtgaagtcccacctcatgtttgcggtccgggaggaggtggaggtgctgaaggagcagatccgggaactggcggagcggaacgctgcgctggagcaggagaatgggctgctgcgcgccctggccagcccggagcagctggctcagctgccctcctcgggggtcccacggcttgggccccctgcgcccaatgggccctccgtctgagcctcccttcccttacaatgtgcctttggggctgcccggccttgcgtcagccgctggccttttctatggcagttatgtccgggtccgggggggagtcaggacagaatggctggtcccggcctgacaattctatatccagcttgtgggagggggcagagagggaaaggaccctggg

SEQ ID NO: 342681 - DNA, 1836 bp, Homo sapiens
agcctaagcagtggctgcagcaactgcaacagcagcggctgtggcaggcctggccccgggccagctggcgggaagccccaggagggagggagggaggaggaaggggaggaagaggggaaggaggaggaggaggaggagaggagcagtcagcaggcccgaggaggcaggacttcctggtgtgggggttgtcaacagcccagaaagagaaagacggagaggcagagacccaggggagccgaggagcggagacacggacccagcagggtcacgcgggaggagactcgggacacccactcgctggctgccaccgggagcagaggggggctcggccgccccctcccacatcagtctccagacccttggggcttcagaggccgctcctaggctcctcggaggaggcgcgggtttcttcttttccggagagcaaactttcctcggagatgcctggcaggatgagccgcggcccccggagaggacgggacagcctctgatcgccgcctgcgtgccccgccactgcccatggccaggaggccccagggaacggacagcccgacctcttaggcgccgggaccctcaggctcagatcagtggccgaggccccagagtttgcaaactcagctctggagttcagcagcaacagcagcaggaaaaacctgcccctgctcccccctcccgccacctcccctctcctcttctcccctcacccagcaggcacccccggttcccgccaggccctcctgccatgtcggacccagacgtccccaggggctcggatgtccccgccatgtggcccccttgttccaggggtgcctgagccccttcaaggagccccaacccacccccaaccttggcccagccctgagccccagggaccatgagcgggggcaagaagaagagtagtttccaaatcaccagcgtcaccacggactatgagggccctgggagcccaggggcttcggatccccctaccccacagcccccaaccgggcccccgccccgcctgcccaatggggagcccagccccgatccggggggcaagggcaccccccggaatggctccccaccacctggggccccttcctcccgtttccgggtggtgaagctgccccacggcctgggagagccttatcgccgcggtcgctggacgtgtgtggatgtttatgagcgagacctggagccccacagcttcggcggactcctggagggaattcgaggggcctcagggggcgccgggggcagatctttggattccaggttggagctggccagcctcggcctgggcgcccccaccccaccgtcaggcctgtctcagggccccacctcctggctccgtccaccccccacctctcctggacctcaggcccgctccttcactgggggactgggccagctggtggtgcccagcaaagccaaggcagagaaacccccactgtcggcctcctcaccccagcagcgccccccagagcctgagaccggtgagagtgcgggcacatcccgggctgccacgcccctgccctctctgagggtggaagcggaggctgggggctcaggggccaggacccctccactgtcccggaggaaagctgtagacatgcggctgcggatggagttgggtgctccagaagagatggggcaggtgcccccacttgactctcgccccagctccccagccctctacttcacccacgatgccagcctggttcacaaatctccagaccccttcggagcagtagcagctcagaagttcagcctggcccactccatgttggccatcagtggtcacctagacagcgacgatgatagtggctaccgttagtctaaactggggggatcctc

SEQ ID NO: 342682 - DNA, 806 bp, Homo sapiens
aatctatctattttcctacatctcatatcttttattttcttagttgagtgtacttaaacccacattgaccagagactttgcagccagctcacccctccaaatccccgccctggagtccctgacccaggaatttctgcatcaggctgctcaaacctgaatttgacaaaatttcaaagcgctgtatctttatgttgataagacaacggataaagtgccatacttggaacctagatcactcaatgttgcctgtagctgagtccacttctgtcactcaccctgcattgccctgccaggagcaagggagagaaagccagccagaaggcatgggcatgggctcaaatcggcttctcctgtggccactgtgaaagttgatcatacaaaggtcactgttgtcatagccaagcagagttatgagaccacaggaaaaagcacttggaccacgtaacattgctccaagagtataactgtctccaaccctggctgctggaacaagtgttgcaacctgaaaccggtttgatctaatagctacagaaacaacctgcggaaatctaagactagtttcacccactcaccaatcagagcttgccggatccccaaaacgttgctagtgctaatgaacttgctttcctaacaatccataacatttctcatttttatgaaacctacaaccttctctttgctctttggacatactgaagaccacccagtctgtgtgtatgccccaaactgaaattcttgctccccaaataaaacaagatgcggccaatgtcagtaccgacaaaaattaagaaataaaagacagacaa

SEQ ID NO: 342683 - DNA, 275 bp, Homo sapiens
atggaaaccaaatttttattgtatgctgtttcttaatgaagtgataactatagatacattaacatatatcattggcaaatctcaaaaatcgattattttacacattgttggtattgcactattagtagtaaataataccctttaagaaatagttaaaagtttcagaaaataggtgtatatttcaaaattacttatttgaaataattgcttacggataattgtggatagcccgcgggtacccgaggctcgaaattcgtaagtccactgggtcctag

SEQ ID NO: 342684 - DNA, 351 bp, Homo sapiens
aggagcactactgatgtagtgataaagtgtcaaggggatttcttctatattcctgtgtttaggtgtcagtattttagcaagctggagttatgcatacccctttctccttatcaaagactagagggaactggactgggtatttgccttcttccaggttggttaatccttgataaaatcccagcaagttaggctctggtgaaataatttcctttgagtgcaggacttgttaaggagaacacagagctcggaatttacttcaaaaatggttattttctcttgagaaaaagtacagatcacttttcccctagatttatgatgaagacccattagagtttctagggataaaactga

SEQ ID NO: 342685 - DNA, 388 bp, Homo sapiens
cctcccagaatcctgtagaggttaaacaaggtaatgtatttaaggtgcctagtacactgcctagcatatacaaatgcatactagacagccaaaatgaaaaaggaactaggcttgtttacactaagactggtgcatttaacacagggataatgtcttagcccacaaaaattcacttttttgacaggatataaagacataatctctagttatggaatgagaaacagtacacagttggtggaaagaggccaagtttgaaatgggcctgtccgagcacttttataatcatataattcataggtacatgcctgtgttgcttaatgcagaactacagacctttaacaacttctttttgctacgtaagacttggctgtgtcctaggatgaaggag

SEQ ID NO: 342686 - DNA, 318 bp, Homo sapiens
tttgctatttgtacaacaccatgaaacatgttcctacttcagggccttgcatttgcactttcttctactgaaatagtcttcctctagatagtgctcatgctctcacttccttcaggtagctgctcaaatactgcctttttattgaggcctttgctgaccaacccatataaaataatagtcttccttccctgccctctctgccctaccttccccaccctgccagactgacaacccctattcctcttatcctgctctctttttctccactgaactgttcactatctgacataataggtatatagttgtttactgtctccc

SEQ ID NO: 342687 - DNA, 586 bp, Homo sapiens
agaacagcacacaggccaatggctagaatgaaagtgacagtggtgggaaaacagagaacggggccagagtaagttaaaccatggttaggcatttctgctcccagatgtgttgggaagccatcagagagtttagagcagaaaaatgactgggtatgacttatgttctaaaaggtacatttcagcgattgggtagaaaatggattgtatggagaaataggctgactggtcaggtgaacagggcaatctgggaaagagatgaaaagtggcttggtatagtagggtgatagctatgaaggtggtaagaatgtgagcaacagtgagttttcggttatactggattcaaatctacattttagttaccttgagcaagtttcgttttttgttgttgttgttgttgctgtttttgagatggagtcttgctctgtcgcccaggccggagtgcagtggcgccatctcggcttactgcaacctccacctcccagattcaagcaattctcctgtgttggcttcctgagtagctgggactaccgtacattgagatgggggaagggatggacactcacatgggcactccataccggggatc

SEQ ID NO: 342688 - DNA, 428 bp, Homo sapiens
tttttgcacttggtaagatttcttcttgcatgtctgcacactgcagacttctccagcacaaaacaaagaattacaacatcctccttaccggctgccactgattacttgattaaatcgtcacctctaatttaccctgagcacctgcaaagttcttctccatgcaccagatagtcttcagggtcggaattacatattctctgcagccttctcaagagcttcactccaacatcagtgtctccacccctccctctcatcctcaggactggattttttttttttttttccttcaaaccattgaccatttaacaaaagctttctgttatttttaattggctagccctacttcaagcgacagccgttgttaatgggtcaagggtttgaaggaattcagtctctaacagccagatactacatcccggctccgggcc

SEQ ID NO: 342689 - DNA, 317 bp, Homo sapiens
tttttgcacttggtaagatttcttcttgcatgtctgcacactgcagacttctccagcacaaaacaaagaattacaacatcctccttaccggctgccactgattacttgattaaatcgtcacctctaatttaccctgagcacctgcaaagttcttctccatgcaccagatagtcttcagggtcggaattacatattctctgcagccttctcaagagcttcactccaacatcagtgtctccacccctccctctcatcctcaggactggatttttttttttttttaagacagagtctcgctctgtcgcccaggctggagt

SEQ ID NO: 342690 - DNA, 1271 bp, Homo sapiens
agttgtagcagatatccattctttttgcatggggccagagacccagaaaggctatcagagatttcagcttcctctgtatcaaggtgctttgggaagcaaagctgcccgtgtaggtgaaagcagtagaaatttggaagaaaactcattgttctagaactgtcatagaaatatctcagatatgaaagacttaaacaaaaaggatattgagggacggctttctgcaaagatgtggcctaagatatgtgcatatctgtactaggagttgctgttgtgcatcttgtttaactctcttagaagggacttcagcctatatgtggttgttattaattacattctcaggaacagaatattaattttctgttacagaaaacagtaaatcagaagaccacaatctacgaaattcaggatgatagaggaaaaatggatgtagtggggacaggacaatgtcacaatatcccctgtgaagaaggagataagctccaacttttctgctttcgacttagaaaaaagaaccagatgtcaaaactgatttcagaaatgcatagttttatccagtaagaattaaataggcaaatattagttttccaaagtggaaatgatttgctttaagttttggcaaaaacaagtttgtaggtttttttacagagttcagcgggaggcatgagaaaacagatattctccttgtattcacatttactttttttaattttttttttctggatggaatgatgtgataggatacaattttaaaaagaaagaaatctgaactttatcaaaaaaattgaactctgaattttatgtaaacttttaagtgattgtagggttgggatttaaaattacatgttctccatttgtgaattagaaaacgtcgtgtgtgtgtgtgtgtgtgtgtgatactttctagtttgtaacattacaatacacatatgtgtgtatttagtccataaaaatacctaatttgaaacttaaaattatttgcagtgatcaaaattatgtcccactgacaaagttttatacagaggaagctctccaatttgttaatttgaattcaaatattcacgtgttaagtttccttacagtacatgattttacgctgttgccattttgaatgttgtaaattattttttatttcagtaggtttttgggaaacaggtggtgcttcgttataggaataagttctttagtggtgatttctgactttttgatgcacccatcgtccaagcagcgtacactgtacccagtgtgtatgtagcattttatccctcaccccc

SEQ ID NO: 342691 - DNA, 4166 bp, Homo sapiens
  misc_feature (3081)..(3081): n is a, c, g, or t
  misc_feature (3145)..(3145): n is a, c, g, or t
  misc_feature (3152)..(3152): n is a, c, g, or t
  misc_feature (3174)..(3174): n is a, c, g, or t
  misc_feature (3200)..(3200): n is a, c, g, or t
acattgtttcctactccattttctctggggcaatagcagaataggagcaagccagcactagtcagctaactaagtgactcaaccaaggccttttttccttgttatctttgcagatacttcattttcttagcgtttctggagattacaacatcctgcggttccgtttctgggaactttactgatttatctcccccctcacacaaataagcattgattcctgcatttctgaagatctcaagatctggactactgttgaaaaaatttccagtgaggctcacttatgtctgtaaagatgggaaaaaaatacaagaacattgttctactaaaaggattagaggtcatcaatgattatcattttagaatggttaagtccttactgagcaacgatttaaaacttaatttaaaaatgagagaagagtatgacaaaattcagattgctgacttgatggaagaaaagttccgaggtgatgctggtttgggcaaactaataaaaattttcgaagatataccaacgcttgaagacctggctgaaactcttaaaaaagaaaagttaaaagtaaaaggaccagccctatcaagaaagaggaagaaggaagtggatgctacttcacctgcaccctccacaagcagcactgtcaaaactgaaggagcagaggcaactcctggagctcagaaaagaaaaaaatcaaccaaagaaaaggctggacccaaagggagtaaggtgtccgaggaacagactcagcctccctctcctgcaggagccggcatgtccacagccatgggccgttccccatctcccaagacctcattgtcagctccacccaacacttcttcaactgagaacccgaaaacagtggccaaatgtcaggtaactcccagaagaaatgttctccaaaaacgcccagtgatagtgaaggtactgagtacaacaaagccatttgaatatgagaccccagaaatggagaaaaaaataatgtttcatgctacagtggctacacagacacagttcttccatgtgaaggttttaaacaccagcttgaaggagaaattcaatggaaagaaaatcatcatcatatcagattatttggaatatgatagtctcctagaggtcaatgaagaatctactgtatctgaagctggtcctaaccaaacgtttgaggttccaaataaaatcatcaacagagcaaaggaaactctgaagattgatattcttcacaaacaagcttcaggaaatattgtatatggggtatttatgctacataagaaaacagtaaatcagaagaccacaatctacgaaattcaggatgatagaggaaaaatggatgtagtggggacaggacaatgtcacaatatcccctgtgaagaaggagataagctccaacttttctgctttcgacttagaaaaaagaaccagatgtcaaaactgatttcagaaatgcatagttttatccagataaagaaaaaaacaaacccgagaaacaatgaccccaagagcatgaagctaccccaggaacagagtcagcttccaaatccttcagaggccagcacaaccttccctgagagccatcttcggactcctcagatgccaccaacaactccatccagcagtttcttcaccaagaaaagtgaagacacaatctccaaaatgaatgacttcatgaggatgcagatactgaaggaagggagtcattttccaggaccgttcatgaccagcataggcccagctgagagccatccccacactcctcagatgcctccatcaacaccaagcagcagtttcttaaccacgttgaaaccaagactgaagactgaacctgaagaagtttccatagaagacagtgcccagagtgacctcaaagaagtgatggtgctgaacgcaacagaatcatttgtatatgagcccaaagagcagaagaaaatgtttcatgccacagtggcaactgagaatgaagtcttccgagtgaaggtttttaatattgacctaaaggagaagttcaccccaaagaagatcattgccatagcaaattatgtttgccgcaatgggttcctggaggtatatcctttcacacttgtggctgatgtgaatgctgaccgaaacatggagatcccaaaaggattgattagaagtgccagcgtaactcctaaaatcaatcagctttgctcacaaactaaaggaagttttgtgaatggggtgtttgaggtacataaggtaagcccacaccattgttttataaaatttctcctgcaacctccaatttttaaagtcttaacttgtcaactggagtttggtcaacttactcaacacagaaaatcaaccccttcacccttcccccagcactagagataattgaatagagttcatttcaggatatggggtacgttatattgtaacattcctcttcttaaggtatcatcatgcaagttatttagacagtcactaggaaacttggcattttattagttttgatgatctattcagagccacccttgtccaggacagtgcagagtttatatcaacacacatatccttaggattttgtttctttgagttcttctccatctgtatcaatgacaacttaatttaattgtgaataaaagagttgctctcccaagcctgaatcctgattgtgacaaccagagtaagaaataaaatagactactctgctttagaatgcagctatgtctaacagttagctagaattctgatcatttggactccaaagtttcttgcctcttctcattcattaattcatcaggagactgtagagcaactaacttctgcattaaataataagagaaatacgaagcaaaaagactaaaaaagtcacgtagcttaactgctcaatttataaatggggcaataaaatgcaaaaaaaagaaaaaaagcttggtgaattcttaggcttacagtgtgcctttcagtctctacacatcatgtaaatattatgcttagctgatttaacttcttgtttgaagtactgtttcatactccattatacatgtcttctagggtggcttacttttaattgtgctgttttctctacactcagtttaaatgactgtacatatatatgtggttgnagagttaatgaataatgagctacaaaccagaacaatgtgactagatagataggatgatctaganttgaganctggcagattgggaaagagtgnctatatggagaagaaagaagtagttncatattgaaataacagtctacttaatgaggacgtgcaacattctttctcaaacttacaaagtgccataaaaagcctctattctctgctcttgggcaggtgtgaaagaaacctaccaaattaatcagatttttctgtatccaggctccttaaaaaatcccagctgtgctgatgtggaaacaggaagaattaggaaagtaatcaattttttttcctagaaaaaatccagcagacaaagaacttcaacaaaagaggctcaagggaggagttgaaaggcaggattcaaagaccaagtatcttaagctatttggtacctgttattcaggacctacagctctgtttactctatcaaagacaaaagtttccagaaacaccctgtatttctcatagatttgaaaattattgatccagtttcagaagataagtgttaattttcttttgcagaaaaatgtaaggggtgaattcacttattatgaaatacaagataatacagggaagatggaagtggtggtgcatggacgactgaccacaatcaactgtgaggaaggagataaactgaaactcacctgctttgaattggcaccgaaaagtgggaataccggggagttgagatctgtaattcatagtcacatcaaggtcatcaagaccaggaaaaacaagaaagacatactcaatcctgattcaagtatggaaacttcaccagactttttcttctaaaatctggatgtcattgacgataatgtttatggagataaggtctaagtgcctaaaaaaatgtacatatacctggttgaaatacaacactatacatacacaccaccatatatactagctgttaatcctatggaatggggtattgggagtgcttttttaatttttcatagtttttttttaataaaatggcatattttgcatctacaacttctataatttgaaaaaataaataaacattatcttttttgtgaaaa

SEQ ID NO: 342692 - DNA, 899 bp, Homo sapiens
gggcaaagcagagtatgaggaagccagcactagtcaagtgactctaagaagggccattttcccttgttgtctttgaaaatacttcattttcttagcatttcaggagattataacatcctgtatttcagtttctgagagctttactgactgatttccctattcaaaacaatcctcatttcctacatttctgaagatctcaagatctggactactgttgaagaaattcccagtaaggctcacttatatctttagagatggcaaataactacaagaaaattgttctactgaaaggattagaggtcatcaatgattatcattttagaattgttaagtccttactgagtaacgatttaaaacttaatccaaaaatgaaagaagagtatgacaaaattcagattgctgacttgatggaggaaaagttcccaggtgatgccggtttgggcaaactaatagaattcttcaaagaaataccaacactgggagaccttgctgaaactcttaaaagagaaaagttaaaagttgcaaataaaattgaatccattccagtcaaaggaataatcccatctaaaaagacgaaacagaaagaagtgtatcctgctacacctgcatgcaccccaagcaaccgtctcacagctaaaggagcagaggagactcttggacctcagaaaagaaaaaaaccatctgaagaagagactggaaccaaaaggagtaagatgtccaaagagcagactcggccttcctgctctgcaggagccagcacgtccacagccatgggccgttccccacctccccagacctcatcatcagctccacccaacacttcctcaactgagagcctaaaaccattggccaaccgtcacgcaactgccagtaaaaatattttccgagaagacccaata

SEQ ID NO: 342693 - DNA, 872 bp, Homo sapiens
gggcaaagcagagtatgaggaagccagcactagtcaagtgactctaagaagggccattttcccttgttgtctttgaaaatacttcattttcttagcatttcaggagattataacatcctgtatttcagtttctgagagctttactgactgatttccctattcaaaacaatcctcatttcctacatttctgaagatctcaagatctggactactgttgaagaaattcccagtaaggctcacttatatctttagagatggcaaataactacaagaaaattgttctactgaaaggattagaggtcatcaatgattatcattttagaattgttaagtccttactgagtaacgatttaaaacttaatccaaaaatgaaagaagagtatgacaaaattcagattgctgacttgatggaggaaaagttcccaggtgatgccggtttgggcaaactaatagaattcttcaaagaaataccaacactgggagaccttgctgaaactcttaaaagagaaaagttaaaagtcaaaggaataatcccatctaaaaagacgaaacagaaagaagtgtatcctgctacacctgcatgcaccccaagcaaccgtctcacagctaaaggagcagaggagactcttggacctcagaaaagaaaaaaaccatctgaagaagagactggaaccaaaaggagtaagatgtccaaagagcagactcggccttcctgctctgcaggagccagcacgtccacagccatgggccgttccccacctccccagacctcatcatcagctccacccaacacttcctcaactgagagcctaaaaccattggccaaccgtcacgcaactgccagtaaaaatattttccgagaagacccaata

SEQ ID NO: 342694 - DNA, 2670 bp, Homo sapiens
acattgtttcctactccattttctctggggcaatagcagaataggagcaagccagcactagtcagctaactaagtgactcaaccaaggccttttttccttgttatctttgcagatacttcattttcttagcgtttctggagattacaacatcctgcggttccgtttctgggaactttactgatttatctcccccctcacacaaataagcattgattcctgcatttctgaagatctcaagatctggactactgttgaaaaaatttccagtgaggctcacttatgtctgtaaagatgggaaaaaaatacaagaacattgttctactaaaaggattagaggtcatcaatgattatcattttagaatggttaagtccttactgagcaacgatttaaaacttaatttaaaaatgagagaagagtatgacaaaattcagattgctgacttgatggaagaaaagttccgaggtgatgctggtttgggcaaactaataaaaattttcgaagatataccaacgcttgaagacctggctgaaactcttaaaaaagaaaagttaaaagtaaaaggaccagccctatcaagaaagaggaagaaggaagtggatgctacttcacctgcaccctccacaagcagcactgtcaaaactgaaggagcagaggcaactcctggagctcagaaaagaaaaaaatcaaccaaagaaaaggctggacccaaagggagtaaggtgtccgaggaacagactcagcctccctctcctgcaggagccggcatgtccacagccatgggccgttccccatctcccaagacctcattgtcagctccacccaacacttcttcaactgagaacccgaaaacagtggccaaatgtcaggtaactcccagaagaaatgttctccaaaaacgcccagtgatagtgaaggtactgagtacaacaaagccatttgaatatgagaccccagaaatggagaaaaaaataatgtttcatgctacagtggctacacagacacagttcttccatgtgaaggttttaaacaccagcttgaaggagaaattcaatggaaagaaaatcatcatcatatcagattatttggaatatgatagtctcctagaggtcaatgaagaatctactgtatctgaagctggtcctaaccaaacgtttgaggttccaaataaaatcatcaacagagcaaaggaaactctgaagattgatattcttcacaaacaagcttcaggaaatattgtatatggggtatttatgctacataagaaaacagtaaatcagaagaccacaatctacgaaattcaggatgatagaggaaaaatggatgtagtggggacaggacaatgtcacaatatcccctgtgaagaaggagataagctccaacttttctgctttcgacttagaaaaaagaaccagatgtcaaaactgatttcagaaatgcatagttttatccagagtcagcttccaaatccttcagaggccagcacaaccttccctgagagccatcttcggactcctcagatgccaccaacaactccatccagcagtttcttcaccaagaaaagtgaagacacaatctccaaaatgaatgacttcatgaggatgcagatactgaaggaagggagtcattttccaggaccgttcatgaccagcataggcccagctgagagccatccccacactcctcagatgcctccatcaacaccaagcagcagtttcttaaccacgttgaaaccaagactgaagactgaacctgaagaagtttccatagaagacagtgcccagagtgacctcaaagaagtgatggtgctgaacgcaacagaatcatttgtatatgagcccaaagagcagaagaaaatgtttcatgccacagtggcaactgagaatgaagtcttccgagtgaaggtttttaatattgacctaaaggagaagttcaccccaaagaagatcattgccatagcaaattatgtttgccgcaatgggttcctggaggtatatcctttcacacttgtggctgatgtgaatgctgaccgaaacatggagatcccaaaaggattgattagaagtgccagcgtaactcctaaaatcaatcagctttgctcacaaactaaaggaagttttgtgaatggggtgtttgaggtacataagaaaaatgtaaggggtgaattcacttattatgaaatacaagataatacagggaagatggaagtggtggtgcatggacgactgaccacaatcaactgtgaggaaggagataaactgaaactcacctgctttgaattggcaccgaaaagtgggaataccggggagttgagatctgtaattcatagtcacatcaaggtcatcaagaccaggaaaaacaagaaagacatactcaatcctgattcaagtatggaaacttcaccagactttttcttctaaaatctggatgtcattgacgataatgtttatggagataaggtctaagtgcctaaaaaaatgtacatatacctggttgaaatacaacactatacatacacaccaccatatatactagctgttaatcctatggaatggggtattgggagtgcttttttaatttttcatagtttttttttaataaaatggcatattttgcatctacaacttctataatttgaaaaaataaataaacattatcttttttgtgaaaa

SEQ ID NO: 342695 - DNA, 2710 bp, Homo sapiens
cgatgctgtcatgttgagagtccactatccacgtttgtttatccaggaataatgcagaaaatctgagcattcgtgaatctaatcattgagatacttcattttcttagcgtttctggagattacaacatcctgcggttccgtttctgggaactttactgatttatctcccccctcacacaaataagcattgattcctgcatttctgaagatctcaagatctggactactgttgaaaaaatttccagtgaggctcacttatgtctgtaaagatgggaaaaaaatacaagaacattgttctactaaaaggattagaggtcatcaatgattatcattttagaatggttaagtccttactgagcaacgatttaaaacttaatttaaaaatgagagaagagtatgacaaaattcagattgctgacttgatggaagaaaagttccgaggtgatgctggtttgggcaaactaataaaaattttcgaagatataccaacgcttgaagacctggctgaaactcttaaaaaagaaaagttaaaagtaaaaggaccagccctatcaagaaagaggaagaaggaagtggatgctacttcacctgcaccctccacaagcagcactgtcaaaactgaaggagcagaggcaactcctggagctcagaaaagaaaaaaatcaaccaaagaaaaggctggacccaaagggagtaaggtgtccgaggaacagactcagcctccctctcctgcaggagccggcatgtccacagccatgggccgttccccatctcccaagacctcattgtcagctccacccaacacttcttcaactgagaacccgaaaacagtggccaaatgtcaggtaactcccagaagaaatgttctccaaaaacgcccagtgatagtgaaggtactgagtacaacaaagccatttgaatatgagaccccagaaatggagaaaaaaataatgtttcatgctacagtggctacacagacacagttcttccatgtgaaggttttaaacaccagcttgaaggagaaattcaatggaaagaaaatcatcatcatatcagattatttggaatatgatagtctcctagaggtcaatgaagaatctactgtatctgaagctggtcctaaccaaacgtttgaggttccaaataaaatcatcaacagagcaaaggaaactctgaagattgatattcttcacaaacaagcttcaggaaatattgtatatggggtatttatgctacataagaaaacagtaaatcagaagaccacaatctacgaaattcaggatgatagaggaaaaatggatgtagtggggacaggacaatgtcacaatatcccctgtgaagaaggagataagctccaacttttctgctttcgacttagaaaaaagaaccagatgtcaaaactgatttcagaaatgcatagttttatccagataaagaaaaaaacaaacccgagaaacaatgaccccaagagcatgaagctaccccaggaacagagtcagcttccaaatccttcagaggccagcacaaccttccctgagagccatcttcggactcctcagatgccaccaacaactccatccagcagtttcttcaccaagaaaagtgaagacacaatctccaaaatgaatgacttcatgaggatgcagatactgaaggaagggagtcattttccaggaccgttcatgaccagcataggcccagctgagagccatccccacactcctcagatgcctccatcaacaccaagcagcagtttcttaaccacgttgaaaccaagactgaagactgaacctgaagaagtttccatagaagacagtgcccagagtgacctcaaagaagtgatggtgctgaacgcaacagaatcatttgtatatgagcccaaagagcagaagaaaatgtttcatgccacagtggcaactgagaatgaagtcttccgagtgaaggtttttaatattgacctaaaggagaagttcaccccaaagaagatcattgccatagcaaattatgtttgccgcaatgggttcctggaggtatatcctttcacacttgtggctgatgtgaatgctgaccgaaacatggagatcccaaaaggattgattagaagtgccagcgtaactcctaaaatcaatcagctttgctcacaaactaaaggaagttttgtgaatggggtgtttgaggtacataagaaaaatgtaaggggtgaattcacttattatgaaatacaagataatacagggaagatggaagtggtggtgcatggacgactgaccacaatcaactgtgaggaaggagataaactgaaactcacctgctttgaattggcaccgaaaagtgggaataccggggagttgagatctgtaattcatagtcacatcaaggtcatcaagaccaggaaaaacaagaaagacatactcaatcctgattcaagtatggaaacttcaccagactttttcttctaaaatctggatgtcattgacgataatgtttatggagataaggtctaagtgcctaaaaaaatgtacatatacctggttgaaatacaacactatacatacacaccaccatatatactagctgttaatcctatggaatggggtattgggagtgcttttttaatttttcatagtttttttttaataaaatggcatattttgcatctacaacttctataatttgaaaaaataaataaacattatcttttttgtgaaaa

SEQ ID NO: 342696 - DNA, 2887 bp, Homo sapiens
gacacccactgcccttaacagaaaaaatactgctgagcaaagggtttaacaggactctcggtctaccagaagttcagtgcattttccaggattttcaaggcttcgatgctgtcatgttgtgagcccactatccacttgtgtttttccatgaataatgaaggaaacctgaggaatcatgaatgtaatcattgagtttctgagagctttactgactgatttccctattcaaaacaatcctcatttcctacatttctgaagatctcaagatctggactactgttgaagaaattcccagtaaggctcacttatatctttagagatggcaaataactacaagaaaattgttctactgaaaggattagaggtcatcaatgattatcattttagaattgttaagtccttactgatgaaaaaatttccagtgaggctcacttatgtctgtaaagatgggaaaaaaatacaagaacattgttctactaaaaggattagaggtcatcaatgattatcattttagaatggttaagtccttactgagcaacgatttaaaacttaatttaaaaatgagagaagagtatgacaaaattcagattgctgacttgatggaagaaaagttccgaggtgatgctggtttgggcaaactaataaaaattttcgaagatataccaacgcttgaagacctggctgaaactcttaaaaaagaaaagttaaaagtaaaaggaccagccctatcaagaaagaggaagaaggaagtggatgctacttcacctgcaccctccacaagcagcactgtcaaaactgaaggagcagaggcaactcctggagctcagaaaagaaaaaaatcaaccaaagaaaaggctggacccaaagggagtaaggtgtccgaggaacagactcagcctccctctcctgcaggagccggcatgtccacagccatgggccgttccccatctcccaagacctcattgtcagctccacccaacacttcttcaactgagaacccgaaaacagtggccaaatgtcaggtaactcccagaagaaatgttctccaaaaacgcccagtgatagtgaaggtactgagtacaacaaagccatttgaatatgagaccccagaaatggagaaaaaaataatgtttcatgctacagtggctacacagacacagttcttccatgtgaaggttttaaacaccagcttgaaggagaaattcaatggaaagaaaatcatcatcatatcagattatttggaatatgatagtctcctagaggtcaatgaagaatctactgtatctgaagctggtcctaaccaaacgtttgaggttccaaataaaatcatcaacagagcaaaggaaactctgaagattgatattcttcacaaacaagcttcaggaaatattgtatatggggtatttatgctacataagaaaacagtaaatcagaagaccacaatctacgaaattcaggatgatagaggaaaaatggatgtagtggggacaggacaatgtcacaatatcccctgtgaagaaggagataagctccaacttttctgctttcgacttagaaaaaagaaccagatgtcaaaactgatttcagaaatgcatagttttatccagataaagaaaaaaacaaacccgagaaacaatgaccccaagagcatgaagctaccccaggaacagagtcagcttccaaatccttcagaggccagcacaaccttccctgagagccatcttcggactcctcagatgccaccaacaactccatccagcagtttcttcaccaagaaaagtgaagacacaatctccaaaatgaatgacttcatgaggatgcagatactgaaggaagggagtcattttccaggaccgttcatgaccagcataggcccagctgagagccatccccacactcctcagatgcctccatcaacaccaagcagcagtttcttaaccacgttgaaaccaagactgaagactgaacctgaagaagtttccatagaagacagtgcccagagtgacctcaaagaagtgatggtgctgaacgcaacagaatcatttgtatatgagcccaaagagcagaagaaaatgtttcatgccacagtggcaactgagaatgaagtcttccgagtgaaggtttttaatattgacctaaaggagaagttcaccccaaagaagatcattgccatagcaaattatgtttgccgcaatgggttcctggaggtatatcctttcacacttgtggctgatgtgaatgctgaccgaaacatggagatcccaaaaggattgattagaagtgccagcgtaactcctaaaatcaatcagctttgctcacaaactaaaggaagttttgtgaatggggtgtttgaggtacataagaaaaatgtaaggggtgaattcacttattatgaaatacaagataatacagggaagatggaagtggtggtgcatggacgactgaccacaatcaactgtgaggaaggagataaactgaaactcacctgctttgaattggcaccgaaaagtgggaataccggggagttgagatctgtaattcatagtcacatcaaggtcatcaagaccaggaaaaacaagaaagacatactcaatcctgattcaagtatggaaacttcaccagactttttcttctaaaatctggatgtcattgacgataatgtttatggagataaggtctaagtgcctaaaaaaatgtacatatacctggttgaaatacaacactatacatacacaccaccatatatactagctgttaatcctatggaatggggtattgggagtgcttttttaatttttcatagtttttttttaataaaatggcatattttgcatctacaacttctataatttgaaaaaataaataaacattatcttttttgtgaaaa

SEQ ID NO: 342697 - DNA, 2264 bp, Homo sapiens
tgtattgaaactgcttcagctgtcggagatcgtttatatgtcttccttttttctgcattggttgggaataaaattgaatctattccagtaaaaggaccagccctatcaagaaagaggaagaaggaagtggatgctacttcacctgcaccctccacaagcagcactgtcaaaactgaaggagcagaggcaactcctggagctcagaaaagaaaaaaatcaaccaaagaaaaggctggacccaaagggagtaaggtgtccgaggaacagactcagcctccctctcctgcaggagccggcatgtccacagccatgggccgttccccatctcccaagacctcattgtcagctccacccaacacttcttcaactgagaacccgaaaacagtggccaaatgtcaggtaactcccagaagaaatgttctccaaaaacgcccagtgatagtgaaggtactgagtacaacaaagccatttgaatatgagaccccagaaatggagaaaaaaataatgtttcatgctacagtggctacacagacacagttcttccatgtgaaggttttaaacaccagcttgaaggagaaattcaatggaaagaaaatcatcatcatatcagattatttggaatatgatagtctcctagaggtcaatgaagaatctactgtatctgaagctggtcctaaccaaacgtttgaggttccaaataaaatcatcaacagagcaaaggaaactctgaagattgatattcttcacaaacaagcttcaggaaatattgtatatggggtatttatgctacataagaaaacagtaaatcagaagaccacaatctacgaaattcaggatgatagaggaaaaatggatgtagtggggacaggacaatgtcacaatatcccctgtgaagaaggagataagctccaacttttctgctttcgacttagaaaaaagaaccagatgtcaaaactgatttcagaaatgcatagttttatccagataaagaaaaaaacaaacccgagaaacaatgaccccaagagcatgaagctaccccaggaacagagtcagcttccaaatccttcagaggccagcacaaccttccctgagagccatcttcggactcctcagatgccaccaacaactccatccagcagtttcttcaccaagaaaagtgaagacacaatctccaaaatgaatgacttcatgaggatgcagatactgaaggaagggagtcattttccaggaccgttcatgaccagcataggcccagctgagagccatccccacactcctcagatgcctccatcaacaccaagcagcagtttcttaaccacgttgaaaccaagactgaagactgaacctgaagaagtttccatagaagacagtgcccagagtgacctcaaagaagtgatggtgctgaacgcaacagaatcatttgtatatgagcccaaagagcagaagaaaatgtttcatgccacagtggcaactgagaatgaagtcttccgagtgaaggtttttaatattgacctaaaggagaagttcaccccaaagaagatcattgccatagcaaattatgtttgccgcaatgggttcctggaggtatatcctttcacacttgtggctgatgtgaatgctgaccgaaacatggagatcccaaaaggattgattagaagtgccagcgtaactcctaaaatcaatcagctttgctcacaaactaaaggaagttttgtgaatggggtgtttgaggtacataagaaaaatgtaaggggtgaattcacttattatgaaatacaagataatacagggaagatggaagtggtggtgcatggacgactgaccacaatcaactgtgaggaaggagataaactgaaactcacctgctttgaattggcaccgaaaagtgggaataccggggagttgagatctgtaattcatagtcacatcaaggtcatcaagaccaggaaaaacaagaaagacatactcaatcctgattcaagtatggaaacttcaccagactttttcttctaaaatctggatgtcattgacgataatgtttatggagataaggtctaagtgcctaaaaaaatgtacatatacctggttgaaatacaacactatacatacacaccaccatatatactagctgttaatcctatggaatggggtattgggagtgcttttttaatttttcatagtttttttttaataaaatggcatattttgcatctacaacttctataatttgaaaaaataaataaacattatcttttttgtgaaaa

SEQ ID NO: 342698 - DNA, 1714 bp, Homo sapiens
gcaagataaagacaaacactggaaagatttctagggagagaaaatgtcacatgcaaatgttaaaatgtgaaacagcatagtgagttctgtataaattggtatatgtagaaaggtataggaaaatgatgcaagacaggtaaaaagcagccctccaacaagctggcttttgtcataaagacagaaatggagtctccaatgtaaaaacatcagtaagtagatattgaaagattttaggaagaagagtacttgatcattccacattttagcaaaaaaaaaattctgacaattgcctggagggatacattagagagagaccatgtttggaagtaatgagacctattagaatctaataaaggatgatattctcacaaatgaaaagatgttgtgcttcctctaatattgaaaaccattaaacagaaaacgaatactttcagataaagaaaaaaacaaacccgagaaacaatgaccccaagagcatgaagctaccccaggaacagagtcagcttccaaatccttcagaggccagcacaaccttccctgagagccatcttcggactcctcagatgccaccaacaactccatccagcagtttcttcaccaagaaaagtgaagacacaatctccaaaatgaatgacttcatgaggatgcagatactgaaggaagggagtcattttccaggaccgttcatgaccagcataggcccagctgagagccatccccacactcctcagatgcctccatcaacaccaagcagcagtttcttaaccacgttgaaaccaagactgaagactgaacctgaagaagtttccatagaagacagtgcccagagtgacctcaaagaagtgatggtgctgaacgcaacagaatcatttgtatatgagcccaaagagcagaagaaaatgtttcatgccacagtggcaactgagaatgaagtcttccgagtgaaggtttttaatattgacctaaaggagaagttcaccccaaagaagatcattgccatagcaaattatgtttgccgcaatgggttcctggaggtatatcctttcacacttgtggctgatgtgaatgctgaccgaaacatggagatcccaaaaggattgattagaagtgccagcgtaactcctaaaatcaatcagctttgctcacaaactaaaggaagttttgtgaatggggtgtttgaggtacataagaaaaatgtaaggggtgaattcacttattatgaaatacaagataatacagggaagatggaagtggtggtgcatggacgactgaccacaatcaactgtgaggaaggagataaactgaaactcacctgctttgaattggcaccgaaaagtgggaataccggggagttgagatctgtaattcatagtcacatcaaggtcatcaagaccaggaaaaacaagaaagacatactcaatcctgattcaagtatggaaacttcaccagactttttcttctaaaatctggatgtcattgacgataatgtttatggagataaggtctaagtgcctaaaaaaatgtacatatacctggttgaaatacaacactatacatacacaccaccatatatactagctgttaatcctatggaatggggtattgggagtgcttttttaatttttcatagtttttttttaataaaatggcatattttgcatctacaacttctataatttgaaaaaataaataaacattatcttttttgtgaaaa

SEQ ID NO: 342699 - DNA, 2585 bp, Homo sapiens
acattgtttcctactccattttctctggggcaatagcagaataggagcaagccagcactagtcagctaactaagtgactcaaccaaggccttttttccttgttatctttgcagatacttcattttcttagcgtttctggagattacaacatcctgcggttccgtttctgggaactttactgatttatctcccccctcacacaaataagcattgattcctgcatttctgaagatctcaagatctggactactgttgaaaaaatttccagtgaggctcacttatgtctgtaaagatgggaaaaaaatacaagaacattgttctactaaaaggattagaggtcatcaatgattatcattttagaatggttaagtccttactgagcaacgatttaaaacttaatttaaaaatgagagaagagtatgacaaaattcagattgctgacttgatggaagaaaagttccgaggtgatgctggtttgggcaaactaataaaaattttcgaagatataccaacgcttgaagacctggctgaaactcttaaaaaagaaaagttaaaagtaaaaggaccagccctatcaagaaagaggaagaaggaagtggatgctacttcacctgcaccctccacaagcagcactgtcaaaactgaaggagcagaggcaactcctggagctcagaaaagaaaaaaatcaaccaaagaaaaggctggacccaaagggagtaaggtgtccgaggaacagactcagcctccctctcctgcaggagccggcatgtccacagccatgggccgttccccatctcccaagacctcattgtcagctccacccaacacttcttcaactgagaacccgaaaacagtggccaaatgtcaggtaactcccagaagaaatgttctccaaaaacgcccagtgatagtgaaggtactgagtacaacaaagccatttgaatatgagaccccagaaatggagaaaaaaataatgtttcatgctacagtggctacacagacacagttcttccatgtgaaggttttaaacaccagcttgaaggagaaattcaatggaaagaaaatcatcatcatatcagattatttggaatatgatagtctcctagaggtcaatgaagaatctactgtatctgaagctggtcctaaccaaacgtttgaggttccaaataaaatcatcaacagagcaaaggaaactctgaagattgatattcttcacaaacaagcttcaggaaatattgtatatggggtatttatgctacataagaaaacagtaaatcagaagaccacaatctacgaaattcaggatgatagaggaaaaatggatgtagtggggacaggacaatgtcacaatatcccctgtgaagaaggagataagctccaacttttctgctttcgacttagaaaaaagaaccagatgtcaaaactgatttcagaaatgcatagttttatccagataaagaaaaaaacaaacccgagaaacaatgaccccaagagcatgaagctaccccaggaacagagtcagcttccaaatccttcagaggccagcacaaccttccctgagagccatcttcggactcctcagatgccaccaacaactccatccagcagtttcttcaccaagaaaagtgaagacacaatctccaaaatgaatgacttcatgaggatgcagatactgaaggaagggagtcattttccaggaccgttcatgaccagcataggcccagctgagagccatccccacactcctcagatgcctccatcaacaccaagcagcagtttcttaaccacgttgaaaccaagactgaagactgaacctgaagaagtttccatagaagacagtgcccagagtgacctcaaagaagtgatggtgctgaacgcaacagaatcatttgtatatgagcccaaagagcagaagaaaatgtttcatgccacagtggcaactgagaatgaagtcttccgagtgaaggtttttaatattgacctaaaggagaagttcaccccaaagaagatcattgccatagcaaattatgtttgccgcaatgggttcctggaggtatatcctttcacacttgtggctgatgtgaatgctgaccgaaacatggagatcccaaaaggattgattagaagtgccagcgtaactcctaaaatcaatcagctttgctcacaaactaaaggaagttttgtgaatggggtgtttgaggtacataagaaaaatgtaaggggtgaattcacttattatgaaatacaagataatacagggaagatggaagtggtggtgcatggacgactgaccacaatcaactgtgaggaaggagataaactgaaactcacctgctttgaattggcaccgaaaagtgggaataccggggagttgagatctgtaattcatagtcacatcaaggttggaactttataggaacatcatttttccaagtggcgaatcattttgtttatactttaagaagactagactgctactattacagagagtctagcaagtggaaaaggaacaaagccttgcactttactgggtgtaaacttcccaccattgtttttaaagaaggatacttgtaatcataataaaa

SEQ ID NO: 342700 - DNA, 4018 bp, Homo sapiens
  misc_feature (3081)..(3081): n is a, c, g, or t
  misc_feature (3145)..(3145): n is a, c, g, or t
  misc_feature (3152)..(3152): n is a, c, g, or t
  misc_feature (3174)..(3174): n is a, c, g, or t
  misc_feature (3200)..(3200): n is a, c, g, or t
acattgtttcctactccattttctctggggcaatagcagaataggagcaagccagcactagtcagctaactaagtgactcaaccaaggccttttttccttgttatctttgcagatacttcattttcttagcgtttctggagattacaacatcctgcggttccgtttctgggaactttactgatttatctcccccctcacacaaataagcattgattcctgcatttctgaagatctcaagatctggactactgttgaaaaaatttccagtgaggctcacttatgtctgtaaagatgggaaaaaaatacaagaacattgttctactaaaaggattagaggtcatcaatgattatcattttagaatggttaagtccttactgagcaacgatttaaaacttaatttaaaaatgagagaagagtatgacaaaattcagattgctgacttgatggaagaaaagttccgaggtgatgctggtttgggcaaactaataaaaattttcgaagatataccaacgcttgaagacctggctgaaactcttaaaaaagaaaagttaaaagtaaaaggaccagccctatcaagaaagaggaagaaggaagtggatgctacttcacctgcaccctccacaagcagcactgtcaaaactgaaggagcagaggcaactcctggagctcagaaaagaaaaaaatcaaccaaagaaaaggctggacccaaagggagtaaggtgtccgaggaacagactcagcctccctctcctgcaggagccggcatgtccacagccatgggccgttccccatctcccaagacctcattgtcagctccacccaacacttcttcaactgagaacccgaaaacagtggccaaatgtcaggtaactcccagaagaaatgttctccaaaaacgcccagtgatagtgaaggtactgagtacaacaaagccatttgaatatgagaccccagaaatggagaaaaaaataatgtttcatgctacagtggctacacagacacagttcttccatgtgaaggttttaaacaccagcttgaaggagaaattcaatggaaagaaaatcatcatcatatcagattatttggaatatgatagtctcctagaggtcaatgaagaatctactgtatctgaagctggtcctaaccaaacgtttgaggttccaaataaaatcatcaacagagcaaaggaaactctgaagattgatattcttcacaaacaagcttcaggaaatattgtatatggggtatttatgctacataagaaaacagtaaatcagaagaccacaatctacgaaattcaggatgatagaggaaaaatggatgtagtggggacaggacaatgtcacaatatcccctgtgaagaaggagataagctccaacttttctgctttcgacttagaaaaaagaaccagatgtcaaaactgatttcagaaatgcatagttttatccagataaagaaaaaaacaaacccgagaaacaatgaccccaagagcatgaagctaccccaggaacagagtcagcttccaaatccttcagaggccagcacaaccttccctgagagccatcttcggactcctcagatgccaccaacaactccatccagcagtttcttcaccaagaaaagtgaagacacaatctccaaaatgaatgacttcatgaggatgcagatactgaaggaagggagtcattttccaggaccgttcatgaccagcataggcccagctgagagccatccccacactcctcagatgcctccatcaacaccaagcagcagtttcttaaccacgttgaaaccaagactgaagactgaacctgaagaagtttccatagaagacagtgcccagagtgacctcaaagaagtgatggtgctgaacgcaacagaatcatttgtatatgagcccaaagagcagaagaaaatgtttcatgccacagtggcaactgagaatgaagtcttccgagtgaaggtttttaatattgacctaaaggagaagttcaccccaaagaagatcattgccatagcaaattatgtttgccgcaatgggttcctggaggtatatcctttcacacttgtggctgatgtgaatgctgaccgaaacatggagatcccaaaaggattgattagaagtgccagcgtaactcctaaaatcaatcagctttgctcacaaactaaaggaagttttgtgaatggggtgtttgaggtacataaggtaagcccacaccattgttttataaaatttctcctgcaacctccaatttttaaagtcttaacttgtcaactggagtttggtcaacttactcaacacagaaaatcaaccccttcacccttcccccagcactagagataattgaatagagttcatttcaggatatggggtacgttatattgtaacattcctcttcttaaggtatcatcatgcaagttatttagacagtcactaggaaacttggcattttattagttttgatgatctattcagagccacccttgtccaggacagtgcagagtttatatcaacacacatatccttaggattttgtttctttgagttcttctccatctgtatcaatgacaacttaatttaattgtgaataaaagagttgctctcccaagcctgaatcctgattgtgacaaccagagtaagaaataaaatagactactctgctttagaatgcagctatgtctaacagttagctagaattctgatcatttggactccaaagtttcttgcctcttctcattcattaattcatcaggagactgtagagcaactaacttctgcattaaataataagagaaatacgaagcaaaaagactaaaaaagtcacgtagcttaactgctcaatttataaatggggcaataaaatgcaaaaaaaagaaaaaaagcttggtgaattcttaggcttacagtgtgcctttcagtctctacacatcatgtaaatattatgcttagctgatttaacttcttgtttgaagtactgtttcatactccattatacatgtcttctagggtggcttacttttaattgtgctgttttctctacactcagtttaaatgactgtacatatatatgtggttgnagagttaatgaataatgagctacaaaccagaacaatgtgactagatagataggatgatctaganttgaganctggcagattgggaaagagtgnctatatggagaagaaagaagtagttncatattgaaataacagtctacttaatgaggacgtgcaacattctttctcaaacttacaaagtgccataaaaagcctctattctctgctcttgggcaggtgtgaaagaaacctaccaaattaatcagatttttctgtatccaggctccttaaaaaatcccagctgtgctgatgtggaaacaggaagaattaggaaagtaatcaattttttttcctagaaaaaatccagcagacaaagaacttcaacaaaagaggctcaagggaggagttgaaaggcaggattcaaagaccaagtatcttaagctatttggtacctgttattcaggacctacagctctgtttactctatcaaagacaaaagtttccagaaacaccctgtatttctcatagatttgaaaattattgatccagtttcagaagataagtgttaattttcttttgcagaaaaatgtaaggggtgaattcacttattatgaaatacaagataatacagggaagatggaagtggtggtgcatggacgactgaccacaatcaactgtgaggaaggagataaactgaaactcacctgctttgaattggcaccgaaaagtgggaataccggggagttgagatctgtaattcatagtcacatcaaggttggaactttataggaacatcatttttccaagtggcgaatcattttgtttatactttaagaagactagactgctactattacagagagtctagcaagtggaaaaggaacaaagccttgcactttactgggtgtaaacttcccaccattgtttttaaagaaggatacttgtaatcataataaaa

SEQ ID NO: 342701 - DNA, 1984 bp, Homo sapiens
acattgtttcctactccattttctctggggcaatagcagaataggagcaagccagcactagtcagctaactaagtgactcaaccaaggccttttttccttgttatctttgcagatacttcattttcttagcgtttctggagattacaacatcctgcggttccgtttctgggaactttactgatttatctcccccctcacacaaataagcattgattcctgcatttctgaagatctcaagatctggactactgttgaaaaaatttccagtgaggctcacttatgtctgtaaagatgggaaaaaaatacaagaacattgttctactaaaaggattagaggtcatcaatgattatcattttagaatggttaagtccttactgagcaacgatttaaaacttaatttaaaaatgagagaagagtatgacaaaattcagattgctgacttgatggaagaaaagttccgaggtgatgctggtttgggcaaactaataaaaattttcgaagatataccaacgcttgaagacctggctgaaactcttaaaaaagaaaagttaaaagtaaaaggaccagccctatcaagaaagaggaagaaggaagtggatgctacttcacctgcaccctccacaagcagcactgtcaaaactgaaggagcagaggcaactcctggagctcagaaaagaaaaaaatcaaccaaagaaaaggctggacccaaagggagtaaggtgtccgaggaacagactcagcctccctctcctgcaggagccggcatgtccacagccatgggccgttccccatctcccaagacctcattgtcagctccacccaacacttcttcaactgagaacccgaaaacagtggccaaatgtcaggtaactcccagaagaaatgttctccaaaaacgcccagtgatagtgaaggtactgagtacaacaaagccatttgaatatgagaccccagaaatggagaaaaaaataatgtttcatgctacagtggctacacagacacagttcttccatgtgaaggttttaaacaccagcttgaaggagaaattcaatggaaagaaaatcatcatcatatcagattatttggaatatgatagtctcctagaggtcaatgaagaatctactgtatctgaagctggtcctaaccaaacgtttgaggttccaaataaaatcatcaacagagcaaaggaaactctgaagattgatattcttcacaaacaagcttcaggaaatattgtatatggggtatttatgctacataagaaaacagtaaatcagaagaccacaatctacgaaattcaggatgatagaggaaaaatggatgtagtggggacaggacaatgtcacaatatcccctgtgaagaaggagataagctccaacttttctgctttcgacttagaaaaaagaaccagatgtcaaaactgatttcagaaatgcatagttttatccagataaagaaaaaaacaaacccgagaaacaatgaccccaagagcatgaagctaccccaggaacagagtcagcttccaaatccttcagaggccagcacaaccttccctgagagccatcttcggactcctcagatgccaccaacaactccatccagcagtttcttcaccaagaaaagtgaagacacaatctccaaaatgaatgacttcatgaggatgcagatactgaaggaagggagtcattttccaggaccgttcatgaccagcataggcccagctgagagccatccccacactcctcagatgcctccatcaacaccaagcagcagtttcttaaccacggtacaagttccctcttcccaatacattcccctcgctactatataatgacaaggattaacacaaccgtgaaagcacctcaccaatcccctactacatacaatgctttaatttaaccaaatcagtcatttatttatcaagtgtgtattttgaggtcctatccaaaattaaaattctgtttttatcatctctattcca

SEQ ID NO: 342702 - DNA, 2169 bp, Homo sapiens
acattgtttcctactccattttctctggggcaatagcagaataggagcaagccagcactagtcagctaactaagtgactcaaccaaggccttttttccttgttatctttgcagatacttcattttcttagcgtttctggagattacaacatcctgcggttccgtttctgggaactttactgatttatctcccccctcacacaaataagcattgattcctgcatttctgaagatctcaagatctggactactgttgaaaaaatttccagtgaggctcacttatgtctgtaaagatgggaaaaaaatacaagaacattgttctactaaaaggattagaggtcatcaatgattatcattttagaatggttaagtccttactgagcaacgatttaaaacttaatttaaaaatgagagaagagtatgacaaaattcagattgctgacttgatggaagaaaagttccgaggtgatgctggtttgggcaaactaataaaaattttcgaagatataccaacgcttgaagacctggctgaaactcttaaaaaagaaaagttaaaagtaaaaggaccagccctatcaagaaagaggaagaaggaagtggatgctacttcacctgcaccctccacaagcagcactgtcaaaactgaaggagcagaggcaactcctggagctcagaaaagaaaaaaatcaaccaaagaaaaggctggacccaaagggagtaaggtgtccgaggaacagactcagcctccctctcctgcaggagccggcatgtccacagccatgggccgttccccatctcccaagacctcattgtcagctccacccaacacttcttcaactgagaacccgaaaacagtggccaaatgtcaggtaactcccagaagaaatgttctccaaaaacgcccagtgatagtgaaggtactgagtacaacaaagccatttgaatatgagaccccagaaatggagaaaaaaataatgtttcatgctacagtggctacacagacacagttcttccatgtgaaggttttaaacaccagcttgaaggagaaattcaatggaaagaaaatcatcatcatatcagattatttggaatatgatagtctcctagaggtcaatgaagaatctactgtatctgaagctggtcctaaccaaacgtttgaggttccaaataaaatcatcaacagagcaaaggaaactctgaagattgatattcttcacaaacaagcttcaggaaatattgtatatggggtatttatgctacataagaaaacagtaaatcagaagaccacaatctacgaaattcaggatgatagaggaaaaatggatgtagtggggacaggacaatgtcacaatatcccctgtgaagaaggagataagctccaacttttctgctttcgacttagaaaaaagaaccagatgtcaaaactgatttcagaaatgcatagttttatccagtaagaattaaataggcaaatattagttttccaaagtggaaatgatttgctttaagttttggcaaaaacaagtttgtaggtttttttacagagttcagcgggaggcatgagaaaacagatattctccttgtattcacatttactttttttaattttttttttctggatggaatgatgtgataggatacaattttaaaaagaaagaaatctgaactttatcaaaaaaattgaactctgaattttatgtaaacttttaagtgattgtagggttgggatttaaaattacatgttctccatttgtgaattagaaaacgtcgtgtgtgtgtgtgtgtgtgtgtgatactttctagtttgtaacattacaatacacatatgtgtgtatttagtccataaaaatacctaatttgaaacttaaaattatttgcagtgatcaaaattatgtcccactgacaaagttttatacagaggaagctctccaatttgttaatttgaattcaaatattcacgtgttaagtttccttacagtacatgattttacgctgttgccattttgaatgttgtaaattattttttatttcagtaggtttttgggaaacaggtggtgcttcgttataggaataagttctttagtggtgatttctgactttttgatgcacccatcgtccaagcagcgtacactgtacccagtgtgtatgtagcattttatccctcaccccc

SEQ ID NO: 342703 - DNA, 1112 bp, Homo sapiens
ttctgtgactttctagttgactaaagacttacactaggaatctcaggttcatcatttgtgaaatgggagaaatactgtctaccatagagggtcatcaacttagctcacagcagccctgaattaccaagaatgcatctgagcaaatcagatcacaaaggtacctgcctttagtgagatacatacactggtttacatcagacagaggtagctgggtctacataacaaagtccatgctttttgccacactgacccatacattcatgtgggattcttggaacactaacaaaggctaatattagaaggcaaatagttcaaaacaaaggctgacatattcaggcacacacatgctctcagattgctccagttctcaggaccagcagtcaaacatttcaaaccttctttgatagcaattgcaccaggaataccttttgtactctcccccttccttctgcccaatgaaaaccctctcctcaactcttgtcattgggtgcaccagctcctttctctctcctgttgttccctgacatctcctgctctttcacttgcactcatgctgagtaggagtgaatatctcatttcacggtccaaattaaacagagaggcatgactcaaaggtcaagaatttattaagggagatagatgagagcgagaaaagaatcatttagaaaggaataggggaagagatatggtgcagggggaggagatacagtgtgattgaagggagaaatgtaggatcatcagcatctcaactggtctgtctttatctctttctccttcaaggtcatcaagaccaggaaaaacaagaaagacatactcaatcctgattcaagtatggaaacttcaccagactttttcttctaaaatctggatgtcattgacgataatgtttatggagataaggtctaagtgcctaaaaaaatgtacatatacctggttgaaatacaacactatacatacacaccaccatatatactagctgttaatcctatggaatggggtattgggagtgcttttttaatttttcatagtttttttttaataaaatggcatattttgcatctacaacttctataatttgaaaaaataaataaacattatcttttttgtgaaaa

SEQ ID NO: 342704 - DNA, 2413 bp, Homo sapiens
  misc_feature (1562)..(1562): n is a, c, g, or t
gacacccactgcccttaacagaaaaaatactgctgagcaaagggtttaacaggactctcggtctaccagaagttcagtgcattttccaggattttcaaggcttcgatgctgtcatgttgtgagcccactatccacttgtgtttttccatgaataatgaaggaaacctgaggaatcatgaatgtaatcattgagtttctgagagctttactgactgatttccctattcaaaacaatcctcatttcctacatttctgaagatctcaagatctggactactgttgaagaaattcccagtaaggctcacttatatctttagagatggcaaataactacaagaaaattgttctactgaaaggattagaggtcatcaatgattatcattttagaattgttaagtccttactgagtaacgatttaaaacttaatccaaaaatgaaagaagagtatgacaaaattcagattgctgacttgatggaggaaaagttcccaggtgatgccggtttgggcaaactaatagaattcttcaaagaaataccaacactgggagaccttgctgaaactcttaaaagagaaaagttaaaagttgcaaataaaattgaatccattccagtcaaaggaataatcccatctaaaaagacgaaacagaaagaagtgtatcctgctacacctgcatgcaccccaagcaaccgtctcacagctaaaggagcagaggagactcttggacctcaggtaagcttcaggaagaggagcaggcttcaagtctcacagtggaagctctgctgtggctgttccactcaatctgtccagcaggcagttatttcttcatatgtttcccatcaagtttcagatttatcaaattacataataattgatcatctttctgcaaggcaacaagttaaacgctttagtaaacataatgtaaatatacataaaataaatataatattttcatctccaatagagaaggatgttaacttgagagtcagataaaaaaacgtttgcctatgtttacaaaagcctagtttcttaactgcaagtcagcatatcccaaaacacaagtaattaaggaatgatgtgtgttactttctctgctccctttttaaaaatgaaaccatctatgccatgttctttcaattggcctggggatgtacttaagtttccaagaaaaacaatttatatacaataaatatattaccttgtaatgaaaatgtgctctgcttcatttgacactgaaagtaattaacaagaaaaataaactacttgtagaaaagaaaaaaaccatctgaagaagagactggaaccaaaaggagtaagatgtccaaagagcagactcggccttcctgctctgcaggagccagcacgtccacagccatgggccgttccccacctccccagacctcatcatcagctccacccaacacttcctcaactgaggtacactcttcctggtccccttttgattcattttcttcaacccaaaatgtaggaatctgatttcatcttctactgaaaaatgacatcaatcatcagccagtaaatcaaatgtatagactgagaattnactgcattttaatcttttgcttccacaggcatatttgatgaacttgacattatctctgactgcaggaagttttctgtcctgtgctgtttggggaagagacagagaactgcggaatctggaactttcagcaacagactcactgtctactgcccccatctattatacacccattccctttgctcactaatttgttcaagtttctctgacatacaccatgctcctttttcctttaggattttcacacaccatatttctttcacctttaaactcttacctggccaaccctatccaccctctggatcccaatattgagatcttatcctcagggaatcctcacttagacccctgtaacaggttaaatcttcatggtgttctgtttcctaggaacttctttcttttctactgtttatgacaactgaagttaataagtgtttatctttcccacctactcaaagtagttccaagattagggctagtttgtaattctgtggaccactgtaaacgagggcctagttcagtgtctgcctcatgggaagcttccaataaatacctttgctcaacgaaaaaatgaaaacccagtggctcacgcctgtaatcccagcactttgggaggccgaggcaggtggattgcctgaggtcaggagtttgagactagtctggccaacatggtgaaacactatctctactaaaaatacaaaaaaattagctgggtatggtggcttacgcctataatcccagctactcaggaggctgaggcaggggaattgcttgaaccagggaggtggaggttgcagtgagctgagatcgcaccactgcactccagcctgggtgacagagcgagactccatctc

SEQ ID NO: 342705 - DNA, 675 bp, Homo sapiens
acattgtttcctactccattttctctggggcaatagcagaataggagcaagccagcactagtcagctaactaagtgactcaaccaaggccttttttccttgttatctttgcagatacttcattttcttagcgtttctggagattacaacatcctgcggttccgtttctgggaactttactgatttatctcccccctcacacaaataagcattgattcctgcatttctgaagatctcaagatctggactactgttgaaaaaatttccagtgaggctcacttatgtctgtaaagatgggaaaaaaatacaagaacattgttctactaaaaggattagaggtcatcaatgattatcattttagaatggttaagtccttactgagcaacgatttaaaacttaatttaaaaatgagagaagagtatgacaaaattcagattgctgacttgatggaagaaaagttccgaggtgatgctggtttgggcaaactaataaaaattttcgaagatataccaacgcttgaagacctggctgaaactcttaaaaaagaaaagttaaaagttccaggtacatcgccactcgaggtatatatatgatggatttgtatagaatatgcgccgctccatcattcaaacagctcagttttaatattagaaactaaaggcaattaatatatctt

SEQ ID NO: 342706 - DNA, 2733 bp, Homo sapiens
acattgtttcctactccattttctctggggcaatagcagaataggagcaagccagcactagtcagctaactaagtgactcaaccaaggccttttttccttgttatctttgcagatacttcattttcttagcgtttctggagattacaacatcctgcggttccgtttctgggaactttactgatttatctcccccctcacacaaataagcattgattcctgcatttctgaagatctcaagatctggactactgttgaaaaaatttccagtgaggctcacttatgtctgtaaagatgggaaaaaaatacaagaacattgttctactaaaaggattagaggtcatcaatgattatcattttagaatggttaagtccttactgagcaacgatttaaaacttaatttaaaaatgagagaagagtatgacaaaattcagattgctgacttgatggaagaaaagttccgaggtgatgctggtttgggcaaactaataaaaattttcgaagatataccaacgcttgaagacctggctgaaactcttaaaaaagaaaagttaaaagtaaaaggaccagccctatcaagaaagaggaagaaggaagtggatgctacttcacctgcaccctccacaagcagcactgtcaaaactgaaggagcagaggcaactcctggagctcagaaaagaaaaaaatcaaccaaagaaaaggctggacccaaagggagtaaggtgtccgaggaacagactcagcctccctctcctgcaggagccggcatgtccacagccatgggccgttccccatctcccaagacctcattgtcagctccacccaacacttcttcaactgagaacccgaaaacagtggccaaatgtcaggtaactcccagaagaaatgttctccaaaaacgcccagtgatagtgaaggtactgagtacaacaaagccatttgaatatgagaccccagaaatggagaaaaaaataatgtttcatgctacagtggctacacagacacagttcttccatgtgaaggttttaaacaccagcttgaaggagaaattcaatggaaagaaaatcatcatcatatcagattatttggaatatgatagtctcctagaggtcaatgaagaatctactgtatctgaagctggtcctaaccaaacgtttgaggttccaaataaaatcatcaacagagcaaaggaaactctgaagattgatattcttcacaaacaagcttcaggaaatattgtatatggggtatttatgctacataagaaaacagtaaatcagaagaccacaatctacgaaattcaggatgatagaggaaaaatggatgtagtggggacaggacaatgtcacaatatcccctgtgaagaaggagataagctccaacttttctgctttcgacttagaaaaaagaaccagatgtcaaaactgatttcagaaatgcatagttttatccagataaagaaaaaaacaaacccgagaaacaatgaccccaagagcatgaagctaccccaggaacagagtcagcttccaaatccttcagaggccagcacaaccttccctgagagccatcttcggactcctcagatgccaccaacaactccatccagcagtttcttcaccaagaaaagtgaagacacaatctccaaaatgaatgacttcatgaggatgcagatactgaaggaagggagtcattttccaggaccgttcatgaccagcataggcccagctgagagccatccccacactcctcagatgcctccatcaacaccaagcagcagtttcttaaccacgttgaaaccaagactgaagactgaacctgaagaagtttccatagaagacagtgcccagagtgacctcaaagaagtgatggtgctgaacgcaacagaatcatttgtatatgagcccaaagagcagaagaaaatgtttcatgccacagtggcaactgagaatgaagtcttccgagtgaaggtttttaatattgacctaaaggagaagttcaccccaaagaagatcattgccatagcaaattatgtttgccgcaatgggttcctggaggtatatcctttcacacttgtggctgatgtgaatgctgaccgaaacatggagatcccaaaaggattgattagaagtgccagcgtaactcctaaaatcaatcagctttgctcacaaactaaaggaagttttgtgaatggggtgtttgaggtacataagaaaaatgtaaggggtgaattcacttattatgaaatacaagataatacagggaagatggaagtggtggtgcatggacgactgaccacaatcaactgtgaggaaggagataaactgaaactcacctgctttgaattggcaccgaaaagtgggaataccggggagttgagatctgtaattcatagtcacatcaaggtcatcaagaccaggaaaaacaagaaagacatactcaatcctgattcaagtatggaaacttcaccagactttttcttctaaaatctggatgtcattgacgataatgtttatggagataaggtctaagtgcctaaaaaaatgtacatatacctggttgaaatacaacactatacatacacaccaccatatatactagctgttaatcctatggaatggggtattgggagtgcttttttaatttttcatagtttttttttaataaaatggcatattttgcatctacaacttctataatttgaaaaaataaataaacattatcttttttgtgaaaa

SEQ ID NO: 342707 - DNA, 694 bp, Homo sapiens
aagactactcaggcgtgcactgcgaggtggagatctgacttctcttgttcccgcttaagactgcctcctgtatacttcattttcttagcgtttctggagattacaacatcctgcggttccgtttctgggaactttactgatttatctcccccctcacacaaataagcattgattcctgcatttctgaagatctcaagatctggactactgttgaaaaaatttccagtgaggctcacttatgtctgtaaagatgggaaaaaaatacaagaacattgttctactaaaaggattagaggtcatcaatgattatcattttagaatggttaagtccttactgagcaacgatttaaaacttaatttaaaaatgagagaagagtatgacaaaattcagattgctgacttgatggaagaaaagttccgaggtgatgctggtttgggcaaactaataaaaattttcgaagatataccaacgcttgaagacctggctgaaactcttaaaaaagaaaagttaaaagtaaaaggaccagccctatcaagaaagaggaagaaggaagtggatgctacttcacctgcaccctccacaagcagcactgtcaaaactgaaggagcagaggcaactcctggagctcagaaaaaacaacaaaaacaacaaaaacccttttgggcgcttggggcctcggaaaggtttttaaac

SEQ ID NO: 342708 - DNA, 2565 bp, Homo sapiens
acattgtttcctactccattttctctggggcaatagcagaataggagcaagccagcactagtcagctaactaagtgactcaaccaaggccttttttccttgttatctttgcagatacttcattttcttagcgtttctggagattacaacatcctgcggttccgtttctgggaactttactgatttatctcccccctcacacaaataagcattgattcctgcatttctgaagatctcaagatctggactactgttgaaaaaatttccagtgaggctcacttatgtctgtaaagatgggaaaaaaatacaagaacattgttctactaaaaggattagaggtcatcaatgattatcattttagaatggttaagtccttactgagcaacgatttaaaacttaatttaaaaatgagagaagagtatgacaaaattcagattgctgacttgatggaagaaaagttccgaggtgatgctggtttgggcaaactaataaaaattttcgaagatataccaacgcttgaagacctggctgaaactcttaaaaaagaaaagttaaaagtaaaaggaccagccctatcaagaaagaggaagaaggaagtggatgctacttcacctgcaccctccacaagcagcactgtcaaaactgaaggagcagaggcaactcctggagctcagaaaagaaaaaaatcaaccaaagaaaaggctggacccaaagggagtaaggtgtccgaggaacagactcagcctccctctcctgcaggagccggcatgtccacagccatgggccgttccccatctcccaagacctcattgtcagctccacccaacacttcttcaactgagaacccgaaaacagtggccaaatgtcaggtaactcccagaagaaatgttctccaaaaacgcccagtgatagtgaaggtactgagtacaacaaagccatttgaatatgagaccccagaaatggagaaaaaaataatgtttcatgctacagtggctacacagacacagttcttccatgtgaaggttttaaacaccagcttgaaggagaaattcaatggaaagaaaatcatcatcatatcagattatttggaatatgatagtctcctagaggtcaatgaagaatctactgtatctgaagctggtcctaaccaaacgtttgaggttccaaataaaatcatcaacagagcaaaggaaactctgaagattgatattcttcacaaacaagcttcaggaaatattgtatatggggtatttatgctacataagaaaacagtaaatcagaagaccacaatctacgaaattcaggatgatagaggaaaaatggatgtagtggggacaggacaatgtcacaatatcccctgtgaagaaggagataagctccaacttttctgctttcgacttagaaaaaagaaccagatgtcaaaactgatttcagaaatgcatagttttatccagataaagaaaaaaacaaacccgagaaacaatgaccccaagagcatgaagctaccccaggaacagagtcagcttccaaatccttcagaggccagcacaaccttccctgagagccatcttcggactcctcagatgccaccaacaactccatccagcagtttcttcaccaagttgaaaccaagactgaagactgaacctgaagaagtttccatagaagacagtgcccagagtgacctcaaagaagtgatggtgctgaacgcaacagaatcatttgtatatgagcccaaagagcagaagaaaatgtttcatgccacagtggcaactgagaatgaagtcttccgagtgaaggtttttaatattgacctaaaggagaagttcaccccaaagaagatcattgccatagcaaattatgtttgccgcaatgggttcctggaggtatatcctttcacacttgtggctgatgtgaatgctgaccgaaacatggagatcccaaaaggattgattagaagtgccagcgtaactcctaaaatcaatcagctttgctcacaaactaaaggaagttttgtgaatggggtgtttgaggtacataagaaaaatgtaaggggtgaattcacttattatgaaatacaagataatacagggaagatggaagtggtggtgcatggacgactgaccacaatcaactgtgaggaaggagataaactgaaactcacctgctttgaattggcaccgaaaagtgggaataccggggagttgagatctgtaattcatagtcacatcaaggtcatcaagaccaggaaaaacaagaaagacatactcaatcctgattcaagtatggaaacttcaccagactttttcttctaaaatctggatgtcattgacgataatgtttatggagataaggtctaagtgcctaaaaaaatgtacatatacctggttgaaatacaacactatacatacacaccaccatatatactagctgttaatcctatggaatggggtattgggagtgcttttttaatttttcatagtttttttttaataaaatggcatattttgcatctacaacttctataatttgaaaaaataaataaacattatcttttttgtgaaaa

SEQ ID NO: 342709 - DNA, 3046 bp, Homo sapiens
tcaacatcgcattcccagaaatgccatgaaaggaaagaccaagtcttgactgagaaacggaccgggcagatgagggactcccacatatacctgtttcctgctcttcccgaagacattttgccacaagcatataattcagcttctgaaaaatacggtcttcctcactgcagacaccatgccagcgttttaaatcaagttggctactcgtgctgtttagagtatgcagtttgcctgtggcaatattaaactcatctggaagaaagcacttaaacctatccagttcctcatcggtgatgttatccaggctggttagcaagagtatctccttatatttactctccatctcacgacttttcagcttataagggatccaaactatgtaagattataccaccaaaagtgattcaacattcaaaatgaagcaagatacttcattttcttagcgtttctggagattacaacatcctgcggttccgtttctgggaactttactgatttatctcccccctcacacaaataagcattgattcctgcatttctgaagatctcaagatctggactactgttgaaaaaatttccagtgaggctcacttatgtctgtaaagatgggaaaaaaatacaagaacattgttctactaaaaggattagaggtcatcaatgattatcattttagaatggttaagtccttactgagcaacgatttaaaacttaatttaaaaatgagagaagagtatgacaaaattcagattgctgacttgatggaagaaaagttccgaggtgatgctggtttgggcaaactaataaaaattttcgaagatataccaacgcttgaagacctggctgaaactcttaaaaaagaaaagttaaaagtaaaaggaccagccctatcaagaaagaggaagaaggaagtggatgctacttcacctgcaccctccacaagcagcactgtcaaaactgaaggagcagaggcaactcctggagctcagaaaagaaaaaaatcaaccaaagaaaaggctggacccaaagggagtaaggtgtccgaggaacagactcagcctccctctcctgcaggagccggcatgtccacagccatgggccgttccccatctcccaagacctcattgtcagctccacccaacacttcttcaactgagaacccgaaaacagtggccaaatgtcaggtaactcccagaagaaatgttctccaaaaacgcccagtgatagtgaaggtactgagtacaacaaagccatttgaatatgagaccccagaaatggagaaaaaaataatgtttcatgctacagtggctacacagacacagttcttccatgtgaaggttttaaacaccagcttgaaggagaaattcaatggaaagaaaatcatcatcatatcagattatttggaatatgatagtctcctagaggtcaatgaagaatctactgtatctgaagctggtcctaaccaaacgtttgaggttccaaataaaatcatcaacagagcaaaggaaactctgaagattgatattcttcacaaacaagcttcaggaaatattgtatatggggtatttatgctacataagaaaacagtaaatcagaagaccacaatctacgaaattcaggatgatagaggaaaaatggatgtagtggggacaggacaatgtcacaatatcccctgtgaagaaggagataagctccaacttttctgctttcgacttagaaaaaagaaccagatgtcaaaactgatttcagaaatgcatagttttatccagataaagaaaaaaacaaacccgagaaacaatgaccccaagagcatgaagctaccccaggaacagagtcagcttccaaatccttcagaggccagcacaaccttccctgagagccatcttcggactcctcagatgccaccaacaactccatccagcagtttcttcaccaagaaaagtgaagacacaatctccaaaatgaatgacttcatgaggatgcagatactgaaggaagggagtcattttccaggaccgttcatgaccagcataggcccagctgagagccatccccacactcctcagatgcctccatcaacaccaagcagcagtttcttaaccacgttgaaaccaagactgaagactgaacctgaagaagtttccatagaagacagtgcccagagtgacctcaaagaagtgatggtgctgaacgcaacagaatcatttgtatatgagcccaaagagcagaagaaaatgtttcatgccacagtggcaactgagaatgaagtcttccgagtgaaggtttttaatattgacctaaaggagaagttcaccccaaagaagatcattgccatagcaaattatgtttgccgcaatgggttcctggaggtatatcctttcacacttgtggctgatgtgaatgctgaccgaaacatggagatcccaaaaggattgattagaagtgccagcgtaactcctaaaatcaatcagctttgctcacaaactaaaggaagttttgtgaatggggtgtttgaggtacataagaaaaatgtaaggggtgaattcacttattatgaaatacaagataatacagggaagatggaagtggtggtgcatggacgactgaccacaatcaactgtgaggaaggagataaactgaaactcacctgctttgaattggcaccgaaaagtgggaataccggggagttgagatctgtaattcatagtcacatcaaggtcatcaagaccaggaaaaacaagaaagacatactcaatcctgattcaagtatggaaacttcaccagactttttcttctaaaatctggatgtcattgacgataatgtttatggagataaggtctaagtgcctaaaaaaatgtacatatacctggttgaaatacaacactatacatacacaccaccatatatactagctgttaatcctatggaatggggtattgggagtgcttttttaatttttcatagtttttttttaataaaatggcatattttgcatctacaacttctataatttgaaaaaataaataaacattatcttttttgtgaaaa

SEQ ID NO: 342710 - DNA, 2901 bp, Homo sapiens
acattgtttcctactccattttctctggggcaatagcagaataggagcaagccagcactagtcagctaactaagtgactcaaccaaggccttttttccttgttatctttgcagatacttcattttcttagcgtttctggagattacaacatcctgcggttccgtttctgggaactttactgatttatctcccccctcacacaaataagcattgattcctgcatttctgaagatctcaagatctggactactgttgaaaaaatttccagtgaggctcacttatgtctgtaaagatgggaaaaaaatacaagaacattgttctactaaaaggattagaggtcatcaatgattatcattttagaatggttaagtccttactgagcaacgatttaaaacttaatttaaaaatgagagaagagtatgacaaaattcagattgctgacttgatggaagaaaagttccgaggtgatgctggtttgggcaaactaataaaaattttcgaagatataccaacgcttgaagacctggctgaaactcttaaaaaagaaaagttaaaagtaaaaggaccagccctatcaagaaagaggaagaaggaagtggatgctacttcacctgcaccctccacaagcagcactgtcaaaactgaaggagcagaggcaactcctggagctcagaaaagaaaaaaatcaaccaaagaaaaggctggacccaaagggagtaaggtgtccgaggaacagactcagcctccctctcctgcaggagccggcatgtccacagccatgggccgttccccatctcccaagacctcattgtcagctccacccaacacttcttcaactgagaacccgaaaacagtggccaaatgtcaggtaactcccagaagaaatgttctccaaaaacgcccagtgatagtgaaggtactgagtacaacaaagccatttgaatatgagaccccagaaatggagaaaaaaataatgtttcatgctacagtggctacacagacacagttcttccatgtgaaggttttaaacaccagcttgaaggagaaattcaatggaaagaaaatcatcatcatatcagattatttggaatatgatagtctcctagaggtcaatgaagaatctactgtatctgaagctggtcctaaccaaacgtttgaggttccaaataaaatcatcaacagagcaaaggaaactctgaagattgatattcttcacaaacaagcttcaggaaatattgtatatggggtatttatgctacataagaaaacagtaaatcagaagaccacaatctacgaaattcaggatgatagaggaaaaatggatgtagtggggacaggacaatgtcacaatatcccctgtgaagaaggagataagctccaacttttctgctttcgacttagaaaaaagaaccagatgtcaaaactgatttcagaaatgcatagttttatccagataaagaaaaaaacaaacccgagaaacaatgaccccaagagcatgaagctaccccaggaacagagtcagcttccaaatccttcagaggccagcacaaccttccctgagagccatcttcggactcctcagatgccaccaacaactccatccagcagtttcttcaccaagaaaagtgaagacacaatctccaaaatgaatgacttcatgaggatgcagatactgaaggaagggagtcattttccaggaccgttcatgaccagcataggcccagctgagagccatccccacactcctcagatgcctccatcaacaccaagcagcagtttcttaaccacgaaaagtgaagacacaatctccaaaatgaatgacttcatgaggatgcagatactgaaggaagggagtcattttccaggaccgttcatgaccagcataggcccagctgagagccatccccacactcctcagatgcctccatcaacaccaagcagcagtttcttaaccacgttgaaaccaagactgaagactgaacctgaagaagtttccatagaagacagtgcccagagtgacctcaaagaagtgatggtgctgaacgcaacagaatcatttgtatatgagcccaaagagcagaagaaaatgtttcatgccacagtggcaactgagaatgaagtcttccgagtgaaggtttttaatattgacctaaaggagaagttcaccccaaagaagatcattgccatagcaaattatgtttgccgcaatgggttcctggaggtatatcctttcacacttgtggctgatgtgaatgctgaccgaaacatggagatcccaaaaggattgattagaagtgccagcgtaactcctaaaatcaatcagctttgctcacaaactaaaggaagttttgtgaatggggtgtttgaggtacataagaaaaatgtaaggggtgaattcacttattatgaaatacaagataatacagggaagatggaagtggtggtgcatggacgactgaccacaatcaactgtgaggaaggagataaactgaaactcacctgctttgaattggcaccgaaaagtgggaataccggggagttgagatctgtaattcatagtcacatcaaggtcatcaagaccaggaaaaacaagaaagacatactcaatcctgattcaagtatggaaacttcaccagactttttcttctaaaatctggatgtcattgacgataatgtttatggagataaggtctaagtgcctaaaaaaatgtacatatacctggttgaaatacaacactatacatacacaccaccatatatactagctgttaatcctatggaatggggtattgggagtgcttttttaatttttcatagtttttttttaataaaatggcatattttgcatctacaacttctataatttgaaaaaataaataaacattatcttttttgtgaaaa

SEQ ID NO: 342711 - DNA, 1835 bp, Homo sapiens
agttgtagcagatatccattctttttgcatggggccagagacccagaaaggctatcagagatttcagcttcctctgtatcaaggtgctttgggaagcaaagctgcccgtgtaggtgaaagcagtagaaatttggaagaaaactcattgttctagaactgtcatagaaatatctcagatatgaaagacttaaacaaaaaggatattgagggacggctttctgcaaagatgtggcctaagatatgtgcatatctgtactaggagttgctgttgtgcatcttgtttaactctcttagaagggacttcagcctatatgtggttgttattaattacattctcaggaacagaatattaattttctgttacagaaaacagtaaatcagaagaccacaatctacgaaattcaggatgatagaggaaaaatggatgtagtggggacaggacaatgtcacaatatcccctgtgaagaaggagataagctccaacttttctgctttcgacttagaaaaaagaaccagatgtcaaaactgatttcagaaatgcatagttttatccagataaagaaaaaaacaaacccgagaaacaatgaccccaagagcatgaagctaccccaggaacagagtcagcttccaaatccttcagaggccagcacaaccttccctgagagccatcttcggactcctcagatgccaccaacaactccatccagcagtttcttcaccaagaaaagtgaagacacaatctccaaaatgaatgacttcatgaggatgcagatactgaaggaagggagtcattttccaggaccgttcatgaccagcataggcccagctgagagccatccccacactcctcagatgcctccatcaacaccaagcagcagtttcttaaccacgttgaaaccaagactgaagactgaacctgaagaagtttccatagaagacagtgcccagagtgacctcaaagaagtgatggtgctgaacgcaacagaatcatttgtatatgagcccaaagagcagaagaaaatgtttcatgccacagtggcaactgagaatgaagtcttccgagtgaaggtttttaatattgacctaaaggagaagttcaccccaaagaagatcattgccatagcaaattatgtttgccgcaatgggttcctggaggtatatcctttcacacttgtggctgatgtgaatgctgaccgaaacatggagatcccaaaaggattgattagaagtgccagcgtaactcctaaaatcaatcagctttgctcacaaactaaaggaagttttgtgaatggggtgtttgaggtacataagaaaaatgtaaggggtgaattcacttattatgaaatacaagataatacagggaagatggaagtggtggtgcatggacgactgaccacaatcaactgtgaggaaggagataaactgaaactcacctgctttgaattggcaccgaaaagtgggaataccggggagttgagatctgtaattcatagtcacatcaaggtcatcaagaccaggaaaaacaagaaagacatactcaatcctgattcaagtatggaaacttcaccagactttttcttctaaaatctggatgtcattgacgataatgtttatggagataaggtctaagtgcctaaaaaaatgtacatatacctggttgaaatacaacactatacatacacaccaccatatatactagctgttaatcctatggaatggggtattgggagtgcttttttaatttttcatagtttttttttaataaaatggcatattttgcatctacaacttctataatttgaaaaaataaataaacattatcttttttgtgaaaa

SEQ ID NO: 342712 - DNA, 2321 bp, Homo sapiens
  misc_feature (1470)..(1470): n is a, c, g, or t
gggcaaagcagagtatgaggaagccagcactagtcaagtgactctaagaagggccattttcccttgttgtctttgaaaatacttcattttcttagcatttcaggagattataacatcctgtatttcagtttctgagagctttactgactgatttccctattcaaaacaatcctcatttcctacatttctgaagatctcaagatctggactactgttgaagaaattcccagtaaggctcacttatatctttagagatggcaaataactacaagaaaattgttctactgaaaggattagaggtcatcaatgattatcattttagaattgttaagtccttactgagtaacgatttaaaacttaatccaaaaatgaaagaagagtatgacaaaattcagattgctgacttgatggaggaaaagttcccaggtgatgccggtttgggcaaactaatagaattcttcaaagaaataccaacactgggagaccttgctgaaactcttaaaagagaaaagttaaaagtcaaaggaataatcccatctaaaaagacgaaacagaaagaagtgtatcctgctacacctgcatgcaccccaagcaaccgtctcacagctaaaggagcagaggagactcttggacctcaggtaagcttcaggaagaggagcaggcttcaagtctcacagtggaagctctgctgtggctgttccactcaatctgtccagcaggcagttatttcttcatatgtttcccatcaagtttcagatttatcaaattacataataattgatcatctttctgcaaggcaacaagttaaacgctttagtaaacataatgtaaatatacataaaataaatataatattttcatctccaatagagaaggatgttaacttgagagtcagataaaaaaacgtttgcctatgtttacaaaagcctagtttcttaactgcaagtcagcatatcccaaaacacaagtaattaaggaatgatgtgtgttactttctctgctccctttttaaaaatgaaaccatctatgccatgttctttcaattggcctggggatgtacttaagtttccaagaaaaacaatttatatacaataaatatattaccttgtaatgaaaatgtgctctgcttcatttgacactgaaagtaattaacaagaaaaataaactacttgtagaaaagaaaaaaaccatctgaagaagagactggaaccaaaaggagtaagatgtccaaagagcagactcggccttcctgctctgcaggagccagcacgtccacagccatgggccgttccccacctccccagacctcatcatcagctccacccaacacttcctcaactgaggtacactcttcctggtccccttttgattcattttcttcaacccaaaatgtaggaatctgatttcatcttctactgaaaaatgacatcaatcatcagccagtaaatcaaatgtatagactgagaattnactgcattttaatcttttgcttccacaggcatatttgatgaacttgacattatctctgactgcaggaagttttctgtcctgtgctgtttggggaagagacagagaactgcggaatctggaactttcagcaacagactcactgtctactgcccccatctattatacacccattccctttgctcactaatttgttcaagtttctctgacatacaccatgctcctttttcctttaggattttcacacaccatatttctttcacctttaaactcttacctggccaaccctatccaccctctggatcccaatattgagatcttatcctcagggaatcctcacttagacccctgtaacaggttaaatcttcatggtgttctgtttcctaggaacttctttcttttctactgtttatgacaactgaagttaataagtgtttatctttcccacctactcaaagtagttccaagattagggctagtttgtaattctgtggaccactgtaaacgagggcctagttcagtgtctgcctcatgggaagcttccaataaatacctttgctcaacgaaaaaatgaaaacccagtggctcacgcctgtaatcccagcactttgggaggccgaggcaggtggattgcctgaggtcaggagtttgagactagtctggccaacatggtgaaacactatctctactaaaaatacaaaaaaattagctgggtatggtggcttacgcctataatcccagctactcaggaggctgaggcaggggaattgcttgaaccagggaggtggaggttgcagtgagctgagatcgcaccactgcactccagcctgggtgacagagcgagactccatctc

SEQ ID NO: 342713 - DNA, 130 bp, Homo sapiens
caggtcttttcccctcaaaggagaaccatttgaggatgtgaaccacattgtctggcttctggcttctctcacctgttgacttaagaaaggagataaggaattatcctttttttttttttttttttttttt

SEQ ID NO: 342714 - DNA, 176 bp, Homo sapiens
tttgttcccaaggcaaaaacaaaaatacttttaaataaaactatttctactacttataccactattacttagaataataaggctcaattaagaatatgtagcttaatacctaatgcatgcagggattaaaacctagataacaggttgataggggcagcaaaccaccatggcacacg

SEQ ID NO: 342715 - DNA, 694 bp, Homo sapiens
aatattgaaaaatgaaacaatatctcctaaaagcagtcattttgtggactggtaaatgaaaaggacaaaaagtatattctttggactgttaaatcctattaaattactgttgctacaagtcatgacgaaagagtaaaccacaaaatccaattttaacaatcactgctccactacatggagcaaaaaaatgaaatagcaaattcaaccaagcaagtcactgcacatcaccaatacctggtaatgtaaatggtatgctgagcagtcaagagcaaaatatacaaatgacacacaagagggcccaatgcgaacaagcccttttaacgttcaaaacagagaaaaataaacatatttgattaaagatctatgaatcctgttccaatgagagaattataatttaggcttaaggaaatgtctcaaatccctttctcaccccattttctggcttctcctttgtgcagactggtggaggagaaatatcaagaatatttacataatgaacaatataaagaataaaagacaatggggttccccaaagggaagagcttatctacaacatggtttaacatgcataggttagggagtgggtgtggaggttcctgcagctctgagggctaactgatgcagatcattaaccactatctccagtgtgtttttggggtatgtttggaaaggctggaaattttcattaaaaagt

SEQ ID NO: 342716 - DNA, 494 bp, Homo sapiens
cagcccaggtccgagtcacatgctacactcagtcgtcacgtcatagccatctccgtcagtctgcaactgtctctcggtctttcttggtgtttgtgaccttggcactttcgaagactacattcggcccagttgatctgtcgaaggtatttccctgtggctagattcaggtcaggtgccgctggcagtaacaacacggaggtgaggctgcgctcttttcagtgtacaccaccaggcggccgagagcttttttttatttgccattactagtaaagttcactttgataatttggtaaaggtgatgtcctccaggcatgtgcactgtgaagttcctcttttcccctttgtaattagtatgtattctgtggggaggtgctttgaggctaggtaaatattccatcctcatgaaaccttcagtttacttttactttttaaatcagtacagattcatggttcctattttattcaatcagttgaaacagctactaatgttattc

SEQ ID NO: 342717 - DNA, 175 bp, Homo sapiens
ctgggtctgtgggaggctcaggattctggtccggactggagtagaacctggggagctattggctggcctctgttatttaaagccacagaatggatgtaaaaccaaggactagcagtcatactgagacggtgaaatggtggaaattggaaccttagggagcagcactgggctggat

SEQ ID NO: 342718 - DNA, 663 bp, Homo sapiens
aagggttttacacaaggcctaacctgaactgatttcttttttaagaccattattgccttgtggagaatgggagcaggaagatcaagtaggaggatgttatattagtctaggcaagagatattggtgactgggctgaggtgtagcaattaggatggagaacaaaagatggttttgagaaatcagcaagatttgggagagggcatactaaggagaaagagagagaaatcaagaatgactgatttttgtaaatgaagtttactgacttgagtaaaaatgggaatgaagtgacattgaatgagatgggaaagtttgcaggggcagaaataaagaggtgtttgagttttgtttaggacctatctctaatatgtttttgaggattctaaagggagctgtcagttggctatataagttcaaagctagggaaatctggatgcagctaaaattatatttgagataagcatggagagctaggcaggcaacagaccacacggggtcttatagggcaagatcagaagtctagattttattctaatgccataagaagacattaaagggtttacacaaggcctaacctgaactgatttcttttttaagaccattattgccttgtggagaatgggagcaggaagtcagtagggagacatgggatcctctaggaatcac

SEQ ID NO: 342719 - DNA, 758 bp, Homo sapiens
aagggttttacacaaggcctaacctgaactgatttcttttttaagaccattattgccttgtggagaatgggagcaggaagatcaagtaggaggatgttatattagtctaggcaagagatattggtgactgggctgaggtgtagcaattaggatggagaacaaaagatggttttgagaaatcagcaagatttgggagagggcatactaaggagaaagagagagaaatcaagaatgactgatttttgtaaatgaagtttactgacttgagtaaaaatgggaatgaagtgacattgaatgagatgggaaagtttgcaggggcagaaataaagaggtgtttgagttttgtttaggacctatctctaatatgtttttgaggattctaaagggagctgtcagttggctatataagttcaaagctagggaaatctggatgcagctaaaattatatttgagataagcacaccttccatcaatatgttggctgtaattttaaaaagcatttggagtatacttgaaaatactgaaactctctatctgtagtacataccttctgttcatcagtgactaattttagggtacacaacagttgtgcaaaagaatgaagtcctcttagttgcacttcttatcaaaatcccaatggtattgttttatagaaatagaaaaaaattaaattcatatggaaccacaaaggagcccaaatagccaaagcaatcttgagaaagaagagcaaagttgaaggcatcacacttcctaacttc

SEQ ID NO: 342720 - DNA, 2115 bp, Homo sapiens
tgcttccggtctggcggtgagtggggagtgggatccgatcccgtggggctatgtaggggaagttggtggctgcagctgccgtggttttctcctggtgtccagcagaaacggcggcggcgcaaggtgtggctgggccaacccaggatctcccaggaccctccgctctgcgcgacaaggggcccgcgcttgccaaggccgacgggcaggagtgaacgtggcctccgtgggtctgcagccccgataggccaattgtacagaatttaaaccgtctctcagatgtgtacagtagaactcaagaagacagactaccaagggtcatctgaagtcgtgattgggtcactaataacaccaggacaaagttaagggatcactactcaagcataagccccagttttcataagactgctgtgaagatgtttgatataaaggcttgggctgagtatgttgtggaatgggctgcaaaggacccctatggcttccttacaaccgttattttggcccttactccactgttcctagcaagtgctgtactgtcttggaaattggccaagatgattgaggccagggagaaggagcaaaagaagaagcaaaaacgccaagaaaacattgcaaaagctaaacgactaaaaaaggattgaaggactgaacaggctttgcaaccagaggaaaatcatttggaaaattacacagctttggaagaatccactaaagtttcttctttggatttcttgacagtatgatttagtaaatgaaatttgaccaaatggaagaatcatgttagttctgacctcaatactatagtaacttttaggcgtgggtgtagaagtttataggtttctattgacagttattgtaaattagcatttactgtggtacaaattctttataactgacttagtcatttgccgcttagcagtttatatactgaaatgaaaacatcttgtggggaaaagtgactttagattatgaactcaattcaaatgaactctatttaaaatggggtcctattttggacaaaggaaattaagaatgtaaaagtcagaacagtcttgaggtaaaaagtgtgctttggcttaaaagggatacagtatattaattacatcttttattattattgtttatttcttagaatcatttctggctttctcaaaacaaaataatattaatgagtacttctatttgctgcatttttcttattacagcctttgagacagctggtaattataagtcattttccattttttaaaacataattttataaagaattctcttatctcgactatgtagaataccacctactggacagaacaatttttgtactcacaaacactgccattttcttagagatggcttgagaggagtaacactatggtttaaagcttgcagtaaaaatgccaaacactgtagtaccttggaacccagtttattcttgtgctaagcagaactgtaaaatagttaaaatgtcttatcaagtaattcgccgattacaaagacaccatttgttttttatttcattctttgttttaactcatgtggtagtgatatttaatactttctgatcaaacaggttcaaagtaaaacgttaaatttcacatttcttttaaagaactcttaaagtgtaacagttacgccatacttcataagtggtaaagaaaggtataaaatttggaaacattttgttgggcatagtagtgattgggtgaaaaggataaattatatcaaaatgagaatgtgctgtaattggaagtagggagctaaaggatgtttctttcagtttagtagaactggaacgttttactattaaacatggcttttataaatgcatggtccaataattttattcactgttagtatttaattcactgtcagcttattaatgttttctgtacccattaatgaattttaaattacaaaaaattgtctagcagctacagtttaaaaatgaaactagacattaaaataaatttgataattttttataaagaggtcctggattttttttttttttttggaggaactaacattttaagttacattatgttatgcaagttagaatttcagttacagctaagcatacttgtaaaatttcaggactgtatctctcagaacctaagg

SEQ ID NO: 342721 - DNA, 452 bp, Homo sapiens
tttttcccgtatgtcaatgaactaaaaaaattttattattgaaataagtaacttagtaaaatacttgatttccagtaattaggattttcttacagggcatttgcaattgtaaattcaaatgaggaagaaacgtattaagttactataccggataggcaattttagatgtcatataggttgcatatatacaatatagaaattttccatttaaaattttattacaattatcctgaaattgtgacttaaattttgttttattttttgtattctttccaactagccaattgtacagaatttaaaccgtctctcagatgtgtacagtagaactcaagaagacagactaccaagggtcatctgaagtcgtgattgggtcactaataacaccaggacaaagttaagggatcactactcaagcataaggtagatgatttttttaaaaaaattccagttga

SEQ ID NO: 342722 - DNA, 2018 bp, Homo sapiens
tttttcccgtatgtcaatgaactaaaaaaattttattattgaaataagtaacttagtaaaatacttgatttccagtaattaggattttcttacagggcatttgcaattgtaaattcaaatgaggaagaaacgtattaagttactataccggataggcaattttagatgtcatataggttgcatatatacaatatagaaattttccatttaaaattttattacaattatcctgaaattgtgacttaaattttgttttattttttgtattctttccaactagccaattgtacagaatttaaaccgtctctcagatgtgtacagtagaactcaagaagacagactaccaagggtcatctgaagtcgtgattgggtcactaataacaccaggacaaagttaagggatcactactcaagcataagccccagttttcataagactgctgtgaagatgtttgatataaaggcttgggctgagtatgttgtggaatgggctgcaaaggacccctatggcttccttacaaccgttattttggcccttactccactgttcctagcaagtgctgtactgtcttggaaattggccaagatgattgaggccagggagaaggagcaaaagaagaagcaaaaacgccaagaaaacattgcaaaagctaaacgactaaaaaaggattgaaggactgaacaggctttgcaaccagaggaaaatcatttggaaaattacacagctttggaagaatccactaaagtttcttctttggatttcttgacagtatgatttagtaaatgaaatttgaccaaatggaagaatcatgttagttctgacctcaatactatagtaacttttaggcgtgggtgtagaagtttataggtttctattgacagttattgtaaattagcatttactgtggtacaaattctttataactgacttagtcatttgccgcttagcagtttatatactgaaatgaaaacatcttgtggggaaaagtgactttagattatgaactcaattcaaatgaactctatttaaaatggggtcctattttggacaaaggaaattaagaatgtaaaagtcagaacagtcttgaggtaaaaagtgtgctttggcttaaaagggatacagtatattaattacatcttttattattattgtttatttcttagaatcatttctggctttctcaaaacaaaataatattaatgagtacttctatttgctgcatttttcttattacagcctttgagacagctggtaattataagtcattttccattttttaaaacataattttataaagaattctcttatctcgactatgtagaataccacctactggacagaacaatttttgtactcacaaacactgccattttcttagagatggcttgagaggagtaacactatggtttaaagcttgcagtaaaaatgccaaacactgtagtaccttggaacccagtttattcttgtgctaagcagaactgtaaaatagttaaaatgtcttatcaagtaattcgccgattacaaagacaccatttgttttttatttcattctttgttttaactcatgtggtagtgatatttaatactttctgatcaaacaggttcaaagtaaaacgttaaatttcacatttcttttaaagaactcttaaagtgtaacagttacgccatacttcataagtggtaaagaaaggtataaaatttggaaacattttgttgggcatagtagtgattgggtgaaaaggataaattatatcaaaatgagaatgtgctgtaattggaagtagggagctaaaggatgtttctttcagtttagtagaactggaacgttttactattaaacatggcttttataaatgcatggtccaataattttattcactgttagtatttaattcactgtcagcttattaatgttttctgtacccattaatgaattttaaattacaaaaaattgtctagcagctacagtttaaaaatgaaactagacattaaaataaatttgataattttttataaa

SEQ ID NO: 342723 - DNA, 1983 bp, Homo sapiens
tgcttccggtctggcggtgagtggggagtgggatccgatcccgtggggctatgtaggggaagttggtggctgcagctgccgtggttttctcctggtgtccagcagaaacggcggcggcgcaaggtgtggctgggccaacccaggatctcccaggaccctccgctctgcgcgacaaggggcccgcgcttgccaaggccgacgggcaggagtgaacgtggcctccgtgggtctgcagccccgataggccaattgtacagaatttaaaccgtctctcagatgtgtacagtagaactcaagaagacagactaccaagggtcatctgaagtcgtgattgggtcactaataacaccaggacaaagttaagggatcactactcaagcataagccccagttttcataagactgctgtgaagatgtttgatataaaggcttgggctgagtatgttgtggaatgggctgcaaaggacccctatggcttccttacaaccgttattttggcccttactccactgttcctagcaagtgctgtactgtcttggaaattggccaagatgattgaggccagggagaaggagcaaaagaagaagcaaaaacgccaagaaaacattgcaaaagctaaacgactaaaaaaggattgaaggactgaacaggctttgcaaccagaggaaaatcatttggaaaattacacagctttggaagaatccactaaagtttcttctttggatttcttgacagtatgatttagtaaatgaaatttgaccaaatggaagaatcatgttagttctgacctcaatactatagtaacttttaggcgtgggtgtagaagtttataggtttctattgacagttattgtaaattagcatttactgtggtacaaattctttataactgacttagtcatttgccgcttagcagtttatatactgaaatgaaaacatcttgtggggaaaagtgactttagattatgaactcaattcaaatgaactctatttaaaatggggtcctattttggacaaaggaaattaagaatgtaaaagtcagaacagtcttgaggtaaaaagtgtgctttggcttaaaagggatacagtatattaattacatcttttattattattgtttatttcttagaatcatttctggctttctcaaaacaaaataatattaatgagtacttctatttgctgcatttttcttattacagcctttgagacagctggtaattataagtcattttccattttttaaaacataattttataaagaattctcttatctcgactatgtagaataccacctactggacagaacaatttttgtactcacaaacactgccattttcttagagatggcttgagaggagtaacactatggtttaaagcttgcagtaaaaatgccaaacactgtagtaccttggaacccagtttattcttgtgctaagcagaactgtaaaatagttaaaatgtcttatcaagtaattcgccgattacaaagacaccatttgttttttatttcattctttgttttaactcatgtggtagtgatatttaatactttctgatcaaacaggttcaaagtaaaacgttaaatttcacatttcttttaaagaactcttaaagtgtaacagttacgccatacttcataagtggtaaagaaaggtataaaatttggaaacattttgttgggcatagtagtgattgggtgaaaaggataaattatatcaaaatgagaatgtgctgtaattggaagtagggagctaaaggatgtttctttcagtttagtagaactggaacgttttactattaaacatggcttttataaatgcatggtccaataattttattcactgttagtatttaattcactgtcagcttattaatgttttctgtacccattaatgaattttaaattacaaaaaattgtctagcagctacagtttaaaaatgaaactagacattaaaataaatttgataattttttataaa

SEQ ID NO: 342724 - DNA, 2382 bp, Homo sapiens
tgcttccggtctggcggtgagtggggagtgggatccgatcccgtggggctatgtaggggaagttggtggctgcagctgccgtggttttctcctggtgtccagcagaaacggcggcggcgcaaggtgtggctgggccaacccaggatctcccaggaccctccgctctgcgcgacaaggggcccgcgcttgccaaggccgacgggcaggagtgaacgtggcctccgtgggtctgcagccccgataggccaattgtacagaatttaaaccgtctctcagatgtgtacagtagaactcaagaagacagactaccaagggtcatctgaagtcgtgattgggtcactaataacaccaggacaaagttaagggatcactactcaagcataagccccagttttcataagactgctgtgaagatgtttgatataaaggcttgggctgagtatgttgtggaatgggctgcaaaggacccctatggcttccttacaaccgttattttggcccttactccactgttcctagcaagtgctgtactgtcttggaaattggccaagatgattgaggccagggagaaggagcaaaagaagaagcaaaaacgccaagaaaacattgcaaaagctaaacgactaaaaaaggattgaaggactgaacaggctttgcaaccagaggaaaatcatttggaaaattacacagctttggaagaatccactaaagtttcttctttggatttcttgacagtatgatttagtaaatgaaatttgaccaaatggaagaatcatgttagttctgacctcaatactatagtaacttttaggcgtgggtgtagaagtttataggtttctattgacagttattgtaaattagcatttactgtggtacaaattctttataactgacttagtcatttgccgcttagcagtttatatactgaaatgaaaacatcttgtggggaaaagtgactttagattatgaactcaattcaaatgaactctatttaaaatggggtcctattttggacaaaggaaattaagaatgtaaaagtcagaacagtcttgaggtaaaaagtgtgctttggcttaaaagggatacagtatattaattacatcttttattattattgtttatttcttagaatcatttctggctttctcaaaacaaaataatattaatgagtacttctatttgctgcatttttcttattacagcctttgagacagctggtaattataagtcattttccattttttaaaacataattttataaagaattctcttatctcgactatgtagaataccacctactggacagaacaatttttgtactcacaaacactgccattttcttagagatggcttgagaggagtaacactatggtttaaagcttgcagtaaaaatgccaaacactgtagtaccttggaacccagtttattcttgtgctaagcagaactgtaaaatagttaaaatgtcttatcaagtaattcgccgattacaaagacaccatttgttttttatttcattctttgttttaactcatgtggtagtgatatttaatactttctgatcaaacaggttcaaagtaaaacgttaaatttcacatttcttttaaagaactcttaaagtgtaacagttacgccatacttcataagtggtaaagaaaggtataaaatttggaaacattttgttgggcatagtagtgattgggtgaaaaggataaattatatcaaaatgagaatgtgctgtaattggaagtagggagctaaaggatgtttctttcagtttagtagaactggaacgttttactattaaacatggcttttataaatgcatggtccaataattttattcactgttagtatttaattcactgtcagcttattaatgttttctgtacccattaatgaattttaaattacaaaaaattgtctagcagctacagtttaaaaatgaaactagacattaaaataaatttgataattttttataaaaaaaaaaagaaaaaaaaaaaaaagaaaaaaaaaaaaaaaaaaaaaaaaaaagaaacaaaaaaaaaaaagggggggggggggaaaaaaccccgcgggggggggcatagaggaccctttttggatgaagagggggcccccaagagagggacggctaacaaaaaggacaaaacaacagggaggggcggaaaaacaccaaggggggaggaggaaacaacatgcatcctggtgacatcctgggaagagcacaccccccactcgcgggggcgggaacaatagggggcccaacccacagcaacaaaatgagccgcccggggaaaaaaaaccgggggtttacggcgtcgacacacgcgaaatcctgccccgcaagagtcgcccgccaaaagaaattaggggatgatc

SEQ ID NO: 342725 - DNA, 1948 bp, Homo sapiens
tgcttccggtctggcggtgagtggggagtgggatccgatcccgtggggctatgtaggggaagttggtggctgcagctgccgtggttttctcctggtgtccagcagaaacggcggcggcgcaaggtgtggctgggccaacccaggatctcccaggaccctccgctctgcgcgacaaggggcccgcgcttgccaaggccgacgggcaggagtgaacgtggcctccgtgggtctgcagccccgataggccaattgtacagaatttaaaccgtctctcagatgtgtacagtagaactcaagaagacagactaccaagggtcatctgaagtcgtgattgggtcactaataacaccaggacaaagttaagggatcactactcaagcataagatataaaggcttgggctgagtatgttgtggaatgggctgcaaaggacccctatggcttccttacaaccgttattttggcccttactccactgttcctagcaagtgctgtactgtcttggaaattggccaagatgattgaggccagggagaaggagcaaaagaagaagcaaaaacgccaagaaaacattgcaaaagctaaacgactaaaaaaggattgaaggactgaacaggctttgcaaccagaggaaaatcatttggaaaattacacagctttggaagaatccactaaagtttcttctttggatttcttgacagtatgatttagtaaatgaaatttgaccaaatggaagaatcatgttagttctgacctcaatactatagtaacttttaggcgtgggtgtagaagtttataggtttctattgacagttattgtaaattagcatttactgtggtacaaattctttataactgacttagtcatttgccgcttagcagtttatatactgaaatgaaaacatcttgtggggaaaagtgactttagattatgaactcaattcaaatgaactctatttaaaatggggtcctattttggacaaaggaaattaagaatgtaaaagtcagaacagtcttgaggtaaaaagtgtgctttggcttaaaagggatacagtatattaattacatcttttattattattgtttatttcttagaatcatttctggctttctcaaaacaaaataatattaatgagtacttctatttgctgcatttttcttattacagcctttgagacagctggtaattataagtcattttccattttttaaaacataattttataaagaattctcttatctcgactatgtagaataccacctactggacagaacaatttttgtactcacaaacactgccattttcttagagatggcttgagaggagtaacactatggtttaaagcttgcagtaaaaatgccaaacactgtagtaccttggaacccagtttattcttgtgctaagcagaactgtaaaatagttaaaatgtcttatcaagtaattcgccgattacaaagacaccatttgttttttatttcattctttgttttaactcatgtggtagtgatatttaatactttctgatcaaacaggttcaaagtaaaacgttaaatttcacatttcttttaaagaactcttaaagtgtaacagttacgccatacttcataagtggtaaagaaaggtataaaatttggaaacattttgttgggcatagtagtgattgggtgaaaaggataaattatatcaaaatgagaatgtgctgtaattggaagtagggagctaaaggatgtttctttcagtttagtagaactggaacgttttactattaaacatggcttttataaatgcatggtccaataattttattcactgttagtatttaattcactgtcagcttattaatgttttctgtacccattaatgaattttaaattacaaaaaattgtctagcagctacagtttaaaaatgaaactagacattaaaataaatttgataattttttataaa

SEQ ID NO: 342726 - DNA, 1929 bp, Homo sapiens
tgcttccggtctggcggtgagtggggagtgggatccgatcccgtggggctatgtaggggaagttggtggctgcagctgccgtggttttctcctggtgtccagcagaaacggcggcggcgcaaggtgtggctgggccaacccaggatctcccaggaccctccgctctgcgcgacaaggggcccgcgcttgccaaggccgacgggcaggagtgaacgtggcctccgtgggtctgcagccccgataggccaattgtacagaatttaaaccgtctctcagatgtgtacagtagaactcaagaagacagactaccaagggtcatctgaagtcgtgattgggtcactaataacaccaggacaaagttaagggatcactactcaagcataagccccagttttcataagactgctgtgaagatgtttgatataaaggcttgggctgagtatgttgtggaatgggctgcaaaggacccctatggcttccttacaaccgttattttggcccttactccactgttcctagcaagtgctgtactgtcttggaaattggccaagatgattgaggccagggagaaggagcaaaagaagaagcaaaaacgccaagaaaacattgcaaaagctaaacgactaaaaaaggattgaaggactgaacaggctttgcaaccagaggaaaatcatttggaaaattacacagctttggaagaatccactaaagtttcttctttggatttcttgacagtatgatttagtaaatgaaatttgaccaaatggaagaatcatgttagttctgacctcaatactatagtaacttttaggcgtgggtgtagaagtttataggtttctattgacagttattgtaaattagcatttactgtggtacaaattctttataactgacttagtcatttgccgcttagcagtttatatactgaaatgaaaacatcttgtggggaaaagtgactttagattatgaactcaattcaaatgaactctatttaaaatggggtcctattttggacaaaggaaattaagaatgtaaaagtcagaacagtcttgaggtaaaaagtgtgctttggcttaaaagggatacagtatattaattacatcttttattattattgtttatttcttagaatcatttctggctttctcaaaacaaaataatattaatgagtacttctatttgctgcatttttcttattacagcctttgagacagctggtaattataagtcattttccattttttaaaacataattttataaagaattctcttatctcgactatgtagaataccacctactggacagaacaatttttgtactcacaaacactgccattttcttagagatggcttgagaggagtaacactatggtttaaagcttgcagtaaaaatgccaaacactgtagtaccttggaacccagtttattcttgtgctaagcagaactgtaaaatagttaaaatgtcttatcaagtaattcgccgattacaaagacaccatttgttttttatttcattctttgttttaactcatgtggtagtgatatttaatactttctgatcaaacaggttcaaagtaaaacgttaaatttcacatttcttttaaagaactcttaaagtgtaacagttacgccatacttcataagtggtaaagaaaggtataaaatttggaaacattttgttgggcatagtagtgattgggtgaaaaggataaattatatcaaaatgagaatgtgctgtaattggaagtagggagctcttttataaatgcatggtccaataattttattcactgttagtatttaattcactgtcagcttattaatgttttctgtacccattaatgaattttaaattacaaaaaattgtctagcagctacagtttaaaaatgaaactagacattaaaataaatttgataattttttataaa

SEQ ID NO: 342727 - DNA, 541 bp, Homo sapiens
tgcttccggtctggcggtgagtggggagtgggatccgatcccgtggggctatgtaggggaagttggtggctgcagctgccgtggttttctcctggtgtccagcagaaacggcggcggcgcaaggtgtggctgggccaacccaggatctcccaggaccctccgctctgcgcgacaaggggcccgcgcttgccaaggccgacgggcaggagtgaacgtggcctccgtgggtctgcagccccgataggccaattgtacagaatttaaaccgtctctcagatgtgtacagtagaactcaagaagacagactaccaagggtcatctgaagtcgtgattgggtcactaataacaccaggacaaagttaagggatcactactcaagcataagccccagttttcataagactgctgtgaagatgtttgatataaaggcttgggctgagtatgttgtggaatgggctgcaaaggacccttggtagtctgtcttcttgagttctactgtacacatctgagagacggtttaaattctgtacaattggcctat

SEQ ID NO: 342728 - DNA, 225 bp, Homo sapiens
caacatggagaaaccccatctctactaaaaacacaaaattagccgggcgtggtggagaatcacttgaacccaggctggagtgcagtggcacaatcagggctcactgcagcctccatctcccaggctcaggtgatcctttgctgggcgtccttgtcatagagaagcagtattttttttttttaaaacctcatcactattatctttatacttcagaagcaaactaag

SEQ ID NO: 342729 - DNA, 324 bp, Homo sapiens
gttgcagtgagctgagatcacaccactgcactccagactccagcctggagtgctggagaacagagtgagactccatctcaaacaacaacaacaacaacaacaaaccctgagatgtcttcacatcatacttcgtacaaaaacctaaagtggccaggcacagtggctcacgcctgtaatcccatcactttgggaggccgaggcgggtggatcacgaggtcaggagttcaagaccagcctggccaacacagcgaaactccatctctactaaaaatacagaaattagccaggcatggtgacgcgtgcctgtagtcccagctacttggg

SEQ ID NO: 342730 - DNA, 516 bp, Homo sapiens
tcctgccccatgtctcctgcgtgagccatccaaaatagtctagaacctgtcaatgtggatatttcatttaattcttgagttagatagtatcagcttgtattttatcattaaaagaaactgagtttcagagaagttaagtcatttggacaagatcaataggaagccgagtcaaacgtaggtctaacaagcaaacccattctgtttccccataccaactgcctccctaaatttctggcgtgtctggccgggtgcggtgactcatatctgtaatcccagcactttgggaggccaaggtgggtagatcacgaagtcaggagatcgagaccatcctggctaacatggtgaaaccccatctctactaaaaatacaaaaaattagccggacgtggtggcgggtgcctgtagtcccacctactcaggaggctgaggcaggagaatggcatgaacctgggaggcggagcttgcagtgagccaagattgcaccactgcactccagcctgggcgacagagggagact

SEQ ID NO: 342731 - DNA, 488 bp, Homo sapiens
ctcaaagccccaagggtactgaataattgcagtcatttaaggagcacctccacttgtgccaggcactgagcactttacatatagcatctcctgtaatcctcacagtgtccccctgaggtgggtgccctcatcatcccagtttacagaggaggaaactgagggttggggaggttgaagaagttgactagaaagtaacagagcaggagtcttcctgactgcagaacccatgttcttaactcctatgctacaatgcttctccaaaggcctcatccaacaagcattcaaaagtcctgggcactttggagggcaagctgactctctgacccagccatttcccttctagaatttaatcagccacataagtgcagaaacagccacataagtgcacaaatacctatggacaaagatatctacaacagctctgtctgtaatagtaaaaaattgaaaacaatgcaaatggggaattaaatgctttatggtttgttcat

SEQ ID NO: 342732 - DNA, 484 bp, Homo sapiens
aaattgtacccagagtaacctatgtatgcctctgcatatatgcactatctggggaaagggtccacaacccttagcaagtttcaggttttcgaagggcccataaaagctaagaagtaccgacctgtattaactttcatacctttatgttctggctcatatacgatgttatgtgctcaaaaggacaagctgggcaacataaagcctcttctcccccttgttctgccaacaaggattccatctagtgctgaaagaaaggacctctggagtcagacccaggcctaaatcctggctccatccattactatgcaatttggggcaattaattaacaaccaagcttcagtgtccacaacacaaactgaggtgagtaaaacctgcttcatagagttgttgtaaggagtaaacaaaatcccttgcgccaagcatctagcaggcacagtaggtactgctatgcacctgtgcccttggtttccttaagttctggcc

SEQ ID NO: 342733 - DNA, 573 bp, Homo sapiens
caccctgaaagtcgtgaactgcagttgggcttcccagtctgaacgttgtggtgtggttccccacatgctttgaatatagaaagtagcccactgcctgaatagtccagggccactgatacactgcaggtggcatttggtggcataaaaagagatgaagcaaaataacgcacgttggtagattgcttcctttgtgaatcaggtgttcagtaacaagttttaatgagatcctgagctgaatgaatcattcctaaagcaaaccatgctgggctgtatgtatctgagtgtatggagagatttaaatgtgaaaaggcctgagtcttgtctgcgagggctcagggtgcaggtgcacagcgtctcagcatacccaggtctctagatgtacagagttagatattacagcattttagacctaagtatagcgtcatgcgctcaggtcctcagtcatcctcatgcccacaagccctctgcatttacagatgagcaaataggatatccaggggctctctctaggcctgcagagctcatcacatgaatccggctggctcagggcgaggtgggtgagccccctgctcc

SEQ ID NO: 342734 - DNA, 568 bp, Homo sapiens
cctcaattacccttgacaattctcttaagttcaccctttaagtacactttaccatatgaacagctcacaatggtggccaatatacaatcccctccaacattcaagcaccatactaaacaggtagtttacagttaaagaccaagtgtacaaaaaagtacatcatttttcttgctcctatgccattccacctccataatccctcatttaaaacccatcaatatctgcccactctgctgaagataaaattcaaaatatctaacatggcctagaatgtcttatatgatttgataccttgcagcctcatctcccattgcatctcactttctacatgacagcccaccaggcctttcatttcccaaaatacactctttcctccttgcagaccatttgcaaaatgctactccctcaatctactctctcttcccttttctccctttctcttacataaggcttagtcatcctttggatctctacagaaacgtcatgtccttagggaagccttctcaatccagcccttccctacactatgttaggggtctccctgccatgcgtgtacacttaagcacac

SEQ ID NO: 342735 - DNA, 504 bp, Homo sapiens
gaaaatgatagcagatggaaatttggttctactcaaaggaatgaaaagtaccaggaatgataagataactaagagggcaaatatgaaagacttttgccgttgtaaaaatgtacttaaattgtttaaagcaaagatataacattatattgtaagatttattaaagtacatggaaataaaatgtatgacaatagcacaaaggatgagaggggagaaatggaaatatactattgtatggttcatacattttatgtcaagtgttatatatttttttgacccagagtctcactgtgtcacccaggctggagtgcagtggcacgatctcagctttctgcagcgtctgcttcctgggttcaagcaattctcgtgcctcagcctcccaagcagctgggattacaggtgtgcgccaccacacccagctaatttctttgtatttttagtagagatagggtttcaccatgttgcccaggttgctctggaactcttgacctcaagtgatctgcctg

SEQ ID NO: 342736 - DNA, 590 bp, Homo sapiens
gggtagcatgctgtatgggtgtgggcaccagagccacaactgttcctggccacaggcactgagcagctgggatcatggcattgtagtcacccatgtgagcatggtggaatgacagtggagcctcaagagtggacaaatgaagtggctactggtcccctgagcagagcactcaagcactggctccaatttcaagatggcaccatactatagcagcttgggtcatggggtggtgagggtacacacattgttcattctctggagcattgcagcttcatggaaattccttgaggctctacaaactgggctcagggcctatgagtactgtagaattctatcagagaaggactgcatgtgcctgcagtggtaatggggactgttgggggcctatggcttacgttttccccacaaggggaagtgcctcctggctcaaagtgggagacagggcagcagagtcagggtgttttgctccccctctatgccgtcatcctgggttgccatactccatggggaattggccactcgctttctgcgctctatcactttccttcagaggctctagtcaaattttagttgtctgttctttttggtcc

SEQ ID NO: 342737 - DNA, 795 bp, Homo sapiens
ccagcagcctcaacaggcacagctcctccctcacagtggcccatttaggcccaacttatgactgtgaggccatttccaggcctagtgcctgcctcgtggctgactcttgaagcccaaaacttcctcaaatcaggcttttgcccaacttctgtctactgtcggactctacaggtcagcctctgcctcacagtggaccctccagacccagatggtgtctcactgtggcatcctcaggtgaagctcctgcctttcggcagcctctccaggcccagctcctcctgcctcccagtggcctctttcggcccagcccagctcatgcctcccggcggccttcccaagccccgcttttgactttcggtggcctctgcaggcctcgacaaggcccagcctcctgcctcccgaaggcctgcacaggcccagcctctgcctcacagcggactctccacgcccagctagctgttgcttcactcgtcgcgaccgtccccggagttcgcatacatgcgtcccttgaccttgccttccggctccgccttacgggtgccaagagatccctacgccttgccccttgtctcctgggcccaagttgtgccgcgtgctgtgctagcggcgcctattcgtggcccgctttgccctatgcttcgtgcacctacatctgtgagcgtctcgcacaccctgcgactcaacgtttctactgttccttgggtcccagtgccgcgattggcctcctgggtgtgttcctcacgcatatcctgcgctacaagcgttcttgttgcgctctttcctcaaagtattcgg

SEQ ID NO: 342738 - DNA, 233 bp, Homo sapiens
acccagcctcagctcggcctgccactcctgcctcccagccttctctccaggccctgaactttctcaagttgacctcaccaggcccagctcatgcttctttgcagcctctccaggcccagctcctgcatcttggtgcccctccaggcccacccggcctcatctccagcctcatctccatccctactccagcacctcagtctccagcctcatctcagccctcatcccagctgcta

SEQ ID NO: 342739 - DNA, 110 bp, Homo sapiens
cacagcagattcttcacgcccagcttctacctcactgtggaccccccaagccaagctcccaacctttcagcagcttctacacacccagctcctgccacccagtggcctct

SEQ ID NO: 342740 - DNA, 662 bp, Homo sapiens
ccagcagcctcaacaggcacagctcctccctcacagtggcccatttaggcccaacttatgactgtgaggccatttccaggcctagtgcctgcctcgtggctgactcttgaagcccaaaacttcctcaaatcaggcttttgcccaacttctgtctactgtcggactctacaggtcagcctctgcctcacagtggaccctccagacccagatggtgtctcactgtggcatcctcaggtgaagctcctgcctttcggcagcctctccaggcccagctcctcctgcctcccagtggcctctttcggcccagcccagctcatgcctcccggcggccttcccaagccccgcttttgactttcggtggcctctgcaggcctcgacaaggcccagcctcctgcctcccgaaggcctgcacaggcccagcctctgcctcacagcggactctccacgcccagctagctgttgcttcactgcggacctcccgagtccaaagctccctgcctctcggccgcttcggcaggcccagctcccgcctgccagtggcctcttcaggcccatggggctcattcctgacaacggcctttccaggcccagtttttcccttccagcggcctctccgggcccagaacctcctcaagtcggcctctccagacccacttgcaccc

SEQ ID NO: 342741 - DNA, 242 bp, Homo sapiens
tcatgactctcaatggcctatttaggcccataccctacgtcacggcagcctccgcagatgaggctactgcctcacaacagcctccacaggcacagctccatcgttacaatggcctctttagacccagctcctgcctcccagccttctctccaggccctgaactttctcaagttgacctcaccaggcccagctcatgcttctttgcagcctctccaggcccagctcctgcatcttggtgcccc

SEQ ID NO: 342742 - DNA, 100 bp, Homo sapiens
tacagagaatttagcagttgaatggcaaggaaaacttctgcctatcaaaacactgcaaacagcgctctctctttttctctcttaccccttccagttcttc

SEQ ID NO: 342743 - DNA, 716 bp, Homo sapiens
ttccatgactccgataacacgaatttgctttttctgtcatattctcacaagctcctcagtctttctgtttttaattctattttctatgttgttgtatacgctgagtaatatgtattattctatcttctagtgcatagattatttcctctgtcccattcattctgctgttaagtctatctctgaatgtatttttatttttctggttcaatttctctcataaaagctctgaactttttatttcaattactgagtcagttataaaaattctaatttaaaaaaattattggctgggagcggggtagggatatggcaggtacgataatgtaaggaaaggcaaagaggtgaaaattagcaagttgtgaacaatagcagtgaccagtgcaggtcagtttcaggtccctggcattcaggttgggaatggcaggatgggaggttgggcagtggagctgggagcagctctcagagggccttgcatggctttctaaggagctcaaacattttccagtaggtgatggcctgcatgagggctttaagcaggggagcaaaatggtcacgtttgcatttttttattatttctagaaggcactatagatggatgagtctggtggttgtgagaggccatgtctgaaggtcaggaggtcagtgaggagtgagggctgactagcctgggccggtgaggatggagaggaggagagggagtagagagctgttggggg

SEQ ID NO: 342744 - DNA, 216 bp, Homo sapiens
gcatcaagttcatatgtgatggaatcgtagggtatgatgtgatggaaaggtttttggctaggcgactgaataaatgctggtcctgtttaccaaaatagtgtggaagaggatcatgcttaagggtgagtgtcggaggcctgggtacagataattgagttcaggatatatcaagtttggggtttttaaagacatcaaattggaggtgtccggtcagat

SEQ ID NO: 342745 - DNA, 349 bp, Homo sapiens
tgcagtgttggaatcaaggctcactgcagcctcaagcggccttcccacctcagcgtcctaagtagatgggactaccggtgcacaccatcacacctggccaatttttaaaaaattggctgggatcacaggcatgcaccaccatgccaagctaatttttgtgtttttagtagagacagggtttcactatgttgtccaggctgttgaactcctgacctcaagtgatccaccctccttggcttcccaaagtgctgggaatacaggcatgagccaccgcgcctgacctttttttttttttttttcacattttatagcttttctttgttttttaagttaggaattcagtgtggaa

SEQ ID NO: 342746 - DNA, 181 bp, Homo sapiens
acccagaggaagaaaggattcatttcctaccattgaatttataggttttatgcaaatgtaacacctcaggcaaggaaaattctatcgtcctgcctcctgactcctctacccacctctgctcttacaatggattttctaaaaggcaattttgatcagacctctcctcaaaggtagcccacaa

SEQ ID NO: 342747 - DNA, 625 bp, Homo sapiens
acatttctttttgtgttgatgtttaaatcttttattattagtctcatattctccctcaagactcagaattctagtactcctaatgaacatttatgtccgttgggcagtcctgctgccatcctaagctacacatactgggaatggaactcaatcatcttttctttgcaaatcagtgtctcttaccaatttctttcattctgtttacccagtcttctaggtttgaaattttggggttgtttttaggattttgtattgccttcattttcttaattaatcagagtccttctagttctagtctagaaatatgtttcatatctgccattcatgttccactatgattttgactgtcttgcagttcctgataattttatgaatagattaatataatgctgtttaacttattttctatatgcttaattcattctagacatagctggaagacagatcttaaattataactttttttttcctatatgttattcaatgaagaataaacctagtttagtatttcacttggtaaagtgtagtacgtcatgcatgaattgcagcatcaggatcacttgtgatatttgccagaggtggccatcccacatcacctaaatcaaatctctgggcatggattctg

SEQ ID NO: 342748 - DNA, 129 bp, Homo sapiens
tctccaaaaagactatactaatttatacttaaaacagtgcaggagaaatttgatttttcctcatttttataaccatgatcagcaaaaaatgttatttcattgattgattgatttttttttttaagtcag

SEQ ID NO: 342749 - DNA, 487 bp, Homo sapiens
aattaatattgccacattattttaaattatgtacaaagacctaacatgtcactcagggaccatttcacccactgctctatttagccgccagtctcttcagcaatggtgagggtttggtgtacacattatttcatcacccaggtaataagcatagcacccgacaggtagtttttcggtcctcaccctcctcccatcttaccctcaagtaggccctgctgtttgttgttcccttttttgtgtcaatgtgtagtcaatgttcagctcccacctataagtgagaacctgtggtgtctggttttctgtccctgcattagttcacttaggatagtggcttccagctccatctatgttgctgcaaaagacattatcttgttcctttttatggctgtgtagtattccatggtgtatatataccacattttctgtctttctccttccttccttccttccttcattccttctctctctctctctttctttctttcag

SEQ ID NO: 342750 - DNA, 279 bp, Homo sapiens
ctaatggagctgcctgggtaggagatgccggtgcggggtggggaggaggagggaggtacatccttctctgtatggggtgagaagtaaggaagtatacagcataacttttggagatactgctaactccacagcttcttctagaacccagctaaggctagaattcagctaaaacacattttactgagctacttccctttttccatctgccttctaacacttctttacaacatttcttgagtgcaaccctcaattgattaattcacaagaatcttggactct

SEQ ID NO: 342751 - DNA, 405 bp, Homo sapiens
tgctccccagaacctggactacaaatgggacaaagggggctcttggtaaaaagcctgggagaccagaaaaaggctgtgcaacacaacaaggaaactggagcctagaggaaaacgcaggaagactaaggagggaaaagaagagggcggggcacaggggagagacagacagaagggagccagagagggcagaaagagaggcaggccgaaaccgtctgtataaatggataaatctggtaaattcagagaattgctctttccacagattgactcagagctgtgaaagttcatctccacgcaggcaccacatttgtttttaccacgtgccccaacagtttcagtgctctacaaccagtgtttcctaatttcttggcttaagttgcttaagtgaaggagtttctcatttct

SEQ ID NO: 342752 - DNA, 439 bp, Homo sapiens
gagacacaggatctcgggtgactgcccactttagttccccaaagtccccctaaaaataaaggcacttcaagggaatttagacaacctttaagtcctttaagtgagcaacagatacttatctgatcataataataagtgtgaagatgatgtataggggccgggtgcggtggctcacgcctgtaatcctagcactttgggaggccgaggccggtagatcacctgaggtcaagagttcaagaccagcctgaccaatgtggtgaaaccccgtctctaccaaaaatacaaaaattagctgggcgtggtggcacatgcctctaatcccagctacttgggaggctgaggcaggagaattgcttgaacctgggaggtggaggttgcaatgagccgagatcatgccactgcactccagcctgggcaacagagtgagactccatctcat

SEQ ID NO: 342753 - DNA, 710 bp, Homo sapiens
ctttggtgtggctgtccactcaaggggctgaactctaagcggaaagcatcagagtgcagggcgctaagcattcagctagccctcacaggccctcacgccaggaaggaactcactgccttcctacaaagaccaagaggtacctgggaggagctctgccagagctggaagtttgagacctaaagttagcatcagggcccctgagaaaaggaaggagactggagcaaaccgtgacccttatgagctgaattatgcttccccctagaattcatatgttgaagccccaacccctagtaccctagaatgtgactgtacttggagatagggtctttaaggaggtaattaagtacaattaggtcatcagggtaagccctaatccaatctgactggtgttcttttaatgaagaagagaaaatttggacacacagagagacaccagggatgcaggtgcacagaggaactaccaggggaggacaaagcattgtgaaagtggttgtctgcaagccagggggagaggtctcaggttaaaccatccctaatggccccttggtcttggactttcagcagtgcaactgtgagaaaataaatttctgttagttatttaagcccctaagtccatagtattttgtcacggcagcctgagcagaccaaccacctctggagagatgggggtcaaaggattgcccagactgaatttccatcaacagagggca

SEQ ID NO: 342754 - DNA, 407 bp, Homo sapiens
atgcacaagttcaaagggatgaatagagaagatttcacagaataggtggcattgacaggtgcataggatttcaatagggagaaattaaggagagaaaacattccaggctgaataaatgagcaatggcgtaaaactaaggaagtataagtcatgtacagggaacttcaaatggttgagtttacttagattttatttagaaaatgcgtagatgaatagaggaaatgagaatataaaagccgatgggtcgcaggcataaaggtcctaggcagtgggaagccatgggaggctttttagccaggagtttcccctcagagcaatctgctgataaaaatctgttagtggtgtgcaggaaggatgaagggactccaggtagctgtaatttatgcatacagtggtagtggtgggag

SEQ ID NO: 342755 - DNA, 465 bp, Homo sapiens
accagtaacaaataaagagattgaagaggtaattaaaaacgttccaacgaagaaaaccccaggaccagatggcttcacagctgaattctgccaaacattcaaagaacaattattaccaatacttcttaaattcttccaaaaaaaaaaataataataaagctagagggaatacttccaaaaactttttatgaggccagcatcaccttgatactgaagcttgacaaagataccacaagaaaagaaaaagtacaggccaatattgctgatgaatattaattcaattctcaataaagtattgcagactgaattcaacaatgcattcaaaagattacgtaatgtgaccagggggatttatccttggcatgcaaggctggtttggcatatacaaataaatcattgtaatatgtcacattaacagaatgaaagatagaaaccacatctaaattgacatagaaaaagcatttg

SEQ ID NO: 342756 - DNA, 380 bp, Homo sapiens
tcctgccttgttttgtctcctctctcctgcatgtaacaagtgagagtagagattttggagtatttttacgagtctgtatttccagagtctaggatagtgcctgggacataggagtgcttaaaaaaagatgagcgacgttaagaatccttgagaaaacctaatggaatgatattaccagtgaccaaaaggtgaatacattttctttttaatggagcatatttgtttttttttttaattttaaaattaaataatattttaaccttattttcgcctctcatcaaatgggcttttctggatctagatacagatattatttactcctgattgtgtcatgcatgtttgaaaccactgctaaggaggtagcaggtatagttaaaggg

SEQ ID NO: 342757 - DNA, 316 bp, Homo sapiens
accagcctgggtgacagaggaagactctgtctcaaaaaacaaaacaaaacaaaaaaaaacactaacatggtgaaagactcatcccaacaatttttcactacagtagctgaggtacatcatgcactacacacatacttgattctttcttccagacgttgccttgtgaattggattttgaactgtgctcctgccatggccttaagaatgaccaagaagtccttgtggcttgatgacatctgatgtctttgagactcacacagcaggcagttggcaaggcagcgggcttactcacacaggcaggggttccacgagtcac

SEQ ID NO: 342758 - DNA, 562 bp, Homo sapiens
agtgtggtagctcatgcctgtaatcccagcactttgggaggctgaggcaggtggatcacgaggtaaggagattgagaccatcctggctaacacggtgaaaccccatctctactaaaaaatacaaaaaaattagctgggtgtggtggcgggcacctgtagtcccagctacttgggaggctgaggcgggagaatggcttgaacccgggaggcggagcttgcagagaaccgagatcgtgccactgcactccagcctgggtgacagagtgagactccgtctcaaaaactgtttctctgaagctgaaatcagatctgagagctaataggagaattttgttttgagaactatgcggtccacattattcctgtttagagaccagtgtttgcttaatggcttgggcctgtttttgcaattactcagcattttcctcactaaaaaacctttaatatactcaacaatcattggtaaatgagacctctttttcttttctagctgagacattgcatattcttttaacatttccaacactgatagttttctgtccttgtgtatccttgtagtttc

SEQ ID NO: 342759 - DNA, 456 bp, Homo sapiens
cctggccaagattgattgattctttgtctgtctgtctttctgtctttccttgtctttctttccttctctgtcactgcactccagcctgggtgacagagtgagactccgtctcaaaaaaaaaaaaaaatgtgttcctgtctttgcttgttatacagttttgtaaaatcctatctgtttctgtttctctgaagctgaaatcagatctgagagctaataggagaattttgttttgagaactatgcggtccacattattcctgtttagagaccagtgtttgcttaatggcttgggcctgtttttgcaattactcagcattttcctcactaaaaaacctttaatatactcaacaatcattggtaaatgagacctctttttcttttctagctgagacattgcatattcttttaacatttccaacactgatagttttctgtccttgtgtatccttgtagtttc

SEQ ID NO: 342760 - DNA, 685 bp, Homo sapiens
attatttaatgtaatggcaactccacgggggaggacaaagaaaaaagcatcttttgatcattctccggatagccttcctttgaggagctccggtaggcaggcgaagaagaaagcaacagagacaacagatgaggatgaagatggtggctcagagaagaagtacaggaaatgtgaaaaggcaggctgtacggcaacatgtcctgtgtgctttgcaagtgcttctgaaagatgtgccaaaaatggctacacctcccgatggtatcatctctcctgtggggaacatttctgtaatgaatgctttgaccattactacagaagccataaggatggatatgacaaatatactacatggaaaaaaatatggactagcaatggcaaaaccgaacctagtcccaaagctttcatggcagaccagcaactcccctactgggttcagtgtacaaaacctgagtgtagaaaatggaggcagcttaccaaggaaatccagcttactccacagatagccaagacttatcgatgcggtatgaaaccaaatactgctattaagcctgagacctcagatcattgttccctcccagaggatctatagtcatcatgagaaggctctgatttgatgactccatgttaagtcaactctggaacagtatcacgtatttgaagactgaaaataactgcttttgttcag

SEQ ID NO: 342761 - DNA, 679 bp, Homo sapiens
attatttaatgtaatggcaactccacgggggaggacaaagaaaaaagcatcttttgatcattctccggatagccttcctttgaggagctccggtaggcaggcgaagaagaaagcaacagagacaacagatgaggatgaagatggtggctcagagaagaagtacaggaaatgtgaaaaggcaggctgtacggcaacatgtcctgtgtgctttgcaagtgcttctgaaagatgtgccaaaaatggctacacctcccgatggtatcatctctcctgtggggaacatttctgtaatgaatgctttgaccattactacagaagccataaggatggatatgacaaatatactacatggaaaaaaatatggactagcaatggcaaaaccgaacctagtcccaaagctttcatggcagaccagcaactcccctactgggttcagtgtacaaaacctgagtgtagaaaatggaggcagcttaccaaggaaatccagcttactccacagatagccaagacttatcgatgcggtatgaaaccaaatactgctattaagagacggggttttgctgtcttgcccagggtgaggcccttgattgattctggaactcaactttaagagttgaaggcctctctgagaagaggaagagaaaagagaaaatgggaaggagctgacatgagggcgtgg

SEQ ID NO: 342762 - DNA, 384 bp, Homo sapiens
tgctttgcaagtgcttctgaaaggtctgtttagatgtgtgtcttggcctcccatttctgcttgtgagaagttctttgtggaaacatcatccttgtagatagttttcctaaagatagatacagatactataagtcatctaatctaataatagagacattgcccagacattctgtacacaccacaccctcctcaaggccctccctacttatccctagcctactgggagaggccacacccatgtcaattttgcaacacagtgtcctcaaatccagccaaccatatctacctctccaagggttgagggtgggatggtgtatgtcgtggtgagacagtagagagaactcatgagctttctgtagacaccagtgtttgtttacttttcgt

SEQ ID NO: 342763 - DNA, 381 bp, Homo sapiens
ggactacaggtgtgtgccactgtgcttcactaatttttgtatttttttttttttttaatagagacggggttttgctgtcttgcccagggtgaggcccttgattgattctggaactcaactttaagagttgaaggcctctctgagaagaggaagagaaaagagaaaatgggaaggagctgacatgagggcgtgggcagttcatttccaggctgcgtggctgcactgatgggagctgggaactgagcaatgaaaataccatgaacaggcagaggggagcgtgtccagcttgcaggaacaatatcttggttgcactaaacttaactacctgtgtcccagattacttgacaatgaaaagttgactcagtggcatttcattataat

SEQ ID NO: 342764 - DNA, 360 bp, Homo sapiens
  misc_feature (349)..(349): n is a, c, g, or t
  misc_feature (359)..(359): n is a, c, g, or t
cgcaaatttccttccactcgaaatttccttccactcgacaggcagatgaatcagagaccaatagaagctgggaagtggggtgggattgtgatccgtggaatggtgcagtctaaatgttgtttattcactgtctgcaaaaagaaaaacgcacacactgagattaggtgttagaaacttttatagcagtttggcgtggctgtaataattgttgtgtgtgttagataactaggtaaaaagagtagaggccatcacactcctgttgctggtggcgtgagctatgtagaagtactatgcacaatacgagtggaaggaaatttcgggggatcctggagattcccaatagcaggcnagcctccctng

SEQ ID NO: 342765 - DNA, 589 bp, Homo sapiens
gacattgcccttgttctaatgaaggtactttcaattatggctcacagcagcctcaatctccgggacccaagcaatcctcccacctaggcctcccaaagtgctggggttacaggtgtgagccactgtgcccagcctaatgagagtacatgttaatggggaaaactaatatgtaaagattaacagataaatgattattacaagacaaaacaagaaaggattatgaaggaaatacacaggcagatgaatcagagaccaatagaagctgggaagtggggtgggattgtgatccgtggaatggtgcagtctaaatgttgtttattcactgtctgcaaaaagaaaaacgcacacactgagattaggtgttagaaacttttatagcagtttggcgtggctgtaataattgttgtgtgtgttagataactaggtaaaaagagtagaggccatcacactcctgttgctggtggcgtgagctatgtagaagtactatgcacaatagaaccatgttccaacttggaatattttagtttgtcaactgtaagccaaatgtgtacataatccaaaatttatttctttcattaaaagctaattt

SEQ ID NO: 342766 - DNA, 268 bp, Homo sapiens
ggcagctgggcccccagcagcgggcgctctaccgggatgtgatgctggagaactatgggaacgtggcctctctgggattccctgtccctaagccggagttgatctcccagctggagcaggggaaggaactttgggtcctgaatcttctgggagctgaggaaccagatatcttgaaaagctgccagaaagattctgaggttgggaccaagaaggaactatctattttaaaccaaaaattttccgaagaagtaaaaaccccagaatttgt

SEQ ID NO: 342767 - DNA, 576 bp, Homo sapiens
tatcacagagtaaacatacccatataatcactacttagagtggtatggaccaaatatttgtgtgtcctaatattcatatgttgaaatcctaatccccaatgtgacagtattagggaatgaatcctccattcatgagatggagtcctcatgaatgggattagtgaactcataaaagagacctcagagagttatgtagctctctttctgccatgtgaggatacaatgagaagtaggcagtctgcagcctagaagacagctctcactagaactgaccatgctggcaccctgattttggatttccagcctccagaatgatgagaaatgaatttctgttaatttgtaagccacccagtttatggtactttaatatagcagcccaaactaagagagagggtggacaatttttttcaacaaagggtcagatagtaagtatgttagcctttgcagttcatataatctctgtggcagctactcagctttgcagttgtagcacaaaagtaaccttagacaatatgtaaacaaatgagcgtggctgtgtttcaataaagctctttctggacaataattttcacatgc

SEQ ID NO: 342768 - DNA, 366 bp, Homo sapiens
gtccatgtgccaaatgttatgtatatttctggacaaaggatgcatgcctgcaaatagacccaaaaacaactatgactccaaaaagcttgagtctccatggtgaaaaattatgagcctatgttcacagaagttgctgcagaatcccatatagcaataattcattttcttctctggacgaatttaccacctggtgggaagatggcagttgagactaggaagactgccactcttaattcttatacatctttctagaaactgaagttgaattcttctactcgtagtgcaagtcaaagataactctttttattatctcactgtcagactagctaaaaataagatgcatatactgtgcttaagatcaacagt

SEQ ID NO: 342769 - DNA, 232 bp, Homo sapiens
tggaaaacatcaaaatgaaaccaataatgcctcctcaggaagctgaccgtcgggaaggatgaatagcaattcagtctacaaatatttcctgaacacttctggctggaaaccttggaccaattaatgactatgctgtagacagcacatacagacagtgctggctgcagtctgggcaagtgaggctcctgcctggccaggacaggaaggctgacccagaggctcaactctctct

SEQ ID NO: 342770 - DNA, 524 bp, Homo sapiens
gaacagatttaactaaggaggtgaaagacccctacaaggaaaactacaaaacatagataaaagaaatcgaagagggcacaaagggaaagacatcccatgctcacggactggaagagctattattgttaaaatgactacactgccaaagcaatctaaagattcagtacaacccctatcaagatatcaatgccatttttcacagaaatagaaaaaaaaaagtcctaaaatgattgtggaaccaaaagagtccaaagagctaacacaacccgagcaaaaacaaagctggcagcatcacactacctgacttcaaaatataaggttatagtaaccaaaaacagcatggtattggtataaaaacaggcacacagaataatggaacagaatagagaacccagaaataaatccacatatttatagctaactgatttttttacaaaggtgccaagaacatacattggaaaatggataccttcttcaataaatagtgctgggaaaatacagaagaatgaaactggacctctgcc

SEQ ID NO: 342771 - DNA, 3759 bp, Homo sapiens
ggctcgggactgtgttaagaaccaagggcatataaagacagatgggaggagaccctggccggggagaggaagaagcatctacataggtactaagtaccattcgctaattcagcttagagaactatcaacacaggacaatgcaagcccatgagctgttccggtattttcgaatgccagagctggttgacttccgacagtacgtgcgtactcttccgaccaacacgcttatgggcttcggagcttttgcagcactcaccaccttctggtacgccacgagacccaaacccctgaagccgccatgcgacctctccatgcagtcagtggaagtggcgggtagtggtggtgcacgaagatccgcactacttgacagcgacgagcccttggtgtatttctatgatgatgtcacaacattatacgaaggtttccagaggggaatacaggtgtcaaataatggcccttgtttaggctctcggaaaccagaccaaccctatgaatggctttcatataaacaggttgcagaattgtcggagtgcataggctcagcactgatccagaagggcttcaagactgccccagatcagttcattggcatctttgctcaaaatagacctgagtgggtgattattgaacaaggatgctttgcttattcgatggtgatcgttccactttatgatacccttggaaatgaagccatcacgtacatagtcaacaaagctgaactctctctggtttttgttgacaagccagagaaggccaaactcttattagagggtgtagaaaataagttaataccaggccttaaaatcatagttgtcatggatgcctacggcagtgaactggtggaacgaggccagaggtgtggggtggaagtcaccagcatgaaggcgatggaggacctgggaagagccaacagacggaagcccaagcctccagcacctgaagatcttgcagtaatttgtttcacaagtggaactacaggcaaccccaaaggagcaatggtcactcaccgaaacatagtgagcgattgttcagcttttgtgaaagcaacagagaatacagtcaatccttgcccagatgatactttgatatctttcttgcctctcgcccatatgtttgagagagttgtagagtgtgtaatgctgtgtcatggagctaaaatcggatttttccaaggagatatcaggctgctcatggatgacctcaaggtgcttcaacccactgtcttccccgtggttccaagactgctgaaccggatgtttgaccgaattttcggacaagcaaacaccacgctgaagcgatggctcttggactttgcctccaagaggaaagaagcagagcttcgcagcggcatcatcagaaacaacagcctgtgggaccggctgatcttccacaaagtacagtcgagcctgggcggaagagtccggctgatggtgacaggagccgccccggtgtctgccactgtgctgacgttcctcagagcagccctgggctgtcagttttatgaaggatacggacagacagagtgcactgccgggtgctgcctaaccatgcctggagactggaccgcaggccatgttggggccccgatgccgtgcaatttgataaaacttgttgatgtggaagaaatgaattacatggctgccgagggcgagggcgaggtgtgtgtgaaagggccaaatgtatttcagggctacttgaaggacccagcgaaaacagcagaagctttggacaaagacggctggttacacacaggggacattggaaaatggttaccaaatggcaccttgaaaattatcgaccggaaaaagcacatatttaagctggcacaaggagaatacatagcccctgaaaagattgaaaatatctacatgcgaagtgagcctgttgctcaggtgtttgtccacggagaaagcctgcaggcatttctcattgcaattgtggtaccagatgttgagacattatgttcctgggcccaaaagagaggatttgaagggtcgtttgaggaactgtgcagaaataaggatgtcaaaaaagctatcctcgaagatatggtgagacttgggaaggattctggtctgaaaccatttgaacaggtcaaaggcatcacattgcaccctgaattattttctatcgacaatggccttctgactccaacaatgaaggcgaaaaggccagagctgcggaactatttcaggtcgcagatagatgacctctattccactatcaaggtttagtgtgaagaagaaagctcagaggaaatggcacagttccacaatctcttctcctgctgatggccttcatgttgttaattttgaatacagcaagtgtagggaaggaagcgttcgtgtttgacttgtccattcggggttcttctcataggaatgctagaggaaacagaacactgccttacagtcacctcatgttgcagaccatgtttatggtaatacacactttccaaaatgagccttaaaaattgtaaaggggatactataaatgtgctaagttatttgagacttcctcagtttaaaaagtgggttttaaatcttctgtctccctgtttttctaatcaaggggttaggactttgctatctctgagatgtctgctacttgctgcaaattctgcagctgtctgctgctctaaagagtacagtgcactagagggaagtgttccctttaaaaataagaacaactgtcctggctggagaatctcacaagcggaccagagatctttttaaatccctgctactgtcccttctcacaggcattcacagaacccttctgattcgtaagggttacgaaactcatgttcttctccagtcccctgtggtttctgttggagcataaggtttccagtaagcgggagggcagatccaactcagaaccatgcagataaggagcctctggcaaatgggtgctcatcagaacgcgtggattctctttcatggcagaatgctcttggactcggttctccaggcctgattccccgactccatcctttttcaggggttatttaaaaatctgccttagattctatagtgaagacaagcatttcaagaaagagttacctggatcagccatgctcagctgtgacgcctgaataactgtctactttatcttcactgaaccactcactctgtgtaaaggccaacagatttttaatgtggttttcatatcaaaagatcatgttgggattaacttgcctttttccccaaaaaataaactctcaggcaagcatttctttaaagctattaagggagtatatacttgagtacttattgaaatggacagtaataagcaaatgttcttataatgctacctgatttctatgaaatgtgtttgacaagccaaaattctaggatgtagaaatctggaaagttcatttcctgggattcacttctccagggattttttaaagttaatttgggaaattaacagcagttcactttattgtgagtctttgccacatttgactgaattgagctgtcatttgtacatttaaagcagctgttttggggtctgtgagagtacatgtattatatacaagcacaacagggcttgcactaaagaattgtcattgtaataacactacttggtagcctaacttcatatatgtattcttaattgcacaaaaagtcaataatttgtcaccttggggttttgaatgtttgctttaagtgttggctatttctatgttttataaaccaaaacaaaatttccaaaaacaatgaaggaaaccaaaataaatatttctgcatttca

SEQ ID NO: 342772 - DNA, 3305 bp, Homo sapiens
tcgagcgcgttaccgactgcatctgtgcctcaaccctatgaatgtttcatataaacaggttgcagaattgtcggagtgcataggctcagcactgatccagaagggcttcaagactgccccagatcagttcattggcatctttgctcaaaatagacctgagtgggtgattattgaacaaggatgctttgcttattcgatggtgatcgttccactttatgatacccttggaaatgaagccatcacgtacatagtcaacaaagctgaactctctctggtttttgttgacaagccagagaaggccaaactcttattagagggtgtagaaaataagttaataccaggccttaaaatcatagttgtcatggatgcctacggcagtgaactggtggaacgaggccagaggtgtggggtggaagtcaccagcatgaaggcgatggaggacctgggaagagccaacagacggaagcccaagcctccagcacctgaagatcttgcagtaatttgtttcacaagtggaactacaggcaaccccaaaggagcaatggtcactcaccgaaacatagtgagcgattgttcagcttttgtgaaagcaacagagaatacagtcaatccttgcccagatgatactttgatatctttcttgcctctcgcccatatgtttgagagagttgtagagtgtgtaatgctgtgtcatggagctaaaatcggatttttccaaggagatatcaggctgctcatggatgacctcaaggtgcttcaacccactgtcttccccgtggttccaagactgctgaaccggatgtttgaccgaattttcggacaagcaaacaccacgctgaagcgatggctcttggactttgcctccaagaggaaagaagcagagcttcgcagcggcatcatcagaaacaacagcctgtgggaccggctgatcttccacaaagtacagtcgagcctgggcggaagagtccggctgatggtgacaggagccgccccggtgtctgccactgtgctgacgttcctcagagcagccctgggctgtcagttttatgaaggatacggacagacagagtgcactgccgggtgctgcctaaccatgcctggagactggaccgcaggccatgttggggccccgatgccgtgcaatttgataaaacttgttgatgtggaagaaatgaattacatggctgccgagggcgagggcgaggtgtgtgtgaaagggccaaatgtatttcagggctacttgaaggacccagcgaaaacagcagaagctttggacaaagacggctggttacacacaggggacattggaaaatggttaccaaatggcaccttgaaaattatcgaccggaaaaagcacatatttaagctggcacaaggagaatacatagcccctgaaaagattgaaaatatctacatgcgaagtgagcctgttgctcaggtgtttgtccacggagaaagcctgcaggcatttctcattgcaattgtggtaccagatgttgagacattatgttcctgggcccaaaagagaggatttgaagggtcgtttgaggaactgtgcagaaataaggatgtcaaaaaagctatcctcgaagatatggtgagacttgggaaggattctggtctgaaaccatttgaacaggtcaaaggcatcacattgcaccctgaattattttctatcgacaatggccttctgactccaacaatgaaggcgaaaaggccagagctgcggaactatttcaggtcgcagatagatgacctctattccactatcaaggtttagtgtgaagaagaaagctcagaggaaatggcacagttccacaatctcttctcctgctgatggccttcatgttgttaattttgaatacagcaagtgtagggaaggaagcgttcgtgtttgacttgtccattcggggttcttctcataggaatgctagaggaaacagaacactgccttacagtcacctcatgttgcagaccatgtttatggtaatacacactttccaaaatgagccttaaaaattgtaaaggggatactataaatgtgctaagttatttgagacttcctcagtttaaaaagtgggttttaaatcttctgtctccctgtttttctaatcaaggggttaggactttgctatctctgagatgtctgctacttgctgcaaattctgcagctgtctgctgctctaaagagtacagtgcactagagggaagtgttccctttaaaaataagaacaactgtcctggctggagaatctcacaagcggaccagagatctttttaaatccctgctactgtcccttctcacaggcattcacagaacccttctgattcgtaagggttacgaaactcatgttcttctccagtcccctgtggtttctgttggagcataaggtttccagtaagcgggagggcagatccaactcagaaccatgcagataaggagcctctggcaaatgggtgctcatcagaacgcgtggattctctttcatggcagaatgctcttggactcggttctccaggcctgattccccgactccatcctttttcaggggttatttaaaaatctgccttagattctatagtgaagacaagcatttcaagaaagagttacctggatcagccatgctcagctgtgacgcctgaataactgtctactttatcttcactgaaccactcactctgtgtaaaggccaacagatttttaatgtggttttcatatcaaaagatcatgttgggattaacttgcctttttccccaaaaaataaactctcaggcaagcatttctttaaagctattaagggagtatatacttgagtacttattgaaatggacagtaataagcaaatgttcttataatgctacctgatttctatgaaatgtgtttgacaagccaaaattctaggatgtagaaatctggaaagttcatttcctgggattcacttctccagggattttttaaagttaatttgggaaattaacagcagttcactttattgtgagtctttgccacatttgactgaattgagctgtcatttgtacatttaaagcagctgttttggggtctgtgagagtacatgtattatatacaagcacaacagggcttgcactaaagaattgtcattgtaataacactacttggtagcctaacttcatatatgtattcttaattgcacaaaaagtcaataatttgtcaccttggggttttgaatgtttgctttaagtgttggctatttctatgttttataaaccaaaacaaaatttccaaaaacaatgaaggaaaccaaaataaatatttctgcatttca

SEQ ID NO: 342773 - DNA, 3791 bp, Homo sapiens
ccgcgggagggcggggccggcgcggcgagcgcaccagcagcatcctggctcagccgcggcggtggcgggggcgcaaccagcgggccgaggcggcggcgccagcggcgccttaaatagcatccagagccggcgcggggcagggagtgggctgcagtgacagccggcggcggagcggccggtccacggaggagaattcagcttagagaactatcaacacaggacaatgcaagcccatgagctgttccggtattttcgaatgccagagctggttgacttccgacagtacgtgcgtactcttccgaccaacacgcttatgggcttcggagcttttgcagcactcaccaccttctggtacgccacgagacccaaacccctgaagccgccatgcgacctctccatgcagtcagtggaagtggcgggtagtggtggtgcacgaagatccgcactacttgacagcgacgagcccttggtgtatttctatgatgatgtcacaacattatacgaaggtttccagaggggaatacaggtgtcaaataatggcccttgtttaggctctcggaaaccagaccaaccctatgaatggctttcatataaacaggttgcagaattgtcggagtgcataggctcagcactgatccagaagggcttcaagactgccccagatcagttcattggcatctttgctcaaaatagacctgagtgggtgattattgaacaaggatgctttgcttattcgatggtgatcgttccactttatgatacccttggaaatgaagccatcacgtacatagtcaacaaagctgaactctctctggtttttgttgacaagccagagaaggccaaactcttattagagggtgtagaaaataagttaataccaggccttaaaatcatagttgtcatggatgcctacggcagtgaactggtggaacgaggccagaggtgtggggtggaagtcaccagcatgaaggcgatggaggacctgggaagagccaacagacggaagcccaagcctccagcacctgaagatcttgcagtaatttgtttcacaagtggaactacaggcaaccccaaaggagcaatggtcactcaccgaaacatagtgagcgattgttcagcttttgtgaaagcaacagagaatacagtcaatccttgcccagatgatactttgatatctttcttgcctctcgcccatatgtttgagagagttgtagagtgtgtaatgctgtgtcatggagtgcttcaacccactgtcttccccgtggttccaagactgctgaaccggatgtttgaccgaattttcggacaagcaaacaccacgctgaagcgatggctcttggactttgcctccaagaggaaagaagcagagcttcgcagcggcatcatcagaaacaacagcctgtgggaccggctgatcttccacaaagtacagtcgagcctgggcggaagagtccggctgatggtgacaggagccgccccggtgtctgccactgtgctgacgttcctcagagcagccctgggctgtcagttttatgaaggatacggacagacagagtgcactgccgggtgctgcctaaccatgcctggagactggaccgcaggccatgttggggccccgatgccgtgcaatttgataaaacttgttgatgtggaagaaatgaattacatggctgccgagggcgagggcgaggtgtgtgtgaaagggccaaatgtatttcagggctacttgaaggacccagcgaaaacagcagaagctttggacaaagacggctggttacacacaggggacattggaaaatggttaccaaatggcaccttgaaaattatcgaccggaaaaagcacatatttaagctggcacaaggagaatacatagcccctgaaaagattgaaaatatctacatgcgaagtgagcctgttgctcaggtgtttgtccacggagaaagcctgcaggcatttctcattgcaattgtggtaccagatgttgagacattatgttcctgggcccaaaagagaggatttgaagggtcgtttgaggaactgtgcagaaataaggatgtcaaaaaagctatcctcgaagatatggtgagacttgggaaggattctggtctgaaaccatttgaacaggtcaaaggcatcacattgcaccctgaattattttctatcgacaatggccttctgactccaacaatgaaggcgaaaaggccagagctgcggaactatttcaggtcgcagatagatgacctctattccactatcaaggtttagtgtgaagaagaaagctcagaggaaatggcacagttccacaatctcttctcctgctgatggccttcatgttgttaattttgaatacagcaagtgtagggaaggaagcgttcgtgtttgacttgtccattcggggttcttctcataggaatgctagaggaaacagaacactgccttacagtcacctcatgttgcagaccatgtttatggtaatacacactttccaaaatgagccttaaaaattgtaaaggggatactataaatgtgctaagttatttgagacttcctcagtttaaaaagtgggttttaaatcttctgtctccctgtttttctaatcaaggggttaggactttgctatctctgagatgtctgctacttgctgcaaattctgcagctgtctgctgctctaaagagtacagtgcactagagggaagtgttccctttaaaaataagaacaactgtcctggctggagaatctcacaagcggaccagagatctttttaaatccctgctactgtcccttctcacaggcattcacagaacccttctgattcgtaagggttacgaaactcatgttcttctccagtcccctgtggtttctgttggagcataaggtttccagtaagcgggagggcagatccaactcagaaccatgcagataaggagcctctggcaaatgggtgctcatcagaacgcgtggattctctttcatggcagaatgctcttggactcggttctccaggcctgattccccgactccatcctttttcaggggttatttaaaaatctgccttagattctatagtgaagacaagcatttcaagaaagagttacctggatcagccatgctcagctgtgacgcctgaataactgtctactttatcttcactgaaccactcactctgtgtaaaggccaacagatttttaatgtggttttcatatcaaaagatcatgttgggattaacttgcctttttccccaaaaaataaactctcaggcaagcatttctttaaagctattaagggagtatatacttgagtacttattgaaatggacagtaataagcaaatgttcttataatgctacctgatttctatgaaatgtgtttgacaagccaaaattctaggatgtagaaatctggaaagttcatttcctgggattcacttctccagggattttttaaagttaatttgggaaattaacagcagttcactttattgtgagtctttgccacatttgactgaattgagctgtcatttgtacatttaaagcagctgttttggggtctgtgagagtacatgtattatatacaagcacaacagggcttgcactaaagaattgtcattgtaataacactacttggtagcctaacttcatatatgtattcttaattgcacaaaaagtcaataatttgtcaccttggggttttgaatgtttgctttaagtgttggctatttctatgttttataaaccaaaacaaaatttccaaaaacaatgaaggaaaccaaaataaatatttctgcatttca

SEQ ID NO: 342774 - DNA, 3439 bp, Homo sapiens
ccgcgggagggcggggccggcgcggcgagcgcaccagcagcatcctggctcagccgcggcggtggcgggggcgcaaccagcgggccgaggcggcggcgccagcggcgccttaaatagcatccagagccggcgcggggcagggagtgggctgcagtgacagccggcggcggagcggccggtccacggaggagggtagtggtggtgcacgaagatccgcactacttgacagcgacgagcccttggtgtatttctatgatgatgtcacaacattatacgaaggtttccagaggggaatacaggtgtcaaataatggcccttgtttaggctctcggaaaccagaccaaccctatgaatggctttcatataaacaggttgcagaattgtcggagtgcataggctcagcactgatccagaagggcttcaagactgccccagatcagttcattggcatctttgctcaaaatagacctgagtgggtgattattgaacaaggatgctttgcttattcgatggtgatcgttccactttatgatacccttggaaatgaagccatcacgtacatagtcaacaaaggacctgggaagagccaacagacggaagcccaagcctccagcacctgaagatcttgcagtaatttgtttcacaagtggaactacaggcaaccccaaaggagcaatggtcactcaccgaaacatagtgagcgattgttcagcttttgtgaaagcaacagagaatacagtcaatccttgcccagatgatactttgatatctttcttgcctctcgcccatatgtttgagagagttgtagagtgtgtaatgctgtgtcatggagctaaaatcggatttttccaaggagatatcaggctgctcatggatgacctcaaggtgcttcaacccactgtcttccccgtggttccaagactgctgaaccggatgtttgaccgaattttcggacaagcaaacaccacgctgaagcgatggctcttggactttgcctccaagaggaaagaagcagagcttcgcagcggcatcatcagaaacaacagcctgtgggaccggctgatcttccacaaagtacagtcgagcctgggcggaagagtccggctgatggtgacaggagccgccccggtgtctgccactgtgctgacgttcctcagagcagccctgggctgtcagttttatgaaggatacggacagacagagtgcactgccgggtgctgcctaaccatgcctggagactggaccgcaggccatgttggggccccgatgccgtgcaatttgataaaacttgttgatgtggaagaaatgaattacatggctgccgagggcgagggcgaggtgtgtgtgaaagggccaaatgtatttcagggctacttgaaggacccagcgaaaacagcagaagctttggacaaagacggctggttacacacaggggacattggaaaatggttaccaaatggcaccttgaaaattatcgaccggaaaaagcacatatttaagctggcacaaggagaatacatagcccctgaaaagattgaaaatatctacatgcgaagtgagcctgttgctcaggtgtttgtccacggagaaagcctgcaggcatttctcattgcaattgtggtaccagatgttgagacattatgttcctgggcccaaaagagaggatttgaagggtcgtttgaggaactgtgcagaaataaggatgtcaaaaaagctatcctcgaagatatggtgagacttgggaaggattctggtctgaaaccatttgaacaggtcaaaggcatcacattgcaccctgaattattttctatcgacaatggccttctgactccaacaatgaaggcgaaaaggccagagctgcggaactatttcaggtcgcagatagatgacctctattccactatcaaggtttagtgtgaagaagaaagctcagaggaaatggcacagttccacaatctcttctcctgctgatggccttcatgttgttaattttgaatacagcaagtgtagggaaggaagcgttcgtgtttgacttgtccattcggggttcttctcataggaatgctagaggaaacagaacactgccttacagtcacctcatgttgcagaccatgtttatggtaatacacactttccaaaatgagccttaaaaattgtaaaggggatactataaatgtgctaagttatttgagacttcctcagtttaaaaagtgggttttaaatcttctgtctccctgtttttctaatcaaggggttaggactttgctatctctgagatgtctgctacttgctgcaaattctgcagctgtctgctgctctaaagagtacagtgcactagagggaagtgttccctttaaaaataagaacaactgtcctggctggagaatctcacaagcggaccagagatctttttaaatccctgctactgtcccttctcacaggcattcacagaacccttctgattcgtaagggttacgaaactcatgttcttctccagtcccctgtggtttctgttggagcataaggtttccagtaagcgggagggcagatccaactcagaaccatgcagataaggagcctctggcaaatgggtgctcatcagaacgcgtggattctctttcatggcagaatgctcttggactcggttctccaggcctgattccccgactccatcctttttcaggggttatttaaaaatctgccttagattctatagtgaagacaagcatttcaagaaagagttacctggatcagccatgctcagctgtgacgcctgaataactgtctactttatcttcactgaaccactcactctgtgtaaaggccaacagatttttaatgtggttttcatatcaaaagatcatgttgggattaacttgcctttttccccaaaaaataaactctcaggcaagcatttctttaaagctattaagggagtatatacttgagtacttattgaaatggacagtaataagcaaatgttcttataatgctacctgatttctatgaaatgtgtttgacaagccaaaattctaggatgtagaaatctggaaagttcatttcctgggattcacttctccagggattttttaaagttaatttgggaaattaacagcagttcactttattgtgagtctttgccacatttgactgaattgagctgtcatttgtacatttaaagcagctgttttggggtctgtgagagtacatgtattatatacaagcacaacagggcttgcactaaagaattgtcattgtaataacactacttggtagcctaacttcatatatgtattcttaattgcacaaaaagtcaataatttgtcaccttggggttttgaatgtttgctttaagtgttggctatttctatgttttataaaccaaaacaaaatttccaaaaacaatgaaggaaaccaaaataaatatttctgcatttca

SEQ ID NO: 342775 - DNA, 3792 bp, Homo sapiens
ccgcgggagggcggggccggcgcggcgagcgcaccagcagcatcctggctcagccgcggcggtggcgggggcgcaaccagcgggccgaggcggcggcgccagcggcgccttaaatagcatccagagccggcgcggggcagggagtgggctgcagtgacagccggcggcggagcggccggtccacggaggagaattcagcttagagaactatcaacacaggacaatgcaagcccatgagctgttccggtattttcgaatgccagagctggttgacttccgacagtacgtgcgtactcttccgaccaacacgcttatgggcttcggagcttttgcagcactcaccaccttctggtacgccacgagacccaaacccctgaagccgccatgcgacctctccatgcagtcagtggaagtggcgggtagtggtggtgcacgaagatccgcactacttgacagcgacgagcccttggtgtatttctatgatgatgtcacaacattatacgaaggtttccagaggggaatacaggtgtcaaataatggcccttgtttaggctctcggaaaccagaccaaccctatgaatggctttcatataaacaggttgcagaattgtcggagtgcataggctcagcactgatccagaagggcttcaagactgccccagatcagttcattggcatctttgctcaaaatagacctgagtgggtgattattgaacaaggatgctttgcttattcgatggtgatcgttccactttatgatacccttggaaatgaagccatcacgtacatagtcaacaaagctgaactctctctggtttttgttgacaagccagagaaggccaaactcttattagagggtgtagaaaataagttaataccaggccttaaaatcatagttgtcatggatgcctacggcagtgaactggtggaacgaggccagaggtgtggggtggaagtcaccagcatgaaggcgatggaggacctgggaagagccaacagacggaagcccaagcctccagcacctgaagatcttgcagtaatttgtttcacaagtggaactacaggcaaccccaaaggagcaatggtcactcaccgaaacatagtgagcgattgttcagcttttgtgaaagcaacagagaatacagtcaatccttgcccagatgatactttgatatctttcttgcctctcgcccatatgtttgagagagttgtagagtgtgtaatgctgtgtcatggagctaaaatcggatttttccaaggagatatcaggctgctcatggatgacctcaaggtgcttcaacccactgtcttccccgtggttccaagactgctgaaccggatgtttgaccgaattttcggacaagcaaacaccacgctgaagcgatggctcttggactttgcctccaagaggaaagaagcagagcttcgcagcggcatcatcagaaacaacagcctgtgggaccggctgatcttccacaaagtacagtcgagcctgggcggaagagtccggctgatggtgacaggagccgccccggtgtctgccactgtgctgacgttcctcagagcagccctgggctgtcagttttatgaaggatacggacagacagagtgcactgccgggtgctgcctaaccatgcctggagactggaccgcaggccatgttggggccccgatgccgtgcaatttgataaaacttgttgatgtggaagaaatgaattacatggctgccgagggcgagggcgaggtgtgtgtgaaagggccaaatgtatttcagggctacttgaaggacccagcgaaaacagcagaagctttggacaaagacggctggttacacacaggggacattggaaaatggttaccaaatggcaccttgaaaattatcgaccggaaaaagcacatatttaagctggcacaaggagaatacatagcccctgaaaagattgaaaatatctacatgcgaagtgagcctgttgctcaggtgtttgtccacggagaaagcctgcaggcatttctcattgcaattgtggtaccagatgttgagacattatgttcctgggcccaaaagagaggatttgaagggtcgtttgaggaactgtgcagaaataaggatgtcaaaaaagctatcctcgaagatatggtgagacttgggaaggattctggtctgaaaccatttgaacaggtcaaaggcatcacattgcaccctgaattattttctatcgacaatggccttctgactccaacaatgaaggcgaaaaggccagagctgcggaactatttcaggtcgcagatagatgacctctattccactatcaaggtttagtgtgaagaagaaagctcagaggaaatggcacagttccacaatctcttctcctgctgatggccttcatgttgttaattttgaatacagcaagtgtagggaaggaagcgttcgtgtttgacttgtccattcggggttcttctcataggaatgctagaggaaacagaacactgccttacagtcacctcatgttgcagaccatgtttatggtaatacacactttccaaaatgagccttaaaaattgtaaaggggatactataaatgtgctaagttatttgagacttcctcagtttgactttgctatctctgagatgtctgctacttgctgcaaattctgcagctgtctgctgctctaaagagtacagtgcactagagggaagtgttccctttaaaaataagaacaactgtcctggctggagaatctcacaagcggaccagagatctttttaaatccctgctactgtcccttctcacaggcattcacagaacccttctgattcgtaagggttacgaaactcatgttcttctccagtcccctgtggtttctgttggagcataaggtttccagtaagcgggagggcagatccaactcagaaccatgcagataaggagcctctggcaaatgggtgctcatcagaacgcgtggattctctttcatggcagaatgctcttggactcggttctccaggcctgattccccgactccatcctttttcaggggttatttaaaaatctgccttagattctatagtgaagacaagcatttcaagaaagagttacctggatcagccatgctcagctgtgacgcctgaataactgtctactttatcttcactgaaccactcactctgtgtaaaggccaacagatttttaatgtggttttcatatcaaaagatcatgttgggattaacttgcctttttccccaaaaaataaactctcaggcaagcatttctttaaagctattaagggagtatatacttgagtacttattgaaatggacagtaataagcaaatgttcttataatgctacctgatttctatgaaatgtgtttgacaagccaaaattctaggatgtagaaatctggaaagttcatttcctgggattcacttctccagggattttttaaagttaatttgggaaattaacagcagttcactttattgtgagtctttgccacatttgactgaattgagctgtcatttgtacatttaaagcagctgttttggggtctgtgagagtacatgtattatatacaagcacaacagggcttgcactaaagaattgtcattgtaataacactacttggtagcctaacttcatatatgtattcttaattgcacaaaaagtcaataatttgtcaccttggggttttgaatgtttgctttaagtgttggctatttctatgttttataaaccaaaacaaaatttccaaaaacaatgaaggaaaccaaaataaatatttctgcatttca

SEQ ID NO: 342776 - DNA, 3791 bp, Homo sapiens
ccgcgggagggcggggccggcgcggcgagcgcaccagcagcatcctggctcagccgcggcggtggcgggggcgcaaccagcgggccgaggcggcggcgccagcggcgccttaaatagcatccagagccggcgcggggcagggagtgggctgcagtgacagccggcggcggagcggccggtccacggaggagaattcagcttagagaactatcaacacaggacaatgcaagcccatgagctgttccggtattttcgaatgccagagctggttgacttccgacagtacgtgcgtactcttccgaccaacacgcttatgggcttcggagcttttgcagcactcaccaccttctggtacgccacgagacccaaacccctgaagccgccatgcgacctctccatgcagtcagtggaagtggcgggtagtggtggtgcacgaagatccgcactacttgacagcgacgagcccttggtgtatttctatgatgatgtcacaacattatacgaaggtttccagaggggaatacaggtgtcaaataatggcccttgtttaggctctcggaaaccagaccaaccctatgaatggctttcatataaacaggttgcagaattgtcggagtgcataggctcagcactgatccagaagggcttcaagactgccccagatcagttcattggcatctttgctcaaaatagacctgagtgggtgattattgaacaaggatgctttgcttattcgatggtgatcgttccactttatgatacccttggaaatgaagccatcacgtacatagtcaacaaagctgaactctctctggtttttgttgacaagccagagaaggccaaactcttattagagggtgtagaaaataagttaataccaggccttaaaatcatagttgtcatggatgcctacggcagtgaactggtggaacgaggccagaggtgtggggtggaagtcaccagcatgaaggcgatggaggacctgggaagagccaacagacggaagcccaagcctccagcacctgaagatcttgcagtaatttgtttcacaagtggaactacaggcaaccccaaaggagcaatggtcactcaccgaaacatagtgagcgattgttcagcttttgtgaaagcaacagagaatacagtcaatccttgcccagatgatactttgatatctttcttgcctctcgcccatatgtttgagagagttgtagagtgtgtaatgctgtgtcatggagctaaaatcggatttttccaaggagatatcaggctgctcatggatgacctcaaggtgcttcaacccactgtcttccccgtggttccaagactgctgaaccggatgtttgaccgaattttcggacaagcaaacaccacgctgaagcgatggctcttggactttgcctccaagaggaaagaagcagagcttcgcagcggcatcatcagaaacaacagcctgtgggaccggctgatcttccacaaagtacagtcgagcctgggcggaagagtccggctgatggtgacaggagccgccccggtgtctgccactgtgctgacgttcctcagagcagccctgggctgtcagttttatgaaggatacggacagacagagtgcactgccgggtgctgcctaaccatgcctggagactggaccgcaggccatgttggggccccgatgccgtgcaatttgataaaacttgttgatgtggaagaaatgaattacatggctgccgagggcgagggcgaggtgtgtgtgaaagggccaaatgtatttcagggctacttgaaggacccagcgaaaacagcagaagctttggacaaagacggctggttacacacaggggacattggaaaatggttaccaaatggcaccttgaaaattatcgaccggaaaaagcacatatttaagctggcacaaggagaatacatagcccctgaaaagattgaaaatatctacatgcgaagtgagcctgttgctcaggtgtttgtccacggagaaagcctgcaggcatttctcattgcaattgtggtaccagatgttgagacattatgttcctgggcccaaaagagaggatttgaagggtcgtttgaggaactgtgcagaaataaggatgtcaaaaaagctatcctcgaagatatggtgagacttgggaaggattctggtctgaaaccatttgaacaggtcaaaggcatcacattgcaccctgaattattttctatcgacaatggccttctgactccaacaatgaaggcgaaaaggccagagctgcggaactatttcaggtcgcagatagatgacctctattccactatcaaggtttagtgtgaagaagaaagctcagaggaaatggcacagttccacaatctcttctcctgctgatggccttcatgttgttaattttgaatacagcaagtgtagggaaggaagcgttcgtgtttgacttgtccattcggggttcttctcataggaatgctagaggaaacagaacactgccttacagtcacctcatgttgcagaccatgtttatggtaatacacactttccaaaatgagccttaaaaattgtaaaggggatactataaatgtgctaagttatttgagacttcctcagtttaaaaagtgggttttaaatcttctgtctccctgtttttctaatcaaggggttaggactttgctatctctgagatgtctgctacttgctgcaaattctgcagctgtctgctgctctaaagagtacagtgcactagagggaagtgttccctttaaaaataagaacaactgtcctggctggagaatctcacaagcggaccagagatctttttaaatccctgctactgtcccttctcacaggcattcacagaacccttctgattcgtaagggttacgaaactcatgttcttctccagtcccctgtggtttctgttggagcataaggtttccagtaagcgggagggcagatccaactcagaaccatgcagataaggagcctctggcaaatgggtgctcatcagaacgcgtggattctctttcatggcagaatgctcttggactcggttctccaggcctgattccccgactccatcctttttcaggggttatttaaaaatctgccttagattctatagtgaagacaagcatttcaagaaagagttacctggatcagccatgctcagctgtgacgcctgaataactgtctactttatcttcactgaaccactcactctgtgtaaaggccaacagatttttaatgtggttttcatatcaaaagatcatgttgggattaacttgcctttttccccaaaaaataaactctcaggcaagcatttctttaaagctattaagggagtatatacttgagtacttattgaaatggacagtaataagcaaatgttcttataatgctacctgatttctatgaaatgtgtttgacaagccaaggattttttaaagttaatttgggaaattaacagcagttcactttattgtgagtctttgccacatttgactgaattgagctgtcatttgtacatttaaagcagctgttttggggtctgtgagagtacatgtattatatacaagcacaacagggcttgcactaaagaattgtcattgtaataacactacttggtagcctaacttcatatatgtattcttaattgcacaaaaagtcaataatttgtcaccttggggttttgaatgtttgctttaagtgttggctatttctatgttttataaaccaaaacaaaatttccaaaaacaatgaaggaaaccaaaataaatatttctgcatttca

SEQ ID NO: 342777 - DNA, 3637 bp, Homo sapiens
ccgcgggagggcggggccggcgcggcgagcgcaccagcagcatcctggctcagccgcggcggtggcgggggcgcaaccagcgggccgaggcggcggcgccagcggcgccttaaatagcatccagagccggcgcggggcagggagtgggctgcagtgacagccggcggcggagcggccggtccacggaggagaattcagcttagagaactatcaacacaggacaatgcaagcccatgagctgttccggtattttcgaatgccagagctggttgacttccgacagtacgtgcgtactcttccgaccaacacgcttatgggcttcggagcttttgcagcactcaccaccttctggtacgccacgagacccaaacccctgaagccgccatgcgacctctccatgcagtcagtggaagtggcgggtagtggtggtgcacgaagatccgcactacttgacagcgacgagcccttggtgtatttctatgatgatgtcacaacattatacgaaggtttccagaggggaatacaggtgtcaaataatggcccttgtttaggctctcggaaaccagaccaaccctatgaatggctttcatataaacaggttgcagaattgtcggagtgcataggctcagcactgatccagaagggcttcaagactgccccagatcagttcattggcatctttgctcaaaatagacctgagtgggtgattattgaacaaggatgctttgcttattcgatggtgatcgttccactttatgatacccttggaaatgaagccatcacgtacatagtcaacaaagctgaactctctctggtttttgttgacaagccagagaaggccaaactcttattagagggtgtagaaaataagttaataccaggccttaaaatcatagttgtcatggatgcctacggcagtgaactggtggaacgaggccagaggtgtggggtggaagtcaccagcatgaaggcgatggaggacctgggaagagccaacagacggaagcccaagcctccagcacctgaagatcttgcagtaatttgtttcacaagtggaactacaggcaaccccaaaggagcaatggtcactcaccgaaacatagtgagcgattgttcagcttttgtgaaagcaacagagaatacagtcaatccttgcccagatgatactttgatatctttcttgcctctcgcccatatgtttgagagagttgtagagtgtgtaatgctgtgtcatggagctaaaatcggatttttccaaggagatatcaggctgctcatggatgacctcaaggtgcttcaacccactgtcttccccgtggttccaagactgctgaaccggatgtttgaccgaattttcggacaagcaaacaccacgctgaagcgatggctcttggactttgcctccaagaggaaagaagcagagcttcgcagcggcatcatcagaaacaacagcctgtgggaccggctgatcttccacaaagtacagtcgagcctgggcggaagagtccggctgatggtgacaggagccgccccggtgtctgccactgtgctgacgttcctcagagcagccctgggctgtcagttttatgaaggatacggacagacagagtgcactgccgggtgctgcctaaccatgcctggagactggaccgcaggccatgttggggccccgatgccgtgcaatttgataaaacttgttgatgtggaagaaatgaattacatggctgccgagggcgagggcgaggtgtgtgtgaaagggccaaatgtatttcagggctacttgaaggacccagcgaaaacagcagaagctttggacaaagacggctggttacacacaggggacattggaaaatggttaccaaatggcaccttgaaaattatcgaccggaaaaagcacatatttaagctggcacaaggagaatacatagcccctgaaaagattgaaaatatctacatgcgaagtgagcctgttgctcaggtgtttgtccacggagaaagcctgcaggcatttctcattgcaattgtggtaccagatgttgagacattatgttcctgggcccaaaagagaggatttgaagggtcgtttgaggaactgtgcagaaataaggatgtcaaaaaagctatcctcgaagatatggtgagacttgggaaggattctggtctgaaaccatttgaacaggtcaaaggcatcacattgcaccctgaattattttctatcgacaatggccttctgactccaacaatgaaggcgaaaaggccagagctgcggaactatttcaggtcgcagatagatgacctctattccactatcaaggtttagtgtgaagaagaaagctcagaggaaatggcacagttccacaatctcttctcctgctgatggccttcatgttgttaattttgaatacagcaagtgtagggaaggaagcgttcgtgtttgacttgtccattcggggttcttctcataggaatgctagaggaaacagaacactgccttacagtcacctcatgttgcagaccatgtttatggtaatacacactttccaaaatgagcttaaaaataagaacaactgtcctggctggagaatctcacaagcggaccagagatctttttaaatccctgctactgtcccttctcacaggcattcacagaacccttctgattcgtaagggttacgaaactcatgttcttctccagtcccctgtggtttctgttggagcataaggtttccagtaagcgggagggcagatccaactcagaaccatgcagataaggagcctctggcaaatgggtgctcatcagaacgcgtggattctctttcatggcagaatgctcttggactcggttctccaggcctgattccccgactccatcctttttcaggggttatttaaaaatctgccttagattctatagtgaagacaagcatttcaagaaagagttacctggatcagccatgctcagctgtgacgcctgaataactgtctactttatcttcactgaaccactcactctgtgtaaaggccaacagatttttaatgtggttttcatatcaaaagatcatgttgggattaacttgcctttttccccaaaaaataaactctcaggcaagcatttctttaaagctattaagggagtatatacttgagtacttattgaaatggacagtaataagcaaatgttcttataatgctacctgatttctatgaaatgtgtttgacaagccaaaattctaggatgtagaaatctggaaagttcatttcctgggattcacttctccagggattttttaaagttaatttgggaaattaacagcagttcactttattgtgagtctttgccacatttgactgaattgagctgtcatttgtacatttaaagcagctgttttggggtctgtgagagtacatgtattatatacaagcacaacagggcttgcactaaagaattgtcattgtaataacactacttggtagcctaacttcatatatgtattcttaattgcacaaaaagtcaataatttgtcaccttggggttttgaatgtttgctttaagtgttggctatttctatgttttataaaccaaaacaaaatttccaaaaacaatgaaggaaaccaaaataaatatttctgcatttca

SEQ ID NO: 342778 - DNA, 1640 bp, Homo sapiens
ccgcgggagggcggggccggcgcggcgagcgcaccagcagcatcctggctcagccgcggcggtggcgggggcgcaaccagcgggccgaggcggcggcgccagcggcgccttaaatagcatccagagccggcgcggggcagggagtgggctgcagtgacagccggcggcggagcggccggtccacggaggagaattcagcttagagaactatcaacacaggacaatgcaagcccatgagctgttccggtattttcgaatgccagagctggttgacttccgacagtacgtgcgtactcttccgaccaacacgcttatgggcttcggagcttttgcagcactcaccaccttctggtacgccacgagacccaaacccctgaagccgccatgcgacctctccatgcagtcagtggaagtggcgggtagtggtggtgcacgaagatccgcactacttgacagcgacgagcccttggtgtatttctatgatgatgtcacaacattatacgaaggtttccagaggggaatacaggtgtcaaataatggcccttgtttaggctctcggaaaccagaccaaccctatgaatggctttcatataaacaggttgcagaattgtcggagtgcataggctcagcactgatccagaagggcttcaagactgccccagatcagttcattggcatctttgctcaaaatagacctgagtgggtgattattgaacaaggatgctttgcttattcgatggtgatcgttccactttatgatacccttggaaatgaagccatcacgtacatagtcaacaaagctgaactctctctggtttttgttgacaagccagagaaggccaaactcttattagagggtgtagaaaataagttaataccaggccttaaaatcatagttgtcatggatgcctacggcagtgaactggtggaacgaggccagaggtgtggggtggaagtcaccagcatgaaggcgatggaggacctgggaagagccaacagacggaagcccaagcctccagcacctgaagatcttgcagtaatttgtttcacaagtggaactacaggcaaccccaaaggagcaatggtcactcaccgaaacatagtgagcgattgttcagcttttgtgaaagcaacagagaatacagtcaatccttgcccagatgatactttgatatctttcttgcctctcgcccatatgtttgagagagttgtagagtgtgtaatgctgtgtcatggagctaaaatcggatttttccaaggagatatcaggctgctcatggatgacctcaaggtgcttcaacccactgtcttccccgtggttccaagactgctgaaccggatgtttgaccgagtaagttccaagcagcgaagtcccaggactgagcactgacttggacgcaggggcttgggcttgaattgggctgtgccatgtgccatctgtatgaccctggacaatcctcccaatcttacagaacttcagtttactcatctgtaaagttagaatgcgtttacctctcagagtggctgataaggattataagagaaaatgcatgaacacactttgtaaaccatggtcacaacacaagcataatgtgggaggtcattttatttttacaataaacactttgagcctctgcttc

SEQ ID NO: 342779 - DNA, 1138 bp, Homo sapiens
ccgcgggagggcggggccggcgcggcgagcgcaccagcagcatcctggctcagccgcggcggtggcgggggcgcaaccagcgggccgaggcggcggcgccagcggcgccttaaatagcatccagagccggcgcggggcagggagtgggctgcagtgacagccggcggcggagcggccggtccacggaggagaattcagcttagagaactatcaacacaggacaatgcaagcccatgagctgttccggtattttcgaatgccagagctggttgacttccgacagtacgtgcgtactcttccgaccaacacgcttatgggcttcggagcttttgcagcactcaccaccttctggtacgccacgagacccaaacccctgaagccgccatgcgacctctccatgcagtcagtggaagtggcgggtagtggtggtgcacgaagatccgcactacttgacagcgacgagcccttggtgtatttctatgatgatgtcacaacattatacgaaggtttccagaggggaatacaggtgtcaaataatggcccttgtttaggctctcggaaaccagaccaaccctatgaatggctttcatataaacaggttgcagaattgtcggagtgcataggctcagcactgatccagaagggcttcaagactgccccagatcagttcattggcatctttgctcaaaatagacctgaggtatgaaccagtaggtacttgctatgcatgattttgagaattctcagatataagagcctaacttctgctagagaccagattttgtagtctgatttctactaaaagtatagctttacgttacaccttagaaagttacacatatgaaaacctcaaccagggccgctgggcacagtggctcacgcctgtaatcccagcactttgtgaggccaaggcgggtgggtcaccagaggtcgggagttccagaccagcctgaccaacatggagaaaccccatctctactaaaaatacaaaattagccaggcctggtggcacacatctgtaatcccagctactcgggaggctgaggcaggagaatcgcttgaatccgggaggcagaggttgcggtgagccaagattgtgccattgcactccagcctgggcaacaagagcgaaactccg

SEQ ID NO: 342780 - DNA, 329 bp, Homo sapiens
tttcttgtgaataaaaccttgtgttttaccaaaaaatctatcaataaaggaatacctgcatgttccctctccgtttctgtgtgcagcattgcttgctggctgagatacaagcctgccgtctggtcagctttgtttctggagttggggcccaatgctgcttctgactttttcctctccattttaggttgcagaattgtcggagtgcataggctcagcactgatccagaagggcttcaagactgccccagatcagttcattggcatctttgctcaaaatagacctgaggtatgaaccagtaggtacttgctatgcatgattttgagaattc

SEQ ID NO: 342781 - DNA, 3845 bp, Homo sapiens
ccgcgggagggcggggccggcgcggcgagcgcaccagcagcatcctggctcagccgcggcggtggcgggggcgcaaccagcgggccgaggcggcggcgccagcggcgccttaaatagcatccagagccggcgcggggcagggagtgggctgcagtgacagccggcggcggagcggccggtccacggaggagaattcagcttagagaactatcaacacaggacaatgcaagcccatgagctgttccggtattttcgaatgccagagctggttgacttccgacagtacgtgcgtactcttccgaccaacacgcttatgggcttcggagcttttgcagcactcaccaccttctggtacgccacgagacccaaacccctgaagccgccatgcgacctctccatgcagtcagtggaagtggcgggtagtggtggtgcacgaagatccgcactacttgacagcgacgagcccttggtgtatttctatgatgatgtcacaacattatacgaaggtttccagaggggaatacaggtgtcaaataatggcccttgtttaggctctcggaaaccagaccaaccctatgaatggctttcatataaacaggttgcagaattgtcggagtgcataggctcagcactgatccagaagggcttcaagactgccccagatcagttcattggcatctttgctcaaaatagacctgagtgggtgattattgaacaaggatgctttgcttattcgatggtgatcgttccactttatgatacccttggaaatgaagccatcacgtacatagtcaacaaagctgaactctctctggtttttgttgacaagccagagaaggccaaactcttattagagggtgtagaaaataagttaataccaggccttaaaatcatagttgtcatggatgcctacggcagtgaactggtggaacgaggccagaggtgtggggtggaagtcaccagcatgaaggcgatggaggacctgggaagagccaacagacggaagcccaagcctccagcacctgaagatcttgcagtaatttgtttcacaagtggaactacaggcaaccccaaaggagcaatggtcactcaccgaaacatagtgagcgattgttcagcttttgtgaaagcaacagagaatacagtcaatccttgcccagatgatactttgatatctttcttgcctctcgcccatatgtttgagagagttgtagagtgtgtaatgctgtgtcatggagctaaaatcggatttttccaaggagatatcaggctgctcatggatgacctcaaggtgcttcaacccactgtcttccccgtggttccaagactgctgaaccggatgtttgaccgaattttcggacaagcaaacaccacgctgaagcgatggctcttggactttgcctccaagaggaaagaagcagagcttcgcagcggcatcatcagaaacaacagcctgtgggaccggctgatcttccacaaagtacagtcgagcctgggcggaagagtccggctgatggtgacaggagccgccccggtgtctgccactgtgctgacgttcctcagagcagccctgggctgtcagttttatgaaggatacggacagacagagtgcactgccgggtgctgcctaaccatgcctggagactggaccgcaggccatgttggggccccgatgccgtgcaatttgataaaacttgttgatgtggaagaaatgaattacatggctgccgagggcgagggcgaggtgtgtgtgaaagggccaaatgtatttcagggctacttgaaggacccagcgaaaacagcagaagctttggacaaagacggctggttacacacaggggacattggaaaatggttaccaaatggcaccttgaaaattatcgaccggaaaaagcacatatttaagctggcacaaggagaatacatagcccctgaaaagattgaaaatatctacatgcgaagtgagcctgttgctcaggtgtttgtccacggagaaagcctgcaggcatttctcattgcaattgtggtaccagatgttgagacattatgttcctgggcccaaaagagaggatttgaagggtcgtttgaggaactgtgcagaaataaggatgtcaaaaaagctatcctcgaagatatggtgagacttgggaaggattctggtctgaaaccatttgaacaggtcaaaggcatcacattgcaccctgaattattttctatcgacaatggccttctgactccaacaatgaaggcgaaaaggccagagctgcggaactatttcaggtcgcagatagatgacctctattccactatcaaggtttagtgtgaagaagaaagctcagaggaaatggcacagttccacaatctcttctcctgctgatggccttcatgttgttaattttgaatacagcaagtgtagggaaggaagcgttcgtgtttgacttgtccattcggggttcttctcataggaatgctagaggaaacagaacactgccttacagtcacctcatgttgcagaccatgtttatggtaatacacactttccaaaatgagccttaaaaattgtaaaggggatactataaatgtgctaagttatttgagacttcctcagtttaaaaagtgggttttaaatcttctgtctccctgtttttctaatcaaggggttaggactttgctatctctgagatgtctgctacttgctgcaaattctgcagctgtctgctgctctaaagagtacagtgcactagagggaagtgttccctttaaaaataagaacaactgtcctggctggagaatctcacaagcggaccagagatctttttaaatccctgctactgtcccttctcacaggcattcacagaacccttctgattcgtaagggttacgaaactcatgttcttctccagtcccctgtggtttctgttggagcataaggtttccagtaagcgggagggcagatccaactcagaaccatgcagataaggagcctctggcaaatgggtgctcatcagaacgcgtggattctctttcatggcagaatgctcttggactcggttctccaggcctgattccccgactccatcctttttcaggggttatttaaaaatctgccttagattctatagtgaagacaagcatttcaagaaagagttacctggatcagccatgctcagctgtgacgcctgaataactgtctactttatcttcactgaaccactcactctgtgtaaaggccaacagatttttaatgtggttttcatatcaaaagatcatgttgggattaacttgcctttttccccaaaaaataaactctcaggcaagcatttctttaaagctattaagggagtatatacttgagtacttattgaaatggacagtaataagcaaatgttcttataatgctacctgatttctatgaaatgtgtttgacaagccaaaattctaggatgtagaaatctggaaagttcatttcctgggattcacttctccagggattttttaaagttaatttgggaaattaacagcagttcactttattgtgagtctttgccacatttgactgaattgagctgtcatttgtacatttaaagcagctgttttggggtctgtgagagtacatgtattatatacaagcacaacagggcttgcactaaagaattgtcattgtaataacactacttggtagcctaacttcatatatgtattcttaattgcacaaaaagtcaataatttgtcaccttggggttttgaatgtttgctttaagtgttggctatttctatgttttataaaccaaaacaaaatttccaaaaacaatgaaggaaaccaaaataaatatttctgcatttca

SEQ ID NO: 342782 - DNA, 3880 bp, Homo sapiens
ccgcgggagggcggggccggcgcggcgagcgcaccagcagcatcctggctcagccgcggcggtggcgggggcgcaaccagcgggccgaggcggcggcgccagcggcgccttaaatagcatccagagccggcgcggggcagggagtgggctgcagtgacagccggcggcggagcggccggtccacggaggagaattcagcttagagaactatcaacacaggacaatgcaagcccatgagctgttccggtattttcgaatgccagagctggttgacttccgacagtacgtgcgtactcttccgaccaacacgcttatgggcttcggagcttttgcagcactcaccaccttctggtacgccacgagacccaaacccctgaagccgccatgcgacctctccatgcagtcagtggaagtggcgggtagtggtggtgcacgaagatccgcactacttgacagcgacgagcccttggtgtatttctatgatgatgtcacaacattatacgaaggtttccagaggggaatacaggtgtcaaataatggcccttgtttaggctctcggaaaccagaccaaccctatgaatggctttcatataaacaggttgcagaattgtcggagtgcataggctcagcactgatccagaagggcttcaagactgccccagatcagttcattggcatctttgctcaaaatagacctgagtgggtgattattgaacaaggatgctttgcttattcgatggtgatcgttccactttatgatacccttggaaatgaagccatcacgtacatagtcaacaaagctgaactctctctggtttttgttgacaagccagagaaggccaaactcttattagagggtgtagaaaataagttaataccaggccttaaaatcatagttgtcatggatgcctacggcagtgaactggtggaacgaggccagaggtgtggggtggaagtcaccagcatgaaggcgatggaggacctgggaagagccaacagacggaagcccaagcctccagcacctgaagatcttgcagtaatttgtttcacaagtggaactacaggcaaccccaaaggagcaatggtcactcaccgaaacatagtgagcgattgttcagcttttgtgaaagcaacagagaatacagtcaatccttgcccagatgatactttgatatctttcttgcctctcgcccatatgtttgagagagttgtagagtgtgtaatgctgtgtcatggagctaaaatcggatttttccaaggagatatcaggctgctcatggatgacctcaaggtgcttcaacccactgtcttccccgtggttccaagactgctgaaccggatgtttgaccgaattttcggacaagcaaacaccacgctgaagcgatggctcttggactttgcctccaagaggaaagaagcagagcttcgcagcggcatcatcagaaacaacagcctgtgggaccggctgatcttccacaaagtacagtcgagcctgggcggaagagtccggctgatggtgacaggagccgccccggtgtctgccactgtgctgacgttcctcagagcagccctgggctgtcagttttatgaaggatacggacagacagagtgcactgccgggtgctgcctaaccatgcctggagactggaccgcaggccatgttggggccccgatgccgtgcaatttgataaaacttgttgatgtggaagaaatgaattacatggctgccgagggcgagggcgaggtgtgtgtgaaagggccaaatgtatttcagggctacttgaaggacccagcgaaaacagcagaagctttggacaaagacggctggttacacacaggggacattggaaaatggttaccaaatggcaccttgaaaattatcgaccggaaaaagcacatatttaagctggcacaaggagaatacatagcccctgaaaagattgaaaatatctacatgcgaagtgagcctgttgctcaggtgtttgtccacggagaaagcctgcaggcatttctcattgcaattgtggtaccagatgttgagacattatgttcctgggcccaaaagagaggatttgaagggtcgtttgaggaactgtgcagaaataaggatgtcaaaaaagctatcctcgaagatatggtgagacttgggaaggattctggtctgaaaccatttgaacaggtcaaaggcatcacattgcaccctgaattattttctatcgacaatggccttctgactccaacaatgaaggcgaaaaggccagagctgcggaactatttcaggtcgcagatagatgacctctattccactatcaaggtttagtgtgaagaagaaagctcagaggaaatggcacagttccacaatctcttctcctgctgatggccttcatgttgttaattttgaatacagcaagtgtagggaaggaagcgttcgtgtttgacttgtccattcggggttcttctcataggaatgctagaggaaacagaacactgccttacagtcacctcatgttgcagaccatgtttatggtaatacacactttccaaaatgagccttaaaaattgtaaaggggatactataaatgtgctaagttatttgagacttcctcagtttaaaaagtgggttttaaatcttctgtctccctgtttttctaatcaaggggttaggactttgctatctctgagatgtctgctacttgctgcaaattctgcagctgtctgctgctctaaagagtacagtgcactagagggaagtgttccctttaaaaataagaacaactgtcctggctggagaatctcacaagcggaccagagatctttttaaatccctgctactgtcccttctcacaggcattcacagaacccttctgattcgtaagggttacgaaactcatgttcttctccagtcccctgtggtttctgttggagcataaggtttccagtaagcgggagggcagatccaactcagaaccatgcagataaggagcctctggcaaatgggtgctcatcagaacgcgtggattctctttcatggcagaatgctcttggactcggttctccaggcctgattccccgactccatcctttttcaggggttatttaaaaatctgccttagattctatagtgaagacaagcatttcaagaaagagttacctggatcagccatgctcagctgtgacgcctgaataactgtctactttatcttcactgaaccactcactctgtgtaaaggccaacagatttttaatgtggttttcatatcaaaagatcatgttgggattaacttgcctttttccccaaaaaataaactctcaggcaagcatttctttaaagctattaagggagtatatacttgagtacttattgaaatggacagtaataagcaaatgttcttataatgctacctgatttctatgaaatgtgtttgacaagccaaaattctaggatgtagaaatctggaaagttcatttcctgggattcacttctccagggattttttaaagttaatttgggaaattaacagcagttcactttattgtgagtctttgccacatttgactgaattgagctgtcatttgtacatttaaagcagctgttttggggtctgtgagagtacatgtattatatacaagcacaacagggcttgcactaaagaattgtcattgtaataacactacttggtagcctaacttcatatatgtattcttaattgcacaaaaagtcaataatttgtcaccttggggttttgaatgtttgctttaagtgttggctatttctatgttttataaaccaaaacaaaatttccaaaaacaatgaaggaaaccaaaataaatatttctgcatttcaaaaaaaaaaacaaaacacaacaacaaacaacactt

SEQ ID NO: 342783 - DNA, 3435 bp, Homo sapiens
tggtcttgaactcctgggctcaactgattcccccaaccttggcctcccaaagtgctgggatcactggtgtgagtcagtgtgcctggccttaatttctttttaagaagggggcatgtgttttgttctcattctgaatcccttatagcacctggcacagagtagtagctaacacagatgttaattttgctgcgtcaaatgttttcactttgaatctctcttgagtattgttctccttattgattacatgatgacatcctgttttctctccctgacctttactgtttgtttagtgggtgattattgaacaaggatgctttgcttattcgatggtgatcgttccactttatgatacccttggaaatgaagccatcacgtacatagtcaacaaagctgaactctctctggtttttgttgacaagccagagaaggccaaactcttattagagggtgtagaaaataagttaataccaggccttaaaatcatagttgtcatggatgcctacggcagtgaactggtggaacgaggccagaggtgtggggtggaagtcaccagcatgaaggcgatggaggacctgggaagagccaacagacggaagcccaagcctccagcacctgaagatcttgcagtaatttgtttcacaagtggaactacaggcaaccccaaaggagcaatggtcactcaccgaaacatagtgagcgattgttcagcttttgtgaaagcaacagagaatacagtcaatccttgcccagatgatactttgatatctttcttgcctctcgcccatatgtttgagagagttgtagagtgtgtaatgctgtgtcatggagctaaaatcggatttttccaaggagatatcaggctgctcatggatgacctcaaggtgcttcaacccactgtcttccccgtggttccaagactgctgaaccggatgtttgaccgaattttcggacaagcaaacaccacgctgaagcgatggctcttggactttgcctccaagaggaaagaagcagagcttcgcagcggcatcatcagaaacaacagcctgtgggaccggctgatcttccacaaagtacagtcgagcctgggcggaagagtccggctgatggtgacaggagccgccccggtgtctgccactgtgctgacgttcctcagagcagccctgggctgtcagttttatgaaggatacggacagacagagtgcactgccgggtgctgcctaaccatgcctggagactggaccgcaggccatgttggggccccgatgccgtgcaatttgataaaacttgttgatgtggaagaaatgaattacatggctgccgagggcgagggcgaggtgtgtgtgaaagggccaaatgtatttcagggctacttgaaggacccagcgaaaacagcagaagctttggacaaagacggctggttacacacaggggacattggaaaatggttaccaaatggcaccttgaaaattatcgaccggaaaaagcacatatttaagctggcacaaggagaatacatagcccctgaaaagattgaaaatatctacatgcgaagtgagcctgttgctcaggtgtttgtccacggagaaagcctgcaggcatttctcattgcaattgtggtaccagatgttgagacattatgttcctgggcccaaaagagaggatttgaagggtcgtttgaggaactgtgcagaaataaggatgtcaaaaaagctatcctcgaagatatggtgagacttgggaaggattctggtctgaaaccatttgaacaggtcaaaggcatcacattgcaccctgaattattttctatcgacaatggccttctgactccaacaatgaaggcgaaaaggccagagctgcggaactatttcaggtcgcagatagatgacctctattccactatcaaggtttagtgtgaagaagaaagctcagaggaaatggcacagttccacaatctcttctcctgctgatggccttcatgttgttaattttgaatacagcaagtgtagggaaggaagcgttcgtgtttgacttgtccattcggggttcttctcataggaatgctagaggaaacagaacactgccttacagtcacctcatgttgcagaccatgtttatggtaatacacactttccaaaatgagccttaaaaattgtaaaggggatactataaatgtgctaagttatttgagacttcctcagtttaaaaagtgggttttaaatcttctgtctccctgtttttctaatcaaggggttaggactttgctatctctgagatgtctgctacttgctgcaaattctgcagctgtctgctgctctaaagagtacagtgcactagagggaagtgttccctttaaaaataagaacaactgtcctggctggagaatctcacaagcggaccagagatctttttaaatccctgctactgtcccttctcacaggcattcacagaacccttctgattcgtaagggttacgaaactcatgttcttctccagtcccctgtggtttctgttggagcataaggtttccagtaagcgggagggcagatccaactcagaaccatgcagataaggagcctctggcaaatgggtgctcatcagaacgcgtggattctctttcatggcagaatgctcttggactcggttctccaggcctgattccccgactccatcctttttcaggggttatttaaaaatctgccttagattctatagtgaagacaagcatttcaagaaagagttacctggatcagccatgctcagctgtgacgcctgaataactgtctactttatcttcactgaaccactcactctgtgtaaaggccaacagatttttaatgtggttttcatatcaaaagatcatgttgggattaacttgcctttttccccaaaaaataaactctcaggcaagcatttctttaaagctattaagggagtatatacttgagtacttattgaaatggacagtaataagcaaatgttcttataatgctacctgatttctatgaaatgtgtttgacaagccaaaattctaggatgtagaaatctggaaagttcatttcctgggattcacttctccagggattttttaaagttaatttgggaaattaacagcagttcactttattgtgagtctttgccacatttgactgaattgagctgtcatttgtacatttaaagcagctgttttggggtctgtgagagtacatgtattatatacaagcacaacagggcttgcactaaagaattgtcattgtaataacactacttggtagcctaacttcatatatgtattcttaattgcacaaaaagtcaataatttgtcaccttggggttttgaatgtttgctttaagtgttggctatttctatgttttataaaccaaaacaaaatttccaaaaacaatgaaggaaaccaaaataaatatttctgcatttca

SEQ ID NO: 342784 - DNA, 3791 bp, Homo sapiens
ccgcgggagggcggggccggcgcggcgagcgcaccagcagcatcctggctcagccgcggcggtggcgggggcgcaaccagcgggccgaggcggcggcgccagcggcgccttaaatagcatccagagccggcgcggggcagggagtgggctgcagtgacagccggcggcggagcggccggtccacggaggagaattcagcttagagaactatcaacacaggacaatgcaagcccatgagctgttccggtattttcgaatgccagagctggttgacttccgacagtacgtgcgtactcttccgaccaacacgcttatgggcttcggagcttttgcagcactcaccaccttctggtacgccacgagacccaaacccctgaagccgccatgcgacctctccatgcagtcagtggaagtggcgggtagtggtggtgcacgaagatccgcactacttgacagcgacgagcccttggtgtatttctatgatgatgtcacaacattatacgaaggtttccagaggggaatacaggtgtcaaataatggcccttgtttaggctctcggaaaccagaccaaccctatgaatggctttcatataaacaggttgcagaattgtcggagtgcataggctcagcactgatccagaagggcttcaagactgccccagatcagttcattggcatctttgctcaaaatagacctgagtgggtgattattgaacaaggatgctttgcttattcgatggtgatcgttccactttatgatacccttggaaatgaagccatcacgtacatagtcaacaaagctgaactctctctggtttttgttgacaagccagagaaggccaaactcttattagagggtgtagaaaataagttaataccaggccttaaaatcatagttgtcatggatgcctacggcagtgaactggtggaacgaggccagaggtgtggggtggaagtcaccagcatgaaggcgatggaggacctgggaagagccaacagacggaagcccaagcctccagcacctgaagatcttgcagtaatttgtttcacaagtggaactacaggcaaccccaaaggagcaatggtcactcaccgaaacatagtgagcgattgttcagcttttgtgaaagcaacagagaatacagtcaatccttgcccagatgatactttgatatctttcttgcctctcgcccatatgtttgagagagttgtagagtgtgtaatgctgtgtcatggagctaaaatcggatttttccaaggagatatcaggctgctcatggatgacctcaaggtgcttcaacccactgtcttccccgtggttccaagactgctgaaccggatgtttgaccgaattttcggacaagcaaacaccacgctgaagcgatggctcttggactttgcctccaagaggaaagaagcagagcttcgcagcggcatcatcagaaacaacagcctgtgggaccggctgatcttccacaaagtacagtcgagcctgggcggaagagtccggctgatggtgacaggagccgccccggtgtctgccactgtgctgacgttcctcagagcagccctgggctgtcagttttatgaaggatacggacagacagagtgcactgccgggtgctgcctaaccatgcctggagactggaccgcaggccatgttggggccccgatgccgtgcaatttgataaaacttgttgatgtggaagaaatgaattacatggctgccgagggcgagggcgaggtgtgtgtgaaagggccaaatgtatttcagggctacttgaaggacccagcgaaaacagcagaagctttggacaaagacggctggttacacacaggggacattggaaaatggttaccaaatggcaccttgaaaattatcgaccggaaaaagcacatatttaagctggcacaaggagaatacatagcccctgaaaagattgaaaatatctacatgcgaagtgagcctgttgctcaggtgtttgtccacggagaaagcctgcaggcatttctcattgcaattgtggtaccagatgttgagacattatgttcctgggcccaaaagagaggatttgaagggtcgtttgaggaactgtgcagaaataaggatgtcaaaaaagctatcctcgaagatatggtgagacttgggaaggattctggtctgaaaccatttgaacaggtcaaaggcatcacattgcaccctgaattattttctatcgacaatggccttctgactccaacaatgaaggcgaatatcaaggtttagtgtgaagaagaaagctcagaggaaatggcacagttccacaatctcttctcctgctgatggccttcatgttgttaattttgaatacagcaagtgtagggaaggaagcgttcgtgtttgacttgtccattcggggttcttctcataggaatgctagaggaaacagaacactgccttacagtcacctcatgttgcagaccatgtttatggtaatacacactttccaaaatgagccttaaaaattgtaaaggggatactataaatgtgctaagttatttgagacttcctcagtttaaaaagtgggttttaaatcttctgtctccctgtttttctaatcaaggggttaggactttgctatctctgagatgtctgctacttgctgcaaattctgcagctgtctgctgctctaaagagtacagtgcactagagggaagtgttccctttaaaaataagaacaactgtcctggctggagaatctcacaagcggaccagagatctttttaaatccctgctactgtcccttctcacaggcattcacagaacccttctgattcgtaagggttacgaaactcatgttcttctccagtcccctgtggtttctgttggagcataaggtttccagtaagcgggagggcagatccaactcagaaccatgcagataaggagcctctggcaaatgggtgctcatcagaacgcgtggattctctttcatggcagaatgctcttggactcggttctccaggcctgattccccgactccatcctttttcaggggttatttaaaaatctgccttagattctatagtgaagacaagcatttcaagaaagagttacctggatcagccatgctcagctgtgacgcctgaataactgtctactttatcttcactgaaccactcactctgtgtaaaggccaacagatttttaatgtggttttcatatcaaaagatcatgttgggattaacttgcctttttccccaaaaaataaactctcaggcaagcatttctttaaagctattaagggagtatatacttgagtacttattgaaatggacagtaataagcaaatgttcttataatgctacctgatttctatgaaatgtgtttgacaagccaaaattctaggatgtagaaatctggaaagttcatttcctgggattcacttctccagggattttttaaagttaatttgggaaattaacagcagttcactttattgtgagtctttgccacatttgactgaattgagctgtcatttgtacatttaaagcagctgttttggggtctgtgagagtacatgtattatatacaagcacaacagggcttgcactaaagaattgtcattgtaataacactacttggtagcctaacttcatatatgtattcttaattgcacaaaaagtcaataatttgtcaccttggggttttgaatgtttgctttaagtgttggctatttctatgttttataaaccaaaacaaaatttccaaaaacaatgaaggaaaccaaaataaatatttctgcatttca

SEQ ID NO: 342785 - DNA, 3788 bp, Homo sapiens
ccgcgggagggcggggccggcgcggcgagcgcaccagcagcatcctggctcagccgcggcggtggcgggggcgcaaccagcgggccgaggcggcggcgccagcggcgccttaaatagcatccagagccggcgcggggcagggagtgggctgcagtgacagccggcggcggagcggccggtccacggaggagaattcagcttagagaactatcaacacaggacaatgcaagcccatgagctgttccggtattttcgaatgccagagctggttgacttccgacagtacgtgcgtactcttccgaccaacacgcttatgggcttcggagcttttgcagcactcaccaccttctggtacgccacgagacccaaacccctgaagccgccatgcgacctctccatgcagtcagtggaagtggcgggtagtggtggtgcacgaagatccgcactacttgacagcgacgagcccttggtgtatttctatgatgatgtcacaacattatacgaaggtttccagaggggaatacaggtgtcaaataatggcccttgtttaggctctcggaaaccagaccaaccctatgaatggctttcatataaacaggttgcagaattgtcggagtgcataggctcagcactgatccagaagggcttcaagactgccccagatcagttcattggcatctttgctcaaaatagacctgagtgggtgattattgaacaaggatgctttgcttattcgatggtgatcgttccactttatgatacccttggaaatgaagccatcacgtacatagtcaacaaagctgaactctctctggtttttgttgacaagccagagaaggccaaactcttattagagggtgtagaaaataagttaataccaggccttaaaatcatagttgtcatggatgcctacggcagtgaactggtggaacgaggccagaggtgtggggtggaagtcaccagcatgaaggcgatggaggacctgggaagagccaacagacggaagcccaagcctccagcacctgaagatcttgcagtaatttgtttcacaagtggaactacaggcaaccccaaaggagcaatggtcactcaccgaaacatagtgagcgattgttcagcttttgtgaaagcaacagagaatacagtcaatccttgcccagatgatactttgatatctttcttgcctctcgcccatatgtttgagagagttgtagagtgtgtaatgctgtgtcatggagctaaaatcggatttttccaaggagatatcaggctgctcatggatgacctcaaggtgcttcaacccactgtcttccccgtggttccaagactgctgaaccggatgtttgaccgaattttcggacaagcaaacaccacgctgaagcgatggctcttggactttgcctccaagaggaaagaagcagagcttcgcagcggcatcatcagaaacaacagcctgtgggaccggctgatcttccacaaagtacagtcgagcctgggcggaagagtccggctgatggtgacaggagccgccccggtgtctgccactgtgctgacgttcctcagagcagccctgggctgtcagttttatgaaggatacggacagacagagtgcactgccgggtgctgcctaaccatgcctggagactggaccgcaggccatgttggggccccgatgccgtgcaatttgataaaacttgttgatgtggaagaaatgaattacatggctgccgagggcgagggcgaggtgtgtgtgaaagggccaaatgtatttcagggctacttgaaggacccagcgaaaacagcagaagctttggacaaagacggctggttacacacaggggacattggaaaatggttaccaaatggcaccttgaaaattatcgaccggaaaaagcacatatttaagctggcacaaggagaatacatagcccctgaaaagattgaaaatatctacatgcgaagtgagcctgttgctcaggtgtttgtccacggagaaagcctgcaggcatttctcattgcaattgtggtaccagatgttgagacattatgttcctgggcccaaaagagaggatttgaagggtcgtttgaggaactgtgcagaaataaggatgtcaaaaaagctatcctcgaagatatggtgagacttgggaaggattctggtctgaaaccatttgaacaggtcaaaggcatcacattgcaccctgaattattttctatcgacaatggccttctgactccaacaatgaaggcgaaaaggccagagctgcggaactatttcaggtcgcagatagatgacctctattccactatcaaggtttagtgtgaagaagaaagctcagaggaaatggcacagttccacaatctcttctcctgctgatggccttcatgttgttaattttgaatacagcaagtgtagggaaggaagcgttcgtgtttgacttgtccattcggggttcttctcataggaatgctagaggaaacagaacactgccttacagtcacctcatgttgcagaccatgtttatggtaatacacactttccaaaatgagccttaaaaattgtaaaggggatactataaatgtgctaagttatttgagacttcctcagtttaaaaagtgggttttaaatcttctgtctccctgtttttctaatcaaggggttaggactttgctatctctgagatgtctgctacttgctgcaaattctgcagctgtctgctgctctaaagagtacagtgcactagagggaagtgttcccttttaaatccctgctactgtcccttctcacaggcattcacagaacccttctgattcgtaagggttacgaaactcatgttcttctccagtcccctgtggtttctgttggagcataaggtttccagtaagcgggagggcagatccaactcagaaccatgcagataaggagcctctggcaaatgggtgctcatcagaacgcgtggattctctttcatggcagaatgctcttggactcggttctccaggcctgattccccgactccatcctttttcaggggttatttaaaaatctgccttagattctatagtgaagacaagcatttcaagaaagagttacctggatcagccatgctcagctgtgacgcctgaataactgtctactttatcttcactgaaccactcactctgtgtaaaggccaacagatttttaatgtggttttcatatcaaaagatcatgttgggattaacttgcctttttccccaaaaaataaactctcaggcaagcatttctttaaagctattaagggagtatatacttgagtacttattgaaatggacagtaataagcaaatgttcttataatgctacctgatttctatgaaatgtgtttgacaagccaaaattctaggatgtagaaatctggaaagttcatttcctgggattcacttctccagggattttttaaagttaatttgggaaattaacagcagttcactttattgtgagtctttgccacatttgactgaattgagctgtcatttgtacatttaaagcagctgttttggggtctgtgagagtacatgtattatatacaagcacaacagggcttgcactaaagaattgtcattgtaataacactacttggtagcctaacttcatatatgtattcttaattgcacaaaaagtcaataatttgtcaccttggggttttgaatgtttgctttaagtgttggctatttctatgttttataaaccaaaacaaaatttccaaaaacaatgaaggaaaccaaaataaatatttctgcatttca

SEQ ID NO: 342786 - DNA, 1290 bp, Homo sapiens
ccgcgggagggcggggccggcgcggcgagcgcaccagcagcatcctggctcagccgcggcggtggcgggggcgcaaccagcgggccgaggcggcggcgccagcggcgccttaaatagcatccagagccggcgcggggcagggagtgggctgcagtgacagccggcggcggagcggccggtccacggaggagaattcagcttagagaactatcaacacaggacaatgcaagcccatgagctgttccggtattttcgaatgccagagctggttgacttccgacagtacgtgcgtactcttccgaccaacacgcttatgggcttcggagcttttgcagcactcaccaccttctggtacgccacgagacccaaacccctgaagccgccatgcgacctctccatgcagtcagtggaagtggcgggtagtggtggtgcacgaagatccgcactacttgacagcgacgagcccttggtgtatttctatgatgatgtcacaacattatacgaaggtttccagaggggaatacaggtgtcaaataatggcccttgtttaggctctcggaaaccagaccaaccctatgaatggctttcatataaacaggttgcagaattgtcggagtgcataggctcagcactgatccagaagggcttcaagactgccccagatcagttcattggcatctttgctcaaaatagacctgagtgggtgattattgaacaaggatgctttgcttattcgatggtgatcgttccactttatgatacccttggaaatgaagccatcacgtacatagtcaacaaagctgaactctctctggtttttgttgacaagccagagaaggccaaactcttattagagggtgtagaaaataagttaataccaggccttaaaatcatagttgtcatggatgcctacggcagtgaactggtggaacgaggccagaggtgtggggtggaagtcaccagcatgaaggcgatggaggacctgggaagagccaacagacggaagcccaagcctccagcacctgaagatcttgcagtaatttgtttcacaagtggaactacaggcaaccccaaaggagcaatggtcactcaccgaaacatagtgagcgattgttcagcttttgtgaaagcaacagaggtaactttttgggatgtcgtcatctttcctcattgattgacattagtccttgagaatgaaagtgctgaaggtgggcaccagtgtgttaggtccatgtggcatttagaaacgatgtgacatatgggtaaggtcagaactttaggcccaagtcc

SEQ ID NO: 342787 - DNA, 519 bp, Homo sapiens
ttagatggctggccggtggaattttggagttctggagaggggtcctgcttccctggaacgaacgtgacatttttctctcccaacagaattcagcttagagaactatcaacacaggacaatgcaagcccatgagctgttccggtattttcgaatgccagagctggttgacttccgacagtacgtgcgtactcttccgaccaacacgcttatgggcttcggagcttttgcagcactcaccaccttctggtacgccacgagacccaaacccctgaagccgccatgcgacctctccatgcagtcagtggaagtggcggtgagtggagggcccagcctgcctcgtgcgttttctccgcatttccccagatgagctgagccctgttgaatgtgatagccatcaagatcaaatatttgtttataactgcactttgtaaatggaaatgtgccaaattactgatggtggtaaatagaggtacagggcaaaatataggcacagggacagatgagagggtgtcggttggg

SEQ ID NO: 342788 - DNA, 279 bp, Homo sapiens
cctcatctgtgaggtattttggggactcttccaccctagaatcggctggtctcttcggcttgttgggtgtatcctaatgacttaggaagttggatgtatgcttagatgagggtctgtttgaacactgggaggaaaatggcagttcatgtgtgaaaatggcggtttaattttcagaaaagtatctagtctgttggtcttggcttcagccctaagtcattaggataccctataaaggaacataggaaaaccctttcacgctcagtggggcctgcctctcaa

SEQ ID NO: 342789 - DNA, 427 bp, Homo sapiens
tgtactatgtgcaaagcatgctgagaaagtagggtagcagaatctaatcttttctggtcaaagaataccttgaaaccagataaaaggtataatctccagaaaaactcacattcacacaaaatttaacttacaaccttagctaataatattctcatatcatggctggaatggttgccattcatctaaatcccatttcttgtacaacccttgcaattttttgttcattttaaaaattattattttttagacacagggcctcactgtcgccaggttggagtgcagtggcgtgatcatagctcactgcagcctcaaactcctgggctcaagtgatcttcctgcctcagcctcccgagtagctgggactacaggcacatgccaccaagctgggctaatttttaattttttttttctgtagagatgggatctc

SEQ ID NO: 342790 - DNA, 4524 bp, Homo sapiens
tgccagaggagccgggacaccgagggaagaggccggagggagatcgcggaggggagggggcgggaggggggtggggtatcctgagtcgtccgtggtccggagtctggaaggccctagagcggcgccagtcgacccgcctcgccacaacttgcccagaccagacacgtttcatcctgcgccctgcaagaaggagccggcctgcctctctccgctttgctgctcctcggcctccgcgggcccggcccgcgtcagcagcgaccctggggtctgggtcccctgtgtcgcccccgcccgcctgcagcgcccggcacccgcccaggagcgcgcagctggggttctagggacgtatacttgagcaagagagaccacagctcttgttcccgctgatcctgcagcccagtggatggagtccagaatctacagacctgccaggaaagaaaaaaaaattcctgatgtctggtccaagcaggaattccccggtggattggggaatgtctggcttttcctcagcttattgatctctgtggtaaccactggaggcccccagaagacccatagaaatgagaggcctgaggtctacaagtcgctgctagaaatattttagcctctccaaagcccagaatgcagccccgacccaagtttgtaagggttctgggtgcacgctgaccctgcgcgggcagacgcgccctttgctccaggtccggacctgggcgctgctatagcaacgtcctggacgcccagaccttaggccgccgccgccgcggaagcgaggaacccggccttctcccgctcctgagggctgtggcggcggcggcccgggaggcggcccaggctgggtaaagaccgcccggctcctcctatgcaagctgaggcagcggattggttttcaagcatgcccttccagaagcatgtctactacccgctcgccagcggcccagaggggcccgacgtcgctgtggccgccgccgccgcgggtgcggcctccatggcctgtgcgccccccagcgcggcttcggggcccctgcccttcttccagttcaggccgcggctggagagtgtggactggcggcggctgagcgccatcgacgtggacaaggtggcgggggctgtggacgtgctgacgctgcaggagaacatcatgaacatcaccttctgcaagctggaagacgagaagtgcccacactgccagtcgggggtggacccggtgctgctgaagctcatccgtctggcgcagttcaccatcgagtacttgctgcactcacaagagttcctcacctcgcagctgcacaccctggaggagcggctgcgcctgagccactgcgacggcgagcagagcaagaagctgctcaccaagcaggcgggggagatcaagacgctcaaggaagagtgcaaacgccggaagaagatgatctccacccagcagctgatgatcgaggccaaagccaactattaccagtgccatttttgtgacaaggcctttatgaaccaagcttttctacaaagtcacattcaacgccgccacactgaagaaaattctcattttgagtatcagaaaaatgcacagattgagaagctccggagtgagatcgtcgtattgaaggaagagctgcagctcaccaggtctgagctagaggctgcacaccatgccagtgcagtcagattctccaaggaatatgaaatgcagaaaacaaaagaggaagactttttgaagttatttgacaggtggaaagaagaagaaaaggagaaactagttgatgaaatggaaaaagtcaaggagatgtttatgaaggaatttaaagaattaacttcgaagaattcagcattagaatatcaactgtcagaaatccagaagtccaatatgcagatcaagtccaacataggcacattaaaagatgcacacgagtttaaagaagaccgttctccatatccccaggatttccataatgtcatgcagcttcttgatagtcaggaaagcaaatggacagctcgagttcaagctattcatcaagaacacaagaaagagaagggtcggctcctgtcacatatagagaaacttcgaacctcaatgatagatgatctaaatgcaagcaatgttttctataagaaaaggatagaagagctagggcagagactccaggagcagaatgagctgattataactcagagacagcagattaaagactttacctgtaatccattaaacagtatcagtgaacccaaagtgaatgccccagccctgcacactttggaaactaaatcaagtctgccaatggtgcatgaacaggcattctcgtcgcacatactggaaccaatagaagaactttcagaggaagaaaaaggaagggaaaatgaacagaaattaaataacaacaaaatgcatttaaggaaagctttgaagagtaactcctccctcactaagggactaagaacaatggtggagcagaacttgatggagaaactggaaaccttggggattaatgcagatatacgtggcatttcaagtgatcagttgcatagagtactaaaaagtgtggaatcagaaagacataagcaagaaagagaaatacctaactttcatcaaattcgagaattccttgaacatcaagtcagctgtaaaattgaggagaaagcactactctcttcagatcagtgcagtgtttctcaaatggataccctttcaactggagaagtacccaaaatgatacaacttccttccaaaaacagacaactgattagacaaaaagctgtttctactgataggacatctgttccaaaaattaagaaaaatgtcatggaagatccttttcccagaaagtcttcaactattacgacccctccttttagttcagaggaggagcaggaggacgacgacctcatccgggcatacgcatccccaggcccacttcctgtgccgccaccacaaaacaagggcagcttcgggaagaacacagtgaaaagtgacgcggacgggaccgagggaagcgaaatcgaggacactgatgattctcccaagcccgcaggagtcgccgttaaaacacctactgaaaaagttgaaaagatgtttccacatcgcaaaaatgtgaacaaaccagtcggtggaactaatgtccctgagatgtttatcaaaaaagaagaattacaagaactaaagtgtgcggatgtggaggatgaagactgggacatatcatccctagaggaagagatatctttgggaaaaaaatctgggaaagaacagaaggaacctccacctgcgaaaaatgaaccacattttgctcatgtgctaaatgcctggggcgcatttaatcctaaggggccaaagggagaaggacttcaagaaaatgaatcaagcacattaaaaagcagcttagtaactgtgactgattggagcgacacttcagatgtctaattccacatgtcagaagattattccagaagccagcagtatttcagtatcacagtgtttcagtaatttgcctccatgattctagtgcttctgccttaccgtgtttcccacagcaacacagagactgattcaaagaacaatggtctctttaatggcacccaatacagtattgaaaatcagatcatcaacagtatttcgaagcatgtaaaggtgtttaagacttccgctgctgcttaaaaataacatgtcattgaagtcataaaaagttttttcttcagaaaggtactctagtgttaagtgtatttttttcaactaattttttagtgaattttttttaaacttacagcatgttttggtttgaattactaaaactttaaaaaatatttttcttatgtatgctgtcgtatcgtaggcgtttatattataaaattctgttagtagtcttaaaattgaattggtggaaccactaatccttaaaagttagtctggttatttttcatatagaagtaagtttaatccgagtgtggtggtgttcacctttaatcccagctacttgggaggctgaggtgggaggataacttgagcacaggagttcaagaccagcgtgggcaatatagcaagactccacccctccacaccccaaaaaagtaagtttaggattagaatatagctaggtccaatgttaaatacattttcctggagtacatttgtcacattcagctttgagccactgtaagcatgttactattaaatggttggttattttatatagcatattctttatcttggatattttatgaataaagtatagttattttaagtgccaattaatttatcagactaaatagaaaatatttgagccattactgaattcacatatgtatgtttttttttactatttaaaatacccaacatgtattatgaaatacctcaaaagtaatttagttacattcttaaacaatgacattgtcgaaagaaagttcttataagctgttttttgcatttttataacttggttatactatattctgtttccaagtaaccttttaactaaaagatttgttgggttttagatctcttttcatttgtcaaccttttcagtaaagccctctgttacatca

SEQ ID NO: 342791 - DNA, 1622 bp, Homo sapiens
tgccagaggagccgggacaccgagggaagaggccggagggagatcgcggaggggagggggcgggaggggggtggggtatcctgagtcgtccgtggtccggagtctggaaggccctagagcggcgccagtcgacccgcctcgccacaacttgcccagaccagacacgtttcatcctgcgccctgcaagaaggagccggcctgcctctctccgctttgctgctcctcggcctccgcgggcccggcccgcgtcagcagcgaccctggggtctgggtcccctgtgtcgcccccgcccgcctgcagcgcccggcacccgcccaggagcgcgcagctggggttctagggacgtatacttgagcaagagagaccacagctcttgttcccgctgatcctgcagcccagtggatggagtccagaatctacagacctgccaggaaagaaaaaaaaattcctgatgtctggtccaagcaggaattccccggtggattggggaatgtctggcttttcctcagcttattgatctctgtggtaaccactggaggcccccagaagacccatagaaatgagaggcctgaggtctacaagtcgctgctagaaatattttagcctctccaaagcccagaatgcagccccgacccaagtttgtaagggttctgggtgcacgctgaccctgcgcgggcagacgcgccctttgctccaggtccggacctgggcgctgctatagcaacgtcctggacgcccagaccttaggccgccgccgccgcggaagcgaggaacccggccttctcccgctcctgagggctgtggcggcggcggcccgggaggcggcccaggctgggtaaagaccgcccggctcctcctatgcaagctgaggcagcggattggttttcaagcatgcccttccagaagcatgtctactacccgctcgccagcggcccagaggggcccgacgtcgctgtggccgccgccgccgcgggtgcggcctccatggcctgtgcgccccccagcgcggcttcggggcccctgcccttcttccagttcaggccgcggctggagagtgtggactggcggcggctgagcgccatcgacgtggacaaggtggcgggggctgtggacgtgctgacgctgcaggagaacatcatgaacatcaccttctgcaagctggaagacgagaagtgcccacactgccagtcgggggtggacccggtgctgctgaagctcatccgtctggcgcagttcaccatcgagtacttgctgcactcacaagagttcctcacctcgcagctgcacaccctggaggagcggctgcgcctgagccactgcgacggcgagcagagcaagaagctgctcaccaagcaggcgggggagatcaagacgctcaaggaagagtgcaaacgccggaagaagatgatctccacccagcagctgatgatcgaggccaaagccaactattaccaggattgtcaaaatgatttgtcttacccagaaggcccaagagtgctgcatttcttcaactctatcaagtttgaaagacatattggatgaagaatattcttagtcacactttccctctgaactttttgatgtggttcctttgtcttctggcagtaaatgttgctgtgag

SEQ ID NO: 342792 - DNA, 333 bp, Homo sapiens
aggtcatctttgagattctgactttctactttggtttccatacctttcatgtctacactcacagacacatgtacatccattcagtcatgtgtacatctgcatagtatcagaaaaatgcacagattgagaagctccggagtgagatcgtcgtattgaaggaagagctgcagctcaccaggtctgagctagaggctgcacaccatgccagtgcagtcagattctccaaggtaccaggcagaattctgtggtattttaattacaattaactgtatgtaattcaattatgccatggactctaataaacagaggacacttaagagtttgtgaatttga

SEQ ID NO: 342793 - DNA, 3330 bp, Homo sapiens
attgagacaggcacctctaagaaaagcccagagtgccactgggtcaaagcaccctgtattattccttgttaccattattgctccctgaagagggctctcatgtatctatgtaggataatccaacctcaacacagcggctgaaagaatctgctaaaaaataattcagtgccccaaaatacactgggctccaaataaactaaagagcaaaaattggctcatgtggcatgaaacaagtaatcgtatcccaagtaagaggacagtttccttcgtgttatcaacaggactgtaccccataagtttccaggtacatttggtaagagatggtgttttaacacgattttctgttgcaacagagtatcagaaaaatgcacagattgagaagctccggagtgagatcgtcgtattgaaggaagagctgcagctcaccaggtctgagctagaggctgcacaccatgccagtgcagtcagattctccaaggaatatgaaatgcagaaaacaaaagaggaagactttttgaagttatttgacaggtggaaagaagaagaaaaggagaaactagttgatgaaatggaaaaagtcaaggagatgtttatgaaggaatttaaagaattaacttcgaagaattcagcattagaatatcaactgtcagaaatccagaagtccaatatgcagatcaagtccaacataggcacattaaaagatgcacacgagtttaaagaagaccgttctccatatccccaggatttccataatgtcatgcagcttcttgatagtcaggaaagcaaatggacagctcgagttcaagctattcatcaagaacacaagaaagagaagggtcggctcctgtcacatatagagaaacttcgaacctcaatgatagatgatctaaatgcaagcaatgttttctataagaaaaggatagaagagctagggcagagactccaggagcagaatgagctgattataactcagagacagcagattaaagactttacctgtaatccattaaacagtatcagtgaacccaaaggaaatcctttagcctggcaggcttttgaatctcagccagctgctccagctgtgcctatgaatgccccagccctgcacactttggaaactaaatcaagtctgccaatggtgcatggaagggaaaatgaacagaaattaaataacaacaaaatgcatttaaggaaagctttgaagagtaactcctccctcactaagggactaagaacaatggtggagcagaacttgatggagaaactggaaaccttggggattaatgcagatatacgtggcatttcaagtgatcagttgcatagagtactaaaaagtgtggaatcagaaagacataagcaagaaagagaaatacctaactttcatcaaattcgagaattccttgaacatcaagtcagctgtaaaattgaggagaaagcactactctcttcagatcagtgcagtgtttctcaaatggataccctttcaactggagaagtacccaaaatgatacaacttccttccaaaaacagacaactgattagacaaaaagctgtttctactgataggacatctgttccaaaaattaagaaaaatgtcatggaagatccttttcccagaaagtcttcaactattacgacccctccttttagttcagaggaggagcaggaggacgacgacctcatccgggcatacgcatccccaggcccacttcctgtgccgccaccacaaaacaagggcagcttcgggaagaacacagtgaaaagtgacgcggacgggaccgagggaagcgaaatcgaggacactgatgattctcccaagcccgcaggagtcgccgttaaaacacctactgaaaaagttgaaaagatgtttccacatcgcaaaaatgtgaacaaaccagtcggtggaactaatgtccctgagatgtttatcaaaaaagaagaattacaagaactaaagtgtgcggatgtggaggatgaagactgggacatatcatccctagaggaagagatatctttgggaaaaaaatctgggaaagaacagaaggaacctccacctgcgaaaaatgaaccacattttgctcatgtgctaaatgcctggggcgcatttaatcctaaggggccaaagggagaaggacttcaagaaaatgaatcaagcacattaaaaagcagcttagtaactgtgactgattggagcgacacttcagatgtctaattccacatgtcagaagattattccagaagccagcagtatttcagtatcacagtgtttcagtaatttgcctccatgattctagtgcttctgccttaccgtgtttcccacagcaacacagagactgattcaaagaacaatggtctctttaatggcacccaatacagtattgaaaatcagatcatcaacagtatttcgaagcatgtaaaggtgtttaagacttccgctgctgcttaaaaataacatgtcattgaagtcataaaaagttttttcttcagaaaggtactctagtgttaagtgtatttttttcaactaattttttagtgaattttttttaaacttacagcatgttttggtttgaattactaaaactttaaaaaatatttttcttatgtatgctgtcgtatcgtaggcgtttatattataaaattctgttagtagtcttaaaattgaattggtggaaccactaatccttaaaagttagtctggttatttttcatatagaagtaagtttaatccgagtgtggtggtgttcacctttaatcccagctacttgggaggctgaggtgggaggataacttgagcacaggagttcaagaccagcgtgggcaatatagcaagactccacccctccacaccccaaaaaagtaagtttaggattagaatatagctaggtccaatgttaaatacattttcctggagtacatttgtcacattcagctttgagccactgtaagcatgttactattaaatggttggttattttatatagcatattctttatcttggatattttatgaataaagtatagttattttaagtgccaattaatttatcagactaaatagaaaatatttgagccattactgaattcacatatgtatgtttttttttactatttaaaatacccaacatgtattatgaaatacctcaaaagtaatttagttacattcttaaacaatgacattgtcgaaagaaagttcttataagctgttttttgcatttttataacttggttatactatattctgtttccaagtaaccttttaactaaaagatttgttgggttttagatctcttttcatttgtcaaccttttcagtaaagccctctgttacatca

SEQ ID NO: 342794 - DNA, 4661 bp, Homo sapiens
  misc_feature (4543)..(4543): n is a, c, g, or t
tgccagaggagccgggacaccgagggaagaggccggagggagatcgcggaggggagggggcgggaggggggtggggtatcctgagtcgtccgtggtccggagtctggaaggccctagagcggcgccagtcgacccgcctcgccacaacttgcccagaccagacacgtttcatcctgcgccctgcaagaaggagccggcctgcctctctccgctttgctgctcctcggcctccgcgggcccggcccgcgtcagcagcgaccctggggtctgggtcccctgtgtcgcccccgcccgcctgcagcgcccggcacccgcccaggagcgcgcagctggggttctagggacgtatacttgagcaagagagaccacagctcttgttcccgctgatcctgcagcccagtggatggagtccagaatctacagacctgccaggaaagaaaaaaaaattcctgatgtctggtccaagcaggaattccccggtggattggggaatgtctggcttttcctcagcttattgatctctgtggtaaccactggaggcccccagaagacccatagaaatgagaggcctgaggtctacaagtcgctgctagaaatattttagcctctccaaagcccagaatgcagccccgacccaagtttgtaagggttctgggtgcacgctgaccctgcgcgggcagacgcgccctttgctccaggtccggacctgggcgctgctatagcaacgtcctggacgcccagaccttaggccgccgccgccgcggaagcgaggaacccggccttctcccgctcctgagggctgtggcggcggcggcccgggaggcggcccaggctgggtaaagaccgcccggctcctcctatgcaagctgaggcagcggattggttttcaagcatgcccttccagaagcatgtctactacccgctcgccagcggcccagaggggcccgacgtcgctgtggccgccgccgccgcgggtgcggcctccatggcctgtgcgccccccagcgcggcttcggggcccctgcccttcttccagttcaggccgcggctggagagtgtggactggcggcggctgagcgccatcgacgtggacaaggtggcgggggctgtggacgtgctgacgctgcaggagaacatcatgaacatcaccttctgcaagctggaagacgagaagtgcccacactgccagtcgggggtggacccggtgctgctgaagctcatccgtctggcgcagttcaccatcgagtacttgctgcactcacaagagttcctcacctcgcagctgcacaccctggaggagcggctgcgcctgagccactgcgacggcgagcagagcaagaagctgctcaccaagcaggcgggggagatcaagacgctcaaggaagagtgcaaacgccggaagaagatgatctccacccagcagctgatgatcgaggccaaagccaactattaccagtgccatttttgtgacaaggcctttatgaaccaagcttttctacaaagtcacattcaacgccgccacactgaagaaaattctcattttgagtatcagaaaaatgcacagattgagaagctccggagtgagatcgtcgtattgaaggaagagctgcagctcaccaggtctgagctagaggctgcacaccatgccagtgcagtcagattctccaaggaatatgaaatgcagaaaacaaaagaggaagactttttgaagttatttgacaggtggaaagaagaagaaaaggagaaactagttgatgaaatggaaaaagtcaaggagatgtttatgaaggaatttaaagaattaacttcgaagaattcagcattagaatatcaactgtcagaaatccagaagtccaatatgcagatcaagtccaacataggcacattaaaagatgcacacgagtttaaagaagaccgttctccatatccccaggatttccataatgtcatgcagcttcttgatagtcaggaaagcaaatggacagctcgagttcaagctattcatcaagaacacaagaaagagaagggtcggctcctgtcacatatagagaaacttcgaacctcaatgatagatgatctaaatgcaagcaatgttttctataagaaaaggatagaagagctagggcagagactccaggagcagaatgagctgattataactcagagacagcagattaaagactttacctgtaatccattaaacagtatcagtgaacccaaaggaaatcctttagcctggcaggcttttgaatctcagccagctgctccagctgtgcctatgaatgccccagccctgcacactttggaaactaaatcaagtctgccaatggtgcatggaagggaaaatgaacagaaattaaataacaacaaaatgcatttaaggaaagctttgaagagtaactcctccctcactaagggactaagaacaatggtggagcagaacttgatggagaaactggaaaccttggggattaatgcagatatacgtggcatttcaagtgatcagttgcatagagtactaaaaagtgtggaatcagaaagacataagcaagaaagagaaatacctaactttcatcaaattcgagaattccttgaacatcaagtcagctgtaaaattgaggagaaagcactactctcttcagatcagtgcagtgtttctcaaatggataccctttcaactggagaagtacccaaaatgatacaacttccttccaaaaacagacaactgattagacaaaaagctgtttctactgataggacatctgttccaaaaattaagaaaaatgtcatggaagatccttttcccagaaagtcttcaactattacgacccctccttttagttcagaggaggagcaggaggacgacgacctcatccgggcatacgcatccccaggcccacttcctgtgccgccaccacaaaacaagggcagcttcgggaagaacacagtgaaaagtgacgcggacgggaccgagggaagcgaaatcgaggacactgatgattctcccaagcccgcaggagtcgccgttaaaacacctactgaaaaagttgaaaagatgtttccacatcgcaaaaatgtgaacaaaccagtcggtggaactaatgtccctgagatgtttatcaaaaaagaagaattacaagaactaaagtgtgcggatgtggaggatgaagactgggacatatcatccctagaggaagagatatctttgggaaaaaaatctgggaaagaacagaaggaacctccacctgcgaaaaatgaaccacattttgctcatgtgctaaatgcctggggcgcatttaatcctaaggggccaaagggagaaggacttcaagaaaatgaatcaagcacattaaaaagcagcttagtaactgtgactgattggagcgacacttcagatgtctaattccacatgtcagaagattattccagaagccagcagtatttcagtatcacagtgtttcagtaatttgcctccatgattctagtgcttctgccttaccgtgtttcccacagcaacacagagactgattcaaagaacaatggtctctttaatggcacccaatacagtattgaaaatcagatcatcaacagtatttcgaagcatgtaaaggtgtttaagacttccgctgctgcttaaaaataacatgtcattgaagtcataaaaagttttttcttcagaaaggtactctagtgttaagtgtatttttttcaactaattttttagtgaattttttttaaacttacagcatgttttggtttgaattactaaaactttaaaaaatatttttcttatgtatgctgtcgtatcgtaggcgtttatattataaaattctgttagtagtcttaaaattgaattggtggaaccactaatccttaaaagttagtctggttatttttcatatagaagtaagtttaatccgagtgtggtggtgttcacctttaatcccagctacttgggaggctgaggtgggaggataacttgagcacaggagttcaagaccagcgtgggcaatatagcaagactccacccctccacaccccaaaaaagtaagtttaggattagaatatagctaggtccaatgttaaatacattttcctggagtacatttgtcacattcagctttgagccactgtaagcatgttactattaaatggttggttattttatatagcatattctttatcttggatattttatgaataaagtatagttattttaagtgccaattaatttatcagactaaatagaaaatatttgagccattactgaattcacatatgtatgtttttttttactatttaaaatacccaacatgtattatgaaatacctcaaaagtaatttagttacattcttaaacaatgacattgtcgaaagaaagttcttataagctgttttttgcatttttataacttggttatactatattctgtttccaagtaaccttttaactaaaagatttgttgggttttagatctcttttcatttgtcaaccttttcagtaaagccctctgttacatcaaaaaaaaaacataatattaacntgaaaaataaagtaacaaatgtacaggttacaaagttttaataatattttagctggagttaatatcccgcctttatttgggtttggcccaggcacaagaggtagatttgacccctccc

SEQ ID NO: 342795 - DNA, 4521 bp, Homo sapiens
  misc_feature (4056)..(4057): n is a, c, g, or t
  misc_feature (4059)..(4059): n is a, c, g, or t
  misc_feature (4063)..(4063): n is a, c, g, or t
  misc_feature (4065)..(4065): n is a, c, g, or t
  misc_feature (4067)..(4067): n is a, c, g, or t
  misc_feature (4069)..(4069): n is a, c, g, or t
  misc_feature (4073)..(4073): n is a, c, g, or t
  misc_feature (4075)..(4075): n is a, c, g, or t
  misc_feature (4082)..(4082): n is a, c, g, or t
  misc_feature (4086)..(4086): n is a, c, g, or t
  misc_feature (4099)..(4099): n is a, c, g, or t
  misc_feature (4120)..(4120): n is a, c, g, or t
  misc_feature (4122)..(4122): n is a, c, g, or t
  misc_feature (4127)..(4127): n is a, c, g, or t
  misc_feature (4136)..(4137): n is a, c, g, or t
  misc_feature (4139)..(4139): n is a, c, g, or t
  misc_feature (4144)..(4144): n is a, c, g, or t
  misc_feature (4158)..(4158): n is a, c, g, or t
  misc_feature (4167)..(4167): n is a, c, g, or t
  misc_feature (4171)..(4171): n is a, c, g, or t
  misc_feature (4174)..(4174): n is a, c, g, or t
  misc_feature (4182)..(4183): n is a, c, g, or t
  misc_feature (4187)..(4187): n is a, c, g, or t
tgccagaggagccgggacaccgagggaagaggccggagggagatcgcggaggggagggggcgggaggggggtggggtatcctgagtcgtccgtggtccggagtctggaaggccctagagcggcgccagtcgacccgcctcgccacaacttgcccagaccagacacgtttcatcctgcgccctgcaagaaggagccggcctgcctctctccgctttgctgctcctcggcctccgcgggcccggcccgcgtcagcagcgaccctggggtctgggtcccctgtgtcgcccccgcccgcctgcagcgcccggcacccgcccaggagcgcgcagctggggttctagggacgtatacttgagcaagagagaccacagctcttgttcccgctgatcctgcagcccagtggatggagtccagaatctacagacctgccaggaaagaaaaaaaaattcctgatgtctggtccaagcaggaattccccggtggattggggaatgtctggcttttcctcagcttattgatctctgtggtaaccactggaggcccccagaagacccatagaaatgagaggcctgaggtctacaagtcgctgctagaaatattttagcctctccaaagcccagaatgcagccccgacccaagtttgtaagggttctgggtgcacgctgaccctgcgcgggcagacgcgccctttgctccaggtccggacctgggcgctgctatagcaacgtcctggacgcccagaccttaggccgccgccgccgcggaagcgaggaacccggccttctcccgctcctgagggctgtggcggcggcggcccgggaggcggcccaggctgggtaaagaccgcccggctcctcctatgcaagctgaggcagcggattggttttcaagcatgcccttccagaagcatgtctactacccgctcgccagcggcccagaggggcccgacgtcgctgtggccgccgccgccgcgggtgcggcctccatggcctgtgcgccccccagcgcggcttcggggcccctgcccttcttccagttcaggccgcggctggagagtgtggactggcggcggctgagcgccatcgacgtggacaaggtggcgggggctgtggacgtgctgacgctgcaggagaacatcatgaacatcaccttctgcaagctggaagacgagaagtgcccacactgccagtcgggggtggacccggtgctgctgaagctcatccgtctggcgcagttcaccatcgagtacttgctgcactcacaagagttcctcacctcgcagctgcacaccctggaggagcggctgcgcctgagccactgcgacggcgagcagagcaagaagctgctcaccaagcaggcgggggagatcaagacgctcaaggaagagtgcaaacgccggaagaagatgatctccacccagcagctgatgatcgaggccaaagccaactattaccagtgccatttttgtgacaaggcctttatgaaccaagcttttctacaaagtcacattcaacgccgccacactgaagaaaattctcattttgagtatcagaaaaatgcacagattgagaagctccggagtgagatcgtcgtattgaaggaagagctgcagctcaccaggtctgagctagaggctgcacaccatgccagtgcagtcagattctccaaggaatatgaaatgcagaaaacaaaagaggaagactttttgaagttatttgacaggtggaaagaagaagaaaaggagaaactagttgatgaaatggaaaaagtcaaggagatgtttatgaaggaatttaaagaattaacttcgaagaattcagcattagaatatcaactgtcagaaatccagaagtccaatatgcagatcaagtccaacataggcacattaaaagatgcacacgagtttaaagaagaccgttctccatatccccaggatttccataatgtcatgcagcttcttgatagtcaggaaagcaaatggacagctcgagttcaagctattcatcaagaacacaagaaagagaagggtcggctcctgtcacatatagagaaacttcgaacctcaatgatagatgatctaaatgcaagcaatgttttctataagaaaaggatagaagagctagggcagagactccaggagcagaatgagctgattataactcagagacagcagattaaagactttacctgtaatccattaaacagtatcagtgaacccaaaggaaatcctttagcctggcaggcttttgaatctcagccagctgctccagctgtgcctatgaatgccccagccctgcacactttggaaactaaatcaagtctgccaatggtgcatggaagggaaaatgaacagaaattaaataacaacaaaatgcatttaaggaaagctttgaagagtaactcctccctcactaagggactaagaacaatggtggagcagaacttgatggagaaactggaaaccttggggattaatgcagatatacgtggcatttcaagtgatcagttgcatagagtactaaaaagtgtggaatcagaaagacataagcaagaaagagaaatacctaactttcatcaaattcgagaattccttgaacatcaagtcagctgtaaaattgaggagaaagcactactctcttcagatcagtgcagtgtttctcaaatggataccctttcaactggagaagtacccaaaatgatacaacttccttccaaaaacagacaactgattagacaaaaagctgtttctactgataggacatctgttccaaaaattaagaaaaatgtcatggaagatccttttcccagaaagtcttcaactattacgacccctccttttagttcagaggaggagcaggaggacgacgacctcatccgggcatacgcatccccaggcccacttcctgtgccgccaccacaaaacaagggcagcttcgggaagaacacagtgaaaagtgacgcggacgggaccgagggaagcgaaatcgaggacactgatgattctcccaagcccgcaggagtcgccgttaaaacacctactgaaaaagttgaaaagatgtttccacatcgcaaaaatgtgaacaaaccagtcggtggaactaatgtccctgagatgtttatcaaaaaagaagaattacaagaactaaagtgtgcggatgtggaggatgaagactgggacatatcatccctagaggaagagatatctttgggaaaaaaatctgggaaagaacagaaggaacctccacctgcgaaaaatgaaccacattttgctcatgtgctaaatgcctggggcgcatttaatcctaaggggccaaagggagaaggacttcaagaaaatgaatcaagcacattaaaaagcagcttagtaactgtgactgattggagcgacacttcagatgtctaattccacatgtcagaagattattccagaagccagcagtatttcagtatcacagtgtttcagtaatttgcctccatgattctagtgcttctgccttaccgtgtttcccacagcaacacagagactgattcaaagaacaatggtctctttaatggcacccaatacagtattgaaaatcagatcatcaacagtatttcgaagcatgtaaaggtgtttaagacttccgctgctgcttaaaaataacatgtcattgaagtcataaaaagttttttcttcagaaaggtactctagtgttaagtgtatttttttcaactaattttttagtgaattttttttaaacttacagcatgttttggtttgaattactaaaactttaaaaaatatttttcttatgtatgctgtcgtatcgtaggcgtttatattataaaattctgttagtagtcttaaaattgaattggtggaaccactaatccttaaaagttagtctggttatttttcatatagaagtaagtttaatccgagtgtggtggtgttcacctttaatcccagctacttgggaggctgaggtgggaggataacttgagcacaggagttcaagaccagcgtgggcaatatagcaagactccacccctccacaccccccccccccccccccnngncccncncncngccngnccccctncccnacccccccccccngagcccccccgcccccccccncnctgcncccccctanncncgtcncccccaaatggtcngcccccccncatngcncacccccnncccnggatattttatgaataaagtatagttattttaagtgccaattaatttatcagactaaatagaaaatatttgagccattactgaattcacatatgtatgtttttttttactatttaaaatacccaacatgtattatgaaatacctcaaaagtaatttagttacattcttaaacaatgacattgtcgaaagaaagttcttataagctgttttttgcatttttataacttggttatactatattctgtttccaagtaaccttttaactaaaagatttgttgggttttagatctcttttcatttgtcaaccttttcagtaaagccctctgttacatca

SEQ ID NO: 342796 - DNA, 1827 bp, Homo sapiens
gccccaaaggacttgtgcccactgagaattacctgagaaaggtgccaccactttaagaggcacatctcttaatattataaatcctaaagcgttacgaaaacagcgcccctatctcggtgttgatttgtgtaggacccctccttttagttcagaggaggagcaggaggacgacgacctcatccgggcatacgcatccccaggcccacttcctgtgccgccaccacaaaacaagggcagcttcgggaagaacacagtgaaaagtgacgcggacgggaccgagggaagcgaaatcgaggacactgatgattctcccaagcccgcaggagtcgccgttaaaacacctactgaaaaagttgaaaagatgtttccacatcgcaaaaatgtgaacaaaccagtcggtggaactaatgtccctgagatgtttatcaaaaaagaagaattacaagaactaaagtgtgcggatgtggaggatgaagactgggacatatcatccctagaggaagagatatctttgggaaaaaaatctgggaaagaacagaaggaacctccacctgcgaaaaatgaaccacattttgctcatgtgctaaatgcctggggcgcatttaatcctaaggggccaaagggagaaggacttcaagaaaatgaatcaagcacattaaaaagcagcttagtaactgtgactgattggagcgacacttcagatgtctaattccacatgtcagaagattattccagaagccagcagtatttcagtatcacagtgtttcagtaatttgcctccatgattctagtgcttctgccttaccgtgtttcccacagcaacacagagactgattcaaagaacaatggtctctttaatggcacccaatacagtattgaaaatcagatcatcaacagtatttcgaagcatgtaaaggtgtttaagacttccgctgctgcttaaaaataacatgtcattgaagtcataaaaagttttttcttcagaaaggtactctagtgttaagtgtatttttttcaactaattttttagtgaattttttttaaacttacagcatgttttggtttgaattactaaaactttaaaaaatatttttcttatgtatgctgtcgtatcgtaggcgtttatattataaaattctgttagtagtcttaaaattgaattggtggaaccactaatccttaaaagttagtctggttatttttcatatagaagtaagtttaatccgagtgtggtggtgttcacctttaatcccagctacttgggaggctgaggtgggaggataacttgagcacaggagttcaagaccagcgtgggcaatatagcaagactccacccctccacaccccaaaaaagtaagtttaggattagaatatagctaggtccaatgttaaatacattttcctggagtacatttgtcacattcagctttgagccactgtaagcatgttactattaaatggttggttattttatatagcatattctttatcttggatattttatgaataaagtatagttattttaagtgccaattaatttatcagactaaatagaaaatatttgagccattactgaattcacatatgtatgtttttttttactatttaaaatacccaacatgtattatgaaatacctcaaaagtaatttagttacattcttaaacaatgacattgtcgaaagaaagttcttataagctgttttttgcatttttataacttggttatactatattctgtttccaagtaaccttttaactaaaagatttgttgggttttagatctcttttcatttgtcaaccttttcagtaaagccctctgttacatca

SEQ ID NO: 342797 - DNA, 3547 bp, Homo sapiens
tgccagaggagccgggacaccgagggaagaggccggagggagatcgcggaggggagggggcgggaggggggtggggtatcctgagtcgtccgtggtccggagtctggaaggccctagagcggcgccagtcgacccgcctcgccacaacttgcccagaccagacacgtttcatcctgcgccctgcaagaaggagccggcctgcctctctccgctttgctgctcctcggcctccgcgggcccggcccgcgtcagcagcgaccctggggtctgggtcccctgtgtcgcccccgcccgcctgcagcgcccggcacccgcccaggagcgcgcagctggggttctagggacgtatacttgagcaagagagaccacagctcttgttcccgctgatcctgcagcccagtggatggagtccagaatctacagacctgccaggaaagaaaaaaaaattcctgatgtctggtccaagcaggaattccccggtggattggggaatgtctggcttttcctcagcttattgatctctgtggtaaccactggaggcccccagaagacccatagaaatgagaggcctgaggtctacaagtcgctgctagaaatattttagcctctccaaagcccagaatgcagccccgacccaagtttgtaagggttctgggtgcacgctgaccctgcgcgggcagacgcgccctttgctccaggtccggacctgggcgctgctatagcaacgtcctggacgcccagaccttaggccgccgccgccgcggaagcgaggaacccggccttctcccgctcctgagggctgtggcggcggcggcccgggaggcggcccaggctgggtaaagaccgcccggctcctcctatgcaagctgaggcagcggattggttttcaagcatgcccttccagaagcatgtctactacccgctcgccagcggcccagaggggcccgacgtcgctgtggccgccgccgccgcgggtgcggcctccatggcctgtgcgccccccagcgcggcttcggggcccctgcccttcttccagttcaggccgcggctggagagtgtggactggcggcggctgagcgccatcgacgtggacaaggtggcgggggctgtggacgtgctgacgctgcaggagaacatcatgaacatcaccttctgcaagctggaagacgagaagtgcccacactgccagtcgggggtggacccggtgctgctgaagctcatccgtctggcgcagttcaccatcgagtacttgctgcactcacaagagttcctcacctcgcagctgcacaccctggaggagcggctgcgcctgagccactgcgacggcgagcagagcaagaagctgctcaccaagcaggcgggggagatcaagacgctcaaggaagagtgcaaacgccggaagaagatgatctccacccagcagctgatgatcgaggccaaagccaactattaccagtgccatttttgtgacaaggcctttatgaaccaagcttttctacaaagtcacattcaacgccgccacactgaagaaaattctcattttgagtatcagaaaaatgcacagattgagaagctccggagtgagatcgtcgtattgaaggaagagctgcagctcaccaggtctgagctagaggctgcacaccatgccagtgcagtcagattctccaaggaatatgaaatgcagaaaacaaaagaggaagactttttgaagttatttgacaggtggaaagaagaagaaaaggagaaactagttgatgaaatggaaaaagtcaaggagatgtttatgaaggaatttaaagaattaacttcgaagaattcagcattagaatatcaactgtcagaaatccagaagtccaatatgcagatcaagtccaacataggcacattaaaagatgcacacgagtttaaagaagaccgttctccatatccccaggatttccataatgtcatgcagcttcttgatagtcaggaaagcaaatggacagctcgagttcaagctattcatcaagaacacaagaaagagaagggtcggctcctgtcacatatagagaaacttcgaacctcaatgatagatgatctaaatgcaagcaatgttttctataagaaaaggatagaagagctagggcagagactccaggagcagaatgagctgattataactcagagacagcagattaaagactttacctgtaatccattaaacagtatcagtgaacccaaaggaaatcctttagcctggcaggcttttgaatctcagccagctgctccagctgtgcctatgaatgccccagccctgcacactttggaaactaaatcaagtctgccaatggtgcatggaagggaaaatgaacagaaattaaataacaacaaaatgcatttaaggaaagctttgaagagtaactcctccctcactaagggactaagaacaatggtggagcagaacttgatggagaaactggaaaccttggggattaatgcagatatacgtggcatttcaagtgatcagttgcatagagtactaaaaagtgtggaatcagaaagacataagcaagaaagagaaatacctaactttcatcaaattcgagaattccttgaacatcaagtcagctgtaaaattgaggagaaagcactactctcttcagatcagtgcagtgtttctcaaatggataccctttcaactggagaagtacccaaaatgatacaacttccttccaaaaacagacaactgattagacaaaaagctgtttctactgataggacatctgttccaaaaattaagaaaaatgtcatggaagatccttttcccagaaagtcttcaactattacgacccctccttttagttcagaggaggagcaggaggacgacgacctcatccgggcatacgcatccccaggcccacttcctgtgccgccaccacaaaacaagggcagcttcgggaagaacacagtgaaaagtgacgcggacgggaccgagggaagcgaaatcgaggacactgatgattctcccaagcccgcaggagtcgccgttaaaacacctactgaaaaagttgaaaagatgtttccacatcgcaaaaatgtgaacaaaccagtcggtggaactaatgtccctgagatgtttatcaaaaaagaagaattacaagaactaaaggtgaaatcacttttacttgctagatatacataaatttgtctttggacagcaccttaatggtcacactttttgtagtgaaatataaaacagatagttagctggtagagtagaggttgagattttcacctttcttgttctcagtattgcatttctttccattccatagacaaagatattggagtgataactgtaacaatacataataagcatgacactttacaggttttcaagatcctgtcacatgtattatctgatacttgcagatatcaaatggtttgtacaaagaaatttgtgactggccagaattggggcccttcagatcttcttcactaccctggcatgagaccttaggtacttttgagggtttagctccacttgggagccgaagtgagggtggag

SEQ ID NO: 342798 - DNA, 746 bp, Homo sapiens
aattcacatatgtatgtttttttttactatttaaaatacccaacatgtattatgaaatacctcaaaagtaatttagttacattcttaaacaatgacattgtcgaaagaaagttcttataagctgttttttgcatttttataacttggttatactatattctgtttccaagtaaccttttaactaaaagatttgttgggttttagatctcttttcatttgtcaaccttttcagtaaagccctctgttacatcactgtgactgtggctgtgttattagagatgaattctgagttaaatttgtacttattaggggtcttacagagggagaatctggccttgattgctatgccatatgacattctgtcctaatggttagaacaaatctttatctgtttccacccaccctgggatcctttttacttgtagcccattcctgccctctaaaagaatccttccaacttcctataggggccatttcatgcagatatactcactttatatgtatgtttctaaaagctttagtgaaggctgaatccaagtttcatgtagtaggacagagaacagaaggccgaatccaagtttcatgtggtaggacagagaacggcaatctacaaaactacaccaagcctaagatggcccatgtgccactttgttcattcatttatttattcagcagatatttattgaaccacttggtctggtttggttttgaacacgcactaattcatttaattacaacaactttgc

SEQ ID NO: 342799 - DNA, 399 bp, Homo sapiens
cccacttctttccttatggttcagtgttagatgctcagtctaaccaataaaatgattgagggacaccatttttttctaagcaacattaattattctccatgcctttcttttagtgtgcggatgtggaggatgaagactgggacatatcatccctagaggaagagatatctttgggaaaaaaatctgggaaagaacagaaggaacctccacctgcgaaaaatgaaccacattttgctcatgtgctaaatgcctggggcgcatttaatcctaaggggccaaagggagaaggtttgctgctttcccctctaatacaagctcgatccattttcttattagttgtgtttcatctttataaatatctaattaacttatgctggtatatcatcagacaaaaaagct

SEQ ID NO: 342800 - DNA, 4521 bp, Homo sapiens
tgccagaggagccgggacaccgagggaagaggccggagggagatcgcggaggggagggggcgggaggggggtggggtatcctgagtcgtccgtggtccggagtctggaaggccctagagcggcgccagtcgacccgcctcgccacaacttgcccagaccagacacgtttcatcctgcgccctgcaagaaggagccggcctgcctctctccgctttgctgctcctcggcctccgcgggcccggcccgcgtcagcagcgaccctggggtctgggtcccctgtgtcgcccccgcccgcctgcagcgcccggcacccgcccaggagcgcgcagctggggttctagggacgtatacttgagcaagagagaccacagctcttgttcccgctgatcctgcagcccagtggatggagtccagaatctacagacctgccaggaaagaaaaaaaaattcctgatgtctggtccaagcaggaattccccggtggattggggaatgtctggcttttcctcagcttattgatctctgtggtaaccactggaggcccccagaagacccatagaaatgagaggcctgaggtctacaagtcgctgctagaaatattttagcctctccaaagcccagaatgcagccccgacccaagtttgtaagggttctgggtgcacgctgaccctgcgcgggcagacgcgccctttgctccaggtccggacctgggcgctgctatagcaacgtcctggacgcccagaccttaggccgccgccgccgcggaagcgaggaacccggccttctcccgctcctgagggctgtggcggcggcggcccgggaggcggcccaggctgggtaaagaccgcccggctcctcctatgcaagctgaggcagcggattggttttcaagcatgcccttccagaagcatgtctactacccgctcgccagcggcccagaggggcccgacgtcgctgtggccgccgccgccgcgggtgcggcctccatggcctgtgcgccccccagcgcggcttcggggcccctgcccttcttccagttcaggccgcggctggagagtgtggactggcggcggctgagcgccatcgacgtggacaaggtggcgggggctgtggacgtgctgacgctgcaggagaacatcatgaacatcaccttctgcaagctggaagacgagaagtgcccacactgccagtcgggggtggacccggtgctgctgaagctcatccgtctggcgcagttcaccatcgagtacttgctgcactcacaagagttcctcacctcgcagctgcacaccctggaggagcggctgcgcctgagccactgcgacggcgagcagagcaagaagctgctcaccaagcaggcgggggagatcaagacgctcaaggaagagtgcaaacgccggaagaagatgatctccacccagcagctgatgatcgaggccaaagccaactattaccagtgccatttttgtgacaaggcctttatgaaccaagcttttctacaaagtcacattcaacgccgccacactgaagaaaattctcattttgagtatcagaaaaatgcacagattgagaagctccggagtgagatcgtcgtattgaaggaagagctgcagctcaccaggtctgagctagaggctgcacaccatgccagtgcagtcagattctccaaggaatatgaaatgcagaaaacaaaagaggaagactttttgaagttatttgacaggtggaaagaagaagaaaaggagaaactagttgatgaaatggaaaaagtcaaggagatgtttatgaaggaatttaaagaattaacttcgaagaattcagcattagaatatcaactgtcagaaatccagaagtccaatatgcagatcaagtccaacataggcacattaaaagatgcacacgagtttaaagaagaccgttctccatatccccaggatttccataatgtcatgcagcttcttgatagtcaggaaagcaaatggacagctcgagttcaagctattcatcaagaacacaagaaagagaagggtcggctcctgtcacatatagagaaacttcgaacctcaatgatagatgatctaaatgcaagcaatgttttctataagaaaaggatagaagagctagggcagagactccaggagcagaatgagctgattataactcagagacagcagattaaagactttacctgtaatccattaaacagtatcagtgaacccaaaggaaatcctttagcctggcaggcttttgaatctcagccagctgctccagctgtgcctatgaatgccccagccctgcacactttggaaactaaatcaagtctgccaatggtgcatggaagggaaaatgaacagaaattaaataacaacaaaatgcatttaaggaaagctttgaagagtaactcctccctcactaagggactaagaacaatggtggagcagaacttgatggagaaactggaaaccttggggattaatgcagatatacgtggcatttcaagtgatcagttgcatagagtactaaaaagtgtggaatcagaaagacataagcaagaaagagaaatacctaactttcatcaaattcgagaattccttgaacatcaagtcagctgtaaaattgaggagaaagcactactctcttcagatcagtgcagtgtttctcaaatggataccctttcaactggagaagtacccaaaatgatacaacttccttccaaaaacagacaactgattagacaaaaagctgtttctactgataggacatctgttccaaaaattaagaaaaatgtcatggaagatccttttcccagaaagtcttcaactattacgacccctccttttagttcagaggaggagcaggaggacgacgacctcatccgggcatacgcatccccaggcccacttcctgtgccgccaccacaaaacaagggcagcttcgggaagaacacagtgaaaagtgacgcggacgggaccgagggaagcgaaatcgaggacactgatgattctcccaagcccgcaggagtcgccgttaaaacacctactgaaaaagttgaaaagatgtttccacatcgcaaaaatgtgaacaaaccagtcggtggaactaatgtccctgagatgtttatcaaaaaagaagaattacaagaactaaagtgtgcggatgtggaggatgaagactgggacatatcatccctagaggaagagatatctttgggaaaaaaatctgggaaagaacagaaggaacctccacctgcgaaaaatgaaccacattttgctcatgtgctaaatgcctggggcgcatttaatcctaaggggccaaagggagaaggacttcaagaaaatgaatcaagcacattaaaaagcagcttagtaactgtgactgattggagcgacacttcagatgtctaattccacatgtcagaagattattccagaagccagcagtatttcagtatcacagtgtttcagtaatttgcctccatgattctagtgcttctgccttaccgtgtttcccacagcaacacagagactgattcaaagaacaatggtctctttaatggcacccaatacagtattgaaaatcagatcatcaacagtatttcgaagcatgtaaaggtgtttaagacttccgctgctgcttaaaaataacatgtcattgaagtcataaaaagttttttcttcagaaaggtactctagtgttaagtgtatttttttcaactaattttttagtgaattttttttaaacttacagcatgttttggtttgaattactaaaactttaaaaaatatttttcttatgtatgctgtcgtatcgtaggcgtttatattataaaattctgttagtagtcttaaaattgaattggtggaaccactaatccttaaaagttagtctggttatttttcatatagaagtaagtttaatccgagtgtggtggtgttcacctttaatcccagctacttgggaggctgaggtgggaggataacttgagcacaggagttcaagaccagcgtgggcaatatagcaagactccacccctccacaccccaaaaaagtaagtttaggattagaatatagctaggtccaatgttaaatacattttcctggagtacatttgtcacattcagctttgagccactgtaagcatgttactattaaatggttggttattttatatagcatattctttatcttggatattttatgaataaagtatagttattttaagtgccaattaatttatcagactaaatagaaaatatttgagccattactgaattcacatatgtatgtttttttttactatttaaaatacccaacatgtattatgaaatacctcaaaagtaatttagttacattcttaaacaatgacattgtcgaaagaaagttcttataagctgttttttgcatttttataacttggttatactatattctgtttccaagtaaccttttaactaaaagatttgttgggttttagatctcttttcatttgtcaaccttttcagtaaagccctctgttacatca

SEQ ID NO: 342801 - DNA, 4867 bp, Homo sapiens
tgccagaggagccgggacaccgagggaagaggccggagggagatcgcggaggggagggggcgggaggggggtggggtatcctgagtcgtccgtggtccggagtctggaaggccctagagcggcgccagtcgacccgcctcgccacaacttgcccagaccagacacgtttcatcctgcgccctgcaagaaggagccggcctgcctctctccgctttgctgctcctcggcctccgcgggcccggcccgcgtcagcagcgaccctggggtctgggtcccctgtgtcgcccccgcccgcctgcagcgcccggcacccgcccaggagcgcgcagctggggttctagggacgtatacttgagcaagagagaccacagctcttgttcccgctgatcctgcagcccagtggatggagtccagaatctacagacctgccaggaaagaaaaaaaaattcctgatgtctggtccaagcaggaattccccggtggattggggaatgtctggcttttcctcagcttattgatctctgtggtaaccactggaggcccccagaagacccatagaaatgagaggcctgaggtctacaagtcgctgctagaaatattttagcctctccaaagcccagaatgcagccccgacccaagtttgtaagggttctgggtgcacgctgaccctgcgcgggcagacgcgccctttgctccaggtccggacctgggcgctgctatagcaacgtcctggacgcccagaccttaggccgccgccgccgcggaagcgaggaacccggccttctcccgctcctgagggctgtggcggcggcggcccgggaggcggcccaggctgggtaaagaccgcccggctcctcctatgcaagctgaggcagcggattggttttcaagcatgcccttccagaagcatgtctactacccgctcgccagcggcccagaggggcccgacgtcgctgtggccgccgccgccgcgggtgcggcctccatggcctgtgcgccccccagcgcggcttcggggcccctgcccttcttccagttcaggccgcggctggagagtgtggactggcggcggctgagcgccatcgacgtggacaaggtggcgggggctgtggacgtgctgacgctgcaggagaacatcatgaacatcaccttctgcaagctggaagacgagaagtgcccacactgccagtcgggggtggacccggtgctgctgaagctcatccgtctggcgcagttcaccatcgagtacttgctgcactcacaagagttcctcacctcgcagctgcacaccctggaggagcggctgcgcctgagccactgcgacggcgagcagagcaagaagctgctcaccaagcaggcgggggagatcaagacgctcaaggaagagtgcaaacgccggaagaagatgatctccacccagcagctgatgatcgaggccaaagccaactattaccagtgccatttttgtgacaaggcctttatgaaccaagcttttctacaaagtcacattcaacgccgccacactgaagaaaattctcattttgagtatcagaaaaatgcacagattgagaagctccggagtgagatcgtcgtattgaaggaagagctgcagctcaccaggtctgagctagaggctgcacaccatgccagtgcagtcagattctccaaggaatatgaaatgcagaaaacaaaagaggaagactttttgaagttatttgacaggtggaaagaagaagaaaaggagaaactagttgatgaaatggaaaaagtcaaggagatgtttatgaaggaatttaaagaattaacttcgaagaattcagcattagaatatcaactgtcagaaatccagaagtccaatatgcagatcaagtccaacataggcacattaaaagatgcacacgagtttaaagaagaccgttctccatatccccaggatttccataatgtcatgcagcttcttgatagtcaggaaagcaaatggacagctcgagttcaagctattcatcaagaacacaagaaagagaagggtcggctcctgtcacatatagagaaacttcgaacctcaatgatagatgatctaaatgcaagcaatgttttctataagaaaaggatagaagagctagggcagagactccaggagcagaatgagctgattataactcagagacagcagattaaagactttacctgtaatccattaaacagtatcagtgaacccaaaggaaatcctttagcctggcaggcttttgaatctcagccagctgctccagctgtgcctatgaatgccccagccctgcacactttggaaactaaatcaagtctgccaatggtgcatggaagggaaaatgaacagaaattaaataacaacaaaatgcatttaaggaaagctttgaagagtaactcctccctcactaagggactaagaacaatggtggagcagaacttgatggagaaactggaaaccttggggattaatgcagatatacgtggcatttcaagtgatcagttgcatagagtactaaaaagtgtggaatcagaaagacataagcaagaaagagaaatacctaactttcatcaaattcgagaattccttgaacatcaagtcagctgtaaaattgaggagaaagcactactctcttcagatcagtgcagtgtttctcaaatggataccctttcaactggagaagtacccaaaatgatacaacttccttccaaaaacagacaactgattagacaaaaagctgtttctactgataggacatctgttccaaaaattaagaaaaatgtcatggaagatccttttcccagaaagtcttcaactattacgacccctccttttagttcagaggaggagcaggaggacgacgacctcatccgggcatacgcatccccaggcccacttcctgtgccgccaccacaaaacaagggcagcttcgggaagaacacagtgaaaagtgacgcggacgggaccgagggaagcgaaatcgaggacactgatgattctcccaagcccgcaggagtcgccgttaaaacacctactgaaaaagttgaaaagatgtttccacatcgcaaaaatgtgaacaaaccagtcggtggaactaatgtccctgagatgtttatcaaaaaagaagaattacaagaactaaagtgtgcggatgtggaggatgaagactgggacatatcatccctagaggaagagatatctttgggaaaaaaatctgggaaagaacagaaggaacctccacctgcgaaaaatgaaccacattttgctcatgtgctaaatgcctggggcgcatttaatcctaaggggccaaagggagaaggacttcaagaaaatgaatcaagcacattaaaaagcagcttagtaactgtgactgattggagcgacacttcagatgtctaattccacatgtcagaagattattccagaagccagcagtatttcagtatcacagtgtttcagtaatttgcctccatgattctagtgcttctgccttaccgtgtttcccacagcaacacagagactgattcaaagaacaatggtctctttaatggcacccaatacagtattgaaaatcagatcatcaacagtatttcgaagcatgtaaaggtgtttaagacttccgctgctgcttaaaaataacatgtcattgaagtcataaaaagttttttcttcagaaaggtactctagtgttaagtgtatttttttcaactaattttttagtgaattttttttaaacttacagcatgttttggtttgaattactaaaactttaaaaaatatttttcttatgtatgctgtcgtatcgtaggcgtttatattataaaattctgttagtagtcttaaaattgaattggtggaaccactaatccttaaaagttagtctggttatttttcatatagaagtaagtttaatccgagtgtggtggtgttcacctttaatcccagctacttgggaggctgaggtgggaggataacttgagcacaggagttcaagaccagcgtgggcaatatagcaagactccacccctccacaccccaaaaaagtaagtttaggattagaatatagctaggtccaatgttaaatacattttcctggagtacatttgtcacattcagctttgagccactgtaagcatgttactattaaatggttggttattttatatagcatattctttatcttggatattttatgaataaagtatagttattttaagtgccaattaatttatcagactaaatagaaaatatttgagccattactgaattcacatatgtatgtttttttttactatttaaaatacccaacatgtattatgaaatacctcaaaagtaatttagttacattcttaaacaatgacattgtcgaaagaaagttcttataagctgttttttgcatttttataacttggttatactatattctgtttccaagtaaccttttaactaaaagatttgttgggttttagatctcttttcatttgtcaaccttttcagtaaagccctctgttacatcaaaaaaaaaaaaaaaaaaaaaaaaaaaaaaaaaaaaaaaaaaaaaaaaaaaaaaaaaaaaaaaaaaaaaaaaaaaaaaaaaaaggggggggggggcaaattttccccggggggggccccatgtcggcggcccacccccgttttttttttatccagagggggcctcaccattaaggggcggtgtctttataaacgagcagacggcgggcgcggctctttaaacaaccgcggtgctgagtgggacacacgctcgctgcgctgcggcaggcccttttgaggaagagaagcccacactttcgtggcgcggggggcacaatcattgggcagcaccctctcagcggaggtgtt

SEQ ID NO: 342802 - DNA, 3684 bp, Homo sapiens
tgccagaggagccgggacaccgagggaagaggccggagggagatcgcggaggggagggggcgggaggggggtggggtatcctgagtcgtccgtggtccggagtctggaaggccctagagcggcgccagtcgacccgcctcgccacaacttgcccagaccagacacgtttcatcctgcgccctgcaagaaggagccggcctgcctctctccgctttgctgctcctcggcctccgcgggcccggcccgcgtcagcagcgaccctggggtctgggtcccctgtgtcgcccccgcccgcctgcagcgcccggcacccgcccaggagcgcgcagctggggttctagggacgtatacttgagcaagagagaccacagctcttgttcccgctgatcctgcagcccagtggatggagtccagaatctacagacctgccaggaaagaaaaaaaaattcctgatgtctggtccaagcaggaattccccggtggattggggaatgtctggcttttcctcagcttattgatctctgtggtaaccactggaggcccccagaagacccatagaaatgagaggcctgaggtctacaagtcgctgctagaaatattttagcctctccaaagcccagaatgcagccccgacccaagtttgtaagggttctgggtgcacgctgaccctgcgcgggcagacgcgccctttgctccaggtccggacctgggcgctgctatagcaacgtcctggacgcccagaccttaggccgccgccgccgcggaagcgaggaacccggccttctcccgctcctgagggctgtggcggcggcggcccgggaggcggcccaggctgggtaaagaccgcccggctcctcctatgcaagctgaggcagcggattggttttcaagcatgcccttccagaagcatgtctactacccgctcgccagcggcccagaggggcccgacgtcgctgtggccgccgccgccgcgggtgcggcctccatggcctgtgcgccccccagcgcggcttcggggcccctgcccttcttccagttcaggccgcggctggagagtgtggactggcggcggctgagcgccatcgacgtggacaaggtggcgggggctgtggacgtgctgacgctgcaggagaacatcatgaacatcaccttctgcaagctggaagacgagaagtgcccacactgccagtcgggggtggacccggtgctgctgaagctcatccgtctggcgcagttcaccatcgagtacttgctgcactcacaagagttcctcacctcgcagctgcacaccctggaggagcggctgcgcctgagccactgcgacggcgagcagagcaagaagctgctcaccaagcaggcgggggagatcaagacgctcaaggaagagtgcaaacgccggaagaagatgatctccacccagcagctgatgatcgaggccaaagccaactattaccagtgccatttttgtgacaaggcctttatgaaccaagcttttctacaaagtcacattcaacgccgccacactgaagaaaattctcattttgagtatcagaaaaatgcacagattgagaagctccggagtgagatcgtcgtattgaaggaagagctgcagctcaccaggtctgagctagaggctgcacaccatgccagtgcagtcagattctccaaggaatatgaaatgcagaaaacaaaagaggaagactttttgaagttatttgacaggtggaaagaagaagaaaaggagaaactagttgatgaaatggaaaaagtcaaggagatgtttatgaaggaatttaaagaattaacttcgaagaattcagcattagaatatcaactgtcagaaatccagaagtccaatatgcagatcaagtccaacataggcacattaaaagatgcacacgagtttaaagaagaccgttctccatatccccaggatttccataatgtcatgcagcttcttgatagtcaggaaagcaaatggacagctcgagttcaagctattcatcaagaacacaagaaagagaagggtcggctcctgtcacatatagagaaacttcgaacctcaatgatagatgatctaaatgcaagcaatgttttctataagaaaaggatagaagagctagggcagagactccaggagcagaatgagctgattataactcagagacagcagattaaagactttacctgtaatccattaaacagtatcagtgaacccaaaggaaatcctttagcctggcaggcttttgaatctcagccagctgctccagctgtgcctatgaatgccccagccctgcacactttggaaactaaatcaagtctgccaatggtgcatggaagggaaaatgaacagaaattaaataacaacaaaatgcatttaaggaaagctttgaagagtaactcctccctcactaagggactaagaacaatggtggagcagaacttgatggagaaactggaaaccttggggattaatgcagatatacgtggcatttcaagtgatcagttgcatagagtactaaaaagtgtggaatcagaaagacataagcaagaaagagaaatacctaactttcatcaaattcgagaattccttgaacatcaagtcagctgtaaaattgaggagaaagcactactctcttcagatcagtgcagtgtttctcaaatggataccctttcaactggagaagtacccaaaatgatacaacttccttccaaaaacagacaactgattagacaaaaagctgtttctactgataggacatctgttccaaaaattaagaaaaatgtcatggaagatccttttcccagaaagtcttcaactattacgacccctccttttagttcagaggaggagcaggaggacgacgacctcatccgggcatacgcatccccaggcccacttcctgtgccgccaccacaaaacaagggcagcttcgggaagaacacagtgaaaagtgacgcggacgggaccgagggaagcgaaatcgaggacactgatgattctcccaagcccgcaggagtcgccgttaaaacacctactgaaaaagttgaaaagatgtttccacatcgcaaaaatgtgaacaaaccagtcggtggaactaatgtccctgagatgtttatcaaaaaagaagaattacaagaactaaagtgtgcggatgtggaggatgaagactgggacatatcatccctagaggaagagatatctttgggaaaaaaatctgggaaagaacagaaggaacctccacctgcgaaaaatgaaccacattttgctcatgtgctaaatgcctggggcgcatttaatcctaaggggccaaagggagaaggacttcaagaaaatgaatcaagcacattaaaaagcagcttagtaactgtgactgattggagcgacacttcagatgtctaattccacatgtcagaagattattccagaagccagcagtatttcagtatcacagtgtttcagtaatttgcctccatgattctagtgcttctgccttaccgtgtttcccacagcaacacagagactgattcaaagaacaatggtctctttaatggcacccaatacagtattgaaaatcagatcatcaacagtatttcgaagcatgtaaaggtgtttaagacttccgctgctgcttaaaaataacatgtcattgaagtcataaaaagttttttcttcagaaaggt

SEQ ID NO: 342803 - DNA, 3365 bp, Homo sapiens
tgccagaggagccgggacaccgagggaagaggccggagggagatcgcggaggggagggggcgggaggggggtggggtatcctgagtcgtccgtggtccggagtctggaaggccctagagcggcgccagtcgacccgcctcgccacaacttgcccagaccagacacgtttcatcctgcgccctgcaagaaggagccggcctgcctctctccgctttgctgctcctcggcctccgcgggcccggcccgcgtcagcagcgaccctggggtctgggtcccctgtgtcgcccccgcccgcctgcagcgcccggcacccgcccaggagcgcgcagctggggttctagggacgtatacttgagcaagagagaccacagctcttgttcccgctgatcctgcagcccagtggatggagtccagaatctacagacctgccaggaaagaaaaaaaaattcctgatgtctggtccaagcaggaattccccggtggattggggaatgtctggcttttcctcagcttattgatctctgtggtaaccactggaggcccccagaagacccatagaaatgagaggcctgaggtctacaagtcgctgctagaaatattttagcctctccaaagcccagaatgcagccccgacccaagtttgtaagggttctgggtgcacgctgaccctgcgcgggcagacgcgccctttgctccaggtccggacctgggcgctgctatagcaacgtcctggacgcccagaccttaggccgccgccgccgcggaagcgaggaacccggccttctcccgctcctgagggctgtggcggcggcggcccgggaggcggcccaggctgggtaaagaccgcccggctcctcctatgcaagctgaggcagcggattggttttcaagcatgcccttccagaagcatgtctactacccgctcgccagcggcccagaggggcccgacgtcgctgtggccgccgccgccgcgggtgcggcctccatggcctgtgcgccccccagcgcggcttcggggcccctgcccttcttccagttcaggccgcggctggagagtgtggactggcggcggctgagcgccatcgacgtggacaaggtggcgggggctgtggacgtgctgacgctgcaggagaacatcatgaacatcaccttctgcaagctggaagacgagaagtgcccacactgccagtcgggggtggacccggtgctgctgaagctcatccgtctggcgcagttcaccatcgagtacttgctgcactcacaagagttcctcacctcgcagctgcacaccctggaggagcggctgcgcctgagccactgcgacggcgagcagagcaagaagctgctcaccaagcaggcgggggagatcaagacgctcaaggaagagtgcaaacgccggaagaagatgatctccacccagcagctgatgatcgaggccaaagccaactattaccagtgccatttttgtgacaaggcctttatgaaccaagcttttctacaaagtcacattcaacgccgccacactgaagaaaattctcattttgagtatcagaaaaatgcacagattgagaagctccggagtgagatcgtcgtattgaaggaagagctgcagctcaccaggtctgagctagaggctgcacaccatgccagtgcagtcagattctccaaggaatatgaaatgcagaaaacaaaagaggaagactttttgaagttatttgacaggtggaaagaagaagaaaaggagaaactagttgatgaaatggaaaaagtcaaggagatgtttatgaaggaatttaaagaattaacttcgaagaattcagcattagaatatcaactgtcagaaatccagaagtccaatatgcagatcaagtccaacataggcacattaaaagatgcacacgagtttaaagaagaccgttctccatatccccaggatttccataatgtcatgcagcttcttgatagtcaggaaagcaaatggacagctcgagttcaagctattcatcaagaacacaagaaagagaagggtcggctcctgtcacatatagagaaacttcgaacctcaatgatagatgatctaaatgcaagcaatgttttctataagaaaaggatagaagagctagggcagagactccaggagcagaatgagctgattataactcagagacagcagattaaagactttacctgtaatccattaaacagtatcagtgaacccaaaggaaatcctttagcctggcaggcttttgaatctcagccagctgctccagctgtgcctatgaatgccccagccctgcacactttggaaactaaatcaagtctgccaatggtgcatggaagggaaaatgaacagaaattaaataacaacaaaatgcatttaaggaaagctttgaagagtaactcctccctcactaagggactaagaacaatggtggagcagaacttgatggagaaactggaaaccttggggattaatgcagatatacgtggcatttcaagtgatcagttgcatagagtactaaaaagtgtggaatcagaaagacataagcaagaaagagaaatacctaactttcatcaaattcgagaattccttgaacatcaagtcagctgtaaaattgaggagaaagcactactctcttcagatcagtgcagtgtttctcaaatggataccctttcaactggagaagtacccaaaatgatacaacttccttccaaaaacagacaactgattagacaaaaagctgtttctactgataggacatctgttccaaaaattaagaaaaatgtcatggaagatccttttcccagaaagtcttcaactattacgacccctccttttagttcagaggaggagcaggaggacgacgacctcatccgggcatacgcatccccaggcccacttcctgtgccgccaccacaaaacaagggcagcttcgggaagaacacagtgaaaagtgacgcggacgggaccgagggaagcgaaatcgaggacactgatgattctcccaagcccgcaggagtcgccgttaaaacacctactgaaaaagttgaaaagatgtttccacatcgcaaaaatgtgaacaaaccagtcggtggaactaatgtccctgagatgtttatcaaaaaagaagaattacaagaactaaagtgtgcggatgtggaggatgaagactgggacatatcatccctagaggaagagatatctttgggaaaaaaatctgggaaagaacagaaggaacctccacctgcgaaaaatgaaccacattttgctcatgtgctaaatgcctggggcgcatttaatcctaaggggccaaagggagaaggaccttcaagaaaaatgaatcaagcacattcttccaggttac

SEQ ID NO: 342804 - DNA, 625 bp, Homo sapiens
tgcctaatattccaggcatataatttgttggtgcaaggtacttagcagagtgtctggcacacagtaaatacccagtaccggtagctgcaattattaataatgttcaggggtttgtttcttctgcctgctcccacctttgaccctttctattgcttattagtttctcaaccactaaacaaaaacaatgaggaacggggtgaagagcagttaacccattgggcagggttaaatggcaaaataaattactgaaattaagttagagattatatatggatttaatttttctggtttttgcctgtctcctgtcataaataattgggagtttaatatattatcatcaatggcaacatcatcatcttcatcatggacctgatcacagggaccaaactgtatactatcaaaaactgacaaccctttcaggactccagtatataccctcattaaaacaaaaacaactacccctgaaaaggccccagagttattgatctcacatgtgagtgaactttttcctagaatttattgcacccgattacaatccaaattcatatcttcactaattgtaactaagaacatttgagatttttgcaaaatgtaatagactgtcctttcccgtcatctctcatat

SEQ ID NO: 342805 - DNA, 371 bp, Homo sapiens
ccctgcctccctccagccttgtcacctctctgcagggaccactccagtactatgcccccatttccccaaaccctgtcacagcccttactcatgtaaggacttgttgacttatttgcctcccctgctagactctagccctgagaactgaggaactactacatctgtttgtttcttccagggctcaagacggcgtgtagcaaacagaaggtgctcaacaaatgtctgtctgtggaatgactgaccacatgcacgaaaagcctttgatggaaaaaaaacaatgaaagagaaaagtgaaatgagagtaaaattcttcactgatgttaattcctatttgccatgaatccaatcaataaacatttagaacaaactta

SEQ ID NO: 342806 - DNA, 714 bp, Homo sapiens
aactgaaaataaaaaaagtgctatccatatgtggatggtagattcattagcaaagccccctttttcataacccctccccaaactgtctcctctgtaaaatgtttcttgctgatttcttccagggaaaataaagcatgtatttgcatatattttaacaggaatgagatcatgctgtactccttgttctgcacctcgcatttgatcacttcaaaatatatttttgagatgcctccatatgaacagttagaaccctgttatagaagattattatgtgtgtgtgtgtgtgtgtgtgtgtgtgtgtgtgtgtgtgtgtagaatgttatagtatatcctacaaatatagcatagtagtctaccaatggatgtattgttcagtcacacctataccggcagacctttgatcctttccagattgttaaactaagtacgttctccaccttccagaggtgtaagaaatactcagttttatttccttcagggttaataatccctctctgtgctcggaacactcttgagatgcaattagaaaaagacaaatctctaaatcaaagtggtgggacctaaaaaaagcctcgagggttatgaaggcttcgctttgtgatttgaaacaaggtaatttttttaaattggctttggtgatgtgtattggaacaccattgttttcagcataattacgcatttcacagcttaattcagccattacacgtgatgcag

SEQ ID NO: 342807 - DNA, 818 bp, Homo sapiens
aaaaaaaaaaaaaaaaaaaaaaagaacagttgatgaaggatggatagactaaaacaatgctgcattaatgaggctacgatagtgcgtatttgtataaaaagcattaatttgcatttgttggcattttgaagctctgttgttggatgcatacacatttagtatctatatgtcgttatgatttgtaaatcatgtaatgcgtctctttacataatgatttttaaattattttgtaatgtttctcattacgttatgtaatgcccttattaactttccttggaaatcttttttacccgttatccatacaaccactcttgctttcttaatactgatgttagcatgatataccttttttcttttgttcgttttttattttaactgtcaacttacctatgctgtgtttgaagtgaggttcttgtacgtggcatgtagttgggttatgttttattttatttaaactgccatctctgtcctttacatcaaaggtaaattgatgttcttagaccacgtacctttaaagtaattcttgatgtgttaaagcttaattctgccattttattatttgttttctgtttgtttcctgtttccctgttctagtcttccactggatacttgatcacttttaaaattccatcttgtttaatttatactgtatttgagtatatcacttacatagttcttttggtggttgctctaggtattacagtatatatctataacttagcctattgctatccacatttaagtacttgcagtgagccgagattatgccattgcactccatcctggacaacagagtgagactccttctcaaaaaaaaa

SEQ ID NO: 342808 - DNA, 5504 bp, Homo sapiens
  misc_feature (1037)..(1037): n is a, c, g, or t
  misc_feature (2082)..(2082): n is a, c, g, or t
  misc_feature (2456)..(2456): n is a, c, g, or t
  misc_feature (2621)..(2621): n is a, c, g, or t
  misc_feature (2736)..(2736): n is a, c, g, or t
  misc_feature (3317)..(3317): n is a, c, g, or t
  misc_feature (4004)..(4004): n is a, c, g, or t
  misc_feature (4170)..(4170): n is a, c, g, or t
  misc_feature (4613)..(4613): n is a, c, g, or t
atatcaacactctgccccctcttcctccagccctgtctccccagactcctctgtcagccccccacaagccactcccattcattctccctcaggggaagagccctgccaagatggccctgcagcttctctcaagatcctgctggcttgggctgggggaatacagactgaggtcaccctgggcccctgggctagtggtttctagcacttacggaggatttccctccatcgcgtgagttcttgggagaaggtggcaagatgctcaacttactgggcacaagagtcactgaatcggtgccctctagggttctttctcttttgccatcttatccatattttaaggggtttctctttttctggggaagaggagagtgagcgaattgggggtcaagggggaggtgataagagaaagaaaagaggacagggctgggcacagtggctcacatctgtagtctcagcgcttcgggaggccaaggcaggaggatcacttgagctcaggaattccagaccagcctgggcaacatagtgagacccccatctctactaaaagaaaaaaaaaagaagaaaagaggacaggaagaaatgaaacaatccctttagtcataattcagttttaaattggggtctgtcccccgcagccgtcattttatcctttgtaaaatatcttgtcctctactttctgaccccctttttggtcattttctgggatgaatgagcgcaggacagagaatttctgttgttaggaataatgacagtattctccgcagctctcctggcagtgataggtcctagtcctagcgcaggaatttgaagctcgattagatcaaaagaaatggggccaaagtgtttttgactcatgctcgatattgacacagtgggtgggtgtcagggttttgctgtccaggggcaacagttggaggtcgacacctgagaacgttaatttcaccctctgtggttgggtgatggatggtgggggttaggggattgggcaatgctcctgaaccccactgccagttccccttgacggcagaccccccacncactgtaccacagtgtggacagaggaaaaggtgtatctcgccctgaggatagcacagcattggctgttcaagctcctcctctctgcgccggtttttgcataggcggtctcttgagcatttcaagaaacttgttcttatggctttcctgctgcacccgggaagatgggctcattctgcagttggcaagccttgttgttgaacaggctaacaggtcaactcactgacacagcaagtatatctcaaaaggaaattattggccggccgccatggctcacgcctgtaatctcagtactttgggaagccgaggagagcagatcacttgaggtcaggagttcgagaccagcctggcaaacatggggaaacccagtctttactaaaaatacaaaaaaaaaaaaaaaaaaaaaaaacaataaccaagcatcgtggcaggcatctgtaatctcagctactagggaggctgagggaggagaattgcttgaacccaggaggcagaggttgcagtgagctgagatcacaccactgcactccagcgtggttgacagagtgagactccatctcagaaaaaaaaaaaaaaaagattattgtagataaattagcaacaagacgtgtcttttaggaggtaaaaccaaatgccccatagcattaggaatgtttcagctgtcccttttgtaaaagtaacccttggggactgaagaaaatgcccacgctcccagaaggagaaggagaacatttcccaggaagcctggcatgctcacagatgtcctagagccctcacacttctcacaggaaccagttccccagcctgcagtgacaggtgaggatcacaaccctctatgtgggaattggaggcctctgttttccagctctgggaccccgggtgggtctttcatccttggtgttttgctttccccaattagcagcaaaggaaattcctgacctcaattagtgattggtcagatggcaccacgtttgtgaaattgcttgaggaaatacgtgccatcttttactaatgtcatagttaatctagcatactatcactggccancacttgcatgaagtttaaattctctaaaaggcccgcaaattaaatcagagatgatgacgtaccctttgggaattacattacaacacctttctgtttctggaatgttctttatagaacagcgatgtgattgatctctgatgggcagcacggcctctgggtgagtgatggccgacagggctgggacagagagcttcgtaacatttctaggcagccagttctggctggtatcctggccactgctcacactctactgtactgggacatgccaaccattcctttctctgaagagcttcagcaaagcccaggcctcccaaatgatgtttatcaaccctagagagacaagtgaggtctagtggttcgagtcagcaagggtngggagccatgagggttcaggtgctcccctgacactcgggttttttcttctttcagggtcactgtgcaaatcatttaaggaaatctctccttctttctctctgcctgtctctccctccctccctccatcagctctccatgcatatacatcaagaaaccattctacnatctaagacagggcggagggaggctgtgctggttggttatttgtagctccttcagaatgagaagctgcacaggcaccaattataattggtaacttctatgctgaccccagagatnagaaacgttgtctgctagatcccagcagcctctgaagcccagagccaaggaacgtcttagagactttgcaggaaaatatttgaaagttcaaaatgtttagagtcgacattagacacttttccctctgaactcagagtggggacttcttgaattggcccccaatccaaacgtctttccttcttcctaatctttttttttctctccctgatgcagttcaccattttatttagagtcaaaggcagagtcaaagggggacagggacattgaagctttgttcccacaatatcagacagaagactgagtcacgtgtatcagccaagactcccagaccaaaatgttccagagtctggggactccttaaggtcagcccagagacctgactttgcaaagagagactctccccgacaatgcccatgtcctcccggtcctctccccaccgagtctgttaggtcgctgtgatattttccattctagaaagaatccggaccgggcgcagtggctcatgcctgtaatcccagcactttgggaggctgagtcgggcagatcacctaagatcaggggtttgacaccagcctggccancatggcaaaaccccgtatctactaaaaatagccaggcgtggtggaccacatgtgtggtcccagctactcaggaggctgagggaggagaatcgcttgaacccaggaggcagaggttgcagtgagctgagatcgtgccaccgcactcccccagcctaggcaacagtgtgaaactctgtctcaaaaaaaaaaaaaaaaaatccagtagtttgctaaagcttccataaggcttccaggaatctagtctcctttaggaaggatgccttttgatctcatatttttgttttaagaatgatgtgtggcaagagttctggtatgacaagggggataagtttttcatgtgattaatgaggtccccaaaatatctggttgggccatcaatctaacctcagttagcaaattacagccaggccctaatgcagatcctattcttattacgatggcctttacataaattatctactttagttatcacaactctgggatgtgggttttaagacctccattttacaaacatgtatctgagaatcaggaaggtgaagggtcaaagtccgatagtgattcactgggaagagccaagattctaattcaggtctttttttttagacagtctcactctagcacccagcctggaatgagatcaggcagtggcgtgatctcagctcactgcaacctccgcctcccgggttnaagcaattctcctgcctcagcctccagagtaactgggactacaggcgtgtgccatcacacaagtctaatttttgtatttttagtagagacagggttttgccatgttagccaggctgttctcaaatacctggcctcaagtgatccacccacctcggcctcccaaagngctgggatggacaggcttgagccaccatgcccagctctaattcaggtcattctgacttcagagcccagacccttcacccagcactgaattggtctaggccttcgtgagttattgttacatcaccgtttgggagtgggctactttttattaaaacctgggtctccataacagagcgatgtagaaagaaaggaagtcatgggttgtactcgccatgcttgcttagagggtaaaactcaaccagatgggcgcaaatgataggctgtgtcaaaatgaaataaaaagcccttttccttccttctgcggcaagccaaaatccttcgagggcctggcagccaggattgttttatgaacaaggaaattcgcctgaggaagtcgacttcagtctgaatgcaaggaaaaaagttgaggttagcaaggaagcataagtcgaggaaaggcccacngggtagggaggaggaggaggaggaagacaattcacaccaggtgaagaaaacaagcgccatgcctcagtgtttcctccagcccgcagacttccatcgtgttaacatgaggtcggaagtcgctgtccttgccagtgtggacagcaacgtcgagggcagaggaagggcagagctgcaggcattcagacagccctggctggacagtaagggcccccaggcacggaaggtaggctgtacacggggcatccaggagtggtgggtccacacccctccatggccttcaccaccgcccccatgcctgctttctcctgtgtgggaaagaccttgggttccacaggccaggcaggaagctacaatggtgaacctcgcccagtccgtgtgtgtgctgtagacagtggccacagaaaggacagatgagcaagtgaccgtttctagttgttttcacgaagttctgtgtactggcaaagcctgttgccttcagcacactcacaaaaagttgatttcctgaagaagaaaacaagcaaacattggacacacgtgtgggaaatgcaaacaaacacattgtcactaccgaaggtagaaactggagcagataccttataaaaaccactgctttagccaggcgcggtggctcacgcctgtaatcccagcactttgggaggctgcagcgggcggatcacctgaggtcaggagtttgagaccagcctggccaacatggcaaaaccccgtctctactaaaaatataaaaattagctgggcgtggtggtggacacctgtaatccccactactcaggaggctaaggcaggaaaaccacttcaacccaggaggcagaggttgcagagagtcaagactgggacactgcactccagcctgggtgactgagactctgtctc

SEQ ID NO: 342809 - DNA, 244 bp, Homo sapiens
ttcaggcctgaatacctcgagtgcctagtattggagtctgtcgtcccccaaacattgaagcctaggctcctgcggctcagagctggctcttcctagtgtctggggtggggggactggggtctagggtcccttgtgtctgggctgggggccccagggtttggggaaaggggtctggacttggcagaagtcagaaggaaaggtggtccctgggctgaggcctggggacctgggcatctgggaggag

SEQ ID NO: 342810 - DNA, 138 bp, Homo sapiens
tgtccccttactgctgatgccttgcccaaggttcatagtgcagccaagacttcagttcaaacctttttcttcctggccctctgaaaccctctttgcagcccccttttcccatgctgaggaggtagtgtgcccagcagt

SEQ ID NO: 342811 - DNA, 843 bp, Homo sapiens
taccgtcaaaaataattaaaaattgtatatttttaaataactaagagtataaatggattttttgtatcacaaaggataaatgtttgaggtgatagatatcccatttaccctgatgtaattattatctattgcatgcatgtatcaaaatatctcatgtaacccatgaatacataacacctaccatgcacccacaaaaattaaaaggaaaaaatcagacattggagtcaggaggagggaagtcagtactgaggagtgtcactggacatgaaagatgaagaatggataggaattaatcaggtgaagaagatagtgcgggtggagagagcattgcaggcagacagaaacatagccatcagtcagcagtaaaagcaaaaagagattagcagagacaatctatgttactggttataaaataaatgcaaattaaaacaaatacaagatatcattatatcatctattaagaaaggttttagttattatggcaatggtgtagtgatcattcaaggattcctactaggagtactaatccaactgttctggaaaataagttgacaatgtttcaaaagtcctaaaaaagatcatacctgttggtaaatgatttctcctcttaggaatctatcttaagcaaaaaagtttaaaacgcagatataaacttatgtacaaaaatttaaaatgttgaaaaattaggccaggtgtggtagctcacgcctgtaatcccagtgctttaagaggccaaggcgggtggatcacttgaggccaggagttcaagacccagccaacatgtcaaaaccccatctctacaaaaaatacaaaaattagccaggcatggtggcacacacctgt

SEQ ID NO: 342812 - DNA, 105 bp, Homo sapiens
gaagagaatcgcaacactaatttccaacccaggcttgacttttcacccagctaatgggtatgcggtacctcccggggacagaggcagctctgggcgctggggata

SEQ ID NO: 342813 - DNA, 1429 bp, Homo sapiens
ccctgtgccagccggctgtcgacccaggttaggaagcccgaggtcggggcgttaccccaagggccctcccgcttcccctccgagggcagagaggcgtccgcgcccggacgcactgcgggaacacctggagccccggcggagctcggctgtccccgcgggagggagcccgacgcgcatccttgggacccggacccggcgcccgcgcctcgggacggatttctgcctcggctgcaggcgcagcgcgcagacctgagcctgccccgcggaaccggggctcgagtcccggcccgagcgcggcgtcggggccagcggagaggggcggaagccgcaagggaccctcggcgcctcggcctggccgcgatgaagtccccgcccctcctcagcccgtgtctctcctggaagagaatggcgggcatctttttcctgccatttatctcatcaggttttgctcctcggtttaagcaggaagagaacttcatgcttggaagagcgcatccgtcccagcctaggtttaattggtctcatctgacccctctggagctgaagaatcgatctgtgggacttggaactgaaagcacaggtcggggtaagccccacttcacactggagggccacaagttcctgatcttcgggggctccatccactatttccgggtgcccagggagtactggagggaccgcctgctgaagctgaaggcctgtggcttcaatactgtcaccacctatgttccgtggaacctgcatgagccagaaagaggcaaatttgacttctctgggaacctggacctggaggccttcgtcctgatggccgcagagatcgggctgtgggtgattctgcgtccaggcccctacatctgcagtgagatggacctcgggggcttgcccagctggctcctgcaagacccccggttactgttgaggacaaccaacaagagcttcattgaagcagttgagaagtattttgaccacctgattcccagagtgattcctctccagtaccgccaggcaggccctgtcatcgcggtgcaagtggagaatgagtatggctcattcaataaggataaaacatacatgccgtatctccacaaggccctgctgagaagagggattgtggagcttctcttgacctctgatggtgagaaacatgtgctgagtggccacaccaaaggagtgttggccgccatcaatttgcaaaaacttcaccaggatactttcaatcagcttcataaagtccagggagccagtatagatgcaggactgctctcagatgcctcacaagcagcaacttcttcctccttatagttcttatctgtgattcttccataattttgtccttctaagcttctgatgcactgaattatgtaaagtgcattcccttcaccagcttgtgcaccctattctgtaactgataataaatggttggtattgc

SEQ ID NO: 342814 - DNA, 740 bp, Homo sapiens
tgggcgccagagcgagactccgtctcgaaaaaaaacaaaaacccagaaagactgaatatttggatggaagttttaccagaagcacaaatgccgttcacaggcacatgtatgcaacgaggaaagctaatttacaggcatcccattgaactgtgggaaatgctaggaaacttttaagaagcaaggaattataaggtaccgccaggcaggccctgtcatcgcggtgcaagtggagaatgagtatggctcattcaataaggataaaacatacatgccgtatctccacaaggccctgctgagaagagggattgtggagcttctcttgacctctgatggtgagaaacatgtgctgagtggccacaccaaaggaggtacacatttagagttagttcacaggagaacagggctctcagccagcccgtgtaaatcttgaacacactgcagagaaaaccaagtgcatctcgatacctccctttcccgtgtccactgggatggatcctggagttcgatgttacaataaatgaggactcaaggttaaggctcagggccactcacagctccctatcttggccttgctcctgccgtctttaaacacagcagcactggagctcctctgttctcaggacgcctttccatctcccatagtttttctgtggcaagaaatctgcattggtgctgcgcctggcttgggatcagggccgtctccactaacttgggaaaccacagggagaaccagaagatgg

SEQ ID NO: 342815 - DNA, 350 bp, Homo sapiens
tcatagaggaattcccaggcagagggagacattttatgccatgtatgatctcatcattgagttgaaaggcaatcttgtttcatttaggatactttcttatgtttatgtcttgataagggcacgtttgaatttccaagcaaataataattttgaattagcttttaatcattgacttctagcacagttatatgatcagaaacatgctgtgtgaaagataccgtaggctggaaaaggggagaacagaaaggacaaggcaaggctgctgtttctctgcttccatctggggaaactgagagtccaggagcagctgttcctgccctgttttcataagtccttggagatgcactgat

SEQ ID NO: 342816 - DNA, 142 bp, Homo sapiens
cataccttacctcacttccttagaccctttcgcaaataacttctctcagttaggccttccctgacctccttatttaaaaaggaaatcctgcaccctcctcccacaaagcagtatccccctttcctgcctaattcttcttttt

SEQ ID NO: 342817 - DNA, 703 bp, Homo sapiens
ggaccacagggaaaacattgtccaaacatggcaccagagtgttggagaggcagcctagagccgtggcagcacagaaaactgaagtaagagatccccacagaggatgggctcagggccaggctccagcttggaggtgcagggtttccctttaatcagggaggtgggattcctgatggcctattctataagtccaccccagagcccccagcccatcctcacagcatcacagccccacccgccttcagccaccatcttcccactgccttcctggcactcaccgtcaaagtccacatcttcatttggcaggctggcctcagcagcccggggtcgtctctctgtatccagctctgcaatgatggagtcaaagaaggcaatggcctcggccacatcagcactgaactgcgagtatttctttggggttgctttctgcaagaggtgaaggggagaagagagagttgcctgagccagtaagccagagactcagaaaagggtgaaatgttgctaaaacgaaatgcgcgtggggttagggatttgtgaggtttcaaaggtaactatgaataagtgccctgtggaaggaaggtagatactccaggtccataattgctgtaggtcaatggatttctaattgtctcaagaagggagagtgaaaggacaacaagatctacttctttcttcatcacagatttgctgtcagacattaggc

SEQ ID NO: 342818 - DNA, 580 bp, Homo sapiens
aaagggctggtgacacttgggttcttggggtttgtcaggggagggcaccaaattggtcttgaggaagcagttaggtgagccccagtgacagtcttaagcacagtgattggcagatagcaagtgaaggaggggcaaggctgccaccacttctggcttctggtgaaattttactggactgattcctaggaaactgctgtttgtctttgagacctttccacatcagatggcccatgaagcgttccacagggacctttggtacaatccatctgtcctacgtgggccatcagaatccccttctgcacatgggctggaagaggagagaagccctccagcctggggatgggagacctaggggtctcaggttcctgagaggtcgaaaggattaacatagtccagctctgtctgagcctcagaaaacctgccctccctgttagaggccatgggaagagtgttctttttaagcatgaagaactgactgtgggccaggtgtagtggctcacgcctgtaatcccaacactttgggaggccgaggtgggcagatcagctggggccaggagttctagaccagcctaacatggca

SEQ ID NO: 342819 - DNA, 439 bp, Homo sapiens
actggactgattcctaggaaactgctgtttgtctttgagacctttccacatcagatggcccatgaagcgttccacagggacctttggtacaatccatctgtcctacgtgggccatcagaatccccttctgcacatgggctggaagaggagagaagccctccagcctggggatgggagacctaggggtctcaggttcctgagaggtcgaaaggattaacatagtccagctctgtctgagcctcagaaaacctgccctccctgttagaggccatgggaagagtgttctttttaagcatgaagaactgactgtgggccaggtgtagtggctcacgcctgtaatcccaacactttgggaggccgaggtgggcagatcagctggggccaggagttctagaccagcctaacatggcaaaaccacatctctcctaaaaatacaaaa

SEQ ID NO: 342820 - DNA, 770 bp, Homo sapiens
gggtggggaggggggatacagagattgcagaataaagacaatgctatttttaaatgttgacaatgtttatcttcataggacaaagaatgtgaaggaaaaggtctttttggcagtgtttcatcttcttggttcatttttgggctttcttgatagctgaaaaaaaatctaactcaccttactattttgtttggggatgatggtttcagcctctctgcttgaacttgttctcagttttttgtctactgttagctcatattcttccaatgcacatttttgggcattattggttatagaaatggcagtctttggagatttttaaatcaagactcttgcttctggtcttattagcaagatcattggggtcacttcatctctgtctgtctttcctgattgattatcctattttcgaatgagactcatgtcctgttctgctttgcaaaatatagtttcacataagaaattaccttgggcaaggttgtgagaggatttggaatctaaatggagaaaagtgtagaggcatatttttcaatcttctacttctatgtcattttccctgtgtgttggattgctaagattatgtatctattgctggcagaaatatcatatcctaaattcttggagaatgatattggttgcccaagattgtatagaagattaaggagctaggactctgaagagctgggttttagaatcataaactctcaggtttggaaaggatgttaaatggtctggttcaatcaacacttctaataatttaatctcttacacaa

SEQ ID NO: 342821 - DNA, 716 bp, Homo sapiens
gggtggggaggggggatacagagattgcagaataaagacaatgctatttttaaatgttgacaatgtttatcttcataggacaaagaatgtgaaggaaaaggtctttttggcagtgtttcatcttcttggttcatttttgggctttcttgatagctgaaaaaaaatctaactcaccttactattttgtttggggatgatggtttcagcctctctgcttgaacttgttctcagttttttgtctactgttagctcatattcttccaatgcacatttttgggcattattggttatagaaatggcagtctttggagatttttaaatcaagactcttgcttctggtcttattagcaagatcattggggtcacttcatctctgtctgtctttcctgattgattatcctattttcgaatgagactcatgtcctgttctgctttgcaaaatatagtttcacataagaaattaccttgggcaaggttgtgagaggatttggaatctaaatggagtgttggattgctaagattatgtatctattgctggcagaaatatcatatcctaaattcttggagaatgatattggttgcccaagattgtatagaagattaaggagctaggactctgaagagctgggttttagaatcataaactctcaggtttggaaaggatgttaaatggtctggttcaatcaacacttctaataatttaatctcttacacaa

SEQ ID NO: 342822 - DNA, 391 bp, Homo sapiens
aagcaaaaatgaataaactgaagatcctcacaccttaaacataacatgcaagaaagctaaacgatgccaaatctagcttaacctagctggttaaaagattcaatttgaatacctatttctgagaaattgcagttaaccatatgcagacaatactaaacagatgtatcaaaggcacagaaaactaggatgcagtattgctttagaaggaatttagtctgaatgctggcccaagcctcccatgaatgattagcatcaacacaaactcttgtgctctcctgacagattcaaattttgaatccctatgttgttgaaatattttattaatatttatgaaaaagcaccaagattggttttctaaactaggaaaaaaaactctagctgatatcaagca

SEQ ID NO: 342823 - DNA, 616 bp, Homo sapiens
gatgatctttatatttcaagtgaccacagctctcttctccaggctgcaaatagatctattaagcaccaggcacatttctgggcactttccattcttttcttttcttttctttttctccccacaacactggtagtaaatacatgctgtttcatattcccatctcaccaatgagaacttaagcctcattcttcagtctcttccttcagccaatctgaaggaccaggcaccacactagtctgacgttggcttcctaaagctgtagtccacccaacaccatgatacaggggaggatcttaggtggcagagaggcaatatcaatccttctgcatcacacagtgggaaaagtttgtctcattgcagttctcttccaagccttctgacttatctcagtttgatgttcgatgatctttaacccctgtctagcaaatctgtgtagcaaagaaagagcgggccacaggctcagcctcttcatttgtggcacggttcaaatgtactacatagctttgttttcatcgtgtgtgcttttctggttggagccagtggtcctcgttgtttattcatggtggcaatctgaagtttccttacaaattctttcttgaagtaaaaaaaaaaaaaa

SEQ ID NO: 342824 - DNA, 252 bp, Homo sapiens
tagcaacactctaggtacaaaagtccaccaatccctaaactccacactttcctaaaatacttaagtgataggagctttctgttttgcttgataaagctgttttttggaatctggcttccaacatcagcatgcacctgcgatcatatctgcgattcatgcgcgttgtatcagggttctccagagagacggcacctataggatagatagttagatatatagatgattgataggtaaatagatagatagatagat

SEQ ID NO: 342825 - DNA, 633 bp, Homo sapiens
atccctccacatcaataccagcacaatatctgaaatatctctgtttacagcccggaaagattttatactgtgcaccaaagattaggattggtaggggtgtcttttttccctaaggaagaagaaaggcactgggaaaagtaagaaccagcaaaataaccagggctgataattttcaggaaagacatctataaatggaagcaagggatttgaaaattgactcccttaaaactactgctgattctgctagaaattatttgtatatcctgagggtatgaacaccttagtttttctactatgagatgctgaatttgataataagagtcagtttcatgtatctaactcagggagcaggaggaatgaaagaagggtaacaggcagtatagaaccacttattccagctaggaagttggggaagcatataactaaaactctctgcccagagtggatactggccatataccttcttctgttaaaggacctgatgggaaaatttcagatattgggtttttctcctagagcaacaaaagagacaagctgaagtaaaatggagtcagttttaaagcagataggcaggtcagtccctagaagggcatcaacctatgtaacttaactggaagtctgtgtgtgtgtgtg

SEQ ID NO: 342826 - DNA, 105 bp, Homo sapiens
aattttggttagtacacagagagtcctttatacatgatctgttatttaatatgaggattgtaaatattttaatctaataaaataagtgtggtttgattgataatt

SEQ ID NO: 342827 - DNA, 925 bp, Homo sapiens
ccctcgacaggatcctctaactggggtggagtcggggcagcaggccttggtgttttcagcctcacgagaccctctgctatacaagcatcactggagggtccatatgcccccacacctgacccattattgtcacagcctgaggggcaggaatgatggagctgtgctgccattgccactatgtccacagagtactggggccaggggacccctgcaatgcaggctgcagagaaggaacgagggaagaacattccctcaagcagacccttcagcccattctccccactttgaaaaacgtgtagagtttgtgattccctcctctctaaatgtctggcatcttcttcttgggtggcaagatgtagaacagcccctgggccaagacttgttagctttctctgcctttagttcacactacacataggatttcatgggaggatagggacaaaaggatagtggagagtgaggatttcccacttgagtagccatgagggaaaggtatgtgctgaactgtagcctggacaggcagagcctaccaccctgcaaggctgtagaatgctcaactcatagcaggtcggggccagtgttgtgcctgttgacacaaggaggtcaagggctgcagcttccagttatctcataatgctggggctttcgaaccagcatctgtgcttgtgtgtagagtccagagaagccagccctgcagaaacagcctgctatggggttcatacaccaaggcagtatcttgccttagatgaccacctgcaatccaggatgagactttggcttgatcaattgcactaaatccacccacactcattctcagttccctctttcaagagggaaaagaaaaggcactgacactgtaagatgatgaaagtagaaagtgaacaggcaaccctgttggatgagccattggtgaaatcatgtggtc

SEQ ID NO: 342828 - DNA, 224 bp, Homo sapiens
tcagctcctcccttccccggaccaaacagattctctctcagttacaaaagccctcgacaggatcctctaactggggtggagtcggggcagcaggccttggtgttttcagcctcacgagaccctctgctatacaagcatcactggagggtccatatgcccccacacctgacccattattgtcacagcctgaggggcaggaatgatggagctgtgctgccattgcc

SEQ ID NO: 342829 - DNA, 450 bp, Homo sapiens
cattgtatgactatcccatgatatatccatcttcctgttgatggcacatgggtttcttccaggttctgctattacaaatgatgctattatgaacattcctgtacgtgtttcctggtgaactttgagaatctatctagggggaatttgctggctcacaagatataaacgttcacttaacaagataatccaaactgcgttcgaagtggctgaaccatttttacattcctgccaatgaggcatttaaggggccctagcgatctatatccaacacttggtattgtctaggacagcactgtccaatacatagctactgaccacgtgtggctactgagcatgtgaaatgtggccagtgtaactaaaggactgaattttaaatttaaattgtattttggatagcactggtctagactcttgaatctttgctgcttgaatggatattaaatgtcttct

SEQ ID NO: 342830 - DNA, 416 bp, Homo sapiens
cagttctttaagctgccttgatgagggtgaccaatgatggggaggtcagagtaccagaatggtggcttgcaattggccacccatcctgactggcttctgtgcactctttttaagaaagtggggccaggcatggtggctcacgcctataatcccagcactttgggaggccgaggtgagtggatcacctgaggtcaggagttcaaaaccaacctggccaatgtggtgaaaccccgtctctactaaaaatacaaaaattagatgggtgtggtggctcgcgcttgtaatcccagctatttgggaggttgaggcaggagaatcgcttgaacccaggaggcggaggttgcagtgaactgagattgccccactgtactccagcctgggcaagagtgaagctctgtctcagaaaaaagaaaaaa

SEQ ID NO: 342831 - DNA, 176 bp, Homo sapiens
ccgcccttaaattaaaagattacgattttccataacagccagttgtgggccccctcctacgtgactttgctcaagcccatattgaactcttggtcacagggaccagggattcctggacccctggcccaagtgacaactacccatagtggcagacaagcagcagccatccaaacatt

SEQ ID NO: 342832 - DNA, 277 bp, Homo sapiens
atgcctctttgattggaatgatgaatgagtttctgttcccattattttacactgctgttgagttgaaatagcaacaaatcacatccctagttgtatttagtgattcaatatactgtacttgggatttcattgttagggtttgaagtcagtatttgtccatttctccaaaccttataccaacatcagatttggatcttgattgttctatattgagggagccaacatccttctcctgaacccagcctagagtctgtaagcctgagactgcttaaagaga

SEQ ID NO: 342833 - DNA, 1787 bp, Homo sapiens
ttaggggaggaacagatgatagagcaggttaatgatgaaaaaggagaacagaagcaaaaacaggaacaggtacaagatgtgatgcttgggagacaaggagaaagaatggggctcactggggagccagagggtctgaatgacggtgagtgggagcaggaggatatggagaggaaggctcagggtcagggaggtccagaacagggagaagagaggaagagggagctgcaggtgccagaagagaacagggcggactctcaggacgaaaagagtcaaacctttttgggaaaatcagaggaagtaactggaaagcaagaagatcatggtataaaggagaaaggggtgccagtcagcgggcaggaggcgaaagagccagagagttgggatgggggcaggctgggggcagtgggaagagcgaggagcagggaagaggagaatgagcatcatgggccttcaatgcccgctctgatagcccctgaggactctcctcactgtgacctgtttccaggtgcctcatatctcgtgactcagattcccgggactcagacagagtccagggctgaggaactgtcccccgcagctctgtctccctcgctagagcccatcaggtgctctcaccagcccatttctctactgggctcctttttgactgaggagtcacctgacaaggaaatagatcaaaacagccagcaagagggatccaggctgaggaagggaacagtgtccagccaagggactgaggtggtctttgccagtgcatctgtgactcctccaaggacaccagattcagctcctcccagtcctgctgaagcctaccccatcacacctgcctcggtatctgccaggcccccagttgcctttcccaggagggaaacctcttgtgctgcacgtgctccagaaactgccagtgcccctctctcaatggatgacccatctccctgtgggacttctgagatgtgcccggctgccctctatggcttcccctccaccgggaccagccctccgaggcccccagccaactccacaggcaccgtccagcacttacggagtgactccttccctggttctcacaggacagagcagactccagacctggtgggaatgttgctttcctactcccactcagagctgccccagaggccccccaaacctgccatctacagctctgtgaccccaagaagggacagaaggagtggtagggactacagcaccgtttcagcatcccctactgccttatccacgctgaagcaggactctcaagaatccatctcaaatctagagagacccagcagtcctcccagcatccagccctgggtctccccacataatccagcctttgccacagagtctcccgcctacggttcttccccatcctttgtctccatggaggatgtgaggatccacgaacctctgccccctcctcccccacagaggagggacacccatccctccgtggtggagacagatggccatgctcgtgtagtggttcccacgctgaagcagcatagccaccctcctccattggccctaggttcagggctgcatgccccccataaaggcccacttccccaagcctctgaccccgctgtggccaggcagcaccgacctctgccatctaccccagacagctcccaccatgctcaggccacccccaggtggagatacaacaagccgctaccccctacccctgatttgccgcagccccaccttcctcccatttctgctcctggtagctcaaggatctacaggcctctacccccactacccatcatagaccctcccaccgaacc

SEQ ID NO: 342834 - DNA, 520 bp, Homo sapiens
tcactacaacctggactacaacatgcactacctcttggtccacaggctgtactccagcctgggcaatagccacagagtctcccgcctacggttcttccccatcctttgtctccatggaggatgtgaggatccacgaacctctgccccctcctcccccacagaggagggacacccatccctccgtggtggagacagatggccatgctcgtgtagtggttcccacgctgaagcagcatagccaccctcctccattggccctaggttcagggctgcatgccccccataaaggcccacttccccaagcctctgaccccgctgtggccaggcagcaccgacctctgccatctaccccagacagctcccaccatgctcaggccacccccaggtggagatacaacaagccgctaccccctacccctgatttgccgcagccccaccttcctcccatttctgctcctggtagctcaaggatctacaggcctctacccccactacccatcatagaccctcccaccgaacc

SEQ ID NO: 342835 - DNA, 518 bp, Homo sapiens
acgctctctctgtggggggcatcgcctgctgcctcttaaacaggtccgtctctactgtgcttccgggccacagagtctcccgcctacggttcttccccatcctttgtctccatggaggatgtgaggatccacgaacctctgccccctcctcccccacagaggagggacacccatccctccgtggtggagacagatggccatgctcgtgtagtggttcccacgctgaagcagcatagccaccctcctccattggccctaggttcagggctgcatgccccccataaaggcccacttccccaagcctctgaccccgctgtggccaggcagcaccgacctctgccatctaccccagacagctcccaccatgctcaggccacccccaggtggagatacaacaagccgctaccccctacccctgatttgccgcagccccaccttcctcccatttctgctcctggtagctcaaggatctacaggcctctacccccactacccatcatagaccctcccaccgaacc

SEQ ID NO: 342836 - DNA, 653 bp, Homo sapiens
gcagtccatgttcttttcccaaggttctggatatacctagtgctcacttggcagagcccacccgtgtgccaaagactctggtggccccattactcagctggttagttgttaccacttggcagtcctcatgacctttgctgatataactttctgctgaacttttgttctctgctaagcctcctgttttcttctgaagtagtgtgtaccatggctaaatctccttgacttgtttgcacagggataaggcttgtctcagtattttggctgtggaatatcgttctctcactgactggcctcttatattgggttaactagaatagactacaggaggtgtgacattgtaagtgaacctggggtgaggcacagggcagacaactccagcaaggcatggaatggatcctgttttgccttccccttaactgagaggcagccacctaacctatgtggtaaatgcctttcctccaaggttaggttcccttagagccctcttcattcactttgtggaatacagagagccaaatacaaatgggcttagttacaatatgtttatacttcaaagttgtctctcaggtatttgacatcctctccctcactagcctcattcatcttggaaatagaaggagattcctagatatcattgaacattttgaggt

SEQ ID NO: 342837 - DNA, 707 bp, Homo sapiens
gcagtccatgttcttttcccaaggttctggatatacctagtgctcacttggcagagcccacccgtgtgccaaagactctggtggccccattactcagctggttagttgttaccacttggcagtcctcatgacctttgctgatataactttctgctgaacttttgttctctgctaagcctcctgttttcttctgaagtagtgtgtaccatggctaaatctccttgacttgtttgcacagggataaggcttgtctcagtattttggctgtaaaatgctatcctgaaaggatggcaataagcaatctttacattccactgataagggaatatcgttctctcactgactggcctcttatattgggttaactagaatagactacaggaggtgtgacattgtaagtgaacctggggtgaggcacagggcagacaactccagcaaggcatggaatggatcctgttttgccttccccttaactgagaggcagccacctaacctatgtggtaaatgcctttcctccaaggttaggttcccttagagccctcttcattcactttgtggaatacagagagccaaatacaaatgggcttagttacaatatgtttatacttcaaagttgtctctcaggtatttgacatcctctccctcactagcctcattcatcttggaaatagaaggagattcctagatatcattgaacattttgaggt

SEQ ID NO: 342838 - DNA, 710 bp, Homo sapiens
ggacaatgctgaggagacccccctgactcaaaggaaatagactgcagcactgattggatgactttggaatgaaaaaaagtagttttcctttacaatgaggcttggcccccagggcgatggtgccacaagccagatcactgggaccactcagagaaagggaacacagaagcctggcatgccagcaaaaagcagggtttttgtgagcagtgtcttgcaccaaactcctgtctcctcctgtgacttagaatgcctaacttcctgggaatgcagcacaggtctcagcctcattttgcccagcccctattcaagacggatttgctgtggttcaaatgcttctgacaatattcctcatggtgaatgctggattttgcatgcccgaggccctgggccacactgtatgtttgctttttgcaagggctgtatggctatgactagttatgtggaccctgcattcctatgtaaatgaccctccataaaaaccccagaaatgaatgcttgagtgaacttccctggcttgtattataatactgtgaacatcttgtcacacatctttgctgggggaattaagtgtgtccctatgtgaccgtaatgggagataacacccagagttttgtgcctgctttcatgtggacttcattctatgtgatttttccctttggtgatcctggtctatatccttttattgtaataaactataaccataacagctt

SEQ ID NO: 342839 - DNA, 765 bp, Homo sapiens
atagtagggaaattctcatgataacaggccataaaagcccctgcagaaccatacaccatgtatcattacatatgtgaacgatgagatgggaagggagaacaagggaagcagaagtccaagatgaaactgggctcttccccaaggctggccctaaatggcgaagtaaggcaacacatctgattcactttattaagggagtaacaacatgaacacttaagtctcataaagaatcagaatcacccccacctccatatctcaacatgcagcccagtaataagccagagtacagcctcctcatagaacagaaggggtgaggccaggcaacttcctcaggcttaggggatgacacgcatggcacgttagctccccaagctgggggaaaatctagcaaacactttcaagggggaactttccacttccaccttcaaacttagctgaaagggcaggctgtattcctggagtatcctgagatggctcccaagaagcttacatataaaaggggccaattttgcccaaatctctttcaaattgacttccaatttaaaagaggctgagggtgtgcacttgctggttgacagctgtgtgtgcacattaaggggcaccagtctcagggccttagacaggtgagtttgcccctgcctcagagaccctggcacaaccagcccccctgcctggctggcttcctcaatgtcagacctcagtcaagtgtctcctcaagaggcctcatgggccactctacataacaagtcagctgctccctgttat

SEQ ID NO: 342840 - DNA, 110 bp, Homo sapiens
atctggtaacttgtacacttatactaaggcttacattctaacctaacttttcatggggccttatctcccagttagactattaatatgtataaggatttgctgaacggttg

SEQ ID NO: 342841 - DNA, 401 bp, Homo sapiens
gctatacaagaaccatggcaccagcatctgcttctgatgagagcctcaggcccccttcatttgtggcagaaggcagagtgaagctggtgtatgcagaggtcacatggtgaagaagatgcaagagagagagctgggaggtgccaggctatttttaacaaccagcacttgcaggaactagcacagtgtgaactcactcattacaaagaggatggcaccaagacatttatgagggatctgctcccatgacccaaacatctcccactagaccccactcccaacactgggcttcaacattcaatatgagatttggaggggggcaaacaaatgaaactatagcaacaacatttcatatactttgtaaatttgcctaggaagataatacaatacatgctattcagtta

SEQ ID NO: 342842 - DNA, 372 bp, Homo sapiens
ttcattcaccttctttatgtttgggttctttgccaaattggggaagtttttagcccttaatttcttcaagtactttttcagtcctcccctccctttctcctctgcttctgggactccagtgaaacaaatgtttgatctttcatatagtctcactggtccttgaggatctgttcatttgttcttccacctgtgttcttgatattatcatgcaacttctactatattctattttattgatttcctttgtttgtgccctcattctgctttttatcccatttactgcacttttatttaattattgtattttttggttctaaagtttccatttggttcacttatattttctgtttgtttgccaagattgtctgtttt

SEQ ID NO: 342843 - DNA, 956 bp, Homo sapiens
ggggcctcccggccctcgggcggggtgtcacttccaggtaccgcgagcacttccgggtcgtcagctcagttctgcggtttctgcggcggctggagaggtggtcggagaagtaggaacctcctgccgggctcgtggcggcttctgtccgctccgcggagggaagcgccttccccacaggacatcaatgcaagcttgaataagaaaaacaaattcttcctcctaagccatggcatatcagttatacagaaatactactttgggaaacagtcttcaggagagcctagatgagctcatacagtctcaacagatcaccccccaacttgcccttcaagttctacttcagtttgataaggctataaatgcagcactggctcagagggtcaggaacagagtcaatttcaggggctctctaaatacgtacagattctgcgataatgtgtggacttttgtactgaatgatgttgaattcagagaggtgacagaacttattaaagtggataaagtgaaaattgtagcctgtgatggtaaaaatactggctccaatactacagaatgaatagaaaaaatatgacttttttacaccatcttctgttattcattgcttttgaagagaagcatagaagagactttttatttattctagaattgcagaaatgactacactgtgctataccagagaattccagtagaaagaaacttgtaactctgtagcctcttacatcacctttattatacagcatgaaaacttaattcttttaggcaaaagtgtggttctaagaactgtttaataatctctacactccaaacaaccaaaaacaacaaatgctcgcgctcgccaactttacccgggcgcccaagtcagctccgtctcgcggtcgcttggttccaacgggcgcggcccggggcctgtagacgcacacggcgttgtcagtgtcgccctatacggccctcccaca

SEQ ID NO: 342844 - DNA, 674 bp, Homo sapiens
ggggcctcccggccctcgggcggggtgtcacttccaggtaccgcgagcacttccgggtcgtcagctcagttctgcggtttctgcggcggctggagaggtggtcggagaagtaggaacctcctgccgggctcgtggcggcttctgtccgctccgcggagggaagcgccttccccacaggtagtgggttagggagggcagggttagggagggaagcagggccgcgctccctgccgcccccccggagtcggagtgcgttggtggggtagtctctgagggcccttcgctcctgggatctgcccgttaccgaccgttgccggcaaggccccgcggccggcaccggagaagggcggcgaggcggcggtgatggtcgcgtcccgtggcgggaggctcgtcgttcacggggcgcccacagaacccacctaggggaggtcttcagcccaccaccgtattttcagccaggtgaatgtcttaaagcatccactagcgccctgtgagttttgccgaatttcggagagcattttttaaatgtctcattcctgtgctttgtagcttgttgtttgaagtctgccttccaactttcttcgtgcgaactccgacaaaaggaacgaattttaaacttggtggtttaatcaaaaaatgctaggacgagttacttccgaatttgacttctaatt

SEQ ID NO: 342845 - DNA, 887 bp, Homo sapiens
ggggcctcccggccctcgggcggggtgtcacttccaggtaccgcgagcacttccgggtcgtcagctcagttctgcggtttctgcggcggctggagaggtggtcggagaagtaggaacctcctgccgggctcgtggcggcttctgtccgctccgcggagggaagcgccttccccacaggacatcaatgcaagcttgaataagaaaaacaaattcttcctcctaagccatggcatatcagttatacagaaatactactttgggaaacagtcttcaggagagcctagatgagctcatacaggtgggagactgaattaaaaatcaaacatttttatcttgatgggtttacagtaattcttgtcatatcacttaggcaaagagatatgaggtaaaatatcttggactatttgacccagcaagtcagtaacactgattaaattacctcaaattcttgtttattacactgtcctgacaacaggacacaaaacatgattgaatgatatcattaaatatagctaaatctgggtacatgcagtgtttcatgcctctaatcccagcactttaggaggacaaggtggaaggatcgcttgaggccagaagtttgagaccagcttaagcaacatagcaccacccatctccacaaaaaataaaaaaattagttcggtgtgggcgcatgcctatagtcccagttactcgggaggctgaggtgagaggatggcttgaacccaggagtttgaggcttaagtgcactatgatggtaccactgtactccagccttggtgacagagcaacatcctgcctctaaataaataaagttaaatcttcaaaaatttttgttcaacataaaaattgagattgttggtttcccccttctcaaatttagggaagaa

SEQ ID NO: 342846 - DNA, 1299 bp, Homo sapiens
  misc_feature (1200)..(1200): n is a, c, g, or t
  misc_feature (1279)..(1279): n is a, c, g, or t
ggggcctcccggccctcgggcggggtgtcacttccaggtaccgcgagcacttccgggtcgtcagctcagttctgcggtttctgcggcggctggagaggtggtcggagaagtaggaacctcctgccgggctcgtggcggcttctgtccgctccgcggagggaagcgccttccccacaggacatcaatgcaagcttgaataagaaaaacaaattcttcctcctaagccatggcatatcagttatacagaaatactactttgggaaacagtcttcaggagagcctagatgagctcatacagtctcaacagatcaccccccaacttgcccttcaagttctacttcagtttgataaggctataaatgcagcactggctcagagggtcaggaacagagtcaatttcaggggctctctaaatacgtacagattctgcgataatgtgtggacttttgtactgaatgatgttgaattcagagaggtgacagaacttattaaagtggataaagtgaaaattgtagcctgtgatggtaaaaatactggctccaatactacagaatgaatagaaaaaatatgacttttttacaccatcttctgttattcattgcttttgaagagaagcatagaagagactttttatttattctagaattgcagaaatgactacactgtgctataccagagaattccagtagaaagaaacttgtaactctgtagcctcttacatcacctttattatacagcatgaaaaaccataacttctttttaaggacaaaagttgttgccttcctaagaaccttctttaataaactcattttaaaactctgagtaataactggtgaagctattaaggtagcaatatgaagatattagataatgcattttcccatttcctttgcaaggaacatgatgccctttcagaatgcttatttcaataaagtcatgttttgtcaaaaaaaaaaaagacctgagaactagaaagaaatgccgactgatgacgtacctggggagaccttcagctgttctattccttcttagcttaacatgaactaaaaacaagcttgattcccgctgtaaaaaaacaacacccctacaaaataaagttggacgccattatggccggcatattttggggcacaatttcgcccctaatgcgggcggtttatttacacaaatattcggcgcggggtgattttataccatcgnctcggacaagggcgacccctgggtggagccccccaatttatataacccctcttcagagaatacatcctcttttatagancgcggctgtggtgcaaactg

SEQ ID NO: 342847 - DNA, 1397 bp, Homo sapiens
  misc_feature (1298)..(1298): n is a, c, g, or t
  misc_feature (1377)..(1377): n is a, c, g, or t
tgacacaaccacacacaccccaaccccccacacgaaaccacaaacaaattagagctacgtaagaggctcacgatgttaatcagagcacgaggggagaggtggtcggagaagtaggaacctcctgccgggctcgtggcggcttctgtccgctccgcggagggaagcgccttccccacagcctctggaatgacttccctcctctgcttggctaaagtctagcttaaagaacctggaagcttttctgagccagctcacttctacaggcagcctccatggacatcaatgcaagcttgaataagaaaaacaaattcttcctcctaagccatggcatatcagttatacagaaatactactttgggaaacagtcttcaggagagcctagatgagctcatacagtctcaacagatcaccccccaacttgcccttcaagttctacttcagtttgataaggctataaatgcagcactggctcagagggtcaggaacagagtcaatttcaggggctctctaaatacgtacagattctgcgataatgtgtggacttttgtactgaatgatgttgaattcagagaggtgacagaacttattaaagtggataaagtgaaaattgtagcctgtgatggtaaaaatactggctccaatactacagaatgaatagaaaaaatatgacttttttacaccatcttctgttattcattgcttttgaagagaagcatagaagagactttttatttattctagaattgcagaaatgactacactgtgctataccagagaattccagtagaaagaaacttgtaactctgtagcctcttacatcacctttattatacagcatgaaaaaccataacttctttttaaggacaaaagttgttgccttcctaagaaccttctttaataaactcattttaaaactctgagtaataactggtgaagctattaaggtagcaatatgaagatattagataatgcattttcccatttcctttgcaaggaacatgatgccctttcagaatgcttatttcaataaagtcatgttttgtcaaaaaaaaaaaagacctgagaactagaaagaaatgccgactgatgacgtacctggggagaccttcagctgttctattccttcttagcttaacatgaactaaaaacaagcttgattcccgctgtaaaaaaacaacacccctacaaaataaagttggacgccattatggccggcatattttggggcacaatttcgcccctaatgcgggcggtttatttacacaaatattcggcgcggggtgattttataccatcgnctcggacaagggcgacccctgggtggagccccccaatttatataacccctcttcagagaatacatcctcttttatagancgcggctgtggtgcaaactg

SEQ ID NO: 342848 - DNA, 1234 bp, Homo sapiens
ggggcctcccggccctcgggcggggtgtcacttccaggtaccgcgagcacttccgggtcgtcagctcagttctgcggtttctgcggcggctggagaggtggtcggagaagtaggaacctcctgccgggctcgtggcggcttctgtccgctccgcggagggaagcgccttccccacaggacatcaatgcaagcttgaataagaaaaacaaattcttcctcctaagccatggcatatcagttatacagaaatactactttgggaaacagtcttcaggagagcctagatgagctcatacagtctcaacagatcaccccccaacttgcccttcaagttctacttcagtttgataaggctataaatgcagcactggctcagagggtcaggaacagagtcaatttcaggggctctctaaatacgtacagattctgcgataatgtgtggacttttgtactgaatgatgttgaattcagagaggtgacagaacttattaaagtggataaagtgaaaattgtagcctgtgatggtaaaaatactggctccaatactacagaatgaatagaaaaaatatgacttttttacaccatcttctgttattcattgcttttgaagagaagcatagaagagactttttatttattctagaattgcagaaatgactacactgtgctataccagagaattccagtagaaagaaacttgtaactctgtagcctcttacatcacctttattatacagcatgaaaaaccataacttctttttaaggacaaaagttgttgccttcctaagaaccttctttaataaactcattttaaaacaaaaaaaaaaaaaaaaaaaaaaaacacttgtggcgcacgcgcctacgggccactcgcgaaaaagacgttttcctaaaacacacatatcgcggttgtgggcgcgcggcgggcgcccaaagtaggggtaaggtggaacacatgtgggccaataagcgtggtgccccaaaggagaaaacccggggccaatggcacataaggcgctcgggaattccttcgcgcgcagagatataaaaaaacgcccccgcggggggggggaacaaacgggaaagcgggttcaggggaaaaccaaaaatgcccgagaaagggagagctacgagagagggcacaatcaacggggggaaccgctaaacataacagaggggggactcccaaaagggagagaccccggagaaagctggaaacatttggacagacccg

SEQ ID NO: 342849 - DNA, 1033 bp, Homo sapiens
  misc_feature (12)..(12): n is a, c, g, or t
  misc_feature (23)..(23): n is a, c, g, or t
  misc_feature (934)..(934): n is a, c, g, or t
  misc_feature (1013)..(1013): n is a, c, g, or t
tccgctccgcgnggtaagcgctntccccacagtctcaacagatcaccccccaacttgcccttcaagttctacttcagtttgataaggctataaatgcagcactggctcagagggtcaggaacagagtcaatttcaggggctctctaaatacgtacagattctgcgataatgtgtggacttttgtactgaatgatgttgaattcagagaggtgacagaacttattaaagtggataaagtgaaaattgtagcctgtgatggtaaaaatactggctccaatactacagaatgaatagaaaaaatatgacttttttacaccatcttctgttattcattgcttttgaagagaagcatagaagagactttttatttattctagaattgcagaaatgactacactgtgctataccagagaattccagtagaaagaaacttgtaactctgtagcctcttacatcacctttattatacagcatgaaaaaccataacttctttttaaggacaaaagttgttgccttcctaagaaccttctttaataaactcattttaaaactctgagtaataactggtgaagctattaaggtagcaatatgaagatattagataatgcattttcccatttcctttgcaaggaacatgatgccctttcagaatgcttatttcaataaagtcatgttttgtcaaaaaaaaaaaagacctgagaactagaaagaaatgccgactgatgacgtacctggggagaccttcagctgttctattccttcttagcttaacatgaactaaaaacaagcttgattcccgctgtaaaaaaacaacacccctacaaaataaagttggacgccattatggccggcatattttggggcacaatttcgcccctaatgcgggcggtttatttacacaaatattcggcgcggggtgattttataccatcgnctcggacaagggcgacccctgggtggagccccccaatttatataacccctcttcagagaatacatcctcttttatagancgcggctgtggtgcaaactg

SEQ ID NO: 342850 - DNA, 1179 bp, Homo sapiens
  misc_feature (1080)..(1080): n is a, c, g, or t
  misc_feature (1159)..(1159): n is a, c, g, or t
tgacacaaccacacacaccccaaccccccacacgaaaccacaaacaaattagagctacgtaagaggctcacgatgttaatcagagcacgaggggagaggtggtcggagaagtaggaacctcctgccgggctcgtggcggcttctgtccgctccgcggagggaagcgccttccccacagtctcaacagatcaccccccaacttgcccttcaagttctacttcagtttgataaggctataaatgcagcactggctcagagggtcaggaacagagtcaatttcaggggctctctaaatacgtacagattctgcgataatgtgtggacttttgtactgaatgatgttgaattcagagaggtgacagaacttattaaagtggataaagtgaaaattgtagcctgtgatggtaaaaatactggctccaatactacagaatgaatagaaaaaatatgacttttttacaccatcttctgttattcattgcttttgaagagaagcatagaagagactttttatttattctagaattgcagaaatgactacactgtgctataccagagaattccagtagaaagaaacttgtaactctgtagcctcttacatcacctttattatacagcatgaaaaaccataacttctttttaaggacaaaagttgttgccttcctaagaaccttctttaataaactcattttaaaactctgagtaataactggtgaagctattaaggtagcaatatgaagatattagataatgcattttcccatttcctttgcaaggaacatgatgccctttcagaatgcttatttcaataaagtcatgttttgtcaaaaaaaaaaaagacctgagaactagaaagaaatgccgactgatgacgtacctggggagaccttcagctgttctattccttcttagcttaacatgaactaaaaacaagcttgattcccgctgtaaaaaaacaacacccctacaaaataaagttggacgccattatggccggcatattttggggcacaatttcgcccctaatgcgggcggtttatttacacaaatattcggcgcggggtgattttataccatcgnctcggacaagggcgacccctgggtggagccccccaatttatataacccctcttcagagaatacatcctcttttatagancgcggctgtggtgcaaactg

SEQ ID NO: 342851 - DNA, 1246 bp, Homo sapiens
  misc_feature (1147)..(1147): n is a, c, g, or t
  misc_feature (1226)..(1226): n is a, c, g, or t
tgacacaaccacacacaccccaaccccccacacgaaaccacaaacaaattagagctacgtaagaggctcacgatgttaatcagagcacgaggggagaggtggtcggagaagtaggaacctcctgccgggctcgtggcggcttctgtccgctccgcggagggaagcgccttccccacaggacatcaatgcaagcttgaataagaaaaacaaattcttcctcctaagccatggcatatcagttatacagaaatactactttgggaaacagtcttcaggagagcctagatgagctcatacaggctataaatgcagcactggctcagagggtcaggaacagagtcaatttcaggggctctctaaatacgtacagattctgcgataatgtgtggacttttgtactgaatgatgttgaattcagagaggtgacagaacttattaaagtggataaagtgaaaattgtagcctgtgatggtaaaaatactggctccaatactacagaatgaatagaaaaaatatgacttttttacaccatcttctgttattcattgcttttgaagagaagcatagaagagactttttatttattctagaattgcagaaatgactacactgtgctataccagagaattccagtagaaagaaacttgtaactctgtagcctcttacatcacctttattatacagcatgaaaaaccataacttctttttaaggacaaaagttgttgccttcctaagaaccttctttaataaactcattttaaaactctgagtaataactggtgaagctattaaggtagcaatatgaagatattagataatgcattttcccatttcctttgcaaggaacatgatgccctttcagaatgcttatttcaataaagtcatgttttgtcaaaaaaaaaaaagacctgagaactagaaagaaatgccgactgatgacgtacctggggagaccttcagctgttctattccttcttagcttaacatgaactaaaaacaagcttgattcccgctgtaaaaaaacaacacccctacaaaataaagttggacgccattatggccggcatattttggggcacaatttcgcccctaatgcgggcggtttatttacacaaatattcggcgcggggtgattttataccatcgnctcggacaagggcgacccctgggtggagccccccaatttatataacccctcttcagagaatacatcctcttttatagancgcggctgtggtgcaaactg

SEQ ID NO: 342852 - DNA, 924 bp, Homo sapiens
  misc_feature (825)..(825): n is a, c, g, or t
  misc_feature (904)..(904): n is a, c, g, or t
tttagaggatcaccaacaatcgttcaggggctctctaaatacgtacagattctgcgataatgtgtggacttttgtactgaatgatgttgaattcagagaggtgacagaacttattaaagtggataaagtgaaaattgtagcctgtgatggtaaaaatactggctccaatactacagaatgaatagaaaaaatatgacttttttacaccatcttctgttattcattgcttttgaagagaagcatagaagagactttttatttattctagaattgcagaaatgactacactgtgctataccagagaattccagtagaaagaaacttgtaactctgtagcctcttacatcacctttattatacagcatgaaaaaccataacttctttttaaggacaaaagttgttgccttcctaagaaccttctttaataaactcattttaaaactctgagtaataactggtgaagctattaaggtagcaatatgaagatattagataatgcattttcccatttcctttgcaaggaacatgatgccctttcagaatgcttatttcaataaagtcatgttttgtcaaaaaaaaaaaagacctgagaactagaaagaaatgccgactgatgacgtacctggggagaccttcagctgttctattccttcttagcttaacatgaactaaaaacaagcttgattcccgctgtaaaaaaacaacacccctacaaaataaagttggacgccattatggccggcatattttggggcacaatttcgcccctaatgcgggcggtttatttacacaaatattcggcgcggggtgattttataccatcgnctcggacaagggcgacccctgggtggagccccccaatttatataacccctcttcagagaatacatcctcttttatagancgcggctgtggtgcaaactg

SEQ ID NO: 342853 - DNA, 1195 bp, Homo sapiens
  misc_feature (1096)..(1096): n is a, c, g, or t
  misc_feature (1175)..(1175): n is a, c, g, or t
tgacacaaccacacacaccccaaccccccacacgaaaccacaaacaaattagagctacgtaagaggctcacgatgttaatcagagcacgaggggagaggtggtcggagaagtaggaacctcctgccgggctcgtggcggcttctgtccgctccgcggagggaagcgccttccccacaggacatcaatgcaagcttgaataagaaaaacaaattcttcctcctaagccatggcatatcagttatacagaaatactactttgggaaacagtcttcaggagagcctagatgagctcatacagggctctctaaatacgtacagattctgcgataatgtgtggacttttgtactgaatgatgttgaattcagagaggtgacagaacttattaaagtggataaagtgaaaattgtagcctgtgatggtaaaaatactggctccaatactacagaatgaatagaaaaaatatgacttttttacaccatcttctgttattcattgcttttgaagagaagcatagaagagactttttatttattctagaattgcagaaatgactacactgtgctataccagagaattccagtagaaagaaacttgtaactctgtagcctcttacatcacctttattatacagcatgaaaaaccataacttctttttaaggacaaaagttgttgccttcctaagaaccttctttaataaactcattttaaaactctgagtaataactggtgaagctattaaggtagcaatatgaagatattagataatgcattttcccatttcctttgcaaggaacatgatgccctttcagaatgcttatttcaataaagtcatgttttgtcaaaaaaaaaaaagacctgagaactagaaagaaatgccgactgatgacgtacctggggagaccttcagctgttctattccttcttagcttaacatgaactaaaaacaagcttgattcccgctgtaaaaaaacaacacccctacaaaataaagttggacgccattatggccggcatattttggggcacaatttcgcccctaatgcgggcggtttatttacacaaatattcggcgcggggtgattttataccatcgnctcggacaagggcgacccctgggtggagccccccaatttatataacccctcttcagagaatacatcctcttttatagancgcggctgtggtgcaaactg

SEQ ID NO: 342854 - DNA, 990 bp, Homo sapiens
ggggcctcccggccctcgggcggggtgtcacttccaggtaccgcgagcacttccgggtcgtcagctcagttctgcggtttctgcggcggctggagaggtggtcggagaagtaggaacctcctgccgggctcgtggcggcttctgtccgctccgcggagggaagcgccttccccacaggacatcaatgcaagcttgaataagaaaaacaaattcttcctcctaagccatggcatatcagttatacagaaatactactttgggaaacagtcttcaggagagcctagatgagctcatacagtctcaacagatcaccccccaacttgcccttcaagttctacttcagtttgataaggctataaatgcagcactggctcagagggtcaggaacagagtcaatttcaggggctctctaaatacgtacagattctgcgataatgtgtggacttttgtactgaatgatgttgaattcagagaggtgacagaacttattaaagtggataaagtgaaaattgtagcctgtgatggtaaaaatactggctccaatactacagaatgaatagatcaccccccaacttgcccttcaagttctacttcagtttgataaggctataaatgcagcactggctcagagggtcaggaacagagtcgatttcaggggctctctgaatacgtacagattctgcgataatgtgtggacttttgtactggatgacctgttgacttcagagaggtgactagaacttattaaagtgggatatcgtgcaaactgtcgcctgtgagggtaaaacatactggtccaatacttcagaatggttgaacaactgtgacgttttaccaccacttctgtatccatgcctttggcgagagctaaagagactttcattatctcgaatggaatgacacatggggttgcgagattcagcagagaaagggactgggcccttatacgttaaaggggacaattttgggatgtgcccaagccaaaactca

SEQ ID NO: 342855 - DNA, 1172 bp, Homo sapiens
  misc_feature (1073)..(1073): n is a, c, g, or t
  misc_feature (1152)..(1152): n is a, c, g, or t
ggggcctcccggccctcgggcggggtgtcacttccaggtaccgcgagcacttccgggtcgtcagctcagttctgcggtttctgcggcggctggagaggtggtcggagaagtaggaacctcctgccgggctcgtggcggcttctgtccgctccgcggagggaagcgccttccccacaggacatcaatgcaagcttgaataagaaaaacaaattcttcctcctaagccatggcatatcagttatacagaaatactactttgggaaacagtcttcaggagagcctagatgagctcatacagtctcaacagatcaccccccaacttgcccttcaagttctacttcagtttgataaggctataaatgcagcactggctcagagggtcaggaacagagtcaatttcaggatactggctccaatactacagaatgaatagaaaaaatatgacttttttacaccatcttctgttattcattgcttttgaagagaagcatagaagagactttttatttattctagaattgcagaaatgactacactgtgctataccagagaattccagtagaaagaaacttgtaactctgtagcctcttacatcacctttattatacagcatgaaaaaccataacttctttttaaggacaaaagttgttgccttcctaagaaccttctttaataaactcattttaaaactctgagtaataactggtgaagctattaaggtagcaatatgaagatattagataatgcattttcccatttcctttgcaaggaacatgatgccctttcagaatgcttatttcaataaagtcatgttttgtcaaaaaaaaaaaagacctgagaactagaaagaaatgccgactgatgacgtacctggggagaccttcagctgttctattccttcttagcttaacatgaactaaaaacaagcttgattcccgctgtaaaaaaacaacacccctacaaaataaagttggacgccattatggccggcatattttggggcacaatttcgcccctaatgcgggcggtttatttacacaaatattcggcgcggggtgattttataccatcgnctcggacaagggcgacccctgggtggagccccccaatttatataacccctcttcagagaatacatcctcttttatagancgcggctgtggtgcaaactg

SEQ ID NO: 342856 - DNA, 829 bp, Homo sapiens
gtaagtgcttgccttatttctgtgaaagctacttgaaaccttgtttttatgagcctttagaagatctgcatccatatgaaaagcctaacgggtaaaatggccctatgatcaattcccagataagcccaggcttttatctccactaaattctgattacatatctcaaacagtgctcttactttgtgacttaataacatatagactgcttacacaggttggatttgtgtgggtaaaataagcaaattaataagcatttgttccctatttccattacaaattttaagtgtttatcaggcttttcagacaccttttactttaaggaataatttttacaatcctatggtttctatgttgctggagacccatatatttaaagagttattttaaacaggattttaattagccataagaactttggagtcatgatggtaaatattcatctaatctgttaaatatgacatgtgcaagtgaacttttcacaccagacctaggaacttcttcaggtccttaaatgtttcaaaaactatacacctaatttctgtttcatgattagtttatttcctttttgctaattatattattttaaatatacttcataatctgaaccatttgtgttaagagcagctattccagaaagtaaatagaaaagactgctgctctttgacacagggagttttgaaaagcaagagaaagatatgtagaaagtaaccccctccatttccctgtttgagtcggatttgttttatatattttgcatttccaaagaaatagctaatcaatcaatcactgaaaaaatgtagagaatacaaaaaagcacatggaagaaaaa

SEQ ID NO: 342857 - DNA, 626 bp, Homo sapiens
agggaaaattgacaaagttttgttctggctttgtaacatcactgcatgttttctcttcaagattgtttgtgtcaagatagtacaaaagatgtcttcaagcttggtgcttcatcatcagttatggcaaaggagataaaggaattctagtttagaggctttggttaacctcagttaaattttagatgataatttgtatatttttatttactttgtctttaatgttcttccttaacgggatttatgacctttaccttttctcagttctcaacagatcaccccccaacttgcccttcaagttctacttcagtttgataaggctataaatgcagcactggctcagagggtcaggaacagagtcaatttcagggtaaggatattttcctgaatctagaagcctgtaccaatggttgttaaaacactgatttttttttaggacccctacatatttattaatcataagaggaagaggtggcttagtcaatttttggaacttgttttatagtaactaaattatacttttcaatcaactataaactaagttgatccacttaatgtgagatacagagatgtttttagatttttatttcattgtttcacaaatcagcctttgtatgtttggctacctt

SEQ ID NO: 342858 - DNA, 848 bp, Homo sapiens
cccacgcgtcgcggacggccggggtcgacccacgcgtccgggctctctaaatacgtacagattctgcgataatgtgtggacttttgtactgaatgatgttgaattcagagaggtgacagaacttattaaagtggataaagtgaaaattgtagcctgtgatggtaaaaatactggctccaatactacagaatgaatagaaaaaatatgacttttttacaccatcttctgttattcattgcttttgaagagaagcatagaagagactttttatttattctagaattgcagaaatgactacactgtgctataccagagaattccagtagaaagaaacttgtaactctgtagcctcttacatcacctttattatacagcatgaaaaaccataacttctttttaaggacaaaagttgttgccttcctaagaaccttctttaataaactcattttaaaacacgtcaagaaaagcaagagacacgacaaaagggagaaaggaacagcagcagggcggaaagcgcaggacggagaaccgaaggggggcgagcaagacaggagggagagagagggggaccagaggagggcggagaagaaagcggcggggaggagagagggggccaggaggggggggagagcgtcaacggaaacgactcagatacacgcaacgcaaaacggagaaagaaaagataagtcacgggaaaaaaagacgccgagcagatgtggagaacccacagagacaacaacggaatgcagaaaaatagagagatagagtatagccgagacacagaggaaaagagacacggggagagaaaagagcggggaccacgagaacaccaaacaacaccacggagg

SEQ ID NO: 342859 - DNA, 1300 bp, Homo sapiens
  misc_feature (1201)..(1201): n is a, c, g, or t
  misc_feature (1280)..(1280): n is a, c, g, or t
tgacacaaccacacacaccccaaccccccacacgaaaccacaaacaaattagagctacgtaagaggctcacgatgttaatcagagcacgaggggagaggtggtcggagaagtaggaacctcctgccgggctcgtggcggcttctgtccgctccgcggagggaagcgccttccccacaggacatcaatgcaagcttgaataagaaaaacaaattcttcctcctaagccatggcatatcagttatacagaaatactactttgggaaacagtcttcaggagagcctagatgagctcatacagtctcaacagatcaccccccaacttgcccttcaagttctacttcagtttgataaggctataaatgcagcactggctcagagggtcaggaacagagtcaatttcaggggctctctaaatacgtacagattctgcgataatgtgtggacttttgtactgaatgatgttgaattcagagaggtgacagaacttattaaagtggataaagtgaaaattgtagcctgtgatggtaaaaatactggctccaatactacagaatgaatagaaaaaatatgacttttttacaccatcttctgttattcattgcttttgaagagaagcatagaagagactttttatttattctagaattgcagaaatgactacactgtgctataccagagaattccagtagaaagaaacttgtaactctgtagcctcttacatcacctttattatacagcatgaaaaaccataacttctttttaaggacaaaagttgttgccttcctaagaaccttctttaataaactcattttaaaactctgagtaataactggtgaagctattaaggtagcaatatgaagatattagataatgcattttcccatttcctttgcaaggaacatgatgccctttcagaatgcttatttcaataaagtcatgttttgtcaaaaaaaaaaaagacctgagaactagaaagaaatgccgactgatgacgtacctggggagaccttcagctgttctattccttcttagcttaacatgaactaaaaacaagcttgattcccgctgtaaaaaaacaacacccctacaaaataaagttggacgccattatggccggcatattttggggcacaatttcgcccctaatgcgggcggtttatttacacaaatattcggcgcggggtgattttataccatcgnctcggacaagggcgacccctgggtggagccccccaatttatataacccctcttcagagaatacatcctcttttatagancgcggctgtggtgcaaactg

SEQ ID NO: 342860 - DNA, 1168 bp, Homo sapiens
  misc_feature (1069)..(1069): n is a, c, g, or t
  misc_feature (1148)..(1148): n is a, c, g, or t
ttttttttgctagttttgtctttttggcaaataggagtccctcagaatctacacttgctctgaaatgtagaaaaacaaattcttcctcctaagccatggcatatcagttatacagaaatactactttgggaaacagtcttcaggagagcctagatgagctcatacagtctcaacagatcaccccccaacttgcccttcaagttctacttcagtttgataaggctataaatgcagcactggctcagagggtcaggaacagagtcaatttcaggggctctctaaatacgtacagattctgcgataatgtgtggacttttgtactgaatgatgttgaattcagagaggtgacagaacttattaaagtggataaagtgaaaattgtagcctgtgatggtaaaaatactggctccaatactacagaatgaatagaaaaaatatgacttttttacaccatcttctgttattcattgcttttgaagagaagcatagaagagactttttatttattctagaattgcagaaatgactacactgtgctataccagagaattccagtagaaagaaacttgtaactctgtagcctcttacatcacctttattatacagcatgaaaaaccataacttctttttaaggacaaaagttgttgccttcctaagaaccttctttaataaactcattttaaaactctgagtaataactggtgaagctattaaggtagcaatatgaagatattagataatgcattttcccatttcctttgcaaggaacatgatgccctttcagaatgcttatttcaataaagtcatgttttgtcaaaaaaaaaaaagacctgagaactagaaagaaatgccgactgatgacgtacctggggagaccttcagctgttctattccttcttagcttaacatgaactaaaaacaagcttgattcccgctgtaaaaaaacaacacccctacaaaataaagttggacgccattatggccggcatattttggggcacaatttcgcccctaatgcgggcggtttatttacacaaatattcggcgcggggtgattttataccatcgnctcggacaagggcgacccctgggtggagccccccaatttatataacccctcttcagagaatacatcctcttttatagancgcggctgtggtgcaaactg

SEQ ID NO: 342861 - DNA, 1211 bp, Homo sapiens
ggggcctcccggccctcgggcggggtgtcacttccaggtaccgcgagcacttccgggtcgtcagctcagttctgcggtttctgcggcggctggagaggtggtcggagaagtaggaacctcctgccgggctcgtggcggcttctgtccgctccgcggagggaagcgccttccccacaggacatcaatgcaagcttgaataagaaaaacaaattcttcctcctaagccatggcatatcagttatacagaaatactactttgggaaacagtcttcaggagagcctagatgagctcatacagtctcaacagatcaccccccaacttgcccttcaagttctacttcagtttgataaggctataaatgcagcactggctcagagggtcaggaacagagtcaatttcaggggctctctaaatacgtacagattctgcgataatgtgtggacttttgtactgaatgatgttgaattcagagaggtgacagaacttattaaagtggataaagtgaaaattgtagcctgtgatggtaaaaatactggctccaatactacagaatgaatagaaaaaatatgacttttttacaccatcttctgttattcattgcttttgaagagaagcatagaagagactttttatttattctagaattgcagaaatgactacactgtgctataccagagaattccagtagaaagaaacttgtaactctgtagcctcttacatcacctttattatacagcatgaaaaaccataacttctttttaaggacaaaagttgttgccttcctaagaaccttctttaataaactcattttaaaacacgtcaagaaaagcaagagacacgacaaaagggagaaaggaacagcagcagggcggaaagcgcaggacggagaaccgaaggggggcgagcaagacaggagggagagagagggggaccagaggagggcggagaagaaagcggcggggaggagagagggggccaggaggggggggagagcgtcaacggaaacgactcagatacacgcaacgcaaaacggagaaagaaaagataagtcacgggaaaaaaagacgccgagcagatgtggagaacccacagagacaacaacggaatgcagaaaaatagagagatagagtatagccgagacacagaggaaaagagacacggggagagaaaagagcggggaccacgagaacaccaaacaacaccacggagg

SEQ ID NO: 342862 - DNA, 1086 bp, Homo sapiens
  misc_feature (987)..(987): n is a, c, g, or t
  misc_feature (1066)..(1066): n is a, c, g, or t
tcgacggggaacgggaggagtctccaggagacccggggacagcatcgcccaggcccctgtttgcaggcctttcagatatatccatctcacaagacatccccgtagaaggagaaatcaccattcctatgagatctcgcatccgggagtttgacagctccacattaaatgaatctgttcgcaataccatcatgcgtgatctaaaagctgttgggaaaaaattcatgcatgttttgtacccaaggaaaagtaatactcttttgagagattgggatttattaaagtggataaagtgaaaattgtagcctgtgatggtaaaaatactggctccaatactacagaatgaatagaaaaaatatgacttttttacaccatcttctgttattcattgcttttgaagagaagcatagaagagactttttatttattctagaattgcagaaatgactacactgtgctataccagagaattccagtagaaagaaacttgtaactctgtagcctcttacatcacctttattatacagcatgaaaaaccataacttctttttaaggacaaaagttgttgccttcctaagaaccttctttaataaactcattttaaaactctgagtaataactggtgaagctattaaggtagcaatatgaagatattagataatgcattttcccatttcctttgcaaggaacatgatgccctttcagaatgcttatttcaataaagtcatgttttgtcaaaaaaaaaaaagacctgagaactagaaagaaatgccgactgatgacgtacctggggagaccttcagctgttctattccttcttagcttaacatgaactaaaaacaagcttgattcccgctgtaaaaaaacaacacccctacaaaataaagttggacgccattatggccggcatattttggggcacaatttcgcccctaatgcgggcggtttatttacacaaatattcggcgcggggtgattttataccatcgnctcggacaagggcgacccctgggtggagccccccaatttatataacccctcttcagagaatacatcctcttttatagancgcggctgtggtgcaaactg

SEQ ID NO: 342863 - DNA, 1227 bp, Homo sapiens
  misc_feature (1128)..(1128): n is a, c, g, or t
  misc_feature (1207)..(1207): n is a, c, g, or t
ggggcctcccggccctcgggcggggtgtcacttccaggtaccgcgagcacttccgggtcgtcagctcagttctgcggtttctgcggcggctggagaggtggtcggagaagtaggaacctcctgccgggctcgtggcggcttctgtccgctccgcggaggacatcaatgcaagcttgaataagaaaaacaaattcttcctcctaagccatggcatatcagttatacagaaatactactttgggaaacagtcttcaggagagcctagatgagctcatacagtctcaacagatcaccccccaacttgcccttcaagttctacttcagtttgataaggctataaatgcagcactggctcagagggtcaggaacagagtcaatttcaggggctctctaaatacgtacagattctgcgataatgtgtggacttttgtactgaatgatgttgaattcagagaggtgacagaacttattaaagtggataaagtgaaaattgtagcctgtgatggtaaaaatactggctccaatactacagaatgaatagaacatagaagagactttttatttattctagaattgcagaaatgactacactgtgctataccagagaattccagtagaaagaaacttgtaactctgtagcctcttacatcacctttattatacagcatgaaaaaccataacttctttttaaggacaaaagttgttgccttcctaagaaccttctttaataaactcattttaaaactctgagtaataactggtgaagctattaaggtagcaatatgaagatattagataatgcattttcccatttcctttgcaaggaacatgatgccctttcagaatgcttatttcaataaagtcatgttttgtcaaaaaaaaaaaagacctgagaactagaaagaaatgccgactgatgacgtacctggggagaccttcagctgttctattccttcttagcttaacatgaactaaaaacaagcttgattcccgctgtaaaaaaacaacacccctacaaaataaagttggacgccattatggccggcatattttggggcacaatttcgcccctaatgcgggcggtttatttacacaaatattcggcgcggggtgattttataccatcgnctcggacaagggcgacccctgggtggagccccccaatttatataacccctcttcagagaatacatcctcttttatagancgcggctgtggtgcaaactg

SEQ ID NO: 342864 - DNA, 322 bp, Homo sapiens
tcttcagcttgtgctgagacaggcctcaaagtagcagtgcagcgcaaagcttggagagctaagatttcatcactgtcgaagtgttgcactgccctctgaagggcttatgcatggaacaggcccaaagccacatagcaaaggatttgaattaagtgtagaacttccatccaccaaaaacaaggcaccacatgtagtctgaacctaactggggtgattacctgctgaaaacatctgtactctcctgaaaattaagcagaggctgtgcagcatcacattcacagtacaatccagaattagtcaacacagctgaagagacctggaa

SEQ ID NO: 342865 - DNA, 134 bp, Homo sapiens
tacaacatttgcccaaagtcagagctgataaatggtgtgggttaggcatgaatcctcaaccactactcactgaattttcacaaaaattctacaaaaggtgtactatcaaccccacttttttttttttttttttt

SEQ ID NO: 342866 - DNA, 321 bp, Homo sapiens
cttggccaggctggtcttgaactcctgacctcatgatccacccacctcaggttcctaaagtgctgggattacaggcttgagccactgcaaccagcctttaacatttattaaacatgccaactttttgatatatggggggagtaaagacatcttaatcacttttacagattttacaaagaatatattttggctattagcagaaatagaaaagagggcacagaattctagctagaaggaacggaatcaggaaaggcagggagatgtgacttcatagcacacagggaaactgaaaaaggtgaacaggactgagaactgtgacag

SEQ ID NO: 342867 - DNA, 390 bp, Homo sapiens
agctcactgcaacctccgcctcccggattcaagctattctcatgcctcagcctcccaggtagctgggattacaggtgcccactaccacacccagctaatttttgtatttttagtagaggtggggtttctccatgttggccagactggtctcgaattcctgacctcgagtgatccacctgcctcagcttcccgaaatgctgggattacagatgtgagcccagccctacctaagatttttatcttaaacattaaaacctatttagacatatttaggcatggattattttcattgtattatacttttaaatacattaaaatgaaaataaaagcagaaattgattaaggtattcctaaaacttctttatatttactcctctaaatcactttttg

SEQ ID NO: 342868 - DNA, 393 bp, Homo sapiens
tgcacttgctaaaacattctcctctctgggtctggaagcctagagtctatatccatatgaggcactgggcaggtattccagacttctgagtcatggatgaaaaatgccatcttgcaactgacacagcaattcctttgccaagaaatcatcatatccttagtttcttatgttgaggaaaagtgatgaattaattacaaatttctgcaaatggaagttcattcatttatttggccaccaaatattttttgagtttggagatcaaagcagtagagtctcaactctgaagtcagacagacctgggtggaatcctggccataccattttcaagctatgtaacctcgaagaaattctgtaatctctctaaacctcaataaaatgaaaatgttcacagtg

SEQ ID NO: 342869 - DNA, 370 bp, Homo sapiens
tggagtgctttttccagagaggatctgtttatttctcctgagacaatgacaacacccacctctgtgtatattttactgcttttaagggttcccgttcaatcctgatctctgactcagatctcccactagagcactgatatggccatctgccctcagggcaacccagcttagagtgtttaaaattctctataagcacaacagtacattaatcagaagggcccattagaggatctagttttccctacttctaaaagtggaagttcaaacctgtgtttcaattttacatacactcttatataatgtaccctcccttagagtgcaaagtatcagtactatcctttatcatcagtttaggagttatatgtagtat

SEQ ID NO: 342870 - DNA, 324 bp, Homo sapiens
gttctgtgaaaaacaatatggcagttcctgaagaagctaaccacagcgaattacaaaaacaacccagcaattccattccaaggaacatacccagatgaattgcaaatagggacttaaaccaataattgtatgccaatgttcactgcagtatccagtttagccaaaaggtgcaaaatgtccacctgaatagagtattactgagcattaaaaaggaatgaaattctggtacatactgcaacacagatgaaccttgaaaatattatactaaatgaaagtagtcagacacaaaaatacaaatattttattattccacttacattaaat

SEQ ID NO: 342871 - DNA, 417 bp, Homo sapiens
tttctctccagtgaataacacaatgtagttattcactggaaaacatcatttgcatttgaaagagttactaactaaattctaaagaatgtaccaaagccttgcttaactgtagaatgaggccacacggctgctgggataccaggtactctccctgagcctattgatggcaaatttcatcctgtgaaaaatgggaacaagacacccacttcataggactattatatggttgaaattaaatatgtgtaaaatgcataacatggtgcctggcacacagtaaacacaaaacagatttcttcctctatagcatttaaatgggaagtatttagcgtttacttgccatgtgcatgagtgaatttgggaaaagtggggggaggatatggggcaaagaaggacagaaagggcctaagagtaggaaga

SEQ ID NO: 342872 - DNA, 157 bp, Homo sapiens
ggcaggacttagtatataaatgattgttcaatgaaaggtggaatgaaggagaagagaattatttgagacctccatttatttgtacatgtatatattagatttgtgtgtatttgcctaaaattttggtcagtctcattcctatgccttcatgtagctt

SEQ ID NO: 342873 - DNA, 227 bp, Homo sapiens
aattaaataatgtttataaaaaaagtgagataatgcttgtctgacttcagtttaagcagtcaataaaacatttccattaccactgctattatcactttattcccagtgaagattcctataacaaagacactgggaattcctccagcaaaggaacctgttgacatttttaaaaccatgtacatcgtgtgtgtgtgtgtgtgtgtgtgtgtgtgtgtgtgtgtgtgtgt

SEQ ID NO: 342874 - DNA, 638 bp, Homo sapiens
aaaaaaaaaaaaaaaaaaaacggcaactctttggcaaatagagctctggaagatgcgctggctggcgccgacataaactgctatcctgatctccatcaaagatgtgggccttctcatgctgcagtttcctcaactgcagaacagggagattcttccaatgataattttacctcgaagtgatgttgtaataaagatggtggtaaaagcattttgcaagaccaatttctgaggaaaccctctggtctaagattctagagagtctacagaggttgataactgggattggcttttaagatcttttctggaatggctgttccctttacctcattattactttaaacaactttggcaggagatatcagtaatgccaataacaataatgatgatgatgatgatggttactgagtagttactgatgagcccagcactgtgctaaacacttgaaggacctttttttttttttttttttgacagagtcttgctctgtcaccaggctggagtgcagtggtgtaatctcagctcacagcaacctccgcctcccaggttcaagcaattctcctgcctcagccttccgtgtagcttggactacaggcacgcaccaccacgcccagctaatttttgtatttttagtagagacg

SEQ ID NO: 342875 - DNA, 692 bp, Homo sapiens
aaaaaaaaaaaaaaaaaaaacggcaactctttggcaaatagagctctggaagatgcgctggctggcgccgacataaactgctatcctgatctccatcaaagatgtgggccttctcatgctgcagtttcctcaactgcagaacagggagattcttccaatgataattttacctcgaagtgatgttgtaataaagatggtggtaaaagcattttgcaagaccaaaaaaagaaacacctactaaacaggcatgctgtctatatctggtgtttgttagaatttctgaggaaaccctctggtctaagattctagagagtctacagaggttgataactgggattggcttttaagatcttttctggaatggctgttccctttacctcattattactttaaacaactttggcaggagatatcagtaatgccaataacaataatgatgatgatgatgatggttactgagtagttactgatgagcccagcactgtgctaaacacttgaaggacctttttttttttttttttttgacagagtcttgctctgtcaccaggctggagtgcagtggtgtaatctcagctcacagcaacctccgcctcccaggttcaagcaattctcctgcctcagccttccgtgtagcttggactacaggcacgcaccaccacgcccagctaatttttgtatttttagtagagacg

SEQ ID NO: 342876 - DNA, 402 bp, Homo sapiens
aaaaaaaaaaaaaaaaaaaacggcaactctttggcaaatagagctctggaagatgcgctggctggcgccgacataaactgctatcctgatctccatcaaagatgtgggccttctcatgctgcagtttcctcaactgcagaacagggagattcttccaatgataattttacctcgaagtgatgttgtaataaagatggtggtaaaagcattttgcaagacctgagcaagccaggcctggcttgctcaggtctggcccccaccctcagccagctggaccgcaacctagacagagaaatgaaaccagacccgacactcctagtgacgtctcgacacaacgtcttccagaatgacgagtttaatgtgttcagcagggactcagtaaacctgagcaaccagggggat

SEQ ID NO: 342877 - DNA, 302 bp, Homo sapiens
gtggcaggaggggatggcttatagtacttgtatacaaatttatttgcttgtttattaattacggggtctctctctgttgcccaggctggagtacaggggcacaatcgtaactcctgggctcaagtgatcctcctgcctcaggctcctgagtaacttggattacaggcacatgccaccaggcccagctgattttttcaaattgtctcactatgttgcccaggctggtctccaacttctgggctcaagtgatacttccaccttagcctcctattagtttttcccttacagcaattcctgcaata

SEQ ID NO: 342878 - DNA, 440 bp, Homo sapiens
ttctctgtagcaagtatcttttctcttgcacacactcaactttctcccagacggaattagtatgtattccatagccattactgtggttgcaaaatgtagactttcacagacccggaagatatctacgttttgacagatacatagattccttccagacccaaagaacgataggtagaactggtgaagtagaagaggttaaaggtggaaattatgcagaaaaacagctacctatccacaaattaaccattttgatatctacttcaaagactacatcaacatgccaattcttatttaaaaagagatgcttgtaaaaaggtccgaaaatggctaggtacagtggctcatgcctgtaaatcccagcaccctgagagaccgatgctggtagatcacttgaggccaggagttcaagaccatcttggccacgtagcgaaatcccatct

SEQ ID NO: 342879 - DNA, 292 bp, Homo sapiens
ataggctcttgaatagtttttatagtctagtcagaggtaaagcacatggatgaacactgtggcagttactttcctatccagttttagattttcagcttacttttatgtctaaagttgtattccaaagaatttgaactattaagtagtctgtacgctagctaaatagaagattatgtactacaatattacagaggttccttaagggtagtgctgactctccaagtagtcaaaattttagaatctctgccacttctctgtagcaagtatcttttctcttgcacacactcaactt

SEQ ID NO: 342880 - DNA, 119 bp, Homo sapiens
tgcctgccttcctccccaccccctccttcccgtggttcagcaccgcatttcggagcgtgagctgggagcaatcaactcgacctgacctggaaagtgttggtcagcccccgcgcgcttga

SEQ ID NO: 342881 - DNA, 299 bp, Homo sapiens
agtggggactaataacagtgacctccccgccaggtcctgtgtgttgccggctgaagaagggtagctgaaaaattcagacccagcacagtgtttatgttggtcaaaaatagaaaactatgtctggcgtggccgaggcgggaggacccttcaggccaagagcagcctagcaacatggcgcaaccccatctctgtagtcctacctcagacccccagctacttgaacccaaaggttcaaggctccagtgagctatgatcccaccacagcattccagcctgcgagattgaggtaaaccctgtct

SEQ ID NO: 342882 - DNA, 381 bp, Homo sapiens
catttctgttttcagctctagggagcaattgattatgagatgtcatgaggagcaactctgaagactctgttccagcttaagggaatcagccagtccatccctgtttctctgtcattgagcctaattaagtagggtgtgtgtgtgtgtgtgtgtgtgtgtgtgtgtgtggcaaaactccaactacaattgagagaatacctcagtttggcaggcttgagatgcatatacctgttattagccatagttgggagtggcttttccaaagatgacatcacttggtgtgtcttagatggaaaggaggtcctgtgatgcttttgataaaaaatctgtataaagagttgcttgagggccaacttgaataccagactagaaaaacatggt

SEQ ID NO: 342883 - DNA, 474 bp, Homo sapiens
gtgcccttccttcaggccccaattctctctctctcaagatagaaacaggtaagggaaatttcctcagaaacataaatataacttaactgagttatctgaacccaaagaccacccttgatggccaccatgtatgtagctcaatggaggggaaagaagatatttcaggaagctgctttatcagtgggatttctctacaaattagaaaaacctgcacactattaactcacaacgtggaagaagcggccaatcactgggttctgttttagacacaaaaagaaaagagggcagggccataagaaagggggagaaaaatgagagaaacaaatgtctctggagatttataccatcagaaaggccagcccctcctcccatagcccctacacccacagggcaggaagtagctcgactggaagtaaatagcaaataagtggaaagtttggggtaggggacacagtgagaagaggaagaagaaag

SEQ ID NO: 342884 - DNA, 351 bp, Homo sapiens
tctgtcacccaggctggagtgcagtggcacaatctctgctcactgcagtctccgtctcctgggttcaagagattctcctgcctcagccaccctagtagctgggattacaggtatgcatcatcacgccaggctaatttttgtatttttaggagagatggggtttcaccatgttggccaggctggtcccaaactcctgacctcatcaagtgatccgcccatctcagccttgcaaagtgctgggaagatctggcttttaattttgcagtgcccatttgcccaccaagtgagggagatggtgggatatatgtgttgggattaatcagaaaggttgatactggagacaaatttgct

SEQ ID NO: 342885 - DNA, 2823 bp, Homo sapiens
  misc_feature (34)..(34): n is a, c, g, or t
  misc_feature (2106)..(2106): n is a, c, g, or t
  misc_feature (2823)..(2823): n is a, c, g, or t
gcttatctgtctcgaagcacacacagacaaaatncttttaaaaaagaagggtccactctcgctctactgcaaatcctgaaactccaaactcaaccatctccagagaggccagcacccagtcctcatcagctgcaaccagccaaggctatattttaccagaaggcaaaatcatgccaaacactgtttttgttggaggaattgatgttaggatggatgaaactgagattagaagcttctttgctagatatggttcagtgaaagaagtgaagataatcactgatcgaactggtgtgtccaaaggctatggatttgtttcattttttaatgacgtggatgtgcagaagatagtagaatcacagataaatttccatggtaaaaagctgaagctgggccctgcaatcaggaaacaaaatttatgtgcttatcatgtgcagccacgtcctttggtttttaatcatcctcctccaccacagtttcagaatgtctggactaatccaaacactgaaacttatatgcagcccacaaccacgatgaatcctataactcagtatgttcaggcatatcctacttacccaaattcaccagttcaggtcatcactggatatcagttgcctgtatataattatcagatgccaccacagtggcctgttggggagcaaaggagctatgttgtacctccggcttattcagctgttaactaccactgtaatgaagttgatccaggagctgaagttgtgccaaatgaatgttcagttcatgaagctactccaccctctggaaatggcccacaaaagaaatctgtggaccgaagcatacaaacggtggtatcttgtctgtttaatccagagaacagactgagaaactctgttgttactcaagatgactacttcaaggataaaagagtgcatcactttagaagaagtcgggcaatgcttaaatctgtttgatcctcctggcttatctagttacatgggaagttgctggttttgaatattaagctaaaaggtttccactattatagaaattctgaattttggtaaatcacactcaaactttgtgtataagttgtattattagactctctagttttatcttaaactgttcttcattagatgtttatttagaaactggttctgtgttgaaatatagttgaaagtaaaaaaataattgagactgaaagaaactaagatttatctgcaaggattttttaaaaattggcattttaagtgtttaaaagcaaatactgattttcaaaaaaatgtttttaaaaacctattttgaaaggtcagaattttgttggtctgaatacaaacatttcacttctccaacaagtacctgtgaacagtacagtatttacagtattgagctttgcatttatgatttctccagaaatttaccacaaaagcaaaatttttaaaactgcatttttaatcagtggaactcaatatatagttagctttattgaagtcttcttatctaaacccagcaaaacagattcaaagcgaacagtccaatcagtgggtcatatgtttattcaaaatattttatcttttagctagaatccacacatatatatcctatttgattagggtagtaattaggataactaaaattctgggcctaattttttaaagaatccaagacaaactaaactttactaggtacataagcttctcaatgagtcaccattcttcttttttgtaaaaacttttttctttgaaatgctaaacttggctgtatgtcaaattgtgcaaaatattggtattaaagaatgctgcaacttttttatgtctcttagaggttaatcagagtatctgaagggaattgtttttataaaaacattgaaatattagttacttgctataaatagatttagtctgttatatttccttttgtaaagtaaaatatgtccagaagagtcaaagtagttagttttggttatttctaaaccacaaaagttgtttaataagtatatcttaagaatgtgctagagttaaaagttagcattgtttctagattagctggtgtcttcattttacattgtgacaaacagctagagcatcagagcccttttgctatacccacagtctttcgtttccagccttngtcactagtctttgaggaggtttgctcctagaactggtgatataaagaatgaaagtagctgtatgagcagagcagttcaagggccaaaccctggaacggtagcaatgggatataatacctttctaagggaaaaagttgtatcagtaccatttgatctgccatggacatgagtttaaagcggctttctggcccttctttcagtgacttcttccctaaaatgtagaaattctaacttaatgtagttactgtgagccatattactagtgccccctagggtctataattccttaaaattttcattctgaatctgaaggagagagtcttttaactttagaattcccaagagggctttattacacctcagaaattgaaagcactatgaatttgtccatttaaaaatgatctgtagtttttttggtgctataacattctgacacatatcattctgtgattaaatctccagcttactataaatgatatctatattctaaagagctacttctaattattccaatatgaccttaaggaaaagtaagggaataaatttttgtctttgttggagtgaagcatttaaaagagtaagggtaaaaaagataaagtcctgaacctttcaaaatggaaaattaattctaaacttagaaatatgcttctgcctattgctgatactgtctttgcatacatgaataaaaataaactttttttcttcaaaaaaaaaan

SEQ ID NO: 342886 - DNA, 2088 bp, Homo sapiens
  misc_feature (1371)..(1371): n is a, c, g, or t
  misc_feature (2088)..(2088): n is a, c, g, or t
cgccattctttttttgccttgcttttcattatgctttttttttcgtggttcctcgtcttcgtaggcacgggccgacacttcaaacggtggtatcttgtctgtttaatccagagaacagactgagaaactctgttgttactcaagatgactacttcaaggataaaagagtgcatcactttagaagaagtcgggcaatgcttaaatctgtttgatcctcctggcttatctagttacatgggaagttgctggttttgaatattaagctaaaaggtttccactattatagaaattctgaattttggtaaatcacactcaaactttgtgtataagttgtattattagactctctagttttatcttaaactgttcttcattagatgtttatttagaaactggttctgtgttgaaatatagttgaaagtaaaaaaataattgagactgaaagaaactaagatttatctgcaaggattttttaaaaattggcattttaagtgtttaaaagcaaatactgattttcaaaaaaatgtttttaaaaacctattttgaaaggtcagaattttgttggtctgaatacaaacatttcacttctccaacaagtacctgtgaacagtacagtatttacagtattgagctttgcatttatgatttctccagaaatttaccacaaaagcaaaatttttaaaactgcatttttaatcagtggaactcaatatatagttagctttattgaagtcttcttatctaaacccagcaaaacagattcaaagcgaacagtccaatcagtgggtcatatgtttattcaaaatattttatcttttagctagaatccacacatatatatcctatttgattagggtagtaattaggataactaaaattctgggcctaattttttaaagaatccaagacaaactaaactttactaggtacataagcttctcaatgagtcaccattcttcttttttgtaaaaacttttttctttgaaatgctaaacttggctgtatgtcaaattgtgcaaaatattggtattaaagaatgctgcaacttttttatgtctcttagaggttaatcagagtatctgaagggaattgtttttataaaaacattgaaatattagttacttgctataaatagatttagtctgttatatttccttttgtaaagtaaaatatgtccagaagagtcaaagtagttagttttggttatttctaaaccacaaaagttgtttaataagtatatcttaagaatgtgctagagttaaaagttagcattgtttctagattagctggtgtcttcattttacattgtgacaaacagctagagcatcagagcccttttgctatacccacagtctttcgtttccagccttngtcactagtctttgaggaggtttgctcctagaactggtgatataaagaatgaaagtagctgtatgagcagagcagttcaagggccaaaccctggaacggtagcaatgggatataatacctttctaagggaaaaagttgtatcagtaccatttgatctgccatggacatgagtttaaagcggctttctggcccttctttcagtgacttcttccctaaaatgtagaaattctaacttaatgtagttactgtgagccatattactagtgccccctagggtctataattccttaaaattttcattctgaatctgaaggagagagtcttttaactttagaattcccaagagggctttattacacctcagaaattgaaagcactatgaatttgtccatttaaaaatgatctgtagtttttttggtgctataacattctgacacatatcattctgtgattaaatctccagcttactataaatgatatctatattctaaagagctacttctaattattccaatatgaccttaaggaaaagtaagggaataaatttttgtctttgttggagtgaagcatttaaaagagtaagggtaaaaaagataaagtcctgaacctttcaaaatggaaaattaattctaaacttagaaatatgcttctgcctattgctgatactgtctttgcatacatgaataaaaataaactttttttcttcaaaaaaaaaan

SEQ ID NO: 342887 - DNA, 3301 bp, Homo sapiens
  misc_feature (2584)..(2584): n is a, c, g, or t
  misc_feature (3301)..(3301): n is a, c, g, or t
aactgcagcctagacacattagattatcatttttgtaaactataccatacatttcagtatgcatacttattttaggggtgttttgggggtgatgtgtgtgtctgtgggtctatgtgagcgcggcgccttcctgggactgaggcaccggacctgcgcacacgcgctgcgtaccctacgcccccgccgcgtgggcgccgtcgtcccccgcagcccccccacgcagggggcggggcgctgccacccattggctgaggccgataccacgcgccccgatacccggcgcaggagccacctccctgagccccgcggaccacgcctcagtccgcctgcgctcctcagcctgacggtccgcctttcggggctcctcagccttgtcacccgctcttggttttccttttctcttcatctttggctcctttgaccactcgaagccgcgcagcgggttccagcggacctcacagcagccccagaagtggtgcgccaagcacagcctctgctcctcctggagccggtcgggaactgctgcctgccgccatcatgtctactgcaaatcctgaaactccaaactcaaccatctccagagaggccagcacccagtcctcatcagctgcaaccagccaaggctatattttaccagaaggcaaaatcatgccaaacactgtttttgttggaggaattgatgttaggatggatgaaactgagattagaagcttctttgctagatatggttcagtgaaagaagtgaagataatcactgatcgaactggtgtgtccaaaggctatggatttgtttcattttttaatgacgtggatgtgcagaagatagtagaatcacagataaatttccatggtaaaaagctgaagctgggccctgcaatcaggaaacaaaatttatgtgcttatcatgtgcagccacgtcctttggtttttaatcatcctcctccaccacagtttcagaatgtctggactaatccaaacactgaaacttatatgcagcccacaaccacgatgaatcctataactcagtatgttcaggcatatcctacttacccaaattcaccagttcaggtcatcactggatatcagttgcctgtatataattatcagatgccaccacagtggcctgttggggagcaaaggagctatgttgtacctccggcttattcagctgttaactaccactgtaatgaagttgatccaggagctgaagttgtgccaaatgaatgttcagttcatgaagctactccaccctctggaaatggcccacaaaagaaatctgtggaccgaagcatacaaacggtggtatcttgtctgtttaatccagagaacagactgagaaactctgttgttactcaagatgactacttcaaggataaaagagtgcatcactttagaagaagtcgggcaatgcttaaatctgtttgatcctcctggcttatctagttacatgggaagttgctggttttgaatattaagctaaaaggtttccactattatagaaattctgaattttggtaaatcacactcaaactttgtgtataagttgtattattagactctctagttttatcttaaactgttcttcattagatgtttatttagaaactggttctgtgttgaaatatagttgaaagtaaaaaaataattgagactgaaagaaactaagatttatctgcaaggattttttaaaaattggcattttaagtgtttaaaagcaaatactgattttcaaaaaaatgtttttaaaaacctattttgaaaggtcagaattttgttggtctgaatacaaacatttcacttctccaacaagtacctgtgaacagtacagtatttacagtattgagctttgcatttatgatttctccagaaatttaccacaaaagcaaaatttttaaaactgcatttttaatcagtggaactcaatatatagttagctttattgaagtcttcttatctaaacccagcaaaacagattcaaagcgaacagtccaatcagtgggtcatatgtttattcaaaatattttatcttttagctagaatccacacatatatatcctatttgattagggtagtaattaggataactaaaattctgggcctaattttttaaagaatccaagacaaactaaactttactaggtacataagcttctcaatgagtcaccattcttcttttttgtaaaaacttttttctttgaaatgctaaacttggctgtatgtcaaattgtgcaaaatattggtattaaagaatgctgcaacttttttatgtctcttagaggttaatcagagtatctgaagggaattgtttttataaaaacattgaaatattagttacttgctataaatagatttagtctgttatatttccttttgtaaagtaaaatatgtccagaagagtcaaagtagttagttttggttatttctaaaccacaaaagttgtttaataagtatatcttaagaatgtgctagagttaaaagttagcattgtttctagattagctggtgtcttcattttacattgtgacaaacagctagagcatcagagcccttttgctatacccacagtctttcgtttccagccttngtcactagtctttgaggaggtttgctcctagaactggtgatataaagaatgaaagtagctgtatgagcagagcagttcaagggccaaaccctggaacggtagcaatgggatataatacctttctaagggaaaaagttgtatcagtaccatttgatctgccatggacatgagtttaaagcggctttctggcccttctttcagtgacttcttccctaaaatgtagaaattctaacttaatgtagttactgtgagccatattactagtgccccctagggtctataattccttaaaattttcattctgaatctgaaggagagagtcttttaactttagaattcccaagagggctttattacacctcagaaattgaaagcactatgaatttgtccatttaaaaatgatctgtagtttttttggtgctataacattctgacacatatcattctgtgattaaatctccagcttactataaatgatatctatattctaaagagctacttctaattattccaatatgaccttaaggaaaagtaagggaataaatttttgtctttgttggagtgaagcatttaaaagagtaagggtaaaaaagataaagtcctgaacctttcaaaatggaaaattaattctaaacttagaaatatgcttctgcctattgctgatactgtctttgcatacatgaataaaaataaactttttttcttcaaaaaaaaaan

SEQ ID NO: 342888 - DNA, 249 bp, Homo sapiens
aaccagagatgttaagtcgtttttcaaggtcaaacatctagttggtagtagaggtaatgagttgttttattctttgctcttatcgaagaaaggaaattatagaattaatggaattttatgaagttgggggttttctttatcgttatcattaaaagaacgcagtgtggttttatgaaagcctcacacaggctgtcttctcagcccttttcagacccgcactctttcctccatccacatcctctcccttct

SEQ ID NO: 342889 - DNA, 382 bp, Homo sapiens
cagaacggactttatccacatcactgtaacctgagcccagacttcatcctagacagtcacacagctagggccacaggtggcacaccatggtaaaaacgtgagaccatctgattatccatcaaaacagagggcctactgcacatagacatagatgtgagttggagtagtgtggtcttcccatttctgatgttgccatctatttcctcgagatgacagacagctcatatattttgctcaaagggttgctagagctgtatcctcctttaaggtgaatcctcatttctactcccacaacagaagtggtcctcaacctctttggcaccagggaccagttttgtagacgactttttttccatggaccaggggtggagagatggtttca

SEQ ID NO: 342890 - DNA, 502 bp, Homo sapiens
gtttttttttgagatggagtctccctctgtcacccaggctggagtgcagtggcacaatctcgctcggctcactgcaacctctgcctcccaggttcaagcgattctcgtgtctcagccttccaagtagctgggactacaggcgcatgccaccatgcctgactaatttttgtatttttagtagagacgggatttcaccatgtttcccaggctagtctcaaactcctgacttcaagtgatttgacgacctcggcctcccgaagtcctgggattacaggcgcgagccaccgcacccagcctggagtttgcttttaaagccaatttttataaagtataaaagtataacatacatgcagaaaaactggtcaattacgaggatgtagctagtgaattttcatggagtgagcacctcccttattttgaatttatttccccccacttattgttaacaaacagtggcttgtcatttacaggcctgtgtccttcccaagctagaccattgagg

SEQ ID NO: 342891 - DNA, 454 bp, Homo sapiens
actgaaaacaacaggccaggcctggatgtcctgacagcctagacctaaatagagaggtttttagtgtcctggtaggtcatttcagcctgcttgcaagtgaatgggtcttagggtgtaaggtacatattcaatcatgagcttgaaaactgagaattacttatgtgaatctggaagtggatgtagttttaaattcaatttagacaaaacaaattcctcaatttttcccaagtgtaaattataaccctatattacagaactgtcagttaaattcatgaaagtactctttaccaagcctgaagcaaattggtgcttttgagtgctattacttatcgagaaataaatatataaatcagaaagctgagctttggaaaaaagaaataaatatgaagtcacccaataatccattctgagtagatgaatgattaaagatatgtgaggtgaggttgctttagag

SEQ ID NO: 342892 - DNA, 513 bp, Homo sapiens
accaacctggacaacatagtaagaccccatctctactaaaaataaaaataaaaattagtctagcatggcagcacacacctctagtcccagcatactcaggagggtgagacaggaaggtcacctgagtctggaaggttgagactgcagtgagctgtgatcgcactgctgtacttcagcctagacaacagaaagagaccctgtctcaaaaaaaaaaaaaaaaaacgtctgatgccagcaacttgggacaggcgaggttaagaaatcctgcctctcctggcatttatatcatgttggaaggctcaatcatttacatgcttataagccttagaggagagggactctcttgtcactgcccgcaacctcctggaattcagactagactttccctttagcatttgagaacttcatcttcaacctacatggcaggaaatcagttaaagcttattaaaatgtctttaattagatggaagccaactcagtggttgactatcaaccttcagaatttggaacatc

SEQ ID NO: 342893 - DNA, 494 bp, Homo sapiens
aatgcttgtgaagggcctggtgctgtgcccagcacataggaagtgttcaataaagtagtctgcatggtggtgcagtggaaggatcccaggctttggagccagaaagacctcagttccaggcacagatggaccattaccaactgtatgaccttgagcaagtcattgtgtcacttttgagattacccatgtgtaaaacaggaatgataatacctgcccagactacctcagggaatggttatggggttcagatgagctgatgaaccaagaaggtatttggagttcacttccagtcttaggagacaaaccatacaacaggttgactgaaagagaccatgggaaagctgttttgagtatagccttgcctcccttgagatactaaccctagttgaaattcttccctgaaaggtgtaagtaataaatgggctctaagtagtgttttctgctcatgagacttaataggaggggactttcacgtttaccgggcctgttgtgtt

SEQ ID NO: 342894 - DNA, 1313 bp, Homo sapiens
atgaatgcatgatatctcttggtaaaatggcccagaagaacacagaaaggagttatgaaaagataacacccgtaagtgtgactacacattttgtgatccagtcatcatttctgtggctgaagccatactattttatagaattaatggaaagcagaaaagacatcacaaaccaagaagaaatttggaaaatgaagcctaggagaaatttagaagacaacgattatttgcatgaggacacgggagagaccagcatgctaaaaagacctgtgcttttgcatttgcagcaaacagcccatgctgatgaatttgactgcccttcagaacttcagcacgcacaggaactctttccacagtggcacttgccaattaaaatagctgctgttatggcatctctgacttttctttacactcttctgagggaagtaattcaccctttagcaacttcccatcaacaatatttttataaaattccaatcctggtcatcaacaaagtcttgccaatggtttccatcactctcttggcattggtttacctaccaggtgtgatagcagcaattgtccaagttcataatggaaccaagtataagaagtttccacattggttggataagtggatgttaacaagaaagcagtttgggcttctcagtttgttttttgctgtactgcatgcaatttatactctgtcttacgcaatgaggcgatcctacagatacaagttgctaaactgggcatatcaacaggtccaacaaaataaagaagatgcctggattgagcatgatgtttggagaatggagatttatgtgtctctgggaattgtgggactggcaatactggctctgttggctgtgacatctattccatctgtgagtgactctttgacatggagagaatttcactatattcaggtacatggtaggatcaacttcctgaccttgtgacagatcctgccagtaacatgagaggaaatgagaacgaggctttggagcacagcattggattgctcatgcagaacaccacccagtgccctttccctctgtcacaatgaacagccatgctgcaggtgacggctgctctgtcaacatggatccggcagggcagatgagtggatcccccagcggactcatgagagagcaaacaaaaagtccatatgtgttgtgctaatccactgagattgtgttggttgttacggagcctaacctagcctatcccgacacgaggatcagacatgataatcaaatgtgtttataaagtgttggatggaaatattctgacaacattaaaagactctacccaaggaaggaatttgcatctct

SEQ ID NO: 342895 - DNA, 1234 bp, Homo sapiens
gcgctctggaggctcaggcgccgcgtggggccggcacctcccggcagcagcggcagctgagactcacggtcaagctacggcgaggagtgggtggctgaagccatactattttatagaattaatggaaagcagaaaagacatcacaaaccaagaagaaatttggaaaatgaagcctaggagaaatttagaagacaacgattatttgcaaacagcccatgctgatgaatttgactgcccttcagaacttcagcacgcacaggaactctttccacagtggcacttgccaattaaaatagctgctgttatggcatctctgacttttctttacactcttctgagggaagtaattcaccctttagcaacttcccatcaacaatatttttataaaattccaatcctggtcatcaacaaagtcttgccaatggtttccatcactctcttggcattggtttacctaccaggtgtgatagcagcaattgtccaagttcataatggaaccaagtataagaagtttccacattggttggataagtggatgttaacaagaaagcagtttgggcttctcagtttgttttttgctgtactgcatgcaatttatactctgtcttacgcaatgaggcgatcctacagatacaagttgctaaactgggcatatcaacaggtccaacaaaataaagaagatgcctggattgagcatgatgtttggagaatggagatttatgtgtctctgggaattgtgggactggcaatactggctctgttggctgtgacatctattccatctgtgagtgactctttgacatggagagaatttcactatattcaggtacatggtaggatcaacttcctgaccttgtgacagatcctgccagtaacatgagaggaaatgagaacgaggctttggagcacagcattggattgctcatgcagaacaccacccagtgccctttccctctgtcacaatgaacagccatgctgcaggtgacggctgctctgtcaacatggatccggcagggcagatgagtggatcccccagcggactcatgagagagcaaacaaaaagtccatatgtgttgtgctaatccactgagattgtgttggttgttacggagcctaacctagcctatcccgacacgaggatcagacatgataatcaaatgtgtttataaagtgttggatggaaatattctgacaacattaaaagactctacccaaggaaggaatttgcatctct

SEQ ID NO: 342896 - DNA, 1314 bp, Homo sapiens
atgaatgcatgatatctcttggtaaaatggcccagaagaacacagaaaggagttatgaaaagataacacccgtaagtgtgactacacattttgtgatccagtcatcatttctgtggctgaagccatactattttatagaattaatggaaagcagaaaagacatcacaaaccaagaagaaatttggaaaatgaagcctaggagaaatttagaagacaacgattatttgcatgaggacacgggagagaccagcatgctaaaaagacctgtgcttttgcatttgcagcaaacagcccatgctgatgaatttgactgcccttcagaacttcagcacgcacaggaactctttccacagtggcacttgccaattaaaatagctgctgttatggcatctctgacttttctttacactcttctgagggaagtaattcaccctttagcaacttcccatcaacaatatttttataaaattccaatcctggtcatcaacaaagtcttgccaatggtttccatcactctcttggcattggtttacctaccaggtgtgatagcagcaattgtccaagttcataatggaaccaagtataagaagtttccacattggttggataagtggatgttaacaagaaagcagtttgggcttctcagtttgttttttgctgtactgcatgcaatttatactctgtcttacgcaatgaggcgatcctacagatacaagttgctaaactgggcatatcaacaggtccaacaaaataaagaagatgcctggattgagcatgatgtttggagaatggagatttatgtgtctctgggaattgtgggactggcaatactggctctgttggctgtgacatctattccatctgtgagtgactctttgacatggagagaatttcactatattcagcgtcttctccaggaatagatttcatctcaagaaaccactttctttgatcatctatgaaaagcaactcctcacttgttcaagttttatcatgaaattgcagcaactcagtcacagcttcaggctgtactcagaattccagttctcttgctgctatttctatacatctgcattgactttttccactgaagtcttgaacccctcaaagtcatccatgaggactggaatcaacttcttctaaacgcctatgaatgttgataatgttgatttctttccacaaatcacaaatatttttaatggcatctaaaatggtaaatctttccagaagattctcaattgactttgcccagatccattaagaggaatcattacctatggcatctctggccttataaaatatacttcaaaaaat

SEQ ID NO: 342897 - DNA, 1291 bp, Homo sapiens
gcgctctggaggctcaggcgccgcgtggggccggcacctcccggcagcagcggcagctgagactcacggtcaagctacggcgaggagtgggtggctgaagccatactattttatagaattaatggaaagcagaaaagacatcacaaaccaagaagaaatttggaaaatgaagcctaggagaaatttagaagacaacgattatttgcatgaggacacgggagagaccagcatgctaaaaagacctgtgcttttgcatttgcagcaaacagcccatgctgatgaatttgactgcccttcagaacttcagcacgcacaggaactctttccacagtggcacttgccaattaaaatagctgctgttatggcatctctgacttttctttacactcttctgagggaagtaattcaccctttagcaacttcccatcaacaatatttttataaaattccaatcctggtcatcaacaaagtcttgccaatggtttccatcactctcttggcattggtttacctaccaggtgtgatagcagcaattgtccaagttcataatggaaccaagtataagaagtttccacattggttggataagtggatgttaacaagaaagcagtttgggcttctcagtttgttttttgctgtactgcatgcaatttatactctgtcttacgcaatgaggcgatcctacagatacaagttgctaaactgggcatatcaacaggtccaacaaaataaagaagatgcctggattgagcatgatgtttggagaatggagatttatgtgtctctgggaattgtgggactggcaatactggctctgttggctgtgacatctattccatctgtgagtgactctttgacatggagagaatttcactatattcaggtacatggtaggatcaacttcctgaccttgtgacagatcctgccagtaacatgagaggaaatgagaacgaggctttggagcacagcattggattgctcatgcagaacaccacccagtgccctttccctctgtcacaatgaacagccatgctgcaggtgacggctgctctgtcaacatggatccggcagggcagatgagtggatcccccagcggactcatgagagagcaaacaaaaagtccatatgtgttgtgctaatccactgagattgtgttggttgttacggagcctaacctagcctatcccgacacgaggatcagacatgataatcaaatgtgtttataaagtgttggatggaaatattctgacaacattaaaagactctacccaaggaaggaatttgcatctct

SEQ ID NO: 342898 - DNA, 847 bp, Homo sapiens
cgtggtagcggaaaagaccatgaagtaagtgtttgcatctgtgtgtacgacatcctggtattaaagtaatactttaacgttgctggtatttttatggtcaacaccaacaatcaacaagttaattcacacataatgtctaagggaacactttcataattttttaaactgctaaactccttaagatgtcataaaaatagaagaattcccaaaacaactgacataagagcaactcaacaacatcaagatctttttgaggggaccaccaatcacattctattttactgacttctctttctatccttacaaaactccaagtccctggaaggaaaaataatttgttagtcctctttacagccacagtaccccaataaagtatcttgtattcagatggtgcataattattgtctaacagaattctgctcagccaaacaagctgcatttcaataaacaaaaggcattctgctccaagatctttaatctccttttaaacaaataagtaattaggaacagaaaagcaagtgtcaaatttagtcattatctatttgtacgtggttgttaaatattatacaaatactaacagagtttacttcaactctgtaaagttaaaaatatatatttaaaagctccagataggccgagcatcatggctcatgcctataatcccagtactttggaaggctaaggtgggaggatcatttgggcccaggagttggagaccagcctgggcaacatagtgagatcccatctctacaaagagaaacttttttaattggccaggtgtggctgcatgtgcttatagtcccagctactcaggaggctggggcaggaggatcacttgagccatgag

SEQ ID NO: 342899 - DNA, 582 bp, Homo sapiens
tggctggtgatgggcagtgcatcatggaggtctgtagacctctgtatgaaagccagggccagtggctatccagaggacatgtttatatgttgatagaatgttctagaagctttaaaatatacatttcctaatctttctctcaatttctcatacttttcaagagctcttgtgcctgtcccctctgctttcttttaggccccttcttcttcctgttcttcccttccctttgtgtttttccctcttcctttcttgcttcttccccacagtctagaaacacgttcgagttcttcccatctctacacaaacagatgcagagcctcgggtggcttctgcccccctgtcactctggcttctgtgccccttctgttccatcgcagtgaagctttgtggaggaagtgtctgtgctcactgcctctatccccacctcctggtcactcccctcgccctggctgtctgtccccaccccttctccagactggccaacagaggtcacctatgtatgacctgtgtgttgctaagtccacggctctcaggagttcctacctcacctctccccagcatcggacagtctctaccacttcc

SEQ ID NO: 342900 - DNA, 173 bp, Homo sapiens
aaaaaaaaattagaaaggaaaagcaaatttttgtgaaaaatgtttcagaaaatgtctggttatcagttttaggaaaatatggtaaatagataaaagaacaaagaatgcaaaaaaaaatccctgcttctttaatggttatgctatttgaatataccctttctgccacctcctag

SEQ ID NO: 342901 - DNA, 458 bp, Homo sapiens
atcatcttaacaatataaagtcttccaatccacaaacatggaatgtttttcttttatttagatcttatttaatctctttgaacagtgttttagctccaggtaagttttttgtaaaatgtattcttaagtattttattatttttgatgctattgtaaatgaaattgtcttgttaatttcatttttggattgttcattgtaagtttatataaatagacttatttttgtatattaactttatatcctgcaacattgttgaactgatttattagtttaaaaagtttttagtgaattccttaggatttgctatatataaaatcatattatctgtgcataggtatagttttccttccaattatgtggtctattttagaataagtgccatgcggtgctgagaagaatgtatattctgttgatttgtggtggagagttctatagctgtctattaggtctgcttggt

SEQ ID NO: 342902 - DNA, 432 bp, Homo sapiens
caccactcctatagatcagttcaggtataaggttcctctgcagccagacttttttatcttttaaaaaagaatgccgggcgcagaggctcaagcctgtaatcccagcacttcgggaggccaaagtgggtggatcagttgaagccaggagttcaaaaccatcttaaagttcagctcatttctcattctgaagtttccttttttcacacttctcagattatactgatggattttcacttcctttacattttctccttcctctcaatagtgaatattagtctccagtggctgggtagtagcaagtaaatttatgaagaatcatagttgtgtttgccaagtgactggaaatcagcttccccagtacctcttcaccacaaacacaattaaaggtggggccgaggatcaaaatggaatgcttccttaggactggtacag

SEQ ID NO: 342903 - DNA, 180 bp, Homo sapiens
agatgtccattataatgatacttaatgtggtgggtctatgtatttggtacatattctaagtaggaggaaaataaccgaagttataactgtttctccttatcactgatcatttgtaagggactatgcttggtacagtactataaacccttgatttgttggtggggcagaataaccatggtt

SEQ ID NO: 342904 - DNA, 243 bp, Homo sapiens
tgctaatttttttggtgtgacaatggtatcatagttgatgatgagtgtttatgtattctatttttgtgcatgtgtgaaatgtttcataaagtttcataagaaaaaaagattttaacttaatgaatatttgagtggactgcaattgtgcactcactaccataatggccctgtaatacaaaagcttccaggtgaatcaatgtagagtgatgtggatgtgatctatcctgtcagcaccttgaagat

SEQ ID NO: 342905 - DNA, 406 bp, Homo sapiens
cagtggggtcagaggctcccgcgggaacccgtgtgggctgccccgcatggcatcccaggaacagtggggtcagaggctccctcaggaacctgtgtgggctgccccgcatggcatcccaggaacagtggggtcagaggctccctcgggaacccgcgtgggctgccccgcatggcatcccaggaacagtggggtcagaggctcccgcaggaaccggcacaggctgcacagcatggtgtcccatcgtcagtgcaattagaggttcccgtggtctcagcgccctggggagtggtggtagttctcactatattggacggtgaggttggagaggaatgcagagctaacactggtggagaggcaggagggcaggcaggacggcacacacacaggacgtttaaaacacacagag

SEQ ID NO: 342906 - DNA, 288 bp, Homo sapiens
tgttgactacatcatatacataaggagagtttgaataaaaggcgaatttcagtcagccatctgctgtaaaagcatggtctgctgtacctgagaatgcgagaaaattaagttcaagatcacctgatgaagtaccttcatcaattttcaacttcaagcattggcagaattcatcaactgttatgtggtacgctgtttatttaatgaagacttgtacatatcttccttgtctcttacaatttattacatctttgtgatattttcttcttaataaaagttgcttaatcaatt

SEQ ID NO: 342907 - DNA, 631 bp, Homo sapiens
tgttgactacatcatatacataaggagagtttgaataaaaggcgaatttcagtcagccatctgctgtaaaagcatggtctgctgtacctgagaatgcgagaaaattaagttcaagatcacctgatgaagtaccttcatcaattttcaacttcaagcattggcagaattcatcaactgttatgtggtacgctgtttatttaatgaagacttgtacatatcttccttgtctcttacaatttattacatctttgtgatattttcttcttaataaaagttgcttaatcaattattttttataatgctcttaatattttgggcattccttgaattttcagttattagattgttaattacttaatacagacagaaactagtgtccaaagaggcttaaaacttaagatcaacctgaaatgaagataatttattgacaataagttaaaagaaaaataagaattaaaaaattaaatttcttcaacttcctctttaaagtatcactccaagtgatgcacactaagatattcaaagctaacattatggcctaaaatagtacaactgagcaatttataatcacttctaactgtatgaaatcactctcaatataatcaaaataaagttggcatctgtattgctg

SEQ ID NO: 342908 - DNA, 538 bp, Homo sapiens
tgttgactacatcatatacataaggagagtttgaataaaaggcgaatttcagtcagccatctgctgtaaaagcatggtctgctgtacctgagaatgcgagaaaattaagttcaagatcacctgatgaagtaccttcatcaattttcaacttcaagcattggcagaattcatcaactgttatgtggtgccagctaaggatcttctaagctgtccagctgaatgtgtccctcaccatcatttgttagaatctcttgcaccagcctaatgcacttgaagtaaggcttttttcttcattattcacagcttagtcaatcatacccaggacattctcttttgaatacatatagacataacttttaatctccttccttttcttttctaacttctacctggttatatttatgacactacgttgactggtttccaatgttatttctgttaaaagggtttcttatgagacctgtcactgtaaccatgattctatgggaaaaagcattattggttttaaactgaaataaaaatgaacttctataacaca

SEQ ID NO: 342909 - DNA, 2772 bp, Homo sapiens
acatctggatcgagtctctgaggacctcgttctcgcagtcgcggtactcggtggtgcagagcctcctgcgggacttcagctccatcagagaggaggagtacaacgaggagctggtgaccgagggcttgcagctcatgttcgacatcctcaagaccagcaaaaacgactccgttcatccagcaactggctaccatcttcacccactgctatggcagcagtcccatccccagcatcccagagatccggaagaccctgccggccaggctagatccacactttttgaacaataaggagatgtcagatgtgaccttcctggtggaaggaaagctgttttatgcacataaagtcctgctggtgacagcttctaacaggtaggcagcctcagataacaaactcccagcccaggggcacagaagcaccttgtttcagattccaggtgacagagagtgactcgctggggctgtaccctgcagcctctgcccctcagactgcagtcacattgcagcagagccccactcgccccacagcgggatgagacggggtggacccagggcagcaggaaaggggggctctgaggtggtgttctttctggcctagttattgcttttattattagaaaacataaatatcctggaatgaagagtcagcattctggccacaggcgtcaggtcgcttgtagggtgggtggtggggacagaattgggctcagctcagatgtcttcctaagatggtgtaaaatggcacttgctgaaaattattttaggagcacagcagtaatttttaaaatgttccgtcttgtggtagccggtcaggtgacagatggtgccatcgccacacagtggtgaagtaaaaggttcaaaacccaccttgctttgtctcctttgctccaggttcaagacactaatgaccaataaatcagaacaggatggggacagcagcaagaccatcgagatcagcgacatgaagtaccacatttttcagatgatgatgcagtatctgtactacggaggaacagaatccatggagatccccaccactgacatcctggagctgctgtcagctgccagcctgttccagctggatgccctgcagaggcactgcgagatcctgtgctcccagaccctcagcatggagagtgccgtgaacacctacaaatatgccaagatccacaatgccccagaactggccctgttctgtgagggcttcttcctcaagcacatgaaggccctactggagcaggatgccttccggcagctcatctacggccgcagcagcaaagtgcagggcctggatccactgcaggacctgcagaacaccctggcagagcgcgtgcactctgtctacatcacctcccgggtgtgaggcagggggcggaggctgccgaggccagggcctgtggaggtgccagggcccaccatgtcggggtatggttgtaggccctcttggagccaggttcacggggctgtttcctcctcctcccccagatgtcccccctgtcaccgggcagctcaccctcatctcctctgccctagagctgtttgttcaatcactgatgggcaaaggggagatgtagctaactggtggccctcctccccatctcagtttgcaactcaagggcagccatgcactccccctgggtgtcgctctcccctcctgcaggtcagcagctgatcctgatccacctccgcccaggccctccaagctctactcacccctagggcctcagtaaactcagaccatcccaactggggctcctgggggtacaggaatccttatgaatgtatagaatgcatactgcctaggcccccagtcgtctgcagtaattcaaaagctggtatttttcttcctaaatgtcacatagcaaaggctgcccaaatccccaaacttgttcttcaaaggtttgacaggcttaatgtgggcatccagtggcctgtggacccccccctgccaccacgactgctgccacccggagttcccccattgtctttggtgcctgggcttccagagtccctcccatcaggactaccagcttgctcagttagcagcagagggcagttccccagcttgatggtttctgagctaagtctggcatggaggggcaaggggtaggggatggggtgctgtgtaggaatggcctcagctcttgttttgctgctggttttaggggccaaagtaaatgggtggattctggaacctcaggcctagactaggttgcctttgtgggggcgatgaagcagagtcccctggtcaagtctctcggctcctttaatgtaggattgagagctgggcaaacaggtcccactggggactgtgactcttggagattaaaggacagggcattgatggaaggtaagggccaggagaagaggcctttctgctgtgtcccctcacggccttgccctcgaattctgcaggccctgggctcccctgacacctgtcatatttatggaccagacactggggcagcatcaggcacagtctgtctgggtgcaacttcttcagctgtctggccgcaccttaaaaactatttattcaccaaaagccccaggcatttcagaaggtggcactcaggtcaccctgaaaagcccccaggggcttgcaattctggaaaatattttgactagctgcttggctggatgtacaaagaaataggcattattttattgctgtaatattgtatgatactttaactgtacaataatgttgtcacttactgtaaatgtactatggttttattaacaataaacactcattaacaatgaaaaacttggc

SEQ ID NO: 342910 - DNA, 1951 bp, Homo sapiens
atactacagcatggaccagcgggggcagaagcctggagacctgtacagtcctgacagcagcccccaggccaacacacaaatgagcagcagccctgtcacatctcctacccagtctccagcaccctctcctgtcaccagcctcagcagtgtctgcacaggactcagtcccctgcctgtcctcacacagttcccccggcctggctagatccccaccactgacatcctggagctgctgtcagctgccagcctgttccagctggatgccctgcagaggcactgcgagatcctgtgctcccagaccctcagcatggagagtgccgtgaacacctacaaatatgccaagatccacaatgccccagaactggccctgttctgtgagggcttcttcctcaagcacatgaaggccctactggagcaggatgccttccggcagctcatctacggccgcagcagcaaagtgcagggcctggatccactgcaggacctgcagaacaccctggcagagcgcgtgcactctgtctacatcacctcccgggtgtgaggcagggggcggaggctgccgaggccagggcctgtggaggtgccagggcccaccatgtcggggtatggttgtaggccctcttggagccaggttcacggggctgtttcctcctcctcccccagatgtcccccctgtcaccgggcagctcaccctcatctcctctgccctagagctgtttgttcaatcactgatgggcaaaggggagatgtagctaactggtggccctcctccccatctcagtttgcaactcaagggcagccatgcactccccctgggtgtcgctctcccctcctgcaggtcagcagctgatcctgatccacctccgcccaggccctccaagctctactcacccctagggcctcagtaaactcagaccatcccaactggggctcctgggggtacaggaatccttatgaatgtatagaatgcatactgcctaggcccccagtcgtctgcagtaattcaaaagctggtatttttcttcctaaatgtcacatagcaaaggctgcccaaatccccaaacttgttcttcaaaggtttgacaggcttaatgtgggcatccagtggcctgtggacccccccctgccaccacgactgctgccacccggagttcccccattgtctttggtgcctgggcttccagagtccctcccatcaggactaccagcttgctcagttagcagcagagggcagttccccagcttgatggtttctgagctaagtctggcatggaggggcaaggggtaggggatggggtgctgtgtaggaatggcctcagctcttgttttgctgctggttttaggggccaaagtaaatgggtggattctggaacctcaggcctagactaggttgcctttgtgggggcgatgaagcagagtcccctggtcaagtctctcggctcctttaatgtaggattgagagctgggcaaacaggtcccactggggactgtgactcttggagattaaaggacagggcattgatggaaggtaagggccaggagaagaggcctttctgctgtgtcccctcacggccttgccctcgaattctgcaggccctgggctcccctgacacctgtcatatttatggaccagacactggggcagcatcaggcacagtctgtctgggtgcaacttcttcagctgtctggccgcaccttaaaaactatttattcaccaaaagccccaggcatttcagaaggtggcactcaggtcaccctgaaaagcccccaggggcttgcaattctggaaaatattttgactagctgcttggctggatgtacaaagaaataggcattattttattgctgtaatattgtatgatactttaactgtacaataatgttgtcacttactgtaaatgtactatggttttattaacaataaacactcattaacaatgaaaaacttggc

SEQ ID NO: 342911 - DNA, 722 bp, Homo sapiens
cggggcccgggacccccggccttggactggctggtcggctatccgcctgattgtgagaggacagccggagagtacatcttgggctcactagaccgtcctggtctgacttaccctgacagtggtctgggcagcctgcagacagacgtgcaaggacagatacaagccacacagctggggtgtgagtccttgttatcagggtgggctcccagccaatgggcattactgagagcttgttggaaatgcagagccccaggccccaccccagccctcctgcatcttcacaagctccccaggtggccatgtgctcagtgcagtttaggaagtgctggtggaggctgcgtcacttctcccaagcatcaaaccccggccacattggtcaaacacgtggccgtgaggcacacatcctgactgtagatcaaagtcaggtctttcgggctttaagctttgcagaacatacaaggttacatactagaaactccagtcagggcagacaaggtccagaggaagacctggctgggatctcagctgaaccccactgagaggagctttctagaaagtagcaactgcaggtctccaggctgtgtggtgggctcagggctgcaagagctgacccttatgggctgggactgaggccaggaggcagctggcaggtgggtctagggccttgccctgcacaggagtggtttgtgatataataggagagattgcaaaccccagagtct

SEQ ID NO: 342912 - DNA, 2253 bp, Homo sapiens
acatctggatcgagtctctgaggacctcgttctcgcagtcgcggtactcggtggtgcagagcctcctgcgggacttcagctccatcagagaggaggagtacaacgaggagctggtgaccgagggcttgcagctcatgttcgacatcctcaagaccagcaaaaacgactccgttcatccagcaactggctaccatcttcacccactgctatggcagcagtcccatccccagcatcccagagatccggaagaccctgccggccaggctagatccacactttttgaacaataaggagatgtcagatgtgaccttcctggtggaaggaaagctgttttatgcacataaagtcctgctggtgacagcttctaacaggttcaagacactaatgaccaataaatcagaacaggatggggacagcagcaagaccatcgagatcagcgacatgaagtaccacatttttcagatgatgatgcagtatctgtactacggaggaacagaatccatggagatccccaccactgacatcctggagctgctgtcagctgccagcctgttccagctggatgccctgcagaggcactgcgagatcctgtgctcccagaccctcagcatggagagtgccgtgaacacctacaaatatgccaagatccacaatgccccagaactggccctgttctgtgagggcttcttcctcaagcacatgaaggccctactggagcaggatgccttccggcagctcatctacggccgcagcagcaaagtgcagggcctggatccactgcaggacctgcagaacaccctggcagagcgcgtgcactctgtctacatcacctcccgggtgtgaggcagggggcggaggctgccgaggccagggcctgtggaggtgccagggcccaccatgtcggggtatggttgtaggccctcttggagccaggttcacggggctgtttcctcctcctcccccagatgtcccccctgtcaccgggcagctcaccctcatctcctctgccctagagctgtttgttcaatcactgatgggcaaaggggagatgtagctaactggtggccctcctccccatctcagtttgcaactcaagggcagccatgcactccccctgggtgtcgctctcccctcctgcaggtcagcagctgatcctgatccacctccgcccaggccctccaagctctactcacccctagggcctcagtaaactcagaccatcccaactggggctcctgggggtacaggaatccttatgaatgtatagaatgcatactgcctaggcccccagtcgtctgcagtaattcaaaagctggtatttttcttcctaaatgtcacatagcaaaggctgcccaaatccccaaacttgttcttcaaaggtttgacaggcttaatgtgggcatccagtggcctgtggacccccccctgccaccacgactgctgccacccggagttcccccattgtctttggtgcctgggcttccagagtccctcccatcaggactaccagcttgctcagttagcagcagagggcagttccccagcttgatggtttctgagctaagtctggcatggaggggcaaggggtaggggatggggtgctgtgtaggaatggcctcagctcttgttttgctgctggttttaggggccaaagtaaatgggtggattctggaacctcaggcctagactaggttgcctttgtgggggcgatgaagcagagtcccctggtcaagtctctcggctcctttaatgtaggattgagagctgggcaaacaggtcccactggggactgtgactcttggagattaaaggacagggcattgatggaaggtaagggccaggagaagaggcctttctgctgtgtcccctcacggccttgccctcgaattctgcaggccctgggctcccctgacacctgtcatatttatggaccagacactggggcagcatcaggcacagtctgtctgggtgcaacttcttcagctgtctggccgcaccttaaaaactatttattcaccaaaagccccaggcatttcagaaggtggcactcaggtcaccctgaaaagcccccaggggcttgcaattctggaaaatattttgactagctgcttggctggatgtacaaagaaataggcattattttattgctgtaatattgtatgatactttaactgtacaataatgttgtcacttactgtaaatgtactatggttttattaacaataaacactcattaacaatgaaaaacttggc

SEQ ID NO: 342913 - DNA, 1816 bp, Homo sapiens
acatctggatcgagtctctgaggacctcgttctcgcagtcgcggtactcggtggtgcagagcctcctgcgggacttcagctccatcagagaggaggagtacaacgaggagctggtgaccgagggcttgcagctcatgttcgacatcctcaagaccagcaaaaacgactccgttcatccagcaactggctaccatcttcacccactgctatggcagcagtcccatccccagcatcccagagatccggaagaccctgccggccaggctagatccacactttttgaacaataaggagatgtcagatgtgaccttcctggtggaaggaaagctgttttatgcacataaagtcctgctggtgacagcttctaacaggtaggcagcctcagataacaaactcccagcccaggggcacagaagcaccttgtttcagattccaggtgacagagagtgactcgctggggctgtaccctgcagcctctgcccctcagactgcagtcacattgcagcagagccccactcgccccacagcgggatgagacggggtggacccagggcagcaggaaaggggggctctgaggtggtgttctttctggcctagttattgcttttattattagaaaacataaatatcctggaatgaagagtcagcattctggccacaggcgtcaggtcgcttgtagggtgggtggtggggacagaattgggctcagctcagatgtcttcctaagatggtgtaaaatggcacttgctgaaaattattttaggagcacagcagtaatttttaaaatgttccgtcttgtggtagccggtcaggtgacagatggtgccatcgccacacagtggtgaagtaaaaggttcaaaacccaccttgctttgtctcctttgctccaggttcaagacactaatgaccaataaatcagaacaggatggggacagcagcaagaccatcgagatcagcgacatgaagtaccacatttttcaggtgtgtgggtcttggtgccgccctcttctcagagggatgaccctcccccaggagcccaccttgtgggcagctgtgcattggttgtcattgttcactctattcccagtgccttctgtattctgttgaatgaatagagcatccaggtctttccctgtgcagaggtagccatccgttgtggggctgcagcttcagagcctgtcacatgggtcctgagctctaaccgctggacaggtggtctgggcagcctgcagacagacgtgcaaggacagatacaagccacacagctggggtgtgagtccttgttatcagggtgggctcccagccaatgggcattactgagagcttgttggaaatgcagagccccaggccccaccccagccctcctgcatcttcacaagctccccaggtggccatgtgctcagtgcagtttaggaagtgctggtggaggctgcgtcacttctcccaagcatcaaaccccggccacattggtcaaacacgtggccgtgaggcacacatcctgactgtagatcaaagtcaggtctttcgggctttaagctttgcagaacatacaaggttacatactagaaactccagtcagggcagacaaggtccagaggaagacctggctgggatctcagctgaaccccactgagaggagctttctagaaagtagcaactgcaggtctccaggctgtgtggtgggctcagggctgcaagagctgacccttatgggctgggactgaggccaggaggcagctggcaggtgggtctagggccttgccctgcacaggagtggtttgtgatataataggagagattgcaaaccccagagtct

SEQ ID NO: 342914 - DNA, 498 bp, Homo sapiens
tgcaggaagccaagagagcagatttggacaatgtagaatttctccacgctcctcctactgtccccatcttaggcctggctactgcgggactgacaggcatggctggctgtccatccgttccttagtttgattgcatggcagacatgaggaaggaaggtgagaactgagctagaaagttggcatttggtgctctggtttctcaatgcaagaaagtaacactttggcttttatagaataaccttctgaggaaattaacaacccgggcgtttcagccccctgtgaacttgattggagcatggtcacaatttgtaacgaaatgtgcttgcatgcccagtgctaaagatttctctctgtctaccctctaggctgtggaaaggtctgttctaaccattagcttgtatctggagctcagatggtgccggacactccgtaggagctcagatctgttgatagaagccactagagaatgggacaagcaacaggaggtgttttgctgcc

SEQ ID NO: 342915 - DNA, 359 bp, Homo sapiens
acacagggcaaaagctttataatattggatttggcagtgatttcttgggatatgacaccaaagacacagacaataaaaggaaaaccagacaaactgtacttcgtcaaaatttgaagcttgtacatcaaaggatactatcaacagagtaaaaaggcaacccatagaattagacaaaataattgcaagtcacctgtctgagaagaaactaatattcagaatatatagagaatgcctaactactgtgtaaaacagggcagttccttaaaaaaacaaacagaattacctgtttcattcagcagtcccacttctgagtatattcacaaatgaattgaaggcagggaattgaaagatatgtttac

SEQ ID NO: 342916 - DNA, 280 bp, Homo sapiens
cccacttgcagttgggtggggccatgtgaccagttctgccaagtgagcagtgagtggcagtgacacacagaagaatattgaagagtggtgtgccgtcttccagctttctcttctgcagctgcaatcctagaggccatgtgttgagacagcagaaccgcacaatggagtaacctggattgctgagtcagcacatggaggacagctgtctttagaaacttgcttgatggtgcatgagtgggaaataaacatttgtggtgttaagccactgaaattcaagaca

SEQ ID NO: 342917 - DNA, 242 bp, Homo sapiens
ccacaccaataatataatggcaggtcattattataaagcccttcatccttgccacaaccccagaagatgggccttactggtattctcattgaaagatgaggaaattgaggctcagagaggtgaagtcacttgctaagaacaccaggtaaggctgcgcatgatggctcgtgcccgaaatcccagcactttgggaagctgaagcaggtggatcacctgaggtcaccaacatggtgaaaccccat

SEQ ID NO: 342918 - DNA, 560 bp, Homo sapiens
ctggagttaatttttatatatggtgaaagataggggtccagtttcattctttggcatatgctctgcccatttttgaactgggttgtttgttttcttgagttttaggagttctctatatattctggatattaacatcagagatatgatttggaaatattttctcctattctgtgggttgcctttttactctgttgatgttgcttttgatgcacaaaagtttaaaagtttcaggatgtctaatttgtctattatttcttttcgtgcctgtgcctttggtgaactaatcactgccaaatccagtgccatgaagggtttgttccatgttttcttctatgagttttatagtttcagtggctacatttaggtctttgatccattttgagttaatttttgtataaggtattaggtaagggcacagctttattcttttgcatgcaaatattcagttttcccagcaccatttgttggaaaactaaaacaaaaactatcctttccccatttcatagtcttggcatcgttgtcaaaattatttgaccatatatgtgagggtttatttctgg

SEQ ID NO: 342919 - DNA, 205 bp, Homo sapiens
atgctccgttgtgattgctcttctttttccagcttttttaaggtggagggttaggtcactgatttgagatagttctttaacgcaggcatatacagctacgaatttccctttaagtatgctttagctggatctcataagtactgttatgttgtgcttttatttgaaagtattttctaatttctgttgtgatttctcccctcaattt

SEQ ID NO: 342920 - DNA, 1826 bp, Homo sapiens
aggtgtttacctggcactcaggtgagtggtgcgctctggctgttttctgtcggagccgcccgcctcttccttcagcgcgtcccacaaatcccgacggcacggaggggccccaggccaagggcgatgggcccctgagccctgacaccgcttcgccgctgctgcaggtgcccctggccggcagcgccgccgtggtcccggagcgcggcgacatgccggagctggtggtgaccgcgctgctggcgccgtcgcgcctgtcgctgaagctgctgcgcgccttcatgtggagcctggtgttctcggtggcgctggtggccgcggcggtctacggctgcatagcgctcacgcacgtgctgtgccggccccggcgcggctgctgcgggcgccgtcggagcgcgtcccccgcctgcctgagcgacccctcgctgggtgagcacggtttcctgaacctcaagagctcgggcctgcgtctgcactatgtctcggctggacgaggtaacggacccctcatgctgtttctgcacggcttccctgagaactggttctcctggcgttaccagctccgggagttccagagccgcttccatgttgtggctgtggacttgcgaggctatggcccctcggatgcacctcgggatgtggactgctacacaatcgacctgctgctggtggacatcaaagatgtcatcctaggcctgggttactcgaagtgcatccttgtggcccatgactggggtgccctccttgcctggcatttctccatctactacccatccctggtcgagcggatggttgtggtcagtggtgcccccatgtcggtgtaccaagactattccctgcaccacatcagccagttcttccgttcccactacatgttcctgttccagctgccctggctgcccgagaagctgctgtctatgtctgactttcagattctgaagaccaccctcacccaccgcaagacaggcatcccatgcttgacccccagcgagctcgaggccttcctttataacttctcacagcctggtggcctcactgggcccctcaactactaccgaaacctcttcaggaacttccccctggaaccccaggagctgaccacacccacattgctgctgtggggggagaaggacacttacttggagctggggctggtggaagccatcggcagccgctttgtgccgggccgcttggaggcccacatcctgccaggcatagggcattggatcccacagagcaacccccaggagatgcaccagtacatgtgggccttcttgcaagacctgctggactagtggtccttgctggcctgcccaggaggcatggatactcaggaaggaacacacacccattatctgtgtgtgcctgggagtccatacaatgtccatacatgggtgaactcttgaatcgctcataggcatgggactcctggatcccacacaagcgcacctatgggtgcctcgggacacaccaacccctatactcacacacaggcatggatgcatgtgtgtgtaacaaacactttgaccctgggaactgggtatacctctcttccagtggagccagatgccgagaccgagtgtcccacctcctcccttcctggggcctcactctgcgctttgccaaagtcgcttctctgccatagctgcacagaccttaaaccctgaccttcctgtccctgccttcgacctcctgcctgggtcttcagctcagtgctactctgaatacaatactgctgaccacatttggctacttcaacttaaatgtatgttaattgaaatgaaatacaatgaaaatgcagtgctcagtcccaccagctgtatttcatt

SEQ ID NO: 342921 - DNA, 1182 bp, Homo sapiens
aggtgtttacctggcactcaggtgagtggtgcgctctggctgttttctgtcggagccgcccgcctcttccttcagcgcgtcccacaaatcccgacggcacggaggggccccaggccaagggcgatgggcccctgagccctgacaccgcttcgccgctgctgcaggtgcccctggccggcagcgccgccgtggtcccggagcgcggcgacatgccggagctggtggtgaccgcgctgctggcgccgtcgcgcctgtcgctgaagctgctgcgcgccttcatgtggagcctggtgttctcggtggcgctggtggccgcggcggtctacggctgcatagcgctcacgcacgtgctgtgccggccccggcgcggctgctgcgggcgccgtcggagcgcgtcccccgcctgcctgagcgacccctcgctgggtgagcacggtttcctgaacctcaagagctcgggcctgcgtctgcactatgtctcggctggacgaggtaacggacccctcatgctgtttctgcacggcttccctgagaactggttctcctggcgttaccagctccgggagttccagagccgcttccatgttgtggctgtggacttgcgaggctatggcccctcggatgcacctcgggatgtggactgctacacaatcgacctgctgctggtggacatcaaagatgtcatcctaggcctgggttactcgaagtgcatccttgtggcccatgactggggtgccctccttgcctggcatttctccatctactacccatccctggtcgagcggatggttgtggtcagtggtgcccccatgtcggtgtaccaagactattccctgcaccacatcagccagttcttccgttcccactacatgttcctgttccagctgccctggctgcccgagaagctgctgtctatgtctgactttcagattctgaagaccaccctcacccaccgcaagacaggcatcccatgcttgacccccagcgagctcgaggccttcctttataacttctcacagcctggtggcctcactgggcccctcaactactaccgaaacctcttcaggtgagaccagttgccaagcataagctcaggagatttgcaggggcaggggggtgggagggttgggggagagatataatttttgtttttggggggggccggtgccccctgccccctcc

SEQ ID NO: 342922 - DNA, 1026 bp, Homo sapiens
aggtgtttacctggcactcaggtgagtggtgcgctctggctgttttctgtcggagccgcccgcctcttccttcagcgcgtcccacaaatcccgacggcacggaggggccccaggccaagggcgatgggcccctgagccctgacaccgcttcgccgctgctgcaggtgcccctggccggcagcgccgccgtggtcccggagcgcggcgacatgccggagctggtggtgaccgcgctgctggcgccgtcgcgcctgtcgctgaagctgctgcgcgccttcatgtggagcctggtgttctcggtggcgctggtggccgcggcggtctacggctgcatagcgctcacgcacgtgctgtgccggccccggcgcggctgctgcgggcgccgtcggagcgcgtcccccgcctgcctgagcgacccctcgctgggtgagcacggtttcctgaacctcaagagctcgggcctgcgtctgcactatgtctcggctggacgaggtaacggacccctcatgctgtttctgcacggcttccctgagaactggttctcctggcgttaccagctccgggagttccagagccgcttccatgttgtggctgtggacttgcgaggctatggcccctcggatgcacctcgggatgtggactgctacacaatcgacctgctgctggtggacatcaaagatgtcatcctaggcctgggttactcgaagtgcatccttgtggcccatgactggggtgccctccttgcctggcatttctccatctactacccatccctggtcgagcggatggttgtggtcagtggtgcccccatgtcggtgtaccaagactatgttttcacataagattagggtccttttggaaagaatagttgcagtgtttataggatagttgtggtaagaatctagtttattttgcatttggctaattggtctgtgctgcatggttatatactcctggattatagattaaaagtctctgtagacatctctgtgaagagcaagctatcattaaacatgtctgtttatc

SEQ ID NO: 342923 - DNA, 783 bp, Homo sapiens
gctagtcttgaactcctgacctcaagttatctgcccgcctcggcctcccagtgctgggattacaggtgttagccactgtgcctggccaacctcacatattttgatgctgttgttaggcccatacacctcaagatctgttatgttttgtgtctaaagtagtaagatatttccgctttctttggattactatctttctccatcccttttgtgtttttatgtttaaagtgggcttcttttctttttttttgttcatggcaagatcttgtcatgagacagcaggtttcttttttctttgcaatggggtcttgctctgttgcccaggctgcagagcagtggtgcaatcacagctcactacaacctcaacttcctgggctcaagcgatcctaccacatcagcctcttgagtagctgagacttataggtacacaacaccacaccaagctaatttttttaactttttgatgagatgatttctcactatgttgtttaggctggtctcaaactcccaggctcaagggatcctcccatctcggcctcccaaagtgctggaattacaggagccatcactcctggccgaagcaggttccttatagaaaacacagttggggccaggcactgtggcctgtaataccagtgctttaggaggccaaagcaggaggactgcttgaggctcaagagtttgagaccaacctgggcaaaatagtgagacctgatctctacaaaaataaaaaaagagctggatgtggtgacatgcacctgtagtcccagctgcccgggatgctga

SEQ ID NO: 342924 - DNA, 633 bp, Homo sapiens
ccctctttctcagtcttttggaatagtttcagtaggattggtaccaattcttatttgaatgtctggtagaatttggctggaattcatctggccctggtctttattgttggcattttttatactgatttaacctcattgcttgttactggctgttcaggatttttgcttcttcctgattcaagctaggagggttgtgtctttccaagaatgtatctattttctttagactttctagtttatgtgcatagaagtctttatagtaatctcaaatgatataaagtctcactttggattttgtttgttcatgtttctctagttccttgaggtatgacattaggttttcaatttctgatttttcagactttctgatgtaggtacttagcactattaactttcctcttagcactgcttttgctgtacaccaaagagattgataacttatgacactatagtcaatcattttgaagaagttttacattttcatcttgatttcatttttagtccaaaaatcattcaggagcagattgtctaatttccatgtatttgtatagttttaggagttccctttggagttgattcctgtctttattccactgtgcactgagaagatacttgacataattttgatattta

SEQ ID NO: 342925 - DNA, 687 bp, Homo sapiens
ccctctttctcagtcttttggaatagtttcagtaggattggtaccaattcttatttgaatgtctggtagaatttggctggaattcatctggccctggtctttattgttggcattttttatactgatttaacctcattgcttgttactggctgttcaggatttttgcttcttcctgattcaagctaggagggttgtgtctttccaagaatgtatctattttctttagactttctagtttatgtgcatagaagtctttatagtaatctcaaatgatataaagtctcaaaaagaactttattcagttcttctctgactttgttatttattttcttccgctagctttggattttgtttgttcatgtttctctagttccttgaggtatgacattaggttttcaatttctgatttttcagactttctgatgtaggtacttagcactattaactttcctcttagcactgcttttgctgtacaccaaagagattgataacttatgacactatagtcaatcattttgaagaagttttacattttcatcttgatttcatttttagtccaaaaatcattcaggagcagattgtctaatttccatgtatttgtatagttttaggagttccctttggagttgattcctgtctttattccactgtgcactgagaagatacttgacataattttgatattta

SEQ ID NO: 342926 - DNA, 580 bp, Homo sapiens
tacattgacattttaattaacaagttcttacttaaattttaactccaaagagtctagcacaatatatttaagtagtcaactacacagtcagtgtaaaatgttgacttctgtccatctaacacagttgtataggaacggttttacctgcaaagcactaataatacttattggcgtatggcctttgactcatttataccatttcctaaaagaggcatgaaggacacagagagcttttccatgtaactcagagcccataaatggtagctcctcttagaatattatgtctactctcttattcaattattcaataaagattgttaactctccctctaaagtggccttcaaattaagtaaaaagttgtgagttgtttgaatcatattcacatccagcactgtttgattaaaaaaaaaaaaaatagcctttctgaaaccagacttggagtcctaatcacccagaatagttccagacaagattcagaatcagaactctgactctgcccaacaattccactaaattaattcactctgcactctcttgaatggatttggaaggcaaatcatgagcttgctttagagtatt

SEQ ID NO: 342927 - DNA, 721 bp, Homo sapiens
tttattttctctaactctacattctcttctcagtactcaattcttcatcaattccagagtctctgtccattatttaaaccaatattttattaaaaccctcatactcttgtccttctccctaattcagccttctatctcatgtgctcaatgaaatcccaaatttggatcaatctaactaactgcatttactgcacctttatttctgctgctgggttctaaaatcacatacaaaaaattaaatcatacgaattaaaagtctccttcttcacctgggcccgcaatgctacatacagtccctccacatgtgcttagtcagcatcctctctcaaagaactatttcaaattttaaccacttgtcaggcccgaatctttaccacatctcttcttctcactctcaggagataagcttacatgctgtttcacagagaaggcaaaaatcattaaatggaaattatcttgtcacaaaaaatgtatccacatttaaactcacctagatcaatttacctagtaaaaagcatcactcctattaaagagtaatccttccactacgtactgtttcctagactctattcacaccttgagaaccttatgctccattaactatgcttgcttctttttttgtgttttttgtttatttggagacagggtctcactcctgtcacctaggctggggtgcagtggtgcgatcacagttcactgcagcctccttgggctcaggtga

SEQ ID NO: 342928 - DNA, 323 bp, Homo sapiens
aaaatggtgctgtaggagaatacaagggacctggccaagatgagggtcaggaaagaccttctgagggaaataatgttaaagccgaaactgatgtctacacaagtcaaaaagttgtatatacacaagtcaaaaagtaggatggagcatattccatttgaagaaatggaatatgtatgcaatatatatttatttcatctggagaaaggaaagcaaaggggagggtggtatgtaacgaggctagaaagacacgcagggcagtgctgtggaaagatttgtaataattattttatctaacaattatttgttaagtacctcctatatcc

SEQ ID NO: 342929 - DNA, 417 bp, Homo sapiens
tgggattatgggtgtgagccaccacgcccggccctgttgtcctattgtggtaccaaatactgtatcttattccttctaattaactgtatttttatactcattagccagcccctctttatttccctctccccactacctgtcccatgtcctgagggcagtattttttagctctcagatatggatgagaacatgagatatttgtctttctatacctgacttacttcacttaatgtaatgtcctccaggtatatccatttatatccatgtcattacaaatgacagcatttttgtggttggataatatcccattgtgtgtatgtaccatagtttttttattcatttattcgttaatggatgctgacaaggatgtggagaaaggggaaccctcgtacactattagtgggaaagtaaattagt

SEQ ID NO: 342930 - DNA, 926 bp, Homo sapiens
  misc_feature (785)..(785): n is a, c, g, or t
tatgtccagaaggtccttcttaacaaacactaattagtacagggaaaggtctctttaagtgaatgcatttaaaatagggagtccacctttgtggtaaatagtgtgcacgaggtgagtctggatcaggacttcacacttgataacggaattcaatttctcaaaatacctttatttcagatttaatgaaattccatgtttgttgaatcattaagaacgagcatttgtgttgtactcatggtggacagccaccattctaatgcttgactttacataattaacgcatgtaatctgcaaaggagccacaaggcgagatctattattattcccattgtgccgctggagaaattaaggcagagaggttaagttgcttgccaccaaactagcgaggggcagagctgggatgtgtagcatccaggtaggttggctccagagcccatgagcctaactactactgtgcccaacctttgtgccaatccccacaacagtcaaaggatggatcaagtactggttttgggggtgggggcaggggactctgggcagtatgttttctgatcacatcacatgacagtaggacattcttcatttcaccatggctttcactgcccaacaataaaaaggtcatgggcactttgggaggccgagggggggggatcacgaggtcaggagatcgagaccatcctggccaacacggtgaaaccccgtctctactaaaaatacaaaaaattagccaggcatggtggcgctgagccaggtactcgagctagcagagatgctgactcgagganactgcatgagtggaccgcatgactcaaactggcaaaacagaatcgttcaaaaaaaaaaggaaaccgggtccactaaacttggaatacctttcactgcgattacaagccaccgtgccttaaattgcaccagggaaggattag

SEQ ID NO: 342931 - DNA, 667 bp, Homo sapiens
aaaaaaaaacatttactaagtaggtaaccttgggtaggttggttaaaatttctctagagcagactggctaccttatctataaaatgtggaagtaacaacatgtacttcctaaggttgttatgagaattcaacaagttacgtataggcttaatctataataaatgctctacttaatctacaataaatgcctataaattctagcaattattatcaatgtgaattatgaaatgccatctacaggacaggaagggtcggggaaatgagaggtacaacagaaagagaaaaggaaaagagttgagactggtttactgaaacaaaaggaaatgaacattaagttacaggaaaatttcaagggagagaaaaggtagtcactgattcataatatactgaagaattctgagaaaagatacttctatgttagggtaacacattttttggagagggcagtgagatatgggagccagcgtcaaataatgcttttaaggcatccacagccttcttagaagaagaccatgaactaccactccaagaagtctgcaactgttttttttttttttttttaaagctgactttctggagttaggaaaaacccacatacagctaagtgtgttcatatccttaatcattcaacaaccattgagtgccctgtgtgtttcaggatgttgac

SEQ ID NO: 342932 - DNA, 501 bp, Homo sapiens
agagagagagagagagagagagagagagatttattttaaggaactggcagatgtggttgttggggccggcaagtctgaaatctgcagggcaggccggcaggctggagacctagggaagggttggtgttgcagcttgagtccaaaggcagactgaaggcagaattccctcttccttgggatccactttttctcttaaggccttcaactgactggatgaggccaacccacattatgaaaggtaacgtgctttactcaaaatctactgatttaaatgccatcttaaaaatacattcaaagtggcaactagactggtgtttgaccccccagtctagatgtccaaatatgtgaatatccaaatatgtggatagcatggatagccaagttgacatataaaattaacaattatacccacttatgtggggaagttagtacagtaattttaattttttattccaatttggctatcaactgttgagagcagagaaagagcaggccaactgt

SEQ ID NO: 342933 - DNA, 204 bp, Homo sapiens
tgtcattgcttttgctcttttgtggacatgagcaaaaacaggcaacgagaagtgaaaactgtgagtgttctgacctgaggtccaacagttgccgttctgcgtccctgttccagctcacactgtaaacaagggtcctttgcccagggtatctggttttgtgtttttttgtttgtttgttttgttttgttttttgttttgaggtgg

SEQ ID NO: 342934 - DNA, 2067 bp, Homo sapiens
agtagagatggggtttcaccatgttggccaggctggtcttgaattcctgacctcaggtgatccacctgcctcagcctcccaaagtgttgggattacaggtgtgagccatcgcacccagctggggctatctttagtagcagatggtaactgagctgggcaattgttctttgacatttccagttcttatctgttaacatggacagtgatttaaataggcagctgcatggacggcctctccctaactgctgctatcttgtatctcctcattggtaattatttttcctagcccaaattccacgtcaaacactatcaatattctggggaccaccctttcatacactgctctgtacacatacctgtttatacatattttaacaaaagtggaatatttacatactgttgttatcatagccaagctcaacagcatcaaaagcatttttaggtacttaattcaagtggctgtaaaatttaaaaaaaatcattttttctgatactatatcatctttgtacccgtatatttcaatttcttgaatgttcattacaattttatttttactttttattctttcttgagacagagtctcactctatcacccaggctggagtgcatggtatggtctcagctcactgcaacctctaccttctgggttcaagcaatcctcccacctcagccttcagagtagctgggaacacaggcgtgcaccaccacgcccggcttatttttgaatttttttgtagagacggggtttctccgtgttgcccagtctggtcttaaagtcctgagctcaagcaatctgcctgcctcggcctcctgaagtgctgggattagaggcaagccactgcgcccagcctttattacaattttaaatgtttttctctgtgttagcgaacctttgatggactgttttaaagagtgttaaagagtgtttaaatcactgtgaaatgcacattctgtcttaatatttataattattagggtaccttcattaatagtgtacattgcatagtgccaaacgagatcaccacatcacttctaaaggattcctggaagtctgagtcacaagcatgagacaacagctgcaggactgggtggtgaaggttgtgaaaacttcctggcttaaacaggaatttgacccaaaacaagaagtcttagggaagatagcttagggcttgtctggtggcaccacaatgccatcaaatgcccagcctctttacagttttctgctctgccatccttggaatgcaggccattgttctcctgtttgttgtttcatgactgaactatgagtgctgtagctcttcacgttcctcctggaagacaggtgtagggcaaagatgagctctgattcgcagagcccttccatctatatgctttcttagaagcctcagcaataagttcaacattcaactcattggcttgaagtgtgtcaaatggctgccccttgcttcaaaggagtctgagaaaataactttagctagaattaaagttccattagagtgcctgggtagacaaagaagagtcagctacagaaggccagtatcatagcaagttgttgctccatgactggaaacaaagaagacttcactctttacttcagatgcgcagttgatagagtacagctaagatatggtacgtgttctaccatgaagagcaagagcaaggtgagggagggtacggtgtaagagatcctgctgcattagctgttgagaggaagaatttcctcctggtcactatgttactgggggtccttgctccccaagttcccaagatggtggcaggtcgcttccaagatggtgacgggccacttccgagatggtggcaagtcttgtgttctctgacctggggttcttggcctcatggattccaaggaatggaatcttgggccaagcggcgagtgttatagctctattagaagctgtgggtcatggaagagaatcgtggaacccagtgactagtgtttagctagattaggacgaacctgggcacttagccctgcaggaacaagggcaagcctttagcccgatcaggagcagcaatgggcgcctcgctggatccagagggatgga

SEQ ID NO: 342935 - DNA, 1122 bp, Homo sapiens
ccccgtgtttaaaggtggacgtggtcaatttcccagctaggcttagggattcttagccagcctaggaaatccaactagtcctgtctctcagtaccccctctcaacaggaaaacccaagtgctattggggaggtttgaccaccgctctaactgcttcctgctgaattggggcacagtaggggttgtgcagttgagatttcctccgtaggggtgccttgtctctcaactaattcagtggtggctacctcgaagcccttctgaagctaagagggaaagagaccagctcgcaaagtcccctatgttatctactcctaagtggaagctgggagctgtgaaaatgcacatctaacaacccttaacttactataccgacttctaaaccacagcagaaaatgaagaaaagttcggctatgggcaatagactcaactttttgttctatgtctaacctataaaatagaaaaataatactgtcatccctcatctcccaccatactgaacacgcattaggtgctcaatgaatacttgtccattttagtgaagattaagaggaatgagacggaaactgacacttgagaggctggcacacgccagaactgcaccacactttgcactcatagctcatttactcatcagcttgtggtcaggtaggcattaccgtccccattagagaagtcaacggaggctcagcaaggacggccagggtcccccagaaagtagaggaggacttcaggtttaaccaaaagcctgtactctttacacatgtaccccatggcttctccaccaaagctcctggcaccgtgctttgcagacagacgacgctcaacacattttgagcagaagcgtggttcagcaccaggaaggacaccaacttttgcagagacgactcttgggatggagaaagacttcccaaatcttcagggtgcggtcaagacagggtaggctagcgccaggggagctagtggctaggccccagggcagctggggccgaggccgagcaaacggccaggggagaggctcccaggagcccgatctgccgctgggcgacgcgaagcctggcggctagagtcccgggcagcccgagcacggcgggaaggcggcagcaacaggatcggcagggccgct

SEQ ID NO: 342936 - DNA, 4367 bp, Homo sapiens
agtagagatggggtttcaccatgttggccaggctggtcttgaattcctgacctcaggtgatccacctgcctcagcctcccaaagtgttgggattacaggtgtgagccatcgcacccagctggggctatctttagtagcagatggtaactgagctgggcaattgttctttgacatttccagttcttatctgttaacatggacagtgatttaaataggcagctgcatggacggcctctccctaactgctgctatcttgtatctcctcattggtaattatttttcctagcccaaattccacgtcaaacactatcaatattctggggaccaccctttcatacactgctctgtacacatacctgtttatacatattttaacaaaagtggaatatttacatactgttgttatcatagccaagctcaacagcatcaaaagcatttttaggtacttaattcaagtggctgtaaaatttaaaaaaaatcattttttctgatactatatcatctttgtacccgtatatttcaatttcttgaatgttcattacaattttatttttactttttattctttcttgagacagagtctcactctatcacccaggctggagtgcatggtatggtctcagctcactgcaacctctaccttctgggttcaagcaatcctcccacctcagccttcagagtagctgggaacacaggcgtgcaccaccacgcccggcttatttttgaatttttttgtagagacggggtttctccgtgttgcccagtctggtcttaaagtcctgagctcaagcaatctgcctgcctcggcctcctgaagtgctgggattagaggcaagccactgcgcccagcctttattacaattttaaatgtttttctctgtgttagcgaacctttgatggactgttttaaagagtgttaaagagtgtttaaatcactgtgaaatgcacattctgtcttaatatttataattattagggtaccttcattaatagtgtacattgcatagtgccaaacgagatcaccacatcacttctaaaggattcctggaagtctgagtcacaagcatgagacaacagctgcaggactgggtggtgaaggttgtgaaaacttcctggcttaaacaggaatttgacccaaaacaagaagtcttagggaagatagcttagggcttgtctggtggcaccacaatgccatcaaatgcccagcctctttacagttttctgctctgccatccttggaatgcaggccattgttctcctgtttgttgtttcatgactgaactatgagtgctgtagctcttcacgttcctcctggaagacaggtgtagggcaaagatgagctctgattcgcagagcccttccatctatatgctttcttagaagcctcagcaataagttcaacattcaactcattggcttgaagtgtgtcaaatggctgccccttgcttcaaaggagtctgagaaaataactttagctagaattaaagttccattagagtgcctgggtagacaaagaagagtcagctacagaaggccagtatcatagcaagttgttgctccatgactggaaacaaagaagacttcactctttacttcagatgcgcagttgatagagtacagctaagatatggtacgtgttctaccatgaagagcaagagcaagctcctggcaccgtgctttgcagacagacgacgctcaacacattttgagcagaagcgtggttcagcaccaggaaggacaccaacttttgcagagacgactcttgggatggagaaagacttcccaaatcttcagggtgcggtcaagacaggcttcctttctcctcacgacggcctccacagtccggagcccggcggagcccggacctggcggggagagctgcctccacggccgggcacccagaccccaccgtcgcagtcgccaccacctcagtccatccttggtaccggcaatgggcttcgtatcctccagtgcacttgtaactgacttggacacggaatactaagaactcacttctgtcctcatcccagtcgcgccggcggtgaccatctcggctcttttgggcttaactgccgctcctctggactctgtctgactttgggggcaccatggaccaaagtgggatggagattcctgtgaccctcatcattaaagcaccgaatcagaaatacagtgaccagactattagctgcttcttgaactggaccgtggggaaactaaaaacgcatctatctaacgtttaccctagcaaaccattgacgaaggatcagagattggtgtattcgggcagactgcttcccgatcatctgcagctgaaagacattctcagaaaacaagatgagtatcatatggttcatctagtatgtacttctcggactcctcccagttctccaaaatccagcaccaatagagaaagtcatgaagcattggcatccagcagcaattctagttcagatcattcaggatcaacaactccatcatctggtcaagaaaccttgtctttagctgtgggttcttcctcagaaggattgaggcagcgtacccttccacaagcacaaactgaccaagcacagagtcaccagtttccatatgtaatgcaaggaaatgtagacaaccaatttcctgggcaagctgctccacctggattcccagtgtatcccgcgtttagcccactgcagatgctatggtggcaacagatgtatgctcatcagtattatatgcagtatcaagctgcagtttcagctcaggccacatcaaatgtcaacccaacccagcctactacttcacagcctctaaatttggcacatgttcctggagaagaacccccaccagctccaaacctagtggcccaagaaaatcgacccatgaatgagaatgttcaaatgaatgcacagggaggtccagtactaaatgaagaagacttcaatcgagactggctagactggatgtacacgttctcacgagctgcgattctccttagcattgtatacttctattcttcttttagtcggtttatcatggtaatgggagccatgctactggtttatttacaccaagctggatggtttccttttaggcaagaaggaggtcatcagcaggctcccaacaataatgccgaagttaacaatgatgggcaaaatgcaaacaacttggaacttgaagaaatggagcgtcttatggatgatgggcttgaagatgagagtggagaagatggaggtgaagatgccagtgcaattcaaaggcctggattaatggcttcagcttggtctttcatcaccaccttctttacttcactaataccagaggggcctccccaggttgccaattgacctgaaaaactgtgccagctacaaggagggtctgacttcaggaaagtggtttaaataacagtgcaatttcaaaaaaatttataactttcttttgatcatcatgtacagaggtgttttttttctttaggcttctcatgcatatgaatattttaagcacgaatggactactaaatatctgagttttttttttttttttttaaagatcctaacagaacatagcgtaacaatattggtcttccaggtgttactcatttcaattatgtgtagtataccaggacagacctattttcatgtcttatttctttaaagagctgcttcattggccgggcgccatggctcacgtctgtaatcccagcactttgggaggccgaggcgggtgggttacttgaggtcaggagttcgagaccagcctggcaaacatggcgaaaccccatcttaactaaaaatacaaaaaaattagccgggtgtggtgtcacgcgcctgtaatcccagctacttggggggctcaggcaggagaattgcctgaacccaggaggcggaggttgcagtgagctgagattgggccactgcactccaccctgggcgacagagtgagactcggtctcagaaaaaaaaaaaaaagagctgcttcacatataaatgtctatagctagtagcctggccctttaatgtttaatttgaatagatatatctgttttccgtgaattatcttgaaagttttaaacagaatgacctcatagtttttaataaagaatattatttacctaaaatgtgctagtagcatcttgcccagccataaagcaataaacttctcaataatcttaattttgatatttgaataaataatggaaactttctgtattaagggcatgtatcccatcaattggaatcagtaccttaacagaaaaaggcagctcttcaatggaattaacgtgatataaaatgtttgatataggcagtacttttataaaaaaagataagctggaaattgctccgtgtaattttttaaataaaaagtcaattatggtaaaaaaaaaa

SEQ ID NO: 342937 - DNA, 3491 bp, Homo sapiens
ccccgtgtttaaaggtggacgtggtcaatttcccagctaggcttagggattcttagccagcctaggaaatccaactagtcctgtctctcagtaccccctctcaacaggaaaacccaagtgctattggggaggtttgaccaccgctctaactgcttcctgctgaattggggcacagtaggggttgtgcagttgagatttcctccgtaggggtgccttgtctctcaactaattcagtggtggctacctcgaagcccttctgaagctaagagggaaagagaccagctcgcaaagtcccctatgttatctactcctaagtggaagctgggagctgtgaaaatgcacatctaacaacccttaacttactataccgacttctaaaccacagcagaaaatgaagaaaagttcggctatgggcaatagactcaactttttgttctatgtctaacctataaaatagaaaaataatactgtcatccctcatctcccaccatactgaacacgcattaggtgctcaatgaatacttgtccattttagtgaagattaagaggaatgagacggaaactgacacttgagaggctggcacacgccagaactgcaccacactttgcactcatagctcatttactcatcagcttgtggtcaggtaggcattaccgtccccattagagaagtcaacggaggctcagcaaggacggccagggtcccccagaaagtagaggaggacttcaggtttaaccaaaagcctgtactctttacacatgtaccccatggcttctccaccaaagctcctggcaccgtgctttgcagacagacgacgctcaacacattttgagcagaagcgtggttcagcaccaggaaggacaccaacttttgcagagacgactcttgggatggagaaagacttcccaaatcttcagggtgcggtcaagacaggcttcctttctcctcacgacggcctccacagtccggagcccggcggagcccggacctggcggggagagctgcctccacggccgggcacccagaccccaccgtcgcagtcgccaccacctcagtccatccttggtaccggcaatgggcttcgtatcctccagtgcacttgtaactgacttggacacggaatactaagaactcacttctgtcctcatcccagtcgcgccggcggtgaccatctcggctcttttgggcttaactgccgctcctctggactctgtctgactttgggggcaccatggaccaaagtgggatggagattcctgtgaccctcatcattaaagcaccgaatcagaaatacagtgaccagactattagctgcttcttgaactggaccgtggggaaactaaaaacgcatctatctaacgtttaccctagcaaaccattgacgaaggatcagagattggtgtattcgggcagactgcttcccgatcatctgcagctgaaagacattctcagaaaacaagatgagtatcatatggttcatctagtatgtacttctcggactcctcccagttctccaaaatccagcaccaatagagaaagtcatgaagcattggcatccagcagcaattctagttcagatcattcaggatcaacaactccatcatctggtcaagaaaccttgtctttagctgtgggttcttcctcagaaggattgaggcagcgtacccttccacaagcacaaactgaccaagcacagagtcaccagtttccatatgtaatgcaaggaaatgtagacaaccaatttcctgggcaagctgctccacctggattcccagtgtatcccgcgtttagcccactgcagatgctatggtggcaacagatgtatgctcatcagtattatatgcagtatcaagctgcagtttcagctcaggccacatcaaatgtcaacccaacccagcctactacttcacagcctctaaatttggcacatgttcctggagaagaacccccaccagctccaaacctagtggcccaagaaaatcgacccatgaatgagaatgttcaaatgaatgcacagggaggtccagtactaaatgaagaagacttcaatcgagactggctagactggatgtacacgttctcacgagctgcgattctccttagcattgtatacttctattcttcttttagtcggtttatcatggtaatgggagccatgctactggtttatttacaccaagctggatggtttccttttaggcaagaaggaggtcatcagcaggctcccaacaataatgccgaagttaacaatgatgggcaaaatgcaaacaacttggaacttgaagaaatggagcgtcttatggatgatgggcttgaagatgagagtggagaagatggaggtgaagatgccagtgcaattcaaaggcctggattaatggcttcagcttggtctttcatcaccaccttctttacttcactaataccagaggggcctccccaggttgccaattgacctgaaaaactgtgccagctacaaggagggtctgacttcaggaaagtggtttaaataacagtgcaatttcaaaaaaatttataactttcttttgatcatcatgtacagaggtgttttttttctttaggcttctcatgcatatgaatattttaagcacgaatggactactaaatatctgagttttttttttttttttttaaagatcctaacagaacatagcgtaacaatattggtcttccaggtgttactcatttcaattatgtgtagtataccaggacagacctattttcatgtcttatttctttaaagagctgcttcattggccgggcgccatggctcacgtctgtaatcccagcactttgggaggccgaggcgggtgggttacttgaggtcaggagttcgagaccagcctggcaaacatggcgaaaccccatcttaactaaaaatacaaaaaaattagccgggtgtggtgtcacgcgcctgtaatcccagctacttggggggctcaggcaggagaattgcctgaacccaggaggcggaggttgcagtgagctgagattgggccactgcactccaccctgggcgacagagtgagactcggtctcagaaaaaaaaaaaaaagagctgcttcacatataaatgtctatagctagtagcctggccctttaatgtttaatttgaatagatatatctgttttccgtgaattatcttgaaagttttaaacagaatgacctcatagtttttaataaagaatattatttacctaaaatgtgctagtagcatcttgcccagccataaagcaataaacttctcaataatcttaattttgatatttgaataaataatggaaactttctgtattaagggcatgtatcccatcaattggaatcagtaccttaacagaaaaaggcagctcttcaatggaattaacgtgatataaaatgtttgatataggcagtacttttataaaaaaagataagctggaaattgctccgtgtaattttttaaataaaaagtcaattatggtaaaaaaaaaa

SEQ ID NO: 342938 - DNA, 4421 bp, Homo sapiens
  misc_feature (2737)..(2738): n is a, c, g, or t
  misc_feature (2799)..(2799): n is a, c, g, or t
agtagagatggggtttcaccatgttggccaggctggtcttgaattcctgacctcaggtgatccacctgcctcagcctcccaaagtgttgggattacaggtgtgagccatcgcacccagctggggctatctttagtagcagatggtaactgagctgggcaattgttctttgacatttccagttcttatctgttaacatggacagtgatttaaataggcagctgcatggacggcctctccctaactgctgctatcttgtatctcctcattggtaattatttttcctagcccaaattccacgtcaaacactatcaatattctggggaccaccctttcatacactgctctgtacacatacctgtttatacatattttaacaaaagtggaatatttacatactgttgttatcatagccaagctcaacagcatcaaaagcatttttaggtacttaattcaagtggctgtaaaatttaaaaaaaatcattttttctgatactatatcatctttgtacccgtatatttcaatttcttgaatgttcattacaattttatttttactttttattctttcttgagacagagtctcactctatcacccaggctggagtgcatggtatggtctcagctcactgcaacctctaccttctgggttcaagcaatcctcccacctcagccttcagagtagctgggaacacaggcgtgcaccaccacgcccggcttatttttgaatttttttgtagagacggggtttctccgtgttgcccagtctggtcttaaagtcctgagctcaagcaatctgcctgcctcggcctcctgaagtgctgggattagaggcaagccactgcgcccagcctttattacaattttaaatgtttttctctgtgttagcgaacctttgatggactgttttaaagagtgttaaagagtgtttaaatcactgtgaaatgcacattctgtcttaatatttataattattagggtaccttcattaatagtgtacattgcatagtgccaaacgagatcaccacatcacttctaaaggattcctggaagtctgagtcacaagcatgagacaacagctgcaggactgggtggtgaaggttgtgaaaacttcctggcttaaacaggaatttgacccaaaacaagaagtcttagggaagatagcttagggcttgtctggtggcaccacaatgccatcaaatgcccagcctctttacagttttctgctctgccatccttggaatgcaggccattgttctcctgtttgttgtttcatgactgaactatgagtgctgtagctcttcacgttcctcctggaagacaggtgtagggcaaagatgagctctgattcgcagagcccttccatctatatgctttcttagaagcctcagcaataagttcaacattcaactcattggcttgaagtgtgtcaaatggctgccccttgcttcaaaggagtctgagaaaataactttagctagaattaaagttccattagagtgcctgggtagacaaagaagagtcagctacagaaggccagtatcatagcaagttgttgctccatgactggaaacaaagaagacttcactctttacttcagatgcgcagttgatagagtacagctaagatatggtacgtgttctaccatgaagagcaagagcaagctcctggcaccgtgctttgcagacagacgacgctcaacacattttgagcagaagcgtggttcagcaccaggaaggacaccaacttttgcagagacgactcttgggatggagaaagacttcccaaatcttcagggtgcggtcaagacaggcttcctttctcctcacgacggcctccacagtccggagcccggcggagcccggacctggcggggagagctgcctccacggccgggcacccagaccccaccgtcgcagtcgccaccacctcagtccatccttggtaccggcaatgggcttcgtatcctccagtgcacttgtaactgacttggacacggaatactaagaactcacttctgtcctcatcccagtcgcgccggcggtgaccatctcggctcttttgggcttaactgccgctcctctggactctgtctgactttgggggcaccatggaccaaagtgggatggagattcctgtgaccctcatcattaaagcaccgaatcagaaatacagtgaccagactattagctgcttcttgaactggaccgtggggaaactaaaaacgcatctatctaacgtttaccctagcaaaccattgacgaaggatcagagattggtgtattcgggcagactgcttcccgatcatctgcagctgaaagacattctcagaaaacaagatgagtatcatatggttcatctagtatgtacttctcggactcctcccagttctccaaaatccagcaccaatagagaaagtcatgaagcattggcatccagcagcaattctagttcagatcattcaggatcaacaactccatcatctggtcaagaaaccttgtctttagctgtgggttcttcctcagaaggattgaggcagcgtacccttccacaagcacaaactgaccaagcacagagtcaccagtttccatatgtaatgcaaggaaatgtagacaaccaatttcctgggcaagctgctccacctggattcccagtgtatcccgcgtttagcccactgcagatgctatggtggcaacagatgtatgctcatcagtattatatgcagtacatcaagccccnntttttggggcccccccaaagggttttccaggcccttcccaaaaggggggcccgggggcccncccaacaatcaaatgtcaacccaacccagcctactacttcacagcctctaaatttggcacatgttcctggagaagaacccccaccagctccaaacctagtggcccaagaaaatcgacccatgaatgagaatgttcaaatgaatgcacagggaggtccagtactaaatgaagaagacttcaatcgagactggctagactggatgtacacgttctcacgagctgcgattctccttagcattgtatacttctattcttcttttagtcggtttatcatggtaatgggagccatgctactggtttatttacaccaagctggatggtttccttttaggcaagaaggaggtcatcagcaggctcccaacaataatgccgaagttaacaatgatgggcaaaatgcaaacaacttggaacttgaagaaatggagcgtcttatggatgatgggcttgaagatgagagtggagaagatggaggtgaagatgccagtgcaattcaaaggcctggattaatggcttcagcttggtctttcatcaccaccttctttacttcactaataccagaggggcctccccaggttgccaattgacctgaaaaactgtgccagctacaaggagggtctgacttcaggaaagtggtttaaataacagtgcaatttcaaaaaaatttataactttcttttgatcatcatgtacagaggtgttttttttctttaggcttctcatgcatatgaatattttaagcacgaatggactactaaatatctgagttttttttttttttttttaaagatcctaacagaacatagcgtaacaatattggtcttccaggtgttactcatttcaattatgtgtagtataccaggacagacctattttcatgtcttatttctttaaagagctgcttcattggccgggcgccatggctcacgtctgtaatcccagcactttgggaggccgaggcgggtgggttacttgaggtcaggagttcgagaccagcctggcaaacatggcgaaaccccatcttaactaaaaatacaaaaaaattagccgggtgtggtgtcacgcgcctgtaatcccagctacttggggggctcaggcaggagaattgcctgaacccaggaggcggaggttgcagtgagctgagattgggccactgcactccaccctgggcgacagagtgagactcggtctcagaaaaaaaaaaaaaagagctgcttcacatataaatgtctatagctagtagcctggccctttaatgtttaatttgaatagatatatctgttttccgtgaattatcttgaaagttttaaacagaatgacctcatagtttttaataaagaatattatttacctaaaatgtgctagtagcatcttgcccagccataaagcaataaacttctcaataatcttaattttgatatttgaataaataatggaaactttctgtattaagggcatgtatcccatcaattggaatcagtaccttaacagaaaaaggcagctcttcaatggaattaacgtgatataaaatgtttgatataggcagtacttttataaaaaaagataagctggaaattgctccgtgtaattttttaaataaaaagtcaattatggtaaaaaaaaaa

SEQ ID NO: 342939 - DNA, 4043 bp, Homo sapiens
agtagagatggggtttcaccatgttggccaggctggtcttgaattcctgacctcaggtgatccacctgcctcagcctcccaaagtgttgggattacaggtgtgagccatcgcacccagctggggctatctttagtagcagatggtaactgagctgggcaattgttctttgacatttccagttcttatctgttaacatggacagtgatttaaataggcagctgcatggacggcctctccctaactgctgctatcttgtatctcctcattggtaattatttttcctagcccaaattccacgtcaaacactatcaatattctggggaccaccctttcatacactgctctgtacacatacctgtttatacatattttaacaaaagtggaatatttacatactgttgttatcatagccaagctcaacagcatcaaaagcatttttaggtacttaattcaagtggctgtaaaatttaaaaaaaatcattttttctgatactatatcatctttgtacccgtatatttcaatttcttgaatgttcattacaattttatttttactttttattctttcttgagacagagtctcactctatcacccaggctggagtgcatggtatggtctcagctcactgcaacctctaccttctgggttcaagcaatcctcccacctcagccttcagagtagctgggaacacaggcgtgcaccaccacgcccggcttatttttgaatttttttgtagagacggggtttctccgtgttgcccagtctggtcttaaagtcctgagctcaagcaatctgcctgcctcggcctcctgaagtgctgggattagaggcaagccactgcgcccagcctttattacaattttaaatgtttttctctgtgttagcgaacctttgatggactgttttaaagagtgttaaagagtgtttaaatcactgtgaaatgcacattctgtcttaatatttataattattagggtaccttcattaatagtgtacattgcatagtgccaaacgagatcaccacatcacttctaaaggattcctggaagtctgagtcacaagcatgagacaacagctgcaggactgggtggtgaaggttgtgaaaacttcctggcttaaacaggaatttgacccaaaacaagaagtcttagggaagatagcttagggcttgtctggtggcaccacaatgccatcaaatgcccagcctctttacagttttctgctctgccatccttggaatgcaggccattgttctcctgtttgttgtttcatgactgaactatgagtgctgtagctcttcacgttcctcctggaagacaggtgtagggcaaagatgagctctgattcgcagagcccttccatctatatgctttcttagaagcctcagcaataagttcaacattcaactcattggcttgaagtgtgtcaaatggctgccccttgcttcaaaggagtctgagaaaataactttagctagaattaaagttccattagagtgcctgggtagacaaagaagagtcagctacagaaggccagtatcatagcaagttgttgctccatgactggaaacaaagaagacttcactctttacttcagatgcgcagttgatagagtacagctaagatatggtacgtgttctaccatgaagagcaagagcaagctcctggcaccgtgctttgcagacagacgacgctcaacacattttgagcagaagcgtggttcagcaccaggaaggacaccaacttttgcagagacgactcttgggatggagaaagacttcccaaatcttcagggtgcggtcaagacaggcttcctttctcctcacgacggcctccacagtccggagcccggcggagcccggacctggcggggagagctgcctccacggccgggcacccagaccccaccgtcgcagtcgccaccacctcagtccatccttggtaccggcaatgggcttcgtatcctccagtgcacttgtaactgacttggacacggaatactaagaactcacttctgtcctcatcccagtcgcgccggcggtgaccatctcggctcttttgggcttaactgccgctcctctggactctgtctgactttgggggcaccatggaccaaagtgggatggagattcctgtgaccctcatcattaaagcaccgaatcagaaatacagtgaccagactattagctgcttcttgaactggaccgtggggaaactaaaaacgcatctatctaacgtttaccctagcaaaccattgacgaaggatcagagattggtgtattcgggcagactgcttcccgatcatctgcagctgaaagacattctcagaaaacaagatgagtatcatatggttcatctagtatgtacttctcggactcctcccagttctccaaaatccagcaccaatagagaaagtcatgaagcattggcatccagcagcaattctagttcagatcattcaggatcaacaactccatcatctggtcaagaaaccttgtctttagctgtgggttcttcctcagaaggattgaggcagcgtacccttccacaagcacaaactgaccaagcacagagtcaccagtttccatatgtaatgcaaggaaatgtagacaaccaatttcctgggcaagctgctccacctggattcccagtgtatcccgcgtttagcccactgcagatgctatggtggcaacagatgtatgctcatcagtattatatgcagtaacaccaagctggatggtttccttttaggcaagaaggaggtcatcagcaggctcccaacaataatgccgaagttaacaatgatgggcaaaatgcaaacaacttggaacttgaagaaatggagcgtcttatggatgatgggcttgaagatgagagtggagaagatggaggtgaagatgccagtgcaattcaaaggcctggattaatggcttcagcttggtctttcatcaccaccttctttacttcactaataccagaggggcctccccaggttgccaattgacctgaaaaactgtgccagctacaaggagggtctgacttcaggaaagtggtttaaataacagtgcaatttcaaaaaaatttataactttcttttgatcatcatgtacagaggtgttttttttctttaggcttctcatgcatatgaatattttaagcacgaatggactactaaatatctgagttttttttttttttttttaaagatcctaacagaacatagcgtaacaatattggtcttccaggtgttactcatttcaattatgtgtagtataccaggacagacctattttcatgtcttatttctttaaagagctgcttcattggccgggcgccatggctcacgtctgtaatcccagcactttgggaggccgaggcgggtgggttacttgaggtcaggagttcgagaccagcctggcaaacatggcgaaaccccatcttaactaaaaatacaaaaaaattagccgggtgtggtgtcacgcgcctgtaatcccagctacttggggggctcaggcaggagaattgcctgaacccaggaggcggaggttgcagtgagctgagattgggccactgcactccaccctgggcgacagagtgagactcggtctcagaaaaaaaaaaaaaagagctgcttcacatataaatgtctatagctagtagcctggccctttaatgtttaatttgaatagatatatctgttttccgtgaattatcttgaaagttttaaacagaatgacctcatagtttttaataaagaatattatttacctaaaatgtgctagtagcatcttgcccagccataaagcaataaacttctcaataatcttaattttgatatttgaataaataatggaaactttctgtattaagggcatgtatcccatcaattggaatcagtaccttaacagaaaaaggcagctcttcaatggaattaacgtgatataaaatgtttgatataggcagtacttttataaaaaaagataagctggaaattgctccgtgtaattttttaaataaaaagtcaattatggtaaaaaaaaaa

SEQ ID NO: 342940 - DNA, 1965 bp, Homo sapiens
ggtttggacatctcattagctgttaaggtaatttattgaaagagagaggagtggttaacatggctgctctcacgtcttttgccttcccctgtcatcttacaatagcaggctgagagaacatcctttcctgtgcgacatctaccatcaaccttggctccacttttccattggaatttgtgcttacctaagaaatgtggtgcaggagttgggatattccatattaggtttatgaaaaatacatatagctccccaagaagtttaaaaaaatatggtatggtaaagtttttttttctttttaatatttattttggtgactatttcagtcaagctgcagtttcagctcaggccacatcaaatgtcaacccaacccagcctactacttcacagcctctaaatttggcacatgttcctggagaagaacccccaccagctccaaacctagtggcccaagaaaatcgacccatgaatgagaatgttcaaatgaatgcacagggaggtccagtactaaatgaagaagacttcaatcgagactggctagactggatgtacacgttctcacgagctgcgattctccttagcattgtatacttctattcttcttttagtcggtttatcatggtaatgggagccatgctactggtttatttacaccaagctggatggtttccttttaggcaagaaggaggtcatcagcaggctcccaacaataatgccgaagttaacaatgatgggcaaaatgcaaacaacttggaacttgaagaaatggagcgtcttatggatgatgggcttgaagatgagagtggagaagatggaggtgaagatgccagtgcaattcaaaggcctggattaatggcttcagcttggtctttcatcaccaccttctttacttcactaataccagaggggcctccccaggttgccaattgacctgaaaaactgtgccagctacaaggagggtctgacttcaggaaagtggtttaaataacagtgcaatttcaaaaaaatttataactttcttttgatcatcatgtacagaggtgttttttttctttaggcttctcatgcatatgaatattttaagcacgaatggactactaaatatctgagttttttttttttttttttaaagatcctaacagaacatagcgtaacaatattggtcttccaggtgttactcatttcaattatgtgtagtataccaggacagacctattttcatgtcttatttctttaaagagctgcttcattggccgggcgccatggctcacgtctgtaatcccagcactttgggaggccgaggcgggtgggttacttgaggtcaggagttcgagaccagcctggcaaacatggcgaaaccccatcttaactaaaaatacaaaaaaattagccgggtgtggtgtcacgcgcctgtaatcccagctacttggggggctcaggcaggagaattgcctgaacccaggaggcggaggttgcagtgagctgagattgggccactgcactccaccctgggcgacagagtgagactcggtctcagaaaaaaaaaaaaaagagctgcttcacatataaatgtctatagctagtagcctggccctttaatgtttaatttgaatagatatatctgttttccgtgaattatcttgaaagttttaaacagaatgacctcatagtttttaataaagaatattatttacctaaaatgtgctagtagcatcttgcccagccataaagcaataaacttctcaataatcttaattttgatatttgaataaataatggaaactttctgtattaagggcatgtatcccatcaattggaatcagtaccttaacagaaaaaggcagctcttcaatggaattaacgtgatataaaatgtttgatataggcagtacttttataaaaaaagataagctggaaattgctccgtgtaattttttaaataaaaagtcaattatggtaaaaaaaaaa

SEQ ID NO: 342941 - DNA, 1504 bp, Homo sapiens
ggttggttttcttttgctgtcgttgctttgaaaagggtagttccctgtcctgaagtgggagatttggtctttttatttattatagttttaatcatttttctcttataggacactaataacattttatagtgttacaaataaaaacaactgtgacttattttattttctctttattttactgaacagacaccaagctggatggtttccttttaggcaagaaggaggtcatcagcaggctcccaacaataatgccgaagttaacaatgatgggcaaaatgcaaacaacttggaacttgaagaaatggagcgtcttatggatgatgggcttgaagatgagagtggagaagatggaggtgaagatgccagtgcaattcaaaggcctggattaatggcttcagcttggtctttcatcaccaccttctttacttcactaataccagaggggcctccccaggttgccaattgacctgaaaaactgtgccagctacaaggagggtctgacttcaggaaagtggtttaaataacagtgcaatttcaaaaaaatttataactttcttttgatcatcatgtacagaggtgttttttttctttaggcttctcatgcatatgaatattttaagcacgaatggactactaaatatctgagttttttttttttttttttaaagatcctaacagaacatagcgtaacaatattggtcttccaggtgttactcatttcaattatgtgtagtataccaggacagacctattttcatgtcttatttctttaaagagctgcttcattggccgggcgccatggctcacgtctgtaatcccagcactttgggaggccgaggcgggtgggttacttgaggtcaggagttcgagaccagcctggcaaacatggcgaaaccccatcttaactaaaaatacaaaaaaattagccgggtgtggtgtcacgcgcctgtaatcccagctacttggggggctcaggcaggagaattgcctgaacccaggaggcggaggttgcagtgagctgagattgggccactgcactccaccctgggcgacagagtgagactcggtctcagaaaaaaaaaaaaaagagctgcttcacatataaatgtctatagctagtagcctggccctttaatgtttaatttgaatagatatatctgttttccgtgaattatcttgaaagttttaaacagaatgacctcatagtttttaataaagaatattatttacctaaaatgtgctagtagcatcttgcccagccataaagcaataaacttctcaataatcttaattttgatatttgaataaataatggaaactttctgtattaagggcatgtatcccatcaattggaatcagtaccttaacagaaaaaggcagctcttcaatggaattaacgtgatataaaatgtttgatataggcagtacttttataaaaaaagataagctggaaattgctccgtgtaattttttaaataaaaagtcaattatggtaaaaaaaaaa

SEQ ID NO: 342942 - DNA, 3206 bp, Homo sapiens
agtagagatggggtttcaccatgttggccaggctggtcttgaattcctgacctcaggtgatccacctgcctcagcctcccaaagtgttgggattacaggtgtgagccatcgcacccagctggggctatctttagtagcagatggtaactgagctgggcaattgttctttgacatttccagttcttatctgttaacatggacagtgatttaaataggcagctgcatggacggcctctccctaactgctgctatcttgtatctcctcattggtaattatttttcctagcccaaattccacgtcaaacactatcaatattctggggaccaccctttcatacactgctctgtacacatacctgtttatacatattttaacaaaagtggaatatttacatactgttgttatcatagccaagctcaacagcatcaaaagcatttttaggtacttaattcaagtggctgtaaaatttaaaaaaaatcattttttctgatactatatcatctttgtacccgtatatttcaatttcttgaatgttcattacaattttatttttactttttattctttcttgagacagagtctcactctatcacccaggctggagtgcatggtatggtctcagctcactgcaacctctaccttctgggttcaagcaatcctcccacctcagccttcagagtagctgggaacacaggcgtgcaccaccacgcccggcttatttttgaatttttttgtagagacggggtttctccgtgttgcccagtctggtcttaaagtcctgagctcaagcaatctgcctgcctcggcctcctgaagtgctgggattagaggcaagccactgcgcccagcctttattacaattttaaatgtttttctctgtgttagcgaacctttgatggactgttttaaagagtgttaaagagtgtttaaatcactgtgaaatgcacattctgtcttaatatttataattattagggtaccttcattaatagtgtacattgcatagtgccaaacgagatcaccacatcacttctaaaggattcctggaagtctgagtcacaagcatgagacaacagctgcaggactgggtggtgaaggttgtgaaaacttcctggcttaaacaggaatttgacccaaaacaagaagtcttagggaagatagcttagggcttgtctggtggcaccacaatgccatcaaatgcccagcctctttacagttttctgctctgccatccttggaatgcaggccattgttctcctgtttgttgtttcatgactgaactatgagtgctgtagctcttcacgttcctcctggaagacaggtgtagggcaaagatgagctctgattcgcagagcccttccatctatatgctttcttagaagcctcagcaataagttcaacattcaactcattggcttgaagtgtgtcaaatggctgccccttgcttcaaaggagtctgagaaaataactttagctagaattaaagttccattagagtgcctgggtagacaaagaagagtcagctacagaaggccagtatcatagcaagttgttgctccatgactggaaacaaagaagacttcactctttacttcagatgcgcagttgatagagtacagctaagatatggtacgtgttctaccatgaagagcaagagcaagctcctggcaccgtgctttgcagacagacgacgctcaacacattttgagcagaagcgtggttcagcaccaggaaggacaccaacttttgcagagacgactcttgggatggagaaagacttcccaaatcttcagggtgcggtcaagacaggcttcctttctcctcacgacggcctccacagtccggagcccggcggagcccggacctggcggggagagctgcctccacggccgggcacccagaccccaccgtcgcagtcgccaccacctcagtccatccttggtaccggcaatgggcttcgtatcctccagtgcacttgtaactgacttggacacggaatactaagaactcacttctgtcctcatcccagtcgcgccggcggtgaccatctcggctcttttgggcttaactgccgctcctctggactctgtctgactttgggggcaccatggaccaaagtgggatggagattcctgtgaccctcatcattaaagcaccgaatcagaaatacagtgaccagactattagctgcttcttgaactggaccgtggggaaactaaaaacgcatctatctaacgtttaccctagcaaaccattgacgaaggatcagagattggtgtattcgggcagactgcttcccgatcatctgcagctgaaagacattctcagaaaacaagatgagtatcatatggttcatctagtatgtacttctcggactcctcccagttctccaaaatccagcaccaatagagaaagtcatgaagcattggcatccagcagcaattctagttcagatcattcaggatcaacaactccatcatctggtcaagaaaccttgtctttagctgtgggttcttcctcagaaggattgaggcagcgtacccttccacaagcacaaactgaccaagcacagagtcaccagtttccatatgtaatgcaaggaaatgtagacaaccaatttcctgggcaagctgctccacctggattcccagtgtatcccgcgtttagcccactgcagatgctatggtggcaacagatgtatgctcatcagtattatatgcagtatcaagctgcagtttcagctcaggccacatcaaatgtcaacccaacccagcctactacttcacagcctctaaatttggcacatgttcctggagaagaacccccaccagctccaaacctagtggcccaagaaaatcgacccatgaatgagaatgttcaaatgaatgcacagggaggtccagtactaaatgaagaagacttcaatcgagactggctagactggatgtacacgttctcacgagctgcgattctccttagcattgtatacttctattcttcttttagtcggtttatcatggtaatgggagccatgctactggtttatttacagacggcggtcagcagtggggctcccaacggtaaggaccgaggtcatcagcgaggcgcccaaatgtaatgccgtaggaaccagagaaaggggagcggcttatggatggtgagcgtaacagctggggggtcctctagattataactgtaggcgtgg

SEQ ID NO: 342943 - DNA, 2790 bp, Homo sapiens
tctcgtccccgccctcctgctacctgtagtcgcctgggccgcccccggcccagccctgccttgccgccaccctgcgctgtccagactgaggggtcaggcggagagccgggccgcgcccttcggtcagcttctctccctttcacccgcgcctcctcgcgagacccggggctgggccgtgcccgtcgccgcgcagcaggaagggagcggctgccacggaaaacgcctggccggacgcttcctttctcctcacgacggcctccacagtccggagcccggcggagcccggacctggcggggagagctgcctccacggccgggcacccagaccccaccgtcgcagtcgccaccacctcagtccatccttggtaccggcaatgggcttcgtatcctccagtgcacttgtaactgacttggacacggaatactaagaactcacttctgtcctcatcccagtcgcgccggcggtgaccatctcggctcttttgggcttaactgccgctcctctggactctgtctgactttgggggcaccatggaccaaagtgggatggagattcctgtgaccctcatcattaaagcaccgaatcagaaatacagtgaccagactattagctgcttcttgaactggaccgtggggaaactaaaaacgcatctatctaacgtttaccctagcaaaccattgacgaaggatcagagattggtgtattcgggcagactgcttcccgatcatctgcagctgaaagacattctcagaaaacaagatgagtatcatatggttcatctagtatgtacttctcggactcctcccagttctccaaaatccagcaccaatagagaaagtcatgaagcattggcatccagcagcaattctagttcagatcattcaggatcaacaactccatcatctggtcaagaaaccttgtctttagctgtgggttcttcctcagaaggattgaggcagcgtacccttccacaagcacaaactgaccaagcacagagtcaccagtttccatatgtaatgcaaggaaatgtagacaaccaatttcctgggcaagctgctccacctggattcccagtgtatcccgcgtttagcccactgcagatgctatggtggcaacagatgtatgctcatcagtattatatgcagtatcaagctgcagtttcagctcaggccacatcaaatgtcaacccaacccagcctactacttcacagcctctaaatttggcacatgttcctggagaagaacccccaccagctccaaacctagtggcccaagaaaatcgacccatgaatgagaatgttcaaatgaatgcacagggaggtccagtactaaatgaagaagacttcaatcgagactggctagactggatgtacacgttctcacgagctgcgattctccttagcattgtatacttctattcttcttttagtcggtttatcatggtaatgggagccatgctactggtttatttacaccaagctggatggtttccttttaggcaagaaggaggtcatcagcaggctcccaacaataatgccgaagttaacaatgatgggcaaaatgcaaacaacttggaacttgaagaaatggagcgtcttatggatgatgggcttgaagatgagagtggagaagatggaggtgaagatgccagtgcaattcaaaggcctggattaatggcttcagcttggtctttcatcaccaccttctttacttcactaataccagaggggcctccccaggttgccaattgacctgaaaaactgtgccagctacaaggagggtctgacttcaggaaagtggtttaaataacagtgcaatttcaaaaaaatttataactttcttttgatcatcatgtacagaggtgttttttttctttaggcttctcatgcatatgaatattttaagcacgaatggactactaaatatctgagttttttttttttttttttaaagatcctaacagaacatagcgtaacaatattggtcttccaggtgttactcatttcaattatgtgtagtataccaggacagacctattttcatgtcttatttctttaaagagctgcttcattggccgggcgccatggctcacgtctgtaatcccagcactttgggaggccgaggcgggtgggttacttgaggtcaggagttcgagaccagcctggcaaacatggcgaaaccccatcttaactaaaaatacaaaaaaattagccgggtgtggtgtcacgcgcctgtaatcccagctacttggggggctcaggcaggagaattgcctgaacccaggaggcggaggttgcagtgagctgagattgggccactgcactccaccctgggcgacagagtgagactcggtctcagaaaaaaaaaaaaaagagctgcttcacatataaatgtctatagctagtagcctggccctttaatgtttaatttgaatagatatatctgttttccgtgaattatcttgaaagttttaaacagaatgacctcatagtttttaataaagaatattatttacctaaaatgtgctagtagcatcttgcccagccataaagcaataaacttctcaataatcttaattttgatatttgaataaataatggaaactttctgtattaagggcatgtatcccatcaattggaatcagtaccttaacagaaaaaggcagctcttcaatggaattaacgtgatataaaatgtttgatataggcagtacttttataaaaaaagataagctggaaattgctccgtgtaattttttaaataaaaagtcaattatggtaaaaaaaaaa

SEQ ID NO: 342944 - DNA, 2855 bp, Homo sapiens
tctcgtccccgccctcctgctacctgtagtcgcctgggccgcccccggcccagccctgccttgccgccaccctgcgctgtccagactgaggggtcaggcggagagccgggccgcgcccttcggtcagcttctctccctttcacccgcgcctcctcgcgagacccggggctgggccgtgcccgtcgccgcgcagcaggaagggagcggctgccacggaaaacgcctggccggacggtgtggctggcggccctgcctgggcgcggagggcggcggtggcgggccccgcggccttctctcagcttcctttctcctcacgacggcctccacagtccggagcccggcggagcccggacctggcggggagagctgcctccacggccgggcacccagaccccaccgtcgcagtcgccaccacctcagtccatccttggtaccggcaatgggcttcgtatcctccagtgcacttgtaactgacttggacacggaatactaagaactcacttctgtcctcatcccagtcgcgccggcggtgaccatctcggctcttttgggcttaactgccgctcctctggactctgtctgactttgggggcaccatggaccaaagtgggatggagattcctgtgaccctcatcattaaagcaccgaatcagaaatacagtgaccagactattagctgcttcttgaactggaccgtggggaaactaaaaacgcatctatctaacgtttaccctagcaaaccattgacgaaggatcagagattggtgtattcgggcagactgcttcccgatcatctgcagctgaaagacattctcagaaaacaagatgagtatcatatggttcatctagtatgtacttctcggactcctcccagttctccaaaatccagcaccaatagagaaagtcatgaagcattggcatccagcagcaattctagttcagatcattcaggatcaacaactccatcatctggtcaagaaaccttgtctttagctgtgggttcttcctcagaaggattgaggcagcgtacccttccacaagcacaaactgaccaagcacagagtcaccagtttccatatgtaatgcaaggaaatgtagacaaccaatttcctgggcaagctgctccacctggattcccagtgtatcccgcgtttagcccactgcagatgctatggtggcaacagatgtatgctcatcagtattatatgcagtatcaagctgcagtttcagctcaggccacatcaaatgtcaacccaacccagcctactacttcacagcctctaaatttggcacatgttcctggagaagaacccccaccagctccaaacctagtggcccaagaaaatcgacccatgaatgagaatgttcaaatgaatgcacagggaggtccagtactaaatgaagaagacttcaatcgagactggctagactggatgtacacgttctcacgagctgcgattctccttagcattgtatacttctattcttcttttagtcggtttatcatggtaatgggagccatgctactggtttatttacaccaagctggatggtttccttttaggcaagaaggaggtcatcagcaggctcccaacaataatgccgaagttaacaatgatgggcaaaatgcaaacaacttggaacttgaagaaatggagcgtcttatggatgatgggcttgaagatgagagtggagaagatggaggtgaagatgccagtgcaattcaaaggcctggattaatggcttcagcttggtctttcatcaccaccttctttacttcactaataccagaggggcctccccaggttgccaattgacctgaaaaactgtgccagctacaaggagggtctgacttcaggaaagtggtttaaataacagtgcaatttcaaaaaaatttataactttcttttgatcatcatgtacagaggtgttttttttctttaggcttctcatgcatatgaatattttaagcacgaatggactactaaatatctgagttttttttttttttttttaaagatcctaacagaacatagcgtaacaatattggtcttccaggtgttactcatttcaattatgtgtagtataccaggacagacctattttcatgtcttatttctttaaagagctgcttcattggccgggcgccatggctcacgtctgtaatcccagcactttgggaggccgaggcgggtgggttacttgaggtcaggagttcgagaccagcctggcaaacatggcgaaaccccatcttaactaaaaatacaaaaaaattagccgggtgtggtgtcacgcgcctgtaatcccagctacttggggggctcaggcaggagaattgcctgaacccaggaggcggaggttgcagtgagctgagattgggccactgcactccaccctgggcgacagagtgagactcggtctcagaaaaaaaaaaaaaagagctgcttcacatataaatgtctatagctagtagcctggccctttaatgtttaatttgaatagatatatctgttttccgtgaattatcttgaaagttttaaacagaatgacctcatagtttttaataaagaatattatttacctaaaatgtgctagtagcatcttgcccagccataaagcaataaacttctcaataatcttaattttgatatttgaataaataatggaaactttctgtattaagggcatgtatcccatcaattggaatcagtaccttaacagaaaaaggcagctcttcaatggaattaacgtgatataaaatgtttgatataggcagtacttttataaaaaaagataagctggaaattgctccgtgtaattttttaaataaaaagtcaattatggtaaaaaaaaaa

SEQ ID NO: 342945 - DNA, 2633 bp, Homo sapiens
tctcgtccccgccctcctgctacctgtagtcgcctgggccgcccccggcccagccctgccttgccgccaccctgcgctgtccagactgaggggtcaggcggagagccgggccgcgcccttcggtcagcttctctccctttcacccgcgcctcctcgcgagacccggggctgggccgtgcccgtcgccgcgcagcaggaagggagcggctgccacggaaaacgcctggccggacggtgtggctggcggccctgcctgggcgcggagggcggcggtggcgggccccgcggccttctctcagtccggagcccggcggagcccggacctggcggggagagctgcctccacggccgggcacccagaccccaccgtcgcagtcgccaccacctcagtccatccttggtaccggcaatgggcttcgtatcctccagtgcacttgtaactgacttggacacggaatactaagaactcacttctgtcctcatcccagtcgcgccggcggtgaccatctcggctcttttgggcttaactgccgctcctctggactctgtctgactttgggggcaccatggaccaaagtgggatggagattcctgtgaccctcatcattaaagcaccgaatcagaaatacagtgaccagactattagctgcttcttgaactggaccgtggggaaactaaaaacgcatctatctaacgtttaccctagcaaaccaagttcagatcattcaggatcaacaactccatcatctggtcaagaaaccttgtctttagctgtgggttcttcctcagaaggattgaggcagcgtacccttccacaagcacaaactgaccaagcacagagtcaccagtttccatatgtaatgcaaggaaatgtagacaaccaatttcctgggcaagctgctccacctggattcccagtgtatcccgcgtttagcccactgcagatgctatggtggcaacagatgtatgctcatcagtattatatgcagtatcaagctgcagtttcagctcaggccacatcaaatgtcaacccaacccagcctactacttcacagcctctaaatttggcacatgttcctggagaagaacccccaccagctccaaacctagtggcccaagaaaatcgacccatgaatgagaatgttcaaatgaatgcacagggaggtccagtactaaatgaagaagacttcaatcgagactggctagactggatgtacacgttctcacgagctgcgattctccttagcattgtatacttctattcttcttttagtcggtttatcatggtaatgggagccatgctactggtttatttacaccaagctggatggtttccttttaggcaagaaggaggtcatcagcaggctcccaacaataatgccgaagttaacaatgatgggcaaaatgcaaacaacttggaacttgaagaaatggagcgtcttatggatgatgggcttgaagatgagagtggagaagatggaggtgaagatgccagtgcaattcaaaggcctggattaatggcttcagcttggtctttcatcaccaccttctttacttcactaataccagaggggcctccccaggttgccaattgacctgaaaaactgtgccagctacaaggagggtctgacttcaggaaagtggtttaaataacagtgcaatttcaaaaaaatttataactttcttttgatcatcatgtacagaggtgttttttttctttaggcttctcatgcatatgaatattttaagcacgaatggactactaaatatctgagttttttttttttttttttaaagatcctaacagaacatagcgtaacaatattggtcttccaggtgttactcatttcaattatgtgtagtataccaggacagacctattttcatgtcttatttctttaaagagctgcttcattggccgggcgccatggctcacgtctgtaatcccagcactttgggaggccgaggcgggtgggttacttgaggtcaggagttcgagaccagcctggcaaacatggcgaaaccccatcttaactaaaaatacaaaaaaattagccgggtgtggtgtcacgcgcctgtaatcccagctacttggggggctcaggcaggagaattgcctgaacccaggaggcggaggttgcagtgagctgagattgggccactgcactccaccctgggcgacagagtgagactcggtctcagaaaaaaaaaaaaaagagctgcttcacatataaatgtctatagctagtagcctggccctttaatgtttaatttgaatagatatatctgttttccgtgaattatcttgaaagttttaaacagaatgacctcatagtttttaataaagaatattatttacctaaaatgtgctagtagcatcttgcccagccataaagcaataaacttctcaataatcttaattttgatatttgaataaataatggaaactttctgtattaagggcatgtatcccatcaattggaatcagtaccttaacagaaaaaggcagctcttcaatggaattaacgtgatataaaatgtttgatataggcagtacttttataaaaaaagataagctggaaattgctccgtgtaattttttaaataaaaagtcaattatggtaaaaaaaaaa

SEQ ID NO: 342946 - DNA, 3869 bp, Homo sapiens
agtagagatggggtttcaccatgttggccaggctggtcttgaattcctgacctcaggtgatccacctgcctcagcctcccaaagtgttgggattacaggtgtgagccatcgcacccagctggggctatctttagtagcagatggtaactgagctgggcaattgttctttgacatttccagttcttatctgttaacatggacagtgatttaaataggcagctgcatggacggcctctccctaactgctgctatcttgtatctcctcattggtaattatttttcctagcccaaattccacgtcaaacactatcaatattctggggaccaccctttcatacactgctctgtacacatacctgtttatacatattttaacaaaagtggaatatttacatactgttgttatcatagccaagctcaacagcatcaaaagcatttttaggtacttaattcaagtggctgtaaaatttaaaaaaaatcattttttctgatactatatcatctttgtacccgtatatttcaatttcttgaatgttcattacaattttatttttactttttattctttcttgagacagagtctcactctatcacccaggctggagtgcatggtatggtctcagctcactgcaacctctaccttctgggttcaagcaatcctcccacctcagccttcagagtagctgggaacacaggcgtgcaccaccacgcccggcttatttttgaatttttttgtagagacggggtttctccgtgttgcccagtctggtcttaaagtcctgagctcaagcaatctgcctgcctcggcctcctgaagtgctgggattagaggcaagccactgcgcccagcctttattacaattttaaatgtttttctctgtgttagcgaacctttgatggactgttttaaagagtgttaaagagtgtttaaatcactgtgaaatgcacattctgtcttaatatttataattattagggtaccttcattaatagtgtacattgcatagtgccaaacgagatcaccacatcacttctaaaggattcctggaagtctgagtcacaagcatgagacaacagctgcaggactgggtggtgaaggttgtgaaaacttcctggcttaaacaggaatttgacccaaaacaagaagtcttagggaagatagcttagggcttgtctggtggcaccacaatgccatcaaatgcccagcctctttacagttttctgctctgccatccttggaatgcaggccattgttctcctgtttgttgtttcatgactgaactatgagtgctgtagctcttcacgttcctcctggaagacaggtgtagggcaaagatgagctctgattcgcagagcccttccatctatatgctttcttagaagcctcagcaataagttcaacattcaactcattggcttgaagtgtgtcaaatggctgccccttgcttcaaaggagtctgagaaaataactttagctagaattaaagttccattagagtgcctgggtagacaaagaagagtcagctacagaaggccagtatcatagcaagttgttgctccatgactggaaacaaagaagacttcactctttacttcagatgcgcagttgatagagtacagctaagatatggtacgtgttctaccatgaagagcaagagcaagctcctggcaccgtgctttgcagacagacgacgctcaacacattttgagcagaagcgtggttcagcaccaggaaggacaccaacttttgcagagacgactcttgggatggagaaagacttcccaaatcttcagggtgcggtcaagacaggcttcctttctcctcacgacggcctccacagtccggagcccggcggagcccggacctggcggggagagctgcctccacggccgggcacccagaccccaccgtcgcagtcgccaccacctcagtccatccttggtaccggcaatgggcttcgtatcctccagtgcacttgtaactgacttggacacggaatactaagaactcacttctgtcctcatcccagtcgcgccggcggtgaccatctcggctcttttgggcttaactgccgctcctctggactctgtctgactttgggggcaccatggaccaaagtgggatggagattcctgtgaccctcatcattaaagcaccgaatcagaaatacagtgaccagactattagctgcttcttgaactggaccgtggggaaactaaaaacgcatctatctaacgtttaccctagcaaaccattgacgaaggatcagagattggtgtattcgggcagactgcttcccgatcatctgcagctgaaagacattctcagaaaacaagatgagtatcatatggttcatctagtatgtacttctcggactcctcccagttctccaaaatccagcaccaatagagaaagtcatgaagcattggcatccagcagcaattctagttcagatcattcaggatcaacaactccatcatctggtcaagaaaccttgtctttagctgtgggttcttcctcagaaggattgaggcagcgtacccttccacaagcacaaactgaccaagcacagagtcaccagtttccatatgtaatgcaaggaaatgtagacaaccaatttcctgggcaagctgctccacctggattcccagtgtatcccgcgtttagcccactgcagatgctatggtggcaacagatgtatgctcatcagtattatatgcagtatcaagctgcagtttcagctcaggccacatcaaatgtcaacccaacccagcctactacttcacagcctctaaatttggcacatgttcctggagaagaacccccaccagctccaaacctagtggcccaagaaaatcgacccatgaatgagaatgttcaaatgaatgcacagggaggtccagtactaaatgaagaagacttcaatcgagactggctagactggatgtacacgttctcacgagctgcgattctccttagcattgtatacttctattcttcttttagtcggtttatcatggtaatgggagccatgctactggtttatttacaccaagctggatggtttccttttaggcaagaaggaggtcatcagcaggctcccaacaataatgccgaagttaacaatgatgggcaaaatgcaaacaacttggaacttgaagaaatggagcgtcttatggatgatgggcttgaagatgagagtggagaagatggaggtgaagatgccagtgcaattcaaaggcctggattaatggcttcagcttggtctttcatcaccaccttctttacttcactaataccagaggggcctccccaggttgccaattgacctgaaaaactgtgccagctacaaggagggtctgacttcaggaaagtggtttaaataacagtgcaatttcaaaaaaatttataactttcttttgatcatcatgtacagaggtgttttttttctttaggcttctcatgcatatgaatattttaagcacgaatggactactaaatatctgagttttttttttttttttttaaagatcctaacagaacatagcgtaacaatattggtcttccaggtgttactcatttcaattatgtgtagtataccaggacagacctattttcatgtcttatttctttaaagagctgcttcattggccgggcgccatggctcacgtctgtaatcccaaagtgctgcaattacaggcatgagccactatgcccagccacattcttaaccttaaagggctctgaatatggagatagaacactggagtcgaagtcccagccccctctgtcgctctctctgaagctcagtgactactccagtattaaatgatgcatgtataaagttagtcactctatcattatctgt

SEQ ID NO: 342947 - DNA, 209 bp, Homo sapiens
cctgggcgacagagtgagactcttgtctcggagaaaaaaaaaattaaaaataaataaataaataataaaaattcgagaggtttgatttctgcttctggtttcagaggaaggaaaatcacttaggcaatgggcccctggggaacagaatagctcctaaatcccgggtgtgctgtcctctgtgggctgagtgtctgtgcagcgggaagaag

SEQ ID NO: 342948 - DNA, 752 bp, Homo sapiens
gagaactgcatcatgaaggagaaacttggatttgtgattcaggcaagtccaggttcaaatcctggctctgcaatttaccagctgcagaaacttggatatttagaacagatgaagatgatcccaaataaggatatttggtgtccctgaagtagagaactcaaaactatggaatagaaagagtgaagatgaccagacaactttctttcagctttaagtcagcctcctctccctcttcaaagcccctcttctaggacagaagaggccatcagggactaacaataaatgcctcacaccctccagcggacatctgcatttctgaacattccagaccaaggttataccaaagaacagccctcttagtggcattttattctatcaggccaagataaagttttcctaaaactggctttttagtaaaagttcacatgataaatacacattcattatactattgttatccttatgcttttgtgtgtatttgaaattttccaaaataaaaaaaaatttttttaagtaacagctggctgggcataatggctcacacatgtaatcccagcactttgagaggctgaggcaggaggatcacttgaggccagaagtttaagaccaacccaggcaacatagtgagaccccctaatctacaaaaaattttaaaacagccaagcatagtggcatacatctgtagtcccagctactgaggaggatgaggtgataggactgcttgagcccaggagttctaggctgcagtgagc

SEQ ID NO: 342949 - DNA, 772 bp, Homo sapiens
gagaactgcatcatgaaggagaaacttggatttgtgattcaggcaagtccaggttcaaatcctggctctgcaatttaccagctgcagaaacttggggatgaagagcatctgtccccacctccctttctcctcagggacctgcctgtctacacagtgaagaggccttgttatgcttggcagtaaaggcgctgatgtgcaggtgaagatgaccagacaactttctttcagctttaagtcagcctcctctccctcttcaaagcccctcttctaggacagaagaggccatcagggactaacaataaatgcctcacaccctccagcggacatctgcatttctgaacattccagaccaaggttataccaaagaacagccctcttagtggcattttattctatcaggccaagataaagttttcctaaaactggctttttagtaaaagttcacatgataaatacacattcattatactattgttatccttatgcttttgtgtgtatttgaaattttccaaaataaaaaaaaatttttttaagtaacagctggctgggcataatggctcacacatgtaatcccagcactttgagaggctgaggcaggaggatcacttgaggccagaagtttaagaccaacccaggcaacatagtgagaccccctaatctacaaaaaattttaaaacagccaagcatagtggcatacatctgtagtcccagctactgaggaggatgaggtgataggactgcttgagcccaggagttctaggctgcagtgagc

SEQ ID NO: 342950 - DNA, 1761 bp, Homo sapiens
gtgtggggctggactctgaggcggccagaggcctaggaacgttatcctgggcacaccgtgcgtggtgtgcagtctgagtcatgctccctgggtagggcatccagctcccagcctgggagtgctgagagccaaatccaccgtagagcaggggtgagagtcagggtcccacctcctctatctgccggcaatccagtggtgacctagggtaaaagcttgagagtcccatacacacggtcatcccacgacatacctcacaggccaggcagggacacacagcccccttccctccctcccaggtaccgtcatagctgctagtgtgactgaaggcagtgtccctggccccagctgaagcaccgtagccagccagcgggctcacgcaccttggcctgttgctcctagggtcacttgtgccattcagccaaggggacgaccgtgcctgctggcccagctgagctccgcccagtgagcccaccccccattctcctgccactgactctcgctcttctgcttttcccagcaggaagggcccagcctcacctacgagacctgcagccccccgaccagctgaggctcccctcttagacttataagtctatggccactggcatccggctgcctgccctccctgcctcccccagggtcccttcagagggtcctgggttttctgaacacccagaggggcctccggcgctccctccagccatcccttttagtttcaccctcctggttcaagcagtgttctttctctatcaggcctggtggctgttgcatggggctccccaaggcaaggggtggccccaggccagtgggttggaagacagggtgaccagagaagagggaagcccgagggggccgagcatcagcctgaattgcgggtgccctgcctgggtgccgtgtgagaggccagcgtgtgtggggtggggagggccgccacagcccccaggcgctatctgtgaagctacggctcctccctccatcttcctcccctttcccttccagccccttttccaggaaccttgccacacccacacctgcagcctcccctccccggccctcccaccactgctgcggcgcggccggccccggccgtgtgctgcgcttgccttaccagctctctcctcgcttttctctcccgttttctctctgctttctctccaactgccagccgatcgggtcaggcaagtccatcccgtcctgagagccccaggccccccttcgacctctaaacagatccctcctcttctcggagacctccctttccaagcctgcctggacggctgttctgtgacttgacagtggctcccccagccccaaagccagcccccttcatctgtgacttaatctgttgtagtggtgagctgatacattcaggtgtgaccgttggtgaaaacttgtgccccttctgtggtatgcccttgccctgttctataaatatctataaatactcatatatatacacacctacacatggccaaccgcctcgcctctagcgctgggaatcagtcactgtgctatccttgtggagtcttgtggcccaactaccagagaacgctgtcccccgacatcccactccaaagtgtgccacctccagtgagcctccttgtcatgcccggcctgtggacagccagcccccgccatccctcccaccccctaccaagcatgggggtgctgtgcaggcagccgtgtggcctgacagtttctaccagtcctgctgtccctcggctgagaataaaacccatttctggatgatggggaatgtca

SEQ ID NO: 342951 - DNA, 479 bp, Homo sapiens
  misc_feature (340)..(340): n is a, c, g, or t
ggagaaatgacagctggactttagcgagcaagccctatctccatgagcagcacgggtgatcctctaagcacaccaggcacgagtgtgcagggagctggtgcaaatgcctctgtgtgcgggtgagcttctgtgttgtgactctgcccacacgtgtgcttcagtgtgctgagtggctgcatgccccagatccatgctgcacgcgccgccggccagtgagggtgctgggcactgggaggtggcggggaaggaggcgtatgcgtgttgtttgtgggcatgtgtgttagcgtgtgcatgtgggccatggggcttcacagcatatgtgtgcacgcccgggctttgncgtgtgtgtgtcccccacccccaggccggccccacccgtgcgtgtgaactgccatgttgattttcgtgctgtctttcagaatcactatcagtgacccctgaggagcgtcagccatggccggtacatgcctcaccgcctg

SEQ ID NO: 342952 - DNA, 565 bp, Homo sapiens
gggggaggacaaagactacaagttagggtggggagcaggtggcaagatctgctggtcacatcgtgggacacagtggactcaattccaaagacagtgacaagaccctgtggggatcctcgcctgatcaggaaggggattctggtcatccgcaagggctggctgactatcaataatattggcatcatgaaagggggctccaaggagtactggtttgtgctgactgctgagaatctgtcctggtacaaggatgatgaggagaaagagaagaaatacatgctgtctgtggacaacctcaagctgcgggacgtggagaagggctttatgtcgagcaagcatatctttgccctctttaacacggagcagagggtggtggcagtactagtcctcttccttcctgacccaaggctgactctagtgggccctctgctactcggagatgagagttcagtccagcggccatcagaggggtccttagagagccacggagaaagctggtgggatctgggccccaagctagagacttcactgactatggttgtcctcttgtcaaaggtccagtcccctt

SEQ ID NO: 342953 - DNA, 3281 bp, Homo sapiens
cgggggccccgcggcgcaggcagtctgggcgcgcggctgcagcggcggagccggaagtcggagccgggagcgctagcggcagccggatcgcagcctgcggggcccgccgcagccatgggcaaccgcggcatggaagatctcatcccgctggtcaaccggctgcaagacgccttctctgccatcggccagaacgcggacctcgacctgccgcagatcgctgtggtgggcggccagagcgccggcaagagctcggtgctcgagaatttcgtaggcagggacttcttgcctcgaggatctggcattgtcacccgacgtcccctggtcttgcagctggtcaatgcaaccacagaatatgccgagttcctgcactgcaagggaaagaaattcaccgacttcgaggaggtgcgccttgagatcgaggccgagaccgacagggtcaccggcaccaacaagggcatctcgccggtgcctatcaacctccgcgtctactcgccgcacgtgctgaacctgaccctggtggacctgcccggaatgaccaaggtcccggtgggggaccaacctcccgacatcgagttccagatccgagacatgcttatgcagtttgtcaccaaggagaactgcctcatcctggccgtgtcccccgccaactctgacctggccaattctgacgccctcaaggtcgccaaggaggtggacccccagggccagcgcaccatcggggtcatcaccaagctggacctgatggacgagggcacagatgcccgtgatgtgctggagaacaagctgctccccctgcgcagaggctacattggagtggtgaaccggagccagaaggacattgatggcaagaaggacattaccgccgccttggctgctgaacgaaagttcttcctctcccatccatcttatcgccacttggctgaccgtatgggcacgccctacctgcagaaggtcctcaatcagcaactgacgaaccacatccgggacacactgccggggctgcggaacaagctgcagagccagctactgtccattgagaaggaggtggaggaatacaagaacttccgccctgatgacccagctcgcaagaccaaggccctgctgcagatggtccagcagttcgccgtagactttgagaagcgcattgagggctcaggagatcagatcgacacctacgaactgtcagggggagcccgcattaaccgaatcttccacgagcgcttccctttcgagctggtcaagatggagtttgatgagaaggaactccgaagggagatcagctatgctatcaagaatatccatggcattagaacggggctgtttaccccagacatggcctttgagaccattgtgaaaaagcaggtgaagaagatccgagaaccgtgtctcaagtgtgtggacatggttatctcggagctaatcagcaccgttagacagtgcaccaagaagctccagcagtacccgcggctacgggaggagatggagcgcatcgtgaccacccacatccgggagcgcgagggccgcactaaggagcaggtcatgcttctcatcgatatcgagctggcttacatgaacaccaaccatgaggacttcataggctttgccaatgctcagcagaggagcaaccagatgaacaagaagaagacttcagggaaccaggatgagattctggtcatccgcaagggctggctgactatcaataatattggcatcatgaaagggggctccaaggagtactggtttgtgctgactgctgagaatctgtcctggtacaaggatgatgaggagaaagagaagaaatacatgctgtctgtggacaacctcaagctgcgggacgtggagaagggctttatgtcgagcaagcatatctttgccctctttaacacggagcagaggaatgtctacaaggattatcggcagctggagctagcctgtgagacacaggaggaggtggacagctggaaggcctccttcctgagggctggcgtgtaccctgagcgtgttggggacaaagagaaagccagcgagaccgaggagaatggctccgacagcttcatgcattccatggacccacagctggaacggcaagtggagaccatccggaatcttgtggactcatacatggccattgtcaacaagaccgtgagggacctcatgcccaagaccatcatgcacctcatgattaacaataccaaggagttcatcttctcggagctgctggccaacctgtactcgtgtggggaccagaacacgctgatggaggagtcggcggagcaggcacagcggcgcgacgagatgctgcgcatgtaccacgcactgaaggaggcgctcagcatcatcggcgacatcaacacgaccaccgtcagcacgcccatgcccccgcccgtggacgactcctggctgcaggtgcagagcgtaccggccggacgcaggtcgcccacgtccagccccacgccgcagcgccgagcccccgccgtgcccccagcccggcccgggtcgcggggccctgctcctgggcctccgcctgctgggtccgccctggggggggcgccccccgtgccctccaggccgggggcttcccctgaccctttcggccctccccctcaggtgccctcgcgccccaaccgcgccccgcccggggtccccagaatcactatcagtgacccctgaggagcgtcagccatgccgatcgggtcaggcaagtccatcccgtcctgagagccccaggccccccttcgacctctaaacagatccctcctcttctcggagacctccctttccaagcctgcctggacggctgttctgtgacttgacagtggctcccccagccccaaagccagcccccttcatctgtgacttaatctgttgtagtggtgagctgatacattcaggtgtgaccgttggtgaaaacttgtgccccttctgtggtatgcccttgccctgttctataaatatctataaatactcatatatatacacacctacacatggccaaccgcctcgcctctagcgctgggaatcagtcactgtgctatccttgtggagtcttgtggcccaactaccagagaacgctgtcccccgacatcccactccaaagtgtgccacctccagtgagcctccttgtcatgcccggcctgtggacagccagcccccgccatccctcccaccccctaccaagcatgggggtgctgtgcaggcagccgtgtggcctgacagtttctaccagtcctgctgtccctcggctgagaataaaacccatttctggatgatggggaatgtca

SEQ ID NO: 342954 - DNA, 3281 bp, Homo sapiens
cgggggccccgcggcgcaggcagtctgggcgcgcggctgcagcggcggagccggaagtcggagccgggagcgctagcggcagccggatcgcagcctgcggggcccgccgcagccatgggcaaccgcggcatggaagatctcatcccgctggtcaaccggctgcaagacgccttctctgccatcggccagaacgcggacctcgacctgccgcagatcgctgtggtgggcggccagagcgccggcaagagctcggtgctcgagaatttcgtaggcagggacttcttgcctcgaggatctggcattgtcacccgacgtcccctggtcttgcagctggtcaatgcaaccacagaatatgccgagttcctgcactgcaagggaaagaaattcaccgacttcgaggaggtgcgccttgagatcgaggccgagaccgacagggtcaccggcaccaacaagggcatctcgccggtgcctatcaacctccgcgtctactcgccgcacgtgctgaacctgaccctggtggacctgcccggaatgaccaaggtcccggtgggggaccaacctcccgacatcgagttccagatccgagacatgcttatgcagtttgtcaccaaggagaactgcctcatcctggccgtgtcccccgccaactctgacctggccaattctgacgccctcaaggtcgccaaggaggtggacccccagggccagcgcaccatcggggtcatcaccaagctggacctgatggacgagggcacagatgcccgtgatgtgctggagaacaagctgctccccctgcgcagaggctacattggagtggtgaaccggagccagaaggacattgatggcaagaaggacattaccgccgccttggctgctgaacgaaagttcttcctctcccatccatcttatcgccacttggctgaccgtatgggcacgccctacctgcagaaggtcctcaatcagcaactgacgaaccacatccgggacacactgccggggctgcggaacaagctgcagagccagctactgtccattgagaaggaggtggaggaatacaagaacttccgccctgatgacccagctcgcaagaccaaggccctgctgcagatggtccagcagttcgccgtagactttgagaagcgcattgagggctcaggagatcagatcgacacctacgaactgtcagggggagcccgcattaaccgaatcttccacgagcgcttccctttcgagctggtcaagatggagtttgatgagaaggaactccgaagggagatcagctatgctatcaagaatatccatggcattaggacgggcctcttcacacctgacctcgcttttgaagccacagtgaaaaagcaggtgcagaagctcaaagagcccagtatcaagtgtgtggatatggtagtcagtgagctcacagccaccatcagaaagtgtagcgaaaagctccagcagtacccgcggctacgggaggagatggagcgcatcgtgaccacccacatccgggagcgcgagggccgcactaaggagcaggtcatgcttctcatcgatatcgagctggcttacatgaacaccaaccatgaggacttcataggctttgccaatgctcagcagaggagcaaccagatgaacaagaagaagacttcagggaaccaggatgagattctggtcatccgcaagggctggctgactatcaataatattggcatcatgaaagggggctccaaggagtactggtttgtgctgactgctgagaatctgtcctggtacaaggatgatgaggagaaagagaagaaatacatgctgtctgtggacaacctcaagctgcgggacgtggagaagggctttatgtcgagcaagcatatctttgccctctttaacacggagcagaggaatgtctacaaggattatcggcagctggagctagcctgtgagacacaggaggaggtggacagctggaaggcctccttcctgagggctggcgtgtaccctgagcgtgttggggacaaagagaaagccagcgagaccgaggagaatggctccgacagcttcatgcattccatggacccacagctggaacggcaagtggagaccatccggaatcttgtggactcatacatggccattgtcaacaagaccgtgagggacctcatgcccaagaccatcatgcacctcatgattaacaataccaaggagttcatcttctcggagctgctggccaacctgtactcgtgtggggaccagaacacgctgatggaggagtcggcggagcaggcacagcggcgcgacgagatgctgcgcatgtaccacgcactgaaggaggcgctcagcatcatcggcgacatcaacacgaccaccgtcagcacgcccatgcccccgcccgtggacgactcctggctgcaggtgcagagcgtaccggccggacgcaggtcgcccacgtccagccccacgccgcagcgccgagcccccgccgtgcccccagcccggcccgggtcgcggggccctgctcctgggcctccgcctgctgggtccgccctggggggggcgccccccgtgccctccaggccgggggcttcccctgaccctttcggccctccccctcaggtgccctcgcgccccaaccgcgccccgcccggggtccccagaatcactatcagtgacccctgaggagcgtcagccatgccgatcgggtcaggcaagtccatcccgtcctgagagccccaggccccccttcgacctctaaacagatccctcctcttctcggagacctccctttccaagcctgcctggacggctgttctgtgacttgacagtggctcccccagccccaaagccagcccccttcatctgtgacttaatctgttgtagtggtgagctgatacattcaggtgtgaccgttggtgaaaacttgtgccccttctgtggtatgcccttgccctgttctataaatatctataaatactcatatatatacacacctacacatggccaaccgcctcgcctctagcgctgggaatcagtcactgtgctatccttgtggagtcttgtggcccaactaccagagaacgctgtcccccgacatcccactccaaagtgtgccacctccagtgagcctccttgtcatgcccggcctgtggacagccagcccccgccatccctcccaccccctaccaagcatgggggtgctgtgcaggcagccgtgtggcctgacagtttctaccagtcctgctgtccctcggctgagaataaaacccatttctggatgatggggaatgtca

SEQ ID NO: 342955 - DNA, 1445 bp, Homo sapiens
tgggccccgccgtaccagttgcgcaagcatatctttgccctctttaacacggagcagaggaatgtctacaaggattatcggcagctggagctagcctgtgagacacaggaggaggtggacagctggaaggcctccttcctgagggctggcgtgtaccctgagcgtgttggggacaaagagaaagccagcgagaccgaggagaatggctccgacagcttcatgcattccatggacccacagctggaacggcaagtggagaccatccggaatcttgtggactcatacatggccattgtcaacaagaccgtgagggacctcatgcccaagaccatcatgcacctcatgattaacaataccaaggagttcatcttctcggagctgctggccaacctgtactcgtgtggggaccagaacacgctgatggaggagtcggcggagcaggcacagcggcgcgacgagatgctgcgcatgtaccacgcactgaaggaggcgctcagcatcatcggcgacatcaacacgaccaccgtcagcacgcccatgcccccgcccgtggacgactcctggctgcaggtgcagagcgtaccggccggacgcaggtcgcccacgtccagccccacgccgcagcgccgagcccccgccgtgcccccagcccggcccgggtcgcggggccctgctcctgggcctccgcctgctgggtccgccctggggggggcgccccccgtgccctccaggccgggggcttcccctgaccctttcggccctccccctcaggtgccctcgcgccccaaccgcgccccgcccggggtccccagaatcactatcagtgacccctgaggagcgtcagccatgccgatcgggtcaggcaagtccatcccgtcctgagagccccaggccccccttcgacctctaaacagatccctcctcttctcggagacctccctttccaagcctgcctggacggctgttctgtgacttgacagtggctcccccagccccaaagccagcccccttcatctgtgacttaatctgttgtagtggtgagctgatacattcaggtgtgaccgttggtgaaaacttgtgccccttctgtggtatgcccttgccctgttctataaatatctataaatactcatatatatacacacctacacatggccaaccgcctcgcctctagcgctgggaatcagtcactgtgctatccttgtggagtcttgtggcccaactaccagagaacgctgtcccccgacatcccactccaaagtgtgccacctccagtgagcctccttgtcatgcccggcctgtggacagccagcccccgccatccctcccaccccctaccaagcatgggggtgctgtgcaggcagccgtgtggcctgacagtttctaccagtcctgctgtccctcggctgagaataaaacccatttctggatgatggggaatgtca

SEQ ID NO: 342956 - DNA, 2909 bp, Homo sapiens
  misc_feature (2422)..(2422): n is a, c, g, or t
cgggggccccgcggcgcaggcagtctgggcgcgcggctgcagcggcggagccggaagtcggagccgggagcgctagcggcagccggatcgcagcctgcggggcccgccgcagccatgggcaaccgcggcatggaagatctcatcccgctggtcaaccggctgcaagacgccttctctgccatcggccagaacgcggacctcgacctgccgcagatcgctgtggtgggcggccagagcgccggcaagagctcggtgctcgagaatttcgtaggcagggacttcttgcctcgaggatctggcattgtcacccgacgtcccctggtcttgcagctggtcaatgcaaccacagaatatgccgagttcctgcactgcaagggaaagaaattcaccgacttcgaggaggtgcgccttgagatcgaggccgagaccgacagggtcaccggcaccaacaagggcatctcgccggtgcctatcaacctccgcgtctactcgccgcacgtgctgaacctgaccctggtggacctgcccggaatgaccaaggtcccggtgggggaccaacctcccgacatcgagttccagatccgagacatgcttatgcagtttgtcaccaaggagaactgcctcatcctggccgtgtcccccgccaactctgacctggccaattctgacgccctcaaggtcgccaaggaggtggacccccagggccagcgcaccatcggggtcatcaccaagctggacctgatggacgagggcacagatgcccgtgatgtgctggagaacaagctgctccccctgcgcagaggctacattggagtggtgaaccggagccagaaggacattgatggcaagaaggacattaccgccgccttggctgctgaacgaaagttcttcctctcccatccatcttatcgccacttggctgaccgtatgggcacgccctacctgcagaaggtcctcaatcagcaactgacgaaccacatccgggacacactgccggggctgcggaacaagctgcagagccagctactgtccattgagaaggaggtggaggaatacaagaacttccgccctgatgacccagctcgcaagaccaaggccctgctgcagatggtccagcagttcgccgtagactttgagaagcgcattgagggctcaggagatcagatcgacacctacgaactgtcagggggagcccgcattaaccgaatcttccacgagcgcttccctttcgagctggtcaagatggagtttgatgagaaggaactccgaagggagatcagctatgctatcaagaatatccatggcattagaacggggctgtttaccccagacatggcctttgagaccattgtgaaaaagcaggtgaagaagatccgagaaccgtgtctcaagtgtgtggacatggttatctcggagctaatcagcaccgttagacagtgcaccaagaagctccagcagtacccgcggctacgggaggagatggagcgcatcgtgaccacccacatccgggagcgcgagggccgcactaaggagcaggtcatgcttctcatcgatatcgagctggcttacatgaacaccaaccatgaggacttcataggctttgccaatgctcagcagaggagcaaccagatgaacaagaagaagacttcagggaaccaggatgagattctggtcatccgcaagggctggctgactatcaataatattggcatcatgaaagggggctccaaggagtactggtttgtgctgactgctgagaatctgtcctggtacaaggatgatgaggagaaagagaagaaatacatgctgtctgtggacaacctcaagctgcgggacgtggagaagggctttatgtcgagcaagcatatctttgccctctttaacacggagcagaggaatgtctacaaggattatcggcagctggagctagcctgtgagacacaggaggaggtggacagctggaaggcctccttcctgagggctggcgtgtaccctgagcgtgttggggacaaagagaaagccagcgagaccgaggagaatggctccgacagcttcatgcattccatggacccacagctggaacggcaagtggagaccatccggaatcttgtggactcatacatggccattgtcaacaagaccgtgagggacctcatgcccaagaccatcatgcacctcatgattaacaataccaaggagttcatcttctcggagctgctggccaacctgtactcgtgtggggaccagaacacgctgatggaggagtcggcggagcaggcacagcggcgcgacgagatgctgcgcatgtaccacgcactgaaggaggcgctcagcatcatcggcgacatcaacacgaccaccgtcagcacgcccatgcccccgcccgtggacgactcctggctgcaggtcgcccacgtccagncccacgccgcagcgccgagcacagccgcacgtgcacacgcagaacacaggacaccggagtacgcggggaacctggaaaatccagggacacaatcgaacgaatgaagatccaaaccaagaggagaagagaaacaagacgaagacaacaacaagaacgagaagaatgacacaaaaaaaagacacgaacaaacaacaaaagaaagaaaagaaagaaaagaagcagacaaaaacaaaaagaaaaaaaaaacgaaaaacagacaaaaaaaaagctacacaagaaacaaacaaaagaaaagcaagaaaaaaacacaacaacagaaaaagtaacaaacagaaaacaaagacaaaaagacaggaaaaaacgagcgataagaaagaacaaagaaacaaaaacaacaagagacaacaaacacagcaaacgagacacaacacaccaacaaacaaaaaaaaaaaagcaccaagcgacaaaaacacaaaaacaaccaaca

SEQ ID NO: 342957 - DNA, 1052 bp, Homo sapiens
  misc_feature (340)..(340): n is a, c, g, or t
ggagaaatgacagctggactttagcgagcaagccctatctccatgagcagcacgggtgatcctctaagcacaccaggcacgagtgtgcagggagctggtgcaaatgcctctgtgtgcgggtgagcttctgtgttgtgactctgcccacacgtgtgcttcagtgtgctgagtggctgcatgccccagatccatgctgcacgcgccgccggccagtgagggtgctgggcactgggaggtggcggggaaggaggcgtatgcgtgttgtttgtgggcatgtgtgttagcgtgtgcatgtgggccatggggcttcacagcatatgtgtgcacgcccgggctttgncgtgtgtgtgtcccccacccccaggccggccccacccgtgcgtgtgaactgccatgttgattttcgtgctgtctttcagaatcactatcagtgacccctgaggagcgtcagccatgccgatcgggtcaggcaagtccatcccgtcctgagagccccaggccccccttcgacctctaaacagatccctcctcttctcggagacctccctttccaagcctgcctggacggctgttctgtgacttgacagtggctcccccagccccaaagccagcccccttcatctgtgacttaatctgttgtagtggtgagctgatacattcaggtgtgaccgttggtgaaaacttgtgccccttctgtggtatgcccttgccctgttctataaatatctataaatactcatatatatacacacctacacatggccaaccgcctcgcctctagcgctgggaatcagtcactgtgctatccttgtggagtcttgtggcccaactaccagagaacgctgtcccccgacatcccactccaaagtgtgccacctccagtgagcctccttgtcatgcccggcctgtggacagccagcccccgccatccctcccaccccctaccaagcatgggggtgctgtgcaggcagccgtgtggcctgacagtttctaccagtcctgctgtccctcggctgagaataaaacccatttctggatgatggggaatgtca

SEQ ID NO: 342958 - DNA, 2406 bp, Homo sapiens
cgggggccccgcggcgcaggcagtctgggcgcgcggctgcagcggcggagccggaagtcggagccgggagcgctagcggcagccggatcgcagcctgcggggcccgccgcagccatgggcaaccgcggcatggaagatctcatcccgctggtcaaccggctgcaagacgccttctctgccatcggccagaacgcggacctcgacctgccgcagatcgctgtggtgggcggccagagcgccggcaagagctcggtgctcgagaatttcgtaggcagggacttcttgcctcgaggatctggcattgtcacccgacgtcccctggtcttgcagctggtcaatgcaaccacagaatatgccgagttcctgcactgcaagggaaagaaattcaccgacttcgaggaggtgcgccttgagatcgaggccgagaccgacagggtcaccggcaccaacaagggcatctcgccggtgcctatcaacctccgcgtctactcgccgcacgtgctgaacctgaccctggtggacctgcccggaatgaccaaggtcccggtgggggaccaacctcccgacatcgagttccagatccgagacatgcttatgcagtttgtcaccaaggagaactgcctcatcctggccgtgtcccccgccaactctgacctggccaattctgacgccctcaaggtcgccaaggaggtggacccccagggccagcgcaccatcggggtcatcaccaagctggacctgatggacgagggcacagatgcccgtgatgtgctggagaacaagctgctccccctgcgcagaggctacattggagtggtgaaccggagccagaaggacattgatggcaagaaggacattaccgccgccttggctgctgaacgaaagttcttcctctcccatccatcttatcgccacttggctgaccgtatgggcacgccctacctgcagaaggtcctcaatcagcaactgacgaaccacatccgggacacactgccggggctgcggaacaagctgcagagccagctactgtccattgagaaggaggtggaggaatacaagaacttccgccctgatgacccagctcgcaagaccaaggccctgctgcagatggtccagcagttcgccgtagactttgagaagcgcattgagggctcaggagatcagatcgacacctacgaactgtcagggggagcccgcattaaccgaatcttccacgagcgcttccctttcgagctggtcaagatggagtttgatgagaaggaactccgaagggagatcagctatgctatcaagaatatccatggcattagaacggggctgtttaccccagacatggcctttgagaccattgtgaaaaagcaggtgaagaagatccgagaaccgtgtctcaagtgtgtggacatggttatctcggagctaatcagcaccgttagacagtgcaccaagaagctccagcagtacccgcggctacgggaggagatggagcgcatcgtgaccacccacatccgggagcgcgagggccgcactaaggagcaggtcatgcttctcatcgatatcgagctggcttacatgaacaccaaccatgaggacttcataggctttgccaatgctcagcagaggagcaaccagatgaacaagaagaagacttcagggaaccaggatgagattctggtcatccgcaagggctggctgactatcaataatattggcatcatgaaagggggctccaaggagtactggtttgtgctgactgctgagaatctgtcctggtacaaggatgatgaggagaaagagaagaaatacatgctgtctgtggacaacctcaagctgcgggacgtggagaagggctttatgtcgagcaagcatatctttgccctctttaacacggagcagaggaatgtctacaaggattatcggcagctggagctagcctgtgagacacaggaggaggtggacagctggaaggcctccttcctgagggctggcgtgtaccctgagcgtgttggggacaaagagaaagccagcgagaccgaggagaatggctccgacagcttcatgcattccatggacccacagctggaacggcaagtggagaccatccggaatcttgtggactcatacatggccattgtcaacaagaccgtgagggacctcatgcccaagaccatcatgcacctcatgattaacaataccaaggagttcatcttctcggagctgctggccaacctgtactcgtgtggggaccagaacacgctgatggaggagtcggcggagcaggcacagcggcgcgacgagatgctgcgcatgtaccacgcactgaaggaggcgctcagcatcatcggcgacatggtgtttcccgccgtcagcccaagcacccccaagcccgtgtcctggtcctggctgttt

SEQ ID NO: 342959 - DNA, 709 bp, Homo sapiens
ctgttctataaatatctataaatactcatatatatacattcaggtgtgaccgttggtgaaaacttgtgccccttctgtggtatgcccttgccctgttctataaatatctatatatactcatatatatacattcaggtgtgaccgttggtgaaaacttgtgccccttctgtggtatgcccttgccctgttctataaatatctataaatactcatatatatacattcaggtgtgaccgttggtgacaacttgtgccccttctgtgtatgcccttgccctgttctataaatatctataaatactcatatctgatacattcaggtgtgaccgttggtgaaaacttgtgccccttctgtggtatgcccttgccctgttctataaatatctataaatactcatatatatacacacctacacatggccaaccgcctcgcctctagcgctgggaatcagtcactgtgctatccttgtggagtcttgtggcccaactaccagagaacgctgtcccccgacatcccactccaaagtgtgccacctccagtgagcctccttgtcatgcccggcctgtggacagccagcccccgccatccctcccaccccctaccaagcatgggggtgctgtgcaggcagccgtgtggcctgacagtttctaccagtcctgctgtccctcggctgagaataaaacccatttctggatgatggggaatgtca

SEQ ID NO: 342960 - DNA, 988 bp, Homo sapiens
cgggggccccgcggcgcaggcagtctgggcgcgcggctgcagcggcggagccggaagtcggagccgggagcgctagcggcagccggatcgcagcctgcggggcccgccgcagccatgggcaaccgcggcatggaagatctcatcccgctggtcaaccggctgcaagacgccttctctgccatcggccagaacgcggacctcgacctgccgcagatcgctgtggtgggcggccagagcgccggcaagagctcggtgctcgagaatttcgtaggcagggacttcttgcctcgaggatctggcattgtcacccgacgtcccctggtcttgcagctggtcaatgcaaccacagaatatgccgagttcctgcactgcaagggaaagaaattcaccgacttcgaggaggtgcgccttgagatcgaggccgagaccgacagggtcaccggcaccaacaagggcatctcgccggtgcctatcaacctccgcgtctactcgccgcacgtgctgaacctgaccctggtggacctgcccggaatgaccaaggtcccggtgggggaccaacctcccgacatcgagttccagatccgagacatgcttatgcagtttgtcaccaaggagaactgcctcatcctggccgtgtcccccgccaactctgacctggccaattctgacgccctcaaggtcgccaaggaggtggacccccagggccagcgcaccatcggggtcatcaccaagctggacctgatggacgagggcacagatgcccgtgatgtgctggagaacaagctgctccccctgcgcagaggctacattggagtggtgaaccggagccagaaggacattgatggcaagaaggacattaccgccgccttggctgctgaacgaaagttcttcctctcccatccatcttatcgccacttggctgaccgtatgggcacgccctacctgcagaaggtcctcaatcaggtaggcgaccaagccaggatggggc

SEQ ID NO: 342961 - DNA, 463 bp, Homo sapiens
ggagaaatgacagctggactttagcgagcaagccctatctccatgagcagcacgggtgatcctctaagcacaccaggcacgagtgtgcagggagctggtgcaaatgcctctgtgtgcgggtgagcttctgtgttgtgactctgcccacacgtgtgcttcagtgtgctgagtggctgcatgccccagatccatgctgcacgcgccgccggccagtgagggtgctgggcactgggaggtggcggggaaggaggcgtatgcgtgttgtttgtgggcatgtgtgttagcgtgtgcattgagcctccttgtcatgcccggcctgtggacagccagcccccgccatccctcccaccccctaccaagcatgggggtgctgtgcaggcagccgtgtggcctgacagtttctaccagtcctgctgtccctcggctgagaataaaacccatttctggatgatggggaatgtca

SEQ ID NO: 342962 - DNA, 3244 bp, Homo sapiens
cgggggccccgcggcgcaggcagtctgggcgcgcggctgcagcggcggagccggaagtcggagccgggagcgctagcggcagccggatcgcagcctgcggggcccgccgcagccatgggcaaccgcggcatggaagatctcatcccgctggtcaaccggctgcaagacgccttctctgccatcggccagaacgcggacctcgacctgccgcagatcgctgtggtgggcggccagagcgccggcaagagctcggtgctcgagaatttcgtaggcagggacttcttgcctcgaggatctggcattgtcacccgacgtcccctggtcttgcagctggtcaatgcaaccacagaatatgccgagttcctgcactgcaagggaaagaaattcaccgacttcgaggaggtgcgccttgagatcgaggccgagaccgacagggtcaccggcaccaacaagggcatctcgccggtgcctatcaacctccgcgtctactcgccgcacgtgctgaacctgaccctggtggacctgcccggaatgaccaaggtcccggtgggggaccaacctcccgacatcgagttccagatccgagacatgcttatgcagtttgtcaccaaggagaactgcctcatcctggccgtgtcccccgccaactctgacctggccaattctgacgccctcaaggtcgccaaggaggtggacccccagggccagcgcaccatcggggtcatcaccaagctggacctgatggacgagggcacagatgcccgtgatgtgctggagaacaagctgctccccctgcgcagaggctacattggagtggtgaaccggagccagaaggacattgatggcaagaaggacattaccgccgccttggctgctgaacgaaagttcttcctctcccatccatcttatcgccacttggctgaccgtatgggcacgccctacctgcagaaggtcctcaatcagcaactgacgaaccacatccgggacacactgccggggctgcggaacaagctgcagagccagctactgtccattgagaaggaggtggaggaatacaagaacttccgccctgatgacccagctcgcaagaccaaggccctgctgcagatggtccagcagttcgccgtagactttgagaagcgcattgagggctcaggagatcagatcgacacctacgaactgtcagggggagcccgcattaaccgaatcttccacgagcgcttccctttcgagctggtcaagatggagtttgatgagaaggaactccgaagggagatcagctatgctatcaagaatatccatggcattagaacggggctgtttaccccagacatggcctttgagaccattgtgaaaaagcaggtgaagaagatccgagaaccgtgtctcaagtgtgtggacatggttatctcggagctaatcagcaccgttagacagtgcaccaagaagctccagcagtacccgcggctacgggaggagatggagcgcatcgtgaccacccacatccgggagcgcgagggccgcactaaggagcaggtcatgcttctcatcgatatcgagctggcttacatgaacaccaaccatgaggacttcataggctttgccaatgctcagcagaggagcaaccagatgaacaagaagaagacttcagggaaccaggatgagattctggtcatccgcaagggctggctgactatcaataatattggcatcatgaaagggggctccaaggagtactggtttgtgctgactgctgagaatctgtcctggtacaaggatgatgaggagaaagagaagaaatacatgctgtctgtggacaacctcaagctgcgggacgtggagaagggctttatgtcgagcaagcatatctttgccctctttaacacggagcagaggaatgtctacaaggattatcggcagctggagctagcctgtgagacacaggaggaggtggacagctggaaggcctccttcctgagggctggcgtgtaccctgagcgtgttggggacaaagagaaagccagcgagaccgaggagaatggctccgacagcttcatgcattccatggacccacagctggaacggcaagtggagaccatccggaatcttgtggactcatacatggccattgtcaacaagaccgtgagggacctcatgcccaagaccatcatgcacctcatgattaacaataccaaggagttcatcttctcggagctgctggccaacctgtactcgtgtggggaccagaacacgctgatggaggagtcggcggagcaggcacagcggcgcgacgagatgctgcgcatgtaccacgcactgaaggaggcgctcagcatcatcggcgacatcaacacgaccaccgtcagcacgcccatgcccccgcccgtggacgactcctggctgcaggtgcagagcgtaccggccggacgcaggtcgcccacgtccagccccacgccgcagcgccgagcccccgccgtgcccccagcccggcccgggtcgcggggccctgctcctgggcctccgcctgctgggtccgccctggggggggcgccccccgtgccctccaggccgggggcttcccctgaccctttcggccctccccctcaggtgccctcgcgccccaaccgcgccccgcccggggtccccagccgatcgggtcaggcaagtccatcccgtcctgagagccccaggccccccttcgacctctaaacagatccctcctcttctcggagacctccctttccaagcctgcctggacggctgttctgtgacttgacagtggctcccccagccccaaagccagcccccttcatctgtgacttaatctgttgtagtggtgagctgatacattcaggtgtgaccgttggtgaaaacttgtgccccttctgtggtatgcccttgccctgttctataaatatctataaatactcatatatatacacacctacacatggccaaccgcctcgcctctagcgctgggaatcagtcactgtgctatccttgtggagtcttgtggcccaactaccagagaacgctgtcccccgacatcccactccaaagtgtgccacctccagtgagcctccttgtcatgcccggcctgtggacagccagcccccgccatccctcccaccccctaccaagcatgggggtgctgtgcaggcagccgtgtggcctgacagtttctaccagtcctgctgtccctcggctgagaataaaacccatttctggatgatggggaatgtca

SEQ ID NO: 342963 - DNA, 524 bp, Homo sapiens
ggcgagctgctaactcaggggcgagctgctaactcaggggcgagctgctaactcaggggcgagctgctaactcaggggcgagctgctaactcaggggcgagctgcaaccaaggccctgctgcagatggtccagcagttcgccgtagactttgagaagcgcattgagggctcaggagatcagatcgacacctacgaactgtcagggggagcccgcattaaccgaatcttccacgagcgcttccctttcgagctggtcaagatggagtttgatgagaaggaactccgaagggagatcagctatgctatcaagaatatccatggcattaggacgggcctcttcacacctgacctcgcttttgaagccacagtgaaaaagcaggtgcagaagctcaaagagcccagtatcaagtgtgtggatatggtagtcagtgagctcacagccaccatcagaaagtgtagcgaaaagctccacagtaccccggctacgggaggagatgagcgcctgggatcctcctagaacgcct

SEQ ID NO: 342964 - DNA, 2797 bp, Homo sapiens
cctgcgtgttactcttgagagatccccgcctaagtggatgctccggaatgaccaaggtcccggtgggggaccaacctcccgacatcgagttccagatccgagacatgcttatgcagtttgtcaccaaggagaactgcctcatcctggccgtgtcccccgccaactctgacctggccaattctgacgccctcaaggtcgccaaggaggtggacccccagggccagcgcaccatcggggtcatcaccaagctggacctgatggacgagggcacagatgcccgtgatgtgctggagaacaagctgctccccctgcgcagaggctacattggagtggtgaaccggagccagaaggacattgatggcaagaaggacattaccgccgccttggctgctgaacgaaagttcttcctctcccatccatcttatcgccacttggctgaccgtatgggcacgccctacctgcagaaggtcctcaatcagcaactgacgaaccacatccgggacacactgccggggctgcggaacaagctgcagagccagctactgtccattgagaaggaggtggaggaatacaagaacttccgccctgatgacccagctcgcaagaccaaggccctgctgcagatggtccagcagttcgccgtagactttgagaagcgcattgagggctcaggagatcagatcgacacctacgaactgtcagggggagcccgcattaaccgaatcttccacgagcgcttccctttcgagctggtcaagatggagtttgatgagaaggaactccgaagggagatcagctatgctatcaagaatatccatggcattagaacggggctgtttaccccagacatggcctttgagaccattgtgaaaaagcaggtgaagaagatccgagaaccgtgtctcaagtgtgtggacatggttatctcggagctaatcagcaccgttagacagtgcaccaagaagctccagcagtacccgcggctacgggaggagatggagcgcatcgtgaccacccacatccgggagcgcgagggccgcactaaggagcaggtcatgcttctcatcgatatcgagctggcttacatgaacaccaaccatgaggacttcataggctttgccaatgctcagcagaggagcaaccagatgaacaagaagaagacttcagggaaccaggatgagattctggtcatccgcaagggctggctgactatcaataatattggcatcatgaaagggggctccaaggagtactggtttgtgctgactgctgagaatctgtcctggtacaaggatgatgaggagaaagagaagaaatacatgctgtctgtggacaacctcaagctgcgggacgtggagaagggctttatgtcgagcaagcatatctttgccctctttaacacggagcagaggaatgtctacaaggattatcggcagctggagctagcctgtgagacacaggaggaggtggacagctggaaggcctccttcctgagggctggcgtgtaccctgagcgtgttggggacaaagagaaagccagcgagaccgaggagaatggctccgacagcttcatgcattccatggacccacagctggaacggcaagtggagaccatccggaatcttgtggactcatacatggccattgtcaacaagaccgtgagggacctcatgcccaagaccatcatgcacctcatgattaacaataccaaggagttcatcttctcggagctgctggccaacctgtactcgtgtggggaccagaacacgctgatggaggagtcggcggagcaggcacagcggcgcgacgagatgctgcgcatgtaccacgcactgaaggaggcgctcagcatcatcggcgacatcaacacgaccaccgtcagcacgcccatgcccccgcccgtggacgactcctggctgcaggtgcagagcgtaccggccggacgcaggtcgcccacgtccagccccacgccgcagcgccgagcccccgccgtgcccccagcccggcccgggtcgcggggccctgctcctgggcctccgcctgctgggtccgccctggggggggcgccccccgtgccctccaggccgggggcttcccctgaccctttcggccctccccctcaggtgccctcgcgccccaaccgcgccccgcccggggtccccagaatcactatcagtgacccctgaggagcgtcagccatgccgatcgggtcaggcaagtccatcccgtcctgagagccccaggccccccttcgacctctaaacagatccctcctcttctcggagacctccctttccaagcctgcctggacggctgttctgtgacttgacagtggctcccccagccccaaagccagcccccttcatctgtgacttaatctgttgtagtggtgagctgatacattcaggtgtgaccgttggtgaaaacttgtgccccttctgtggtatgcccttgccctgttctataaatatctataaatactcatatatatacacacctacacatggccaaccgcctcgcctctagcgctgggaatcagtcactgtgctatccttgtggagtcttgtggcccaactaccagagaacgctgtcccccgacatcccactccaaagtgtgccacctccagtgagcctccttgtcatgcccggcctgtggacagccagcccccgccatccctcccaccccctaccaagcatgggggtgctgtgcaggcagccgtgtggcctgacagtttctaccagtcctgctgtccctcggctgagaataaaacccatttctggatgatggggaatgtca

SEQ ID NO: 342965 - DNA, 2679 bp, Homo sapiens
caggaatgccccttgaagagaaagggaggggcgggactagagcagggagctggagagggaggtcaggctgctatactgcaaccctaggaggcagcctctgcgccacggtttacgggaatggacccccctggagttgtgcagtgcatggcctgggcagctggatgcggcaaccctagagatagggaatggtactgaggtttggagtcaggatgaagcaaattctgggacactgggaaacgtagaattgaacaggatgggtggatgaggtcctggccttgtcctggcctgggtcagctccttaggagaacccaaggctgtggacaaagacggcactgggagagagcaggcagcctcagtgaggccgaggagcaggggagcatccctgggaagaggatctgaactcaataggggtcttgtacggagcaggggcttggtccctcgtacctctggccatacctatggagcccaggggatgcttggcagcacctgggaggtgccaaccccgggtggcaagggagggccggtcccacgctcacattgtcttctgttctctctctctctttatctgtgtcgatgtctctctctcttcccccgtgcccgtgccatcctctccacccctggattcctgtctctgcttggctttcacccacttctcctccccacccacggctgctcctcctcctgtccccacctcctccccgggtgcaggacgggcctcttcacacctgacctcgcttttgaagccacagtgaaaaagcaggtgcagaagctcaaagagcccagtatcaagtgtgtggatatggtagtcagtgagctcacagccaccatcagaaagtgtagcgaaaagctccagcagtacccgcggctacgggaggagatggagcgcatcgtgaccacccacatccgggagcgcgagggccgcactaaggagcaggtcatgcttctcatcgatatcgagctggcttacatgaacaccaaccatgaggacttcataggctttgccaatgctcagcagaggagcaaccagatgaacaagaagaagacttcagggaaccaggatgagattctggtcatccgcaagggctggctgactatcaataatattggcatcatgaaagggggctccaaggagtactggtttgtgctgactgctgagaatctgtcctggtacaaggatgatgaggagaaagagaagaaatacatgctgtctgtggacaacctcaagctgcgggacgtggagaagggctttatgtcgagcaagcatatctttgccctctttaacacggagcagaggaatgtctacaaggattatcggcagctggagctagcctgtgagacacaggaggaggtggacagctggaaggcctccttcctgagggctggcgtgtaccctgagcgtgttggggacaaagagaaagccagcgagaccgaggagaatggctccgacagcttcatgcattccatggacccacagctggaacggcaagtggagaccatccggaatcttgtggactcatacatggccattgtcaacaagaccgtgagggacctcatgcccaagaccatcatgcacctcatgattaacaataccaaggagttcatcttctcggagctgctggccaacctgtactcgtgtggggaccagaacacgctgatggaggagtcggcggagcaggcacagcggcgcgacgagatgctgcgcatgtaccacgcactgaaggaggcgctcagcatcatcggcgacatcaacacgaccaccgtcagcacgcccatgcccccgcccgtggacgactcctggctgcaggtgcagagcgtaccggccggacgcaggtcgcccacgtccagccccacgccgcagcgccgagcccccgccgtgcccccagcccggcccgggtcgcggggccctgctcctgggcctccgcctgctgggtccgccctggggggggcgccccccgtgccctccaggccgggggcttcccctgaccctttcggccctccccctcaggtgccctcgcgccccaaccgcgccccgcccggggtccccagaatcactatcagtgacccctgaggagcgtcagccatgccgatcgggtcaggcaagtccatcccgtcctgagagccccaggccccccttcgacctctaaacagatccctcctcttctcggagacctccctttccaagcctgcctggacggctgttctgtgacttgacagtggctcccccagccccaaagccagcccccttcatctgtgacttaatctgttgtagtggtgagctgatacattcaggtgtgaccgttggtgaaaacttgtgccccttctgtggtatgcccttgccctgttctataaatatctataaatactcatatatatacacacctacacatggccaaccgcctcgcctctagcgctgggaatcagtcactgtgctatccttgtggagtcttgtggcccaactaccagagaacgctgtcccccgacatcccactccaaagtgtgccacctccagtgagcctccttgtcatgcccggcctgtggacagccagcccccgccatccctcccaccccctaccaagcatgggggtgctgtgcaggcagccgtgtggcctgacagtttctaccagtcctgctgtccctcggctgagaataaaacccatttctggatgatggggaatgtca

SEQ ID NO: 342966 - DNA, 3151 bp, Homo sapiens
cgggggccccgcggcgcaggcagtctgggcgcgcggctgcagcggcggagccggaagtcggagccgggagcgctagcggcagccggatcgcagcctgcggggcccgccgcagccatgggcaaccgcggcatggaagatctcatcccgctggtcaaccggctgcaagacgccttctctgccatcggccagaacgcggacctcgacctgccgcagatcgctgtggtgggcggccagagcgccggcaagagctcggtgctcgagaatttcgtaggcagggacttcttgcctcgaggatctggcattgtcacccgacgtcccctggtcttgcagctggtcaatgcaaccacagaatatgccgagttcctgcactgcaagggaaagaaattcaccgacttcgaggaggtgcgccttgagatcgaggccgagaccgacagggtcaccggcaccaacaagggcatctcgccggtgcctatcaacctccgcgtctactcgccgcacgtgctgaacctgaccctggtggacctgcccggaatgaccaaggtcccggtgggggaccaacctcccgacatcgagttccagatccgagacatgcttatgcagtttgtcaccaaggagaactgcctcatcctggccgtgtcccccgccaactctgacctggccaattctgacgccctcaaggtcgccaaggaggtggacccccagggccagcgcaccatcggggtcatcaccaagctggacctgatggacgagggcacagatgcccgtgatgtgctggagaacaagctgctccccctgcgcagaggctacattggagtggtgaaccggagccagaaggacattgatggcaagaaggacattaccgccgccttggctgctgaacgaaagttcttcctctcccatccatcttatcgccacttggctgaccgtatgggcacgccctacctgcagaaggtcctcaatcagcaactgacgaaccacatccgggacacactgccggggctgcggaacaagctgcagagccagctactgtccattgagaaggaggtggaggaatacaagaacttccgccctgatgacccagctcgcaagaccaaggccctgctgcagatggtccagcagttcgccgtagactttgagaagcgcattgagggctcaggagatcagatcgacacctacgaactgtcagggggagcccgcattaaccgaatcttccacgagcgcttccctttcgagctggtcaagatggagtttgatgagaaggaactccgaagggagatcagctatgctatcaagaatatccatggcattagaacggggctgtttaccccagacatggcctttgagaccattgtgaaaaagcaggtgaagaagatccgagaaccgtgtctcaagtgtgtggacatggttatctcggagctaatcagcaccgttagacagtgcaccaagaagctccagcagtacccgcggctacgggaggagatggagcgcatcgtgaccacccacatccgggagcgcgagggccgcactaaggagcaggtcatgcttctcatcgatatcgagctggcttacatgaacaccaaccatgaggacttcataggctttgccaatgctcagcagaggagcaaccagatgaacaagaagaagacttcagggaaccaggatgagattctggtcatccgcaagggctggctgactatcaataatattggcatcatgaaagggggctccaaggagtactggtttgtgctgactgctgagaatctgtcctggtacaaggatgatgaggagaaagagaagaaatacatgctgtctgtggacaacctcaagctgcgggacgtggagaagggctttatgtcgagcaagcatatctttgccctctttaacacggagcagaggaatgtctacaaggattatcggcagctggagctagcctgtgagacacaggaggaggtggacagctggaaggcctccttcctgagggctggcgtgtaccctgagcgtgttggggacaaagagaaagccagcgagaccgaggagaatggctccgacagcttcatgcattccatggacccacagctggaacggcaagtggagaccatccggaatcttgtggactcatacatggccattgtcaacaagaccgtgagggacctcatgcccaagaccatcatgcacctcatgattaacaataccaaggagttcatcttctcggagctgctggccaacctgtactcgtgtggggaccagaacacgctgatggaggagtcggcggagcaggcacagcggcgcgacgagatgctgcgcatgtaccacgcactgaaggaggcgctcagcatcatcggcgacatcaacacgaccaccgtcagcacgcccatgcccccgcccgtggacgactcctggctgcaggtgcagagcgtaccggccggacgcaggtcgcccacgtccagccccacgccgcagcgccgagcccccgccgtgcccccagcccggcccgggtcgcggggccctgctcctgggcctccgcctgctgggtccgccctggggggggcgccccccgtgccctccaggccgggggcttcccctgaccctttcggccctccccctcaggtgccctcgcgccccaaccgcgccccgcccggggtccccagccgatcgggtcaggcaagtccatcccgtcctgagagccccaggccccccttcgacctctaaacagatccctcctcttctcggagacctccctttccaagcctgcctggacggctgttctgtgacttgacagtggctcccccagccccaaagccagcccccttcatctgtgacttaatctgttgtagtggtgagctgatacattcaggtgtgaccgttggtgaaaacttgtgccccttctgtggtatgcccttgccctgttctataaatatctataaatactcatatatatacacacctacacatggccaaccgcctcgcctctagcgctgggaatcagtcactgtgctatccttgtggagtcttgtggcccaactaccagagaacgctgtcccccgacatcccactccaaagtgtgccacctccagtgagccctcctttggtattgccccggccctggtgggaacaggacatgcctctctgctaattctctttcccaccgctt

SEQ ID NO: 342967 - DNA, 1740 bp, Homo sapiens
cgggggccccgcggcgcaggcagtctgggcgcgcggctgcagcggcggagccggaagtcggagccgggagcgctagcggcagccggatcgcagcctgcggggcccgccgcagccatgggcaaccgcggcatggaagatctcatcccgctggtcaaccggctgcaagacgccttctctgccatcggccagaacgcggacctcgacctgccgcagatcgctgtggtgggcggccagagcgccggcaagagctcggtgctcgagaatttcgtaggcagggacttcttgcctcgaggatctggcattgtcacccgacgtcccctggtcttgcagctggtcaatgcaaccacagaatatgccgagttcctgcactgcaagggaaagaaattcaccgacttcgaggaggtgcgccttgagatcgaggccgagaccgacagggtcaccggcaccaacaagggcatctcgccggtgcctatcaacctccgcgtctactcgccgcacgtgctgaacctgaccctggtggacctgcccggaatgaccaaggtcccggtgggggaccaacctcccgacatcgagttccagatccgagacatgcttatgcagtttgtcaccaaggagaactgcctcatcctggccgtgtcccccgccaactctgacctggccaattctgacgccctcaaggtcgccaaggaggtggacccccagggccagcgcaccatcggggtcatcaccaagctggacctgatggacgagggcacagatgcccgtgatgtgctggagaacaagctgctccccctgcgcagaggctacattggagtggtgaaccggagccagaaggacattgatggcaagaaggacattaccgccgccttggctgctgaacgaaagttcttcctctcccatccatcttatcgccacttggctgaccgtatgggcacgccctacctgcagaaggtcctcaatcagcaactgacgaaccacatccgggacacactgccggggctgcggaacaagctgcagagccagctactgtccattgagaaggaggtggaggaatacaagaacttccgccctgatgacccagctcgcaagaccaaggccctgctgcagatggtccagcagttcgccgtagactttgagaagcgcattgagggctcaggagatcagatcgacacctacgaactgtcagggggagcccgcattaaccgaatcttccacgagcgcttccctttcgagctggtcaagatggagtttgatgagaaggaactccgaagggagatcagctatgctatcaagaatatccatggcattaggacgggcctcttcacacctgacctcgcttttgaagccacagtgaaaaagcaggtgcagaagctcaaagagcccagtatcaagtgtgtggatatggtagtcagtgagctcacagccaccatcagaaagtgtagcgaaaaggtatgacggccgcctgggcggggctgggcctggccgtccattccttgtggccacagcctcccgtgggcagaaggatctgctgagccggcctcacggctacccgcagggacccagccctagtgtttcctgccacgttctaaccctgtgtacttgcactcatgacccctccaggcccccatcccagaagacttgactccaacccaagcctccttggtggcacctatgctagtgatgaagatgatgttaaggagatggcagctgtttactgagcacctactatgtgccaagcac

SEQ ID NO: 342968 - DNA, 559 bp, Homo sapiens
caaactgtaggtgaaactgaaaaataattataaaattcaaagccatatttaagaacaacagcaaatctgtagctcttacattaccaattattaagacatgctataaagctacataatgaagactgtggcatcagaacaaggatagacaaataggtaaatggaacagaagtgagagttcagagacagagctacaagataatgcagtatcttggcttacaacaaaggctacactgcaattaagcgggtgtggaggcgggagaagagtcttttccacagatggcgctagtcagttgatattcctgaggaaaaaaataaaacttgattcctatgccatacacaaaaatgattttatgatggatcataggcttaaatgttaaaactaaaacaattaaccttctagaaaaaatacaagagaaatatcttcgtgaacttgggatatgcgaagattttttaaaataatacttttaacttaagatgtgtgcactttactgtatgttaattatacttcaatagaatttcctctcccttgtcttttgttatgtgacactcttaattttct

SEQ ID NO: 342969 - DNA, 501 bp, Homo sapiens
ggaaattgaatatagagcctagaattttacctcttcaagagatggatttgttacttatattcctttggtttaggagttgtggtttttgatccttttcttcagaaaaagttagaatgtctgaaaagcctggacctctttaactgtgaggttaccaacctgaatgactaccgagagagtgtcttcaagctcctgccccagcttacctacttggatggctatgaccgagaggaccaggaagcacctgactcagatgccgaggtggatggtgtggatgaagaggaggaggacgaaggtgagtaggctcagcatctggtgaacctgatgtctgcctttcaaagcctctgataaaagctattggatgttggccgggcgcagtggcacacaactgtaatcccagcactttgggtggccgaggcagggggcattgcttgagcccaggagtttgagactagcctgggcaacatggcaataccttgtttctacagaaaatagaaaaaaaaa

SEQ ID NO: 342970 - DNA, 493 bp, Homo sapiens
  misc_feature (8)..(8): n is a, c, g, or t
  misc_feature (42)..(42): n is a, c, g, or t
  misc_feature (47)..(47): n is a, c, g, or t
gtgatggngttctagaggatccctactctgaaagacatcagnacctnggaacttgaaaaagttagaatgtctgaaaagcctggacctctttaactgtgaggttaccaacctgaatgactaccgagagagtgtcttcaagctcctgccccagcttacctacttggatggctatgaccgagaggaccaggaagcacctgactcagatgccgaggtggatggtgtggatgaagaggaggaggacgaagaaggagaagatgaggaagacgaggacgatgaggatggtgaagaagaggagtttgatgaagaagatgatgaagatgaagatgtagaaggggatgaggacgacgatgaagtcagtgaggagaataataatttgtactttattaataagattaatattatgatgaagattaatatgtataatatattttattttatttttttatattataaattgtaaattgaattatgttttttatagtttttatttagc

SEQ ID NO: 342971 - DNA, 1493 bp, Homo sapiens
gcggccgccgagccgagcagcgccgcgcggggccgagtggagccgagcagctgccgcgccgcgtcgccggtttaagcgcagtgcaggccgcggccgggggcggcggtagtgagcccagcgctgcgctccagcccccttttccctccatggtttctctccgctcccgtgagtaacttggctccgggggctccgctcgcctgcccgcacgccgcccgccacccaggaccgcgccgccggcctccgccgctagcaaacccttccgacggccctcgctgcgcaagccgggacgcctctcccccctccgcccccgccgcggaaagttaagtttgaagaggggggaagaggggaacatggacatgaagaggaggatccacctggagctgaggaaccggaccccggcagctgttcgagaacttgtcttggacaattgcaaatcaaatgatggaaaaattgagggcttaacagctgaatttgtgaacttagagttcctcagtttaataaatgtaggcttgatctcagtttcaaatctccccaagctgcctaaattgaaaaagcttgaactcagtgaaaatagaatctttggaggtctggacatgttagctgaaaaacttccaaatctcacacatctaaacttaagtggaaataaactgaaagatatcagcaccttggaacctttgaaaaagttagaatgtctgaaaagcctggacctctttaactgtgaggttaccaacctgaatgactaccgagagagtgtcttcaagctcctgccccagcttacctacttggatggctatgaccgagaggaccaggaagcacctgactcagatgccgaggtggatggtgtggatgaagaggaggaggacgaagaaggagaagatgaggaagacgaggacgatgaggatggtgaagaagaggagtttgatgaagaagatgatgaagatgaagatgtagaaggggatgaggacgacgatgaagtcagtgaggaggaagaagaatttggacttgatgaagaagatgaagatgaggatgaggatgaagaggaggaagaaggtgggaaaggtgaaaagaggaagagagaaacagatgatgaaggagaagatgattaagaccccagatgacctgcagaaacagaactgttcagtattggttggactgctcatggattttgtagctgtttaaaaaaaaaaaaaaggtagctgtgatacaaaccccaggacacccacccacccaaagagccaaagaatagttcctgtgacattccgccttccttccatgtagtccctcttggtaatctaccaccaagcttgtggacttcaccccaacaaaattgtaagcgttgttaggtttttgtgtaagattcttgctgtagcgtggatagctgtgattggtgagtcaaccgtctgtggctaccagttacactgagattgtaacagcatttttactttctgtacaacaaaaaagctttgtaaataaaatcttaacattttgggtct

SEQ ID NO: 342972 - DNA, 1403 bp, Homo sapiens
  misc_feature (3)..(3): n is a, c, g, or t
ttnctcatggacctatgctcgacagtcgcgctgcgctccagcccccttttccctccatggtttctctccgctcccgtgagtaacttggctccgggggctccgctcgcctgcccgcacgccgcccgccacccaggaccgcgccgccggcctccgccgctagcaaacccttccgacggccctcgctgcgcaagccgggacgcctctcccccctccgcccccgccgcggaaagttaagtttgaagaggggggaagaggggaacatggacatgaagaggaggatccacctggagctgaggaaccggaccccggcagctgttcgagaacttgtcttggacaattgcaaatcaaatgatggaaaaattgagggcttaacagctgaatttgtgaacttagagttcctcagtttaataaatgtaggcttgatctcagtttcaaatctccccaagctgcctaaattgaaaaagcttgaactcagtgaaaatagaatctttggaggtctggacatgttagctgaaaaacttccaaatctcacacatctaaacttaagtggaaataaactgaaagatatcagcaccttggaacctttgaaaaagttagaatgtctgaaaagcctggacctctttaactgtgaggttaccaacctgaatgactaccgagagagtgtcttcaagctcctgccccagcttacctacttggatggctatgaccgagaggaccaggaagcacctgactcagatgccgaggtggatggtgtggatgaagaggaggaggacgaagaaggagaagatgaggaagacgaggacgatgaggatggtgaagaagaggagtttgatgaagaagatgatgaagatgaagatgtagaaggggatgaggacgacgatgaagtcagtgaggaggaagaagaatttggacttgatgaagaagatgaagatgaggatgaggatgaagaggaggaagaaggtgggaaaggtgaaaagaggaagagagaaacagatgatgaaggagaagatgattaagaccccagatgacctgcagaaacagaactgttcagtattggttggactgctcatggattttgtagctgtttaaaaaaaaaaaaaaggtagctgtgatacaaaccccaggacacccacccacccaaagagccaaagaatagttcctgtgacattccgccttccttccatgtagtccctcttggtaatctaccaccaagcttgtggacttcaccccaacaaaattgtaagcgttgttaggtttttgtgtaagattcttgctgtagcgtggatagctgtgattggtgagtcaaccgtctgtggctaccagttacactgagattgtaacagcatttttactttctgtacaacaaaaaagctttgtaaataaaatcttaacattttgggtct

SEQ ID NO: 342973 - DNA, 1390 bp, Homo sapiens
tcggcggtacgcccgcagtatgggatatcgtcgaccacggcgtcgggtttctctccgctcccgtgagtaacttggctccgggggctccgctcgcctgcccgcacgccgcccgccacccaggaccgcgccgccggcctccgccgctagcaaacccttccgacggccctcgctgcgcaagccgggacgcctctcccccctccgcccccgccgcggaaagttaagtttgaagaggggggaagaggggaacatggacatgaagaggaggatccacctggagctgaggaaccggaccccggcagctgttcgagaacttgtcttggacaattgcaaatcaaatgatggaaaaattgagggcttaacagctgaatttgtgaacttagagttcctcagtttaataaatgtaggcttgatctcagtttcaaatctccccaagctgcctaaattgaaaaagcttgaactcagtgaaaatagaatctttggaggtctggacatgttagctgaaaaacttccaaatctcacacatctaaacttaagtggaaataaactgaaagatatcagcaccttggaacctttgaaaaagttagaatgtctgaaaagcctggacctctttaactgtgaggttaccaacctgaatgactaccgagagagtgtcttcaagctcctgccccagcttacctacttggatggctatgaccgagaggaccaggaagcacctgactcagatgccgaggtggatggtgtggatgaagaggaggaggacgaagaaggagaagatgaggaagacgaggacgatgaggatggtgaagaagaggagtttgatgaagaagatgatgaagatgaagatgtagaaggggatgaggacgacgatgaagtcagtgaggaggaagaagaatttggacttgatgaagaagatgaagatgaggatgaggatgaagaggaggaagaaggtgggaaaggtgaaaagaggaagagagaaacagatgatgaaggagaagatgattaagaccccagatgacctgcagaaacagaactgttcagtattggttggactgctcatggattttgtagctgtttaaaaaaaaaaaaaaggtagctgtgatacaaaccccaggacacccacccacccaaagagccaaagaatagttcctgtgacattccgccttccttccatgtagtccctcttggtaatctaccaccaagcttgtggacttcaccccaacaaaattgtaagcgttgttaggtttttgtgtaagattcttgctgtagcgtggatagctgtgattggtgagtcaaccgtctgtggctaccagttacactgagattgtaacagcatttttactttctgtacaacaaaaaagctttgtaaataaaatcttaacattttgggtct

SEQ ID NO: 342974 - DNA, 1683 bp, Homo sapiens
gcggccgccgagccgagcagcgccgcgcggggccgagtggagccgagcagctgccgcgccgcgtcgccggtttaagcgcagtgcaggccgcggccgggggcggcggtagtgagcccagcgctgcgctccagcccccttttccctccatggtttctctccgctcccgtgagtaacttggctccgggggctccgctcgcctgcccgcacgccgcccgccacccaggaccgcgccgccggcctccgccgctagcaaacccttccgacggccctcgctgcgcaagccgggacgcctctcccccctccgcccccgccgcggaaagttaagtttgaagaggggggaagaggggaacatggacatgaagaggaggatccacctggagctgaggaaccggaccccggcagctgttcgagaacttgtcttggacaattgcaaatcaaatgatggaaaaattgagggcttaacagctgaatttgtgaacttagagttcctcagtttaataaatgtaggcttgatctcagtttcaaatctccccaagctgcctaaattgaaaaagcttgaactcagtgaaaatagaatctttggaggtctggacatgttagctgaaaaacttccaaatctcacacatctaaacttaagtggaaataaactgaaagatatcagcaccttggaacctttgaaaaagttagaatgtctgaaaagcctggacctctttaactgtgaggttaccaacctgaatgactaccgagagagtgtcttcaagctcctgccccagcttacctacttggatggctatgaccgagaggaccaggaagcacctgactcagatgccgaggtggatggtgtggatgaagaggaggaggacgaagaaggagaagatgaggaagacgaggacgatgaggatggtgaagaagaggagtttgatgaagaagatgatgaagatgaagatgtagaaggggatgaggacgacgatgaagtcagtgaggaggaagaagaatttggacttgatgaagaagatgaagatgaggatgaggatgaagaggaggaagaaggtgggaaaggtgaaaagaggaagagagaaacagatgatgaaggagaagatgattaagaccccagatgacctgcagaaacagaactgttcagtattggttggactgctcatggattttgtagctgtttaaaaaaaaaaaaaaggtagctgtgatacaaaccccaggacacccacccacccaaagagccaaagaatagttcctgtgacattccgccttccttccatgtagtccctcttggtaatctaccaccaagcttgtggacttcaccccaacaaaattgtaagcgttgttaggtttttgtgtaagattcttgctgtagcgtggatagctgtgattggtgagtcaaccgtctgtggctaccagttacactgagattgtaacagcatttttactttctgtacaacaaaaaagctttgtaaataaaatcttaacattttgggtctagaagagagcattactgaatgggagaacttttgttagctgaaaatttgcctgttaccatttatatgaaaaaagcttaattcgttttttatagaattagcccattatattcttgaccatctcatcctttgttagcagaggggaacgctttccaaaagttgccggtatttttcgcgtcctcattcccgataa

SEQ ID NO: 342975 - DNA, 1565 bp, Homo sapiens
gcggccgccgagccgagcagcgccgcgcggggccgagtggagccgagcagctgccgcgccgcgtcgccggtttaagcgcagtgcaggccgcggccgggggcggcggtagtgagcccagcgctgcgctccagcccccttttccctccatggtttctctccgctcccgtgagtaacttggctccgggggctccgctcgcctgcccgcacgccgcccgccacccaggaccgcgccgccggcctccgccgctagcaaacccttccgacggccctcgctgcgcaagccgggacgcctctcccccctccgcccccgccgcggaaagttaagtttgaagaggggggaagaggggaacatggacatgaagaggaggatccacctggagctgaggaaccggaccccggcagctgttcgagaacttgtcttggacaattgcaaatcaaatgatggaaaaattgagggcttaacagctgaatttgtgaacttagagttcctcagtttaataaatgtaggcttgatctcagtttcaaatctccccaagctgcctaaattgaaaaagcttgaactcagtgaaaatagaatctttggaggtctggacatgttagctgaaaaacttccaaatctcacacatctaaacttaagtggaaataaactgaaagatatcagcaccttggaacctttgaaaaagttagaatgtctgaaaagcctggacctctttaactgtgaggttaccaacctgaatgactaccgagagagtgtcttcaagctcctgccccagcttacctacttggatggctatgaccgagaggaccaggaagcacctgactcagatgccgaggtggatggtgtggatgaagaggaggaggacgaagaaggagaagatgaggaagacgaggacgatgaggatggtgaagaagaggagtttgatgaagaagatgatgaagatgaagatgtagaaggggatgaggacgacgatgaagtcagtgaggaggaagaagaatttggacttgatgaagaagatgaagatgaggatgaggatgaagaggaggaagaaggtgggaaaggtgaaaagaggaagagagaaacagatgatgaaggagaagatgattaagaccccagatgacctgcagaaacagaactgttcagtattggttggactgctcatggattttgtagctgtttaaaaaaaaaaaaaaggtagctgtgatacaaaccccaggacacccacccacccaaagagccaaagaatagttcctgtgacattccgccttccttccatgtagtccctcttggtaatctaccaccaagcttgtggacttcaccctaacaacgcttacaattttgttggggtgaagtccacaagcttggtggtagattaccaagagggactacaccccaacaaaattgtaagcgttgttaggtttttgtgtaagattcttgctgtagcgtggatagctgtgattggtgagtcaaccgtctgtggctaccagttacactgagattgtaacagcatttttactttctgtacaacaaaaaagctttgtaaataaaatcttaacattttgggtct

SEQ ID NO: 342976 - DNA, 1306 bp, Homo sapiens
gcggccgccgagccgagcagcgccgcgcggggccgagtggagccgagcagctgccgcgccgcgtcgccggtttaagcgcagtgcaggccgcggccgggggcggcggtagtgagcccagcgctgcgctccagcccccttttccctccatggtttctctccgctcccgtgagtaacttggctccgggggctccgctcgcctgcccgcacgccgcccgccacccaggaccgcgccgccggcctccgccgctagcaaacccttccgacggccctcgctgcgcaagccgggacgcctctcccccctccgcccccgccgcggaaagttaagtttgaagaggggggaagaggggaacatggacatgaagaggaggatccacctggagctgaggaaccggaccccggcagctgttcgagaacttgtcttggacaattgcaaatcaaatgatggaaaaattgagggcttaacagctgaatttgtgaacttagagttcctcagtttaataaatgtaggcttgatctcagtttcaaatctccccaagctgcctaaattgaaaaagcttgaactcagtgaaaatagaatctttggaggtctggacatgttagctgaaaaacttccaaatctcacacatctaaacttaagtggaaataaactgaaagatatcagcaccttggaacctttgaaaaagttagaatgtctgaaaagcctggacctctttaactgtgaggttaccaacctgaatgactaccgagagagtgtcttcaagctcctgccccagcttacctacttggatggctatgaccgagaggaccaggaagcacctgactcagatgccgaggtggatggtgtggatgaagaggaggaggacgaagaaggagaagatgaggaagacgaggacgatgaggatggtgaagaagaggagtttgatgaagaagatgatgaagatgaagatgtagaaggggatgaggacgacgatgaagtcagtgaggaggaagaagaatttggacttgatgaagaagatgaagatgaggatgaggatgaagaggaggaagaaggtgggaaaggtgaaaagaggaagagagaaacagatgatgaaggagaagatgattaagaccccagatgacctgcagaaacagaactgttcagtattggttggactgctcatggattttgtagctgtttaaaaaaaagaatgatctcaatgtaatgcttcatgtcgcgcgcttctaccacagtgactttagactaaagcattctattcatgcggccgtaattcaaagttacttgcccattcgcctaaagtaagcatgt

SEQ ID NO: 342977 - DNA, 2689 bp, Homo sapiens
gcggccgccgagccgagcagcgccgcgcggggccgagtggagccgagcagctgccgcgccgcgtcgccggtttaagcgcagtgcaggccgcggccgggggcggcggtagtgagcccagcgctgcgctccagcccccttttccctccatggtttctctccgctcccgtgagtaacttggctccgggggctccgctcgcctgcccgcacgccgcccgccacccaggaccgcgccgccggcctccgccgctagcaaacccttccgacggccctcgctgcgcaagccgggacgcctctcccccctccgcccccgccgcggaaagttaagtttgaagaggggggaagaggggaacatggacatgaagaggaggatccacctggagctgaggaaccggaccccggcagctgttcgagaacttgtcttggacaattgcaaatcaaatgatggaaaaattgagggcttaacagctgaatttgtgaacttagagttcctcagtttaataaatgtaggcttgatctcagtttcaaatctccccaagctgcctaaattgaaaaagcttgaactcagtgaaaatagaatctttggaggtctggacatgttagctgaaaaacttccaaatctcacacatctaaacttaagtggaaataaactgaaagatatcagcaccttggaacctttgaaaaagttagaatgtctgaaaagcctggacctctttaactgtgaggttaccaacctgaatgactaccgagagagtgtcttcaagctcctgccccagcttacctacttggatggctatgaccgagaggaccaggaagcacctgactcagatgccgaggtggatggtgtggatgaagaggaggaggacgaagaaggagaagatgaggaagacgaggacgatgaggatggtgaagaagaggagtttgatgaagaagatgatgaagatgaagatgtagaaggggatgaggacgacgatgaagtcagtgaggaggaagagagaaacagatgatgaaggagaagatgattaagaccccagatgacctgcagaaacagaactgttcagtattggttggactgctcatggattttgtagctgtttaaaaaaaaaaaaaaggtagctgtgatacaaaccccaggacacccacccacccaaagagccaaagaatagttcctgtgacattccgccttccttccatgtagtccctcttggtaatctaccaccaagcttgtggacttcaccccaacaaaattgtaagcgttgttaggtttttgtgtaagattcttgctgtagcgtggatagctgtgattggtgagtcaaccgtctgtggctaccagttacactgagattgtaacagcatttttactttctgtacaacaaaaaagctttgtaaataaaatcttaacattttgggtctgttttttcatgctttgctttttaattattattattattttttttacattaggacattttatgtgacaactgccaaaaaagtatttttaagaatttaagcgaaataaacagttactctttggtaaagcctagttgtatgcttacatttttaaattatactctcattgtaagctcatgttaaaacaccaaagaactggtttatttggcatttttatattagtagttgttgaggggaattgcacaagtgtgtaggatctttgagcatttagatcaaatcctcattgataactgggagtaaatgaagcatactttaaaaaataacgttcaaaatggaatactctggggccctgaaaaccagtaaaatgttaggttcaagtattatgtgaattaagggaaagaagatagtgtaaagcaaaaggccttcaccagaatcccaagagatctgaattctagttctggctctgcccctgattttctgtgtgaccttgtgttgactctgggtcaccacccagtctggaaaattgaaggggtgtgaccaaatggcttctgaagtcacttgtagcactgatgttctgtgacccttgctgacaggaaggtctgaagagaaaaatgggctttccactagtctgaagcatgtagggtttgactgatgggtgaacacagtatggtttgttgccaagacaggcgtgaaaagggggaatgacatgtgaaaagcctcaccaagcagtgggtaggcactgcctgaggtcaactcaggttttccataagatggaaattttctctattcttacagatcttaaagggatttgagaaaggaggatattctgtctgtattcagtgattaaccgtttagcgaaaatagatgtatgactgcattatcaatacagttttttatagtggaagatttaaggattgtttcagtaaattttagcttatagctgctggaatgagtgaggtttttgatgcatgtaaatgcaatatgtaaaattggaatctaatttgaatttataacaagtcacagtctctatggagcccccaaatactgtactttaaaatcaaaatctcccatagactttaaaatggagtttcttttttgcaaagaaaatccaagaaaatttgatttctgattttacaggtattacacatcattttccccaaccataaggccattttggcaaaccttcaatacattgtaaaatggtttcttctgtagcctaagtgtgtccttaaggttttgcttatttgtcaaatatcaaacacagtaactttgagtgattatt

SEQ ID NO: 342978 - DNA, 1410 bp, Homo sapiens
gcggccgccgagccgagcagcgccgcgcggggccgagtggagccgagcagctgccgcgccgcgtcgccggtttaagcgcagtgcaggccgcggccgggggcggcggtagtgagcccagcgctgcgctccagcccccttttccctccatggtttctctccgctcccgtgagtaacttggctccgggggctccgctcgcctgcccgcacgccgcccgccacccaggaccgcgccgccggcctccgccgctagcaaacccttccgacggccctcgctgcgcaagccgggacgcctctcccccctccgcccccgccgcggaaagttaagtttgaagaggggggaagaggggaacatggacatgaagaggaggatccacctggagctgaggaaccggaccccggcagctgttcgagaacttgtcttggacaattgcaaatcaaatgatggaaaaattgagggcttaacagctgaatttgtgaacttagagttcctcagtttaataaatgtaggcttgatctcagtttcaaatctccccaagctgcctaaattgaaaaagcttgaactcagtgaaaatagaatctttggaggtctggacatgttagctgaaaaacttccaaatctcacacatctaaacttaagtggaaataaactgaaagatatcagcaccttggaacctttgaaaaagttagaatgtctgaaaagcctggacctctttaactgtgaggttaccaacctgaatgactaccgagagagtgtcttcaagctcctgccccagcttacctacttggatggctatgaccgagaggaccaggaagcacctgactcagatgccgaggtggatggtgtggatgaagaggaggaggacgaagaaggagaagatgaggaagacgaggacgatgaggatggtgaagaagaggagtttgatgaagaagatgatgaagatgaagatgtagaaggggatgaggacgacgatgaagtcagtgaggaggaagagagaaacagatgatgaaggagaagatgattaagaccccagatgacctgcagaaacagaactgttcagtattggttggactgctcatggattttgtagctgtttaaaaaaaaaaaaaaggtagctgtgatacaaaccccaggacacccacccacccaaagagccaaagaatagttcctgtgacattccgccttccttccatgtagtccctcttggtaatctaccaccaagcttgtggacttcaccccaacaaaattgtaagcgttgttaggtttttgtgtaagattcttgctgtagcgtggatagctgtgattggtgagtcaaccgtctgtggctaccagttacactgagattgtaacagcatttttactttctgtacaacaaaaaagctttgtaaataaaatcttaacattttgggtct

SEQ ID NO: 342979 - DNA, 1115 bp, Homo sapiens
gcggccgccgagccgagcagcgccgcgcggggccgagtggagccgagcagctgccgcgccgcgtcgccggtttaagcgcagtgcaggccgcggccgggggcggcggtagtgagcccagcgctgcgctccagcccccttttccctccatggtttctctccgctcccgtgagtaacttggctccgggggctccgctcgcctgcccgcacgccgcccgccacccaggaccgcgccgccggcctccgccgctagcaaacccttccgacggccctcgctgcgcaagccgggacgcctctcccccctccgcccccgccgcggaaagttaagtttgaagaggggggaagaggggaacatggacatgaagaggaggatccacctggagctgaggaaccggaccccggcagctgttcgagaacttgtcttggacaattgcaaatcaaatgatggaaaaattgagggcttaacagctgaatttgtgaacttagagttcctcagtttaataaatgtaggcttgatctcagtttcaaatctccccaagctgcctaaattgaaaaagcttgaactcagtgaaaatagaatctttggaggtctggacatgttagctgaaaaacttccaaatctcacacatctaaacttaagtggaaataaactgaaagatatcagcaccttggaacctttgaaaaagttagaatgtctgaaaagcctggacctctttaactgtgaggttaccaacctgaatgactaccgagagagtgtcttcaagctcctgccccagcttacctacttggatggctatgaccgagaggaccaggaagcacctgactcagatgccgaggtggatggtgtggatgaagaggaggaggacgaagaaggagaagatgaggaagacgaggacgatgaggatggtgaagaagaggagtttgatgaagaagatgatgaagatgaagatgtagaaggggatgaggacgacgatgaagtcagtgaggagaataataatttgtactttattaataagattaatattatgatgaagattaatatgtataatatattttattttatttttttatattataaattgtaaattgaattatgttttttatagtttttatttagc

SEQ ID NO: 342980 - DNA, 1355 bp, Homo sapiens
  misc_feature (6)..(8): n is a, c, g, or t
aaatannngtaggtagaggctggtgttaatcggccgaggggtccgggggctccgctcgcctgcccgcacgccgcccgccacccaggaccgcgccgccggcctccgccgctagcaaacccttccgacggccctcgctgcgcaagccgggacgcctctcccccctccgcccccgccgcggaaagttaagtttgaagaggggggaagaggggaacatggacatgaagaggaggatccacctggagctgaggaaccggaccccggcagctgttcgagaacttgtcttggacaattgcaaatcaaatgatggaaaaattgagggcttaacagctgaatttgtgaacttagagttcctcagtttaataaatgtaggcttgatctcagtttcaaatctccccaagctgcctaaattgaaaaagcttgaactcagtgaaaatagaatctttggaggtctggacatgttagctgaaaaacttccaaatctcacacatctaaacttaagtggaaataaactgaaagatatcagcaccttggaacctttgaaaaagttagaatgtctgaaaagcctggacctctttaactgtgaggttaccaacctgaatgactaccgagagagtgtcttcaagctcctgccccagcttacctacttggatggctatgaccgagaggaccaggaagcacctgactcagatgccgaggtggatggtgtggatgaagaggaggaggacgaagaaggagaagatgaggaagacgaggacgatgaggatggtgaagaagaggagtttgatgaagaagatgatgaagatgaagatgtagaaggggatgaggacgacgatgaagtcagtgaggaggaagaagaatttggacttgatgaagaagatgaagatgaggatgaggatgaagaggaggaagaaggtgggaaaggtgaaaagaggaagagagaaacagatgatgaaggagaagatgattaagaccccagatgacctgcagaaacagaactgttcagtattggttggactgctcatggattttgtagctgtttaaaaaaaaaaaaaaggtagctgtgatacaaaccccaggacacccacccacccaaagagccaaagaatagttcctgtgacattccgccttccttccatgtagtccctcttggtaatctaccaccaagcttgtggacttcaccccaacaaaattgtaagcgttgttaggtttttgtgtaagattcttgctgtagcgtggatagctgtgattggtgagtcaaccgtctgtggctaccagttacactgagattgtaacagcatttttactttctgtacaacaaaaaagctttgtaaataaaatcttaacattttgggtct

SEQ ID NO: 342981 - DNA, 1279 bp, Homo sapiens
gcggccgccgagccgagcagcgccgcgcggggccgagtggagccgagcagctgccgcgccgcgtcgccggtttaagcgcagtgcaggccgcggccgggggcggcggtagtgagcccagcgctgcgctccagcccccttttccctccatggtttctctccgctcccgtgagtaacttggctccgggggctccgctcgcctgcccgcacgccgcccgccacccaggaccgcgccgccggcctccgccgctagcaaacccttccgacggccctcgctgcgcaagccgggacgcctctcccccctccgcccccgccgcggaaagttaagtttgaagaggggggaagaggggaacatggacatgaagaggaggatccacctggagctgaggaaccggaccccggcagctgttcgagaacttgtcttggacaattgcaaatcaaatgatggaaaaattgagggcttaacagctgaatttgtgaacttagagttcctcagtttaataaatgtaggcttgatctcagtttcaaatctccccaagctgcctaaattgaaaaagcttgaactcagtgaaaatagaatctttggaggtctggacatgttagctgaaaaacttccaaatctcacacatctaaacttaagtggaaataaactgaaagatatcagcaccttggaacctttgaaaaagttagaatgtctgaaaagcctggacctctttaactgtgaggttaccaacctgaatgactaccgagagagtgtcttcaagctcctgccccagcttacctacttggatggctatgaccgagaggaccaggaagcacctgactcagatgccgaggtggatggtgtggatgaagaggaggaggacgaagaaggagaagatgaggaagacgaggacgatgaggatggtgaagaagaggagtttgatgaagaagcgaaagccaagactatgatgaagaatgctcagaagaagatgaatcggttggggaagaaaaggggaggcggatagacacgtgtttgatatgaagcccaagcacttgctgtctgggaagaggaaagctggtaaaaaggacaggagatagtatccgtttggttggcgtggcttcgctagagtgttgctgtatatttcctggttttggcacagtatggtttcatgaacattggagctctgtataaactgacaaaagacaaaataagtaaagcacttgttgctttgctgaaaaactatggttaaccctatataggtgtgggacaatcttgtcactgcataatattaccaaacat

SEQ ID NO: 342982 - DNA, 1234 bp, Homo sapiens
  misc_feature (65)..(65): n is a, c, g, or t
tccagtcggtcccagtttacggaactctcccctgagctcgcccgtcacaaagagcttcaacaggngagagtgttagacggaagaggggaacatggacatgaagaggaggatccacctggagctgaggaaccggaccccggcagctgttcgagaacttgtcttggacaattgcaaatcaaatgatggaaaaattgagggcttaacagctgaatttgtgaacttagagttcctcagtttaataaatgtaggcttgatctcagtttcaaatctccccaagctgcctaaattgaaaaagcttgaactcagtgaaaatagaatctttggaggtctggacatgttagctgaaaaacttccaaatctcacacatctaaacttaagtggaaataaactgaaagatatcagcaccttggaacctttgaaaaagttagaatgtctgaaaagcctggacctctttaactgtgaggttaccaacctgaatgactaccgagagagtgtcttcaagctcctgccccagcttacctacttggatggctatgaccgagaggaccaggaagcacctgactcagatgccgaggtggatggtgtggatgaagaggaggaggacgaagaaggagaagatgaggaagacgaggacgatgaggatggtgaagaagaggagtttgatgaagaagatgatgaagatgaagatgtagaaggggatgaggacgacgatgaagtcagtgaggaggaagaagaatttggacttgatgaagaagatgaagatgaggatgaggatgaagaggaggaagaaggtgggaaaggtgaaaagaggaagagagaaacagatgatgaaggagaagatgattaagaccccagatgacctgcagaaacagaactgttcagtattggttggactgctcatggattttgtagctgtttaaaaaaaaaaaaaaggtagctgtgatacaaaccccaggacacccacccacccaaagagccaaagaatagttcctgtgacattccgccttccttccatgtagtccctcttggtaatctaccaccaagcttgtggacttcaccccaacaaaattgtaagcgttgttaggtttttgtgtaagattcttgctgtagcgtggatagctgtgattggtgagtcaaccgtctgtggctaccagttacactgagattgtaacagcatttttactttctgtacaacaaaaaagctttgtaaataaaatcttaacattttgggtct

SEQ ID NO: 342983 - DNA, 1381 bp, Homo sapiens
agtgcaattgaataatgtcaagtcgcttatcaaaatagaggttgatagagaacagcatactgccctttcaagatcgtgaacttcctcatagaatttggctttctatctgtgcacattttaacttgcaggtttttgagagcattcactcgtcttttaactaccctaggcaggctttcaatgtatcctgttggtgtttctaccagaccatcaagtctatcttggataatgtgatagccgctgatccgcttaagggaggatccacctggagctgaggaaccggaccccggcagctgttcgagaacttgtcttggacaattgcaaatcaaatgatggaaaaattgagggcttaacagctgaatttgtgaacttagagttcctcagtttaataaatgtaggcttgatctcagtttcaaatctccccaagctgcctaaattgaaaaagcttgaactcagtgaaaatagaatctttggaggtctggacatgttagctgaaaaacttccaaatctcacacatctaaacttaagtggaaataaactgaaagatatcagcaccttggaacctttgaaaaagttagaatgtctgaaaagcctggacctctttaactgtgaggttaccaacctgaatgactaccgagagagtgtcttcaagctcctgccccagcttacctacttggatggctatgaccgagaggaccaggaagcacctgactcagatgccgaggtggatggtgtggatgaagaggaggaggacgaagaaggagaagatgaggaagacgaggacgatgaggatggtgaagaagaggagtttgatgaagaagatgatgaagatgaagatgtagaaggggatgaggacgacgatgaagtcagtgaggaggaagaagaatttggacttgatgaagaagatgaagatgaggatgaggatgaagaggaggaagaaggtgggaaaggtgaaaagaggaagagagaaacagatgatgaaggagaagatgattaagaccccagatgacctgcagaaacagaactgttcagtattggttggactgctcatggattttgtagctgtttaaaaaaaaaaaaaaggtagctgtgatacaaaccccaggacacccacccacccaaagagccaaagaatagttcctgtgacattccgccttccttccatgtagtccctcttggtaatctaccaccaagcttgtggacttcaccccaacaaaattgtaagcgttgttaggtttttgtgtaagattcttgctgtagcgtggatagctgtgattggtgagtcaaccgtctgtggctaccagttacactgagattgtaacagcatttttactttctgtacaacaaaaaagctttgtaaataaaatcttaacattttgggtct

SEQ ID NO: 342984 - DNA, 1076 bp, Homo sapiens
gcggccgccgagccgagcagcgccgcgcggggccgagtggagccgagcagctgccgcgccgcgtcgccggtttaagcgcagtgcaggccgcggccgggggcggcggtagtgagcccagcgctgcgctccagcccccttttccctccatggtttctctccgctcccgtgagtaacttggctccgggggctccgctcgcctgcccgcacgccgcccgccacccaggaccgcgccgccggcctccgccgctagcaaacccttccgacggccctcgctgcgcaagccgggacgcctctcccccctccgcccccgccgcggaaagttaagtttgaagaggggggaagaggggaacatggacatgaagaggaggatccacctggagctgaggaaccggaccccggcagctgttcgagaacttgtcttggacaattgcaaatcaaatgatggaaaaattgagggcttaacagctgaatttgtgaacttagagttcctcagtttaataaatgtaggcttgatctcagtttcaaatctccccaagctgcctaaattgaaaaagcttgaactcagtgaaaatagaatctttggaggtctggacatgttagctgaaaaacttccaaatctcacacatctaaacttaagtggaaataaactgaaagatatcagcaccttggaacctttgaaaaagttagaatgtctgaaaagcctggacctctttaactgtgaggttaccaacctgaatgactaccgagagagtgtcttcaagctcctgccccagcttacctacttggatggctatgaccgagaggaccaggaagcacctgactcagatgccgaggtggatggtgtggatgaagaggaggaggacgaaggtgagtaggctcagcatctggtgaacctgatgtctgcctttcaaagcctctgataaaagctattggatgttggccgggcgcagtggcacacaactgtaatcccagcactttgggtggccgaggcagggggcattgcttgagcccaggagtttgagactagcctgggcaacatggcaataccttgtttctacagaaaatagaaaaaaaaa

SEQ ID NO: 342985 - DNA, 889 bp, Homo sapiens
gcggccgcctactactactaaattcgcggccgcgtcgactaaactgaaagatatcagcaccttggaacctttgaaaaagttagaatgtctgaaaagcctggacctctttaactgtgaggttaccaacctgaatgactaccgagagagtgtcttcaagctcctgccccagcttacctacttggatggctatgaccgagaggaccaggaagcacctgactcagatgccgaggtggatggtgtggatgaagaggaggaggacgaagaaggagaagatgaggaagacgaggacgatgaggatggtgaagaagaggagtttgatgaagaagatgatgaagatgaagatgtagaaggggatgaggacgacgatgaagtcagtgaggaggaagaagaatttggacttgatgaagaagatgaagatgaggatgaggatgaagaggaggaagaaggtgggaaaggtgaaaagaggaagagagaaacagatgatgaaggagaagatgattaagaccccagatgacctgcagaaacagaactgttcagtattggttggactgctcatggattttgtagctgtttaaaaaaaaaaaaaaggtagctgtgatacaaaccccaggacacccacccacccaaagagccaaagaatagttcctgtgacattccgccttccttccatgtagtccctcttggtaatctaccaccaagcttgtggacttcaccccaacaaaattgtaagcgttgttaggtttttgtgtaagattcttgctgtagcgtggatagctgtgattggtgagtcaaccgtctgtggctaccagttacactgagattgtaacagcatttttactttctgtacaacaaaaaagctttgtaaataaaatcttaacattttgggtct

SEQ ID NO: 342986 - DNA, 978 bp, Homo sapiens
atcgagctcggtcccccggaagttgcccaattgaaaaagcttgaactcagtgaaaatagaatctttggaggtctggacatgttagctgaaaaacttccaaatctcacacatctaaacttaagtggaaataaactgaaagatatcagcaccttggaacctttgaaaaagttagaatgtctgaaaagcctggacctctttaactgtgaggttaccaacctgaatgactaccgagagagtgtcttcaagctcctgccccagcttacctacttggatggctatgaccgagaggaccaggaagcacctgactcagatgccgaggtggatggtgtggatgaagaggaggaggacgaagaaggagaagatgaggaagacgaggacgatgaggatggtgaagaagaggagtttgatgaagaagatgatgaagatgaagatgtagaaggggatgaggacgacgatgaagtcagtgaggaggaagaagaatttggacttgatgaagaagatgaagatgaggatgaggatgaagaggaggaagaaggtgggaaaggtgaaaagaggaagagagaaacagatgatgaaggagaagatgattaagaccccagatgacctgcagaaacagaactgttcagtattggttggactgctcatggattttgtagctgtttaaaaaaaaaaaaaaggtagctgtgatacaaaccccaggacacccacccacccaaagagccaaagaatagttcctgtgacattccgccttccttccatgtagtccctcttggtaatctaccaccaagcttgtggacttcaccccaacaaaattgtaagcgttgttaggtttttgtgtaagattcttgctgtagcgtggatagctgtgattggtgagtcaaccgtctgtggctaccagttacactgagattgtaacagcatttttactttctgtacaacaaaaaagctttgtaaataaaatcttaacattttgggtct

SEQ ID NO: 342987 - DNA, 967 bp, Homo sapiens
cggacgcgtgggtcgacccacgcgtccgcttgaactcagtgaaaatagaatctttggaggtctggacatgttagctgaaaaacttccaaatctcacacatctaaacttaagtggaaataaactgaaagatatcagcaccttggaacctttgaaaaagttagaatgtctgaaaagcctggacctctttaactgtgaggttaccaacctgaatgactaccgagagagtgtcttcaagctcctgccccagcttacctacttggatggctatgaccgagaggaccaggaagcacctgactcagatgccgaggtggatggtgtggatgaagaggaggaggacgaagaaggagaagatgaggaagacgaggacgatgaggatggtgaagaagaggagtttgatgaagaagatgatgaagatgaagatgtagaaggggatgaggacgacgatgaagtcagtgaggaggaagaagaatttggacttgatgaagaagatgaagatgaggatgaggatgaagaggaggaagaaggtgggaaaggtgaaaagaggaagagagaaacagatgatgaaggagaagatgattaagaccccagatgacctgcagaaacagaactgttcagtattggttggactgctcatggattttgtagctgtttaaaaaaaaaaaaaaggtagctgtgatacaaaccccaggacacccacccacccaaagagccaaagaatagttcctgtgacattccgccttccttccatgtagtccctcttggtaatctaccaccaagcttgtggacttcaccccaacaaaattgtaagcgttgttaggtttttgtgtaagattcttgctgtagcgtggatagctgtgattggtgagtcaaccgtctgtggctaccagttacactgagattgtaacagcatttttactttctgtacaacaaaaaagctttgtaaataaaatcttaacattttgggtct

SEQ ID NO: 342988 - DNA, 918 bp, Homo sapiens
ggaaattgaatatagagcctagaattttacctcttcaagagatggatttgttacttatattcctttggtttaggagttgtggtttttgatccttttcttcagaaaaagttagaatgtctgaaaagcctggacctctttaactgtgaggttaccaacctgaatgactaccgagagagtgtcttcaagctcctgccccagcttacctacttggatggctatgaccgagaggaccaggaagcacctgactcagatgccgaggtggatggtgtggatgaagaggaggaggacgaagaaggagaagatgaggaagacgaggacgatgaggatggtgaagaagaggagtttgatgaagaagatgatgaagatgaagatgtagaaggggatgaggacgacgatgaagtcagtgaggaggaagaagaatttggacttgatgaagaagatgaagatgaggatgaggatgaagaggaggaagaaggtgggaaaggtgaaaagaggaagagagaaacagatgatgaaggagaagatgattaagaccccagatgacctgcagaaacagaactgttcagtattggttggactgctcatggattttgtagctgtttaaaaaaaaaaaaaaggtagctgtgatacaaaccccaggacacccacccacccaaagagccaaagaatagttcctgtgacattccgccttccttccatgtagtccctcttggtaatctaccaccaagcttgtggacttcaccccaacaaaattgtaagcgttgttaggtttttgtgtaagattcttgctgtagcgtggatagctgtgattggtgagtcaaccgtctgtggctaccagttacactgagattgtaacagcatttttactttctgtacaacaaaaaagctttgtaaataaaatcttaacattttgggtct

SEQ ID NO: 342989 - DNA, 858 bp, Homo sapiens
  misc_feature (35)..(35): n is a, c, g, or t
  misc_feature (37)..(37): n is a, c, g, or t
gtgatcgatctgagaggatcccctcagcacttggnanctttgaaaaagttagaatgtctgaaaagcctggacctctttaactgtgaggttaccaacctgaatgactaccgagagagtgtcttcaagctcctgccccagcttacctacttggatggctatgaccgagaggaccaggaagcacctgactcagatgccgaggtggatggtgtggatgaagaggaggaggacgaagaaggagaagatgaggaagacgaggacgatgaggatggtgaagaagaggagtttgatgaagaagatgatgaagatgaagatgtagaaggggatgaggacgacgatgaagtcagtgaggaggaagaagaatttggacttgatgaagaagatgaagatgaggatgaggatgaagaggaggaagaaggtgggaaaggtgaaaagaggaagagagaaacagatgatgaaggagaagatgattaagaccccagatgacctgcagaaacagaactgttcagtattggttggactgctcatggattttgtagctgtttaaaaaaaaaaaaaaggtagctgtgatacaaaccccaggacacccacccacccaaagagccaaagaatagttcctgtgacattccgccttccttccatgtagtccctcttggtaatctaccaccaagcttgtggacttcaccccaacaaaattgtaagcgttgttaggtttttgtgtaagattcttgctgtagcgtggatagctgtgattggtgagtcaaccgtctgtggctaccagttacactgagattgtaacagcatttttactttctgtacaacaaaaaagctttgtaaataaaatcttaacattttgggtct

SEQ ID NO: 342990 - DNA, 1203 bp, Homo sapiens
tgacaaccttacaggctaggtacgaggcctgggttgtggagccgagcagctgccgcgccgcgtcgccggtttaagcgcagtgcaggccgcggccgggggcggcggtagtgagcccagttaccaacctgaatgactactgaggaaccggaccccggcagctgttcgagaacttgtcttggacaattgcaaatcaaatgatggaaaaattgagggcttaacagctgaatttgtgaacttagagttcctcagtttaataaatgtaggcttgatctcagtttcaaatctccccaagctgcctaaattgaaaaagcttgaactcagtgaaaatagaatctttggaggtctggacatgttagctgaaaaacttccaaatctcacacatctaaacttaagtggaaataaactgaaagatatcagcaccttggaacctttgaaaaagttagaatgtctgaaaagcctggacctctttaactgtgaggttaccaacctgaatgactaccgagagagtgtcttgaccaggaagcacctgactcagatgccgaggtggatggtgtggatgaagaggaggaggacgaagaaggagaagatgaggaagacgaggacgatgaggatggtgaagaagaggagtttgatgaagaagatgatgaagatgaagatgtagaaggggatgaggacgacgatgaagtcagtgaggaggaagaagaatttggacttgatgaagaagatgaagatgaggatgaggatgaagaggaggaagaaggtgggaaaggtgaaaagaggaagagagaaacagatgatgaaggagaagatgattaagaccccagatgacctgcagaaacagaactgttcagtattggttggactgctcatggattttgtagctgtttaaaaaaaaaaaaaaggtagctgtgatacaaaccccaggacacccacccacccaaagagccaaagaatagttcctgtgacattccgccttccttccatgtagtccctcttggtaatctaccaccaagcttgtggacttcaccccaacaaaattgtaagcgttgttaggtttttgtgtaagattcttgctgtagcgtggatagctgtgattggtgagtcaaccgtctgtggctaccagttacactgagattgtaacagcatttttactttctgtacaacaaaaaagctttgtaaataaaatcttaacattttgggtct

SEQ ID NO: 342991 - DNA, 791 bp, Homo sapiens
ccacgcgtcggccgaggtggatggtgtggatgaagaggaactctaagttcacaaattcagctgttaagccctcaatttttccatcatttgatttgcaattgtccaagacaagttctcgatcagatgccgaggtggatggtgtggatgaagaggaggaggacgaagaaggagaagatgaggaagacgaggacgatgaggatggtgaagaagaggagtttgatgaagaagatgatgaagatgaagatgtagaaggggatgaggacgacgatgaagtcagtgaggaggaagaagaatttggacttgatgaagaagatgaagatgaggatgaggatgaagaggaggaagaaggtgggaaaggtgaaaagaggaagagagaaacagatgatgaaggagaagatgattaagaccccagatgacctgcagaaacagaactgttcagtattggttggactgctcatggattttgtagctgtttaaaaaaaaaaaaaaggtagctgtgatacaaaccccaggacacccacccacccaaagagccaaagaatagttcctgtgacattccgccttccttccatgtagtccctcttggtaatctaccaccaagcttgtggacttcaccccaacaaaattgtaagcgttgttaggtttttgtgtaagattcttgctgtagcgtggatagctgtgattggtgagtcaaccgtctgtggctaccagttacactgagattgtaacagcatttttactttctgtacaacaaaaaagctttgtaaataaaatcttaacattttgggtct

SEQ ID NO: 342992 - DNA, 947 bp, Homo sapiens
ggtcatagctgatcttattttattcctgcatacccttaccttcttccccactccatataattttgaagcaaatcttagccattgtatcatttcatcagcgagaattatagtgtttgtcttatctaccaggacttctagctctctgattttatgggactctatcggacaaagggactgagctgtagcacatagtagaaagaaagtgactgcagttcgtggccttacagcatttgttctgtgagccagcccacagatcctcaacactttgtcccctgtggagcgtcgaggatatttaatgaatcccttttggactatttttagaaggagaagatgaggaagacgaggacgatgaggatggtgaagaagaggagtttgatgaagaagatgatgaagatgaagatgtagaaggggatgaggacgacgatgaagtcagtgaggaggaagaagaatttggacttgatgaagaagatgaagatgaggatgaggatgaagaggaggaagaaggtgggaaaggtgaaaagaggaagagagaaacagatgatgaaggagaagatgattaagaccccagatgacctgcagaaacagaactgttcagtattggttggactgctcatggattttgtagctgtttaaaaaaaaaaaaaaggtagctgtgatacaaaccccaggacacccacccacccaaagagccaaagaatagttcctgtgacattccgccttccttccatgtagtccctcttggtaatctaccaccaagcttgtggacttcaccccaacaaaattgtaagcgttgttaggtttttgtgtaagattcttgctgtagcgtggatagctgtgattggtgagtcaaccgtctgtggctaccagttacactgagattgtaacagcatttttactttctgtacaacaaaaaagctttgtaaataaaatcttaacattttgggtct

SEQ ID NO: 342993 - DNA, 593 bp, Homo sapiens
gcacgagtgccggattattcggcacgagagatgatgaagatgaagatgtagaaggggatgaggacgacgatgaagtcagtgaggaggaagaagaatttggacttgatgaagaagatgaagatgaggatgaggatgaagaggaggaagaaggtgggaaaggtgaaaagaggaagagagaaacagatgatgaaggagaagatgattaagaccccagatgacctgcagaaacagaactgttcagtattggttggactgctcatggattttgtagctgtttaaaaaaaaaaaaaaggtagctgtgatacaaaccccaggacacccacccacccaaagagccaaagaatagttcctgtgacattccgccttccttccatgtagtccctcttggtaatctaccaccaagcttgtggacttcaccccaacaaaattgtaagcgttgttaggtttttgtgtaagattcttgctgtagcgtggatagctgtgattggtgagtcaaccgtctgtggctaccagttacactgagattgtaacagcatttttactttctgtacaacaaaaaagctttgtaaataaaatcttaacattttgggtct

SEQ ID NO: 342994 - DNA, 825 bp, Homo sapiens
caacgatggtcctcagctctgacggctgatccctcaaagagtgatggaccagcacaaacttaccaggaccagtgggaggaccggatccaggtgtggcatgcggaacaccgtgggatgctcaaagataatgctatgttggaatacctgaagattgctcaggacctggaaatgtatggaatcaactatttcgagataaaaaacaagaaaggaacagacctttggcttggagttgatgcccttggactgaatatttatgagaaagatgatgaagatgaagatgtagaaggggatgaggacgacgatgaagtcagtgaggaggaagaagaatttggacttgatgaagaagatgaagatgaggatgaggatgaagaggaggaagaaggtgggaaaggtgaaaagaggaagagagaaacagatgatgaaggagaagatgattaagaccccagatgacctgcagaaacagaactgttcagtattggttggactgctcatggattttgtagctgtttaaaaaaaaaaaaaaggtagctgtgatacaaaccccaggacacccacccacccaaagagccaaagaatagttcctgtgacattccgccttccttccatgtagtccctcttggtaatctaccaccaagcttgtggacttcaccccaacaaaattgtaagcgttgttaggtttttgtgtaagattcttgctgtagcgtggatagctgtgattggtgagtcaaccgtctgtggctaccagttacactgagattgtaacagcatttttactttctgtacaacaaaaaagctttgtaaataaaatcttaacattttgggtct

SEQ ID NO: 342995 - DNA, 968 bp, Homo sapiens
gcggccgccgagccgagcagcgccgcgcggggccgagtggagccgagcagctgccgcgccgcgtcgccggtttaagcgcagtgcaggccgcggccgggggcggcggtagtgagcccagcgctgcgctccagcccccttttccctccatggtttctctccgctcccgtgagtaacttggctccgggggctccgctcgcctgcccgcacgccgcccgccacccaggaccgcgccgccggcctccgccgctagcaaacccttccgacggccctcgctgcgcaagccgggacgcctctcccccctccgcccccgccgcggaaagttaagtttgaagaggggggaagaggggaacatggacatgaagaggaggatccacctggagctgaggaaccggaccccggcagctgttcgagaacttgtcttggacaattgcaaatcaaatgatggaaaaattgagggcttaacagctgaatttgtgaacttagagttcctcagtttaataaatgtaggcttgatctcagtttcaaatctccccaagctgcctaaattgaaaaagcttgaactcagtgaaaatagaatctttggaggtctggacatgttagctgaaaaacttccaaatctcacacatctaaacttaagtggaaataaactgaaagatatcagcaccttggaacctttgaaaaagttagaatgtctgaaaagcctggacctctttaactgtgaggttaccaacctgaatgactaccgagagagtgtctttcttggtaatctaccaccaagcttgtggacttcaccccaacaaaattgtaagcgttgttaggtttttgtgtaagattcttgctgtagcgtggatagctgtgattggtgagtcaaccgtctgtggctaccagttacactgagattgtaacagcatttttactttctgtacaacaaaaaagctttgtaaataaaatcttaacattttgggtct

SEQ ID NO: 342996 - DNA, 2102 bp, Homo sapiens
tgacaaccttacaggctaggtacgaggcctgggttgggtttctctccgctcccgtgagtaacttggctccgggggctccgctcgcctgcccgcacgccgcccgccacccaggaccgcgccgccggcctccgccgctagcaaacccttccgacggccctcgctgcgcaagccgggacgcctctcccccctccgcccccgccgcggaaagttaagtttgaagaggggggaagaggggaacatggacatgaagaggaggatccacctggagctgaggaaccggaccccggcagctgttcgagaacttgtcttggacaattgcaaatcaaatgatggaaaaattgagggcttaacagctgaatttgtgaacttagagttcctcagtttaataaatgtaggcttgatctcagtttcaaatctccccaagctgcctaaattgaaaaagcttgaactcagtgaaaatagaatctttggaggtctggacatgttagctgaaaaacttccaaatctcacacatctaaacttaagtggaaataaactgaaagatatcagcaccttggaacctttgccaaagaatagttcctgtgacattccgccttccttccatgtagtccctcttggtaatctaccaccaagcttgtggacttcaccccaacaaaattgtaagcgttgttaggtttttgtgtaagattcttgctgtagcgtggatagctgtgattggtgagtcaaccgtctgtggctaccagttacactgagattgtaacagcatttttactttctgtacaacaaaaaagctttgtaaataaaatcttaacattttgggtctgttttttcatgctttgctttttaattattattattattttttttacattaggacattttatgtgacaactgccaaaaaagtatttttaagaatttaagcgaaataaacagttactctttggtaaagcctagttgtatgcttacatttttaaattatactctcattgtaagctcatgttaaaacaccaaagaactggtttatttggcatttttatattagtagttgttgaggggaattgcacaagtgtgtaggatctttgagcatttagatcaaatcctcattgataactgggagtaaatgaagcatactttaaaaaataacgttcaaaatggaatactctggggccctgaaaaccagtaaaatgttaggttcaagtattatgtgaattaagggaaagaagatagtgtaaagcaaaaggccttcaccagaatcccaagagatctgaattctagttctggctctgcccctgattttctgtgtgaccttgtgttgactctgggtcaccacccagtctggaaaattgaaggggtgtgaccaaatggcttctgaagtcacttgtagcactgatgttctgtgacccttgctgacaggaaggtctgaagagaaaaatgggctttccactagtctgaagcatgtagggtttgactgatgggtgaacacagtatggtttgttgccaagacaggcgtgaaaagggggaatgacatgtgaaaagcctcaccaagcagtgggtaggcactgcctgaggtcaactcaggttttccataagatggaaattttctctattcttacagatcttaaagggatttgagaaaggaggatattctgtctgtattcagtgattaaccgtttagcgaaaatagatgtatgactgcattatcaatacagttttttatagtggaagatttaaggattgtttcagtaaattttagcttatagctgctggaatgagtgaggtttttgatgcatgtaaatgcaatatgtaaaattggaatctaatttgaatttataacaagtcacagtctctatggagcccccaaatactgtactttaaaatcaaaatctcccatagactttaaaatggagtttcttttttgcaaagaaaatccaagaaaatttgatttctgattttacaggtattacacatcattttccccaaccataaggccattttggcaaaccttcaatacattgtaaaatggtttcttctgtagcctaagtgtgtccttaaggttttgcttatttgtcaaatatcaaacacagtaactttgagtgattatt

SEQ ID NO: 342997 - DNA, 2660 bp, Homo sapiens
tgacaaccttacaggctaggtacgaggcctgggttgggtttctctccgctcccgtgagtaacttggctccgggggctccgctcgcctgcccgcacgccgcccgccacccaggaccgcgccgccggcctccgccgctagcaaacccttccgacggccctcgctgcgcaagccgggacgcctctcccccctccgcccccgccgcggaaagttaagtttgaagaggggggaagaggggaacatggacatgaagaggaggatccacctggagctgaggaaccggaccccggcagctgttcgagaacttgtcttggacaattgcaaatcaaatgatggaaaaattgagggcttaacagctgaatttgtgaacttagagttcctcagtttaataaatgtaggcttgatctcagtttcaaatctccccaagctgcctaaattgaaaaagcttgaactcagtgaaaatagaatctttggaggtctggacatgttagctgaaaaacttccaaatctcacacatctaaacttaagtggaaataaactgaaagatatcagcaccttggaacctttgaaaaagttagaatgtctgaaaagcctggacctctttaactgtgaggttaccaacctgaatgactaccgagagagtgtcttcaagctcctgccccagcttacctacttggatggctatgaccgagaggaccaggaagcacctgactcagatgccgaggtggatggtgtggatgaagaggaggaggacgaagaaggagaagatgaggaagacgaggacgatgaggatggtgaagaagaggagtttgatgaagaagatgatgaagatgaagatgtagaaggggatgaggacgacgatgaagtcagtgaggaggaagaagaatttggacttgatgaagaagatgaagatgaggatgaggatgaagaggaggaagaaggtgggaaaggtgaaaagaggaagagagaaacagatgatgaaggagaagatgattaagaccccagatgacctgcagaaacagaactgttcagtattggttggactgctcatggattttgtagctgtttaaaaaaaaaaaaaaggtagctgtgatacaaaccccaggacacccacccacccaaagagccaaagaatagttcctgtgacattccgccttccttccatgtagtccctcttggtaatctaccaccaagcttgtggacttcaccccaacaaaattgtaagcgttgttaggtttttgtgtaagattcttgctgtagcgtggatagctgtgattggtgagtcaaccgtctgtggctaccagttacactgagattgtaacagcatttttactttctgtacaacaaaaaagctttgtaaataaaatcttaacattttgggtctgttttttcatgctttgctttttaattattattattattttttttacattaggacattttatgtgacaactgccaaaaaagtatttttaagaatttaagcgaaataaacagttactctttggtaaagcctagttgtatgcttacatttttaaattatactctcattgtaagctcatgttaaaacaccaaagaactggtttatttggcatttttatattagtagttgttgaggggaattgcacaagtgtgtaggatctttgagcatttagatcaaatcctcattgataactgggagtaaatgaagcatactttaaaaaataacgttcaaaatggaatactctggggccctgaaaaccagtaaaatgttaggttcaagtattatgtgaattaagggaaagaagatagtgtaaagcaaaaggccttcaccagaatcccaagagatctgaattctagttctggctctgcccctgattttctgtgtgaccttgtgttgactctgggtcaccacccagtctggaaaattgaaggggtgtgaccaaatggcttctgaagtcacttgtagcactgatgttctgtgacccttgctgacaggaaggtctgaagagaaaaatgggctttccactagtctgaagcatgtagggtttgactgatgggtgaacacagtatggtttgttgccaagacaggcgtgaaaagggggaatgacatgtgaaaagcctcaccaagcagtgggtaggcactgcctgaggtcaactcaggttttccataagatggaaattttctctattcttacagatcttaaagggatttgagaaaggaggatattctgtctgtattcagtgattaaccgtttagcgaaaatagatgtatgactgcattatcaatacagttttttatagtggaagatttaaggattgtttcagtaaattttagcttatagctgctggaatgagtgaggtttttgatgcatgtaaatgcaatatgtaaaattggaatctaatttgaatttataacaagtcacagtctctatggagcccccaaatactgtactttaaaatcaaaatctcccatagactttaaaatggagtttcttttttgcaaagaaaatccaagaaaatttgatttctgattttacaggtattacacatcattttccccaaccataaggccattttggcaaaccttcaatacattgtaaaatggtttcttctgtagcctaagtgtgtccttaaggttttgcttatttgtcaaatatcaaacacagtaactttgagtgattatt

SEQ ID NO: 342998 - DNA, 499 bp, Homo sapiens
cggacgcgtgggtcgacccacgcgtccgcttgaactcagtgaaaatagaatctttggaggtctggacatgttagctgaaaaacttccaaatctcacacatctaaacttaagtggaaataaactgaaagatatcagcaccttggaacctttgaaaaagttagaatgtctgaaaagcctggacctctttaactgtgaggttaccaacctgaatgactaccgagagagtgtcttcaagctcctgccccagcttacctacttggatggctatgaccgagaggaccaggaagcacctgactcagatgccgaggtggatggtgtggatgaagaggaggaggacgaagaaggagaagaaaaggaagaagaggaagaagaaaggaaagaaagaaaaagaagatagaaggaaagaagatagaagaagaaaagaagagaagaagaataaggaacaagaagaaagaagaaagaagaaaaggaagaagaggaagaagaaagaaaaaaaaaa

SEQ ID NO: 342999 - DNA, 1386 bp, Homo sapiens
  misc_feature (6)..(8): n is a, c, g, or t
aaatannngtaggtagaggctggtgttaatcggccgaggggggtttctctccgctcccgtgagtaacttggctccgggggctccgctcgcctgcccgcacgccgcccgccacccaggaccgcgccgccggcctccgccgctagcaaacccttccgacggccctcgctgcgcaagccgggacgcctctcccccctccgcccccgccgcggaaagttaagtttgaagaggggggaagaggggaacatggacatgaagaggaggatccacctggagctgaggaaccggaccccggcagctgttcgagaacttgtcttggacaattgcaaatcaaatgatggaaaaattgagggcttaacagctgaatttgtgaacttagagttcctcagtttaataaatgtaggcttgatctcagtttcaaatctccccaagctgcctaaattgaaaaagcttgaactcagtgaaaatagaatctttggaggtctggacatgttagctgaaaaacttccaaatctcacacatctaaacttaagtggaaataaactgaaagatatcagcaccttggaacctttgaaaaagttagaatgtctgaaaagcctggacctctttaactgtgaggttaccaacctgaatgactaccgagagagtgtcttcaagctcctgccccagcttacctacttggatggctatgaccgagaggaccaggaagcacctgactcagatgccgaggtggatggtgtggatgaagaggaggaggacgaagaaggagaagatgaggaagacgaggacgatgaggatggtgaagaagaggagtttgatgaagaagatgatgaagatgaagatgtagaaggggatgaggacgacgatgaagtcagtgaggaggaagaagaatttggacttgatgaagaagatgaagatgaggatgaggatgaagaggaggaagaaggtgggaaaggtgaaaagaggaagagagaaacagatgatgaaggagaagatgattaagaccccagatgacctgcagaaacagaactgttcagtattggttggactgctcatggattttgtagctgtttaaaaaaaaaaaaaaggtagctgtgatacaaaccccaggacacccacccacccaaagagccaaagaatagttcctgtgacattccgccttccttccatgtagtccctcttggtaatctaccaccaagcttgtggacttcaccccaacaaaattgtaagcgttgttaggtttttgtgtaagattcttgctgtagcgtggatagctgtgattggtgagtcaaccgtctgtggctaccagttacactgagattgtaacagcatttttactttctgtacaacaaaaaagctttgtaaataaaatcttaacattttgggtct

SEQ ID NO: 343000 - DNA, 1373 bp, Homo sapiens
agctaggctagtacgaggccgggtgttaggtttctctccgctcccgtgagtaacttggctccgggggctccgctcgcctgcccgcacgccgcccgccacccaggaccgcgccgccggcctccgccgctagcaaacccttccgacggccctcgctgcgcaagccgggacgcctctcccccctccgcccccgccgcggaaagttaagtttgaagaggggggaagaggggaacatggacatgaagaggaggatccacctggagctgaggaaccggaccccggcagctgttcgagaacttgtcttggacaattgcaaatcaaatgatggaaaaattgagggcttaacagctgaatttgtgaacttagagttcctcagtttaataaatgtaggcttgatctcagtttcaaatctccccaagctgcctaaattgaaaaagcttgaactcagtgaaaatagaatctttggaggtctggacatgttagctgaaaaacttccaaatctcacacatctaaacttaagtggaaataaactgaaagatatcagcaccttggaacctttgaaaaagttagaatgtctgaaaagcctggacctctttaactgtgaggttaccaacctgaatgactaccgagagagtgtcttcaagctcctgccccagcttacctacttggatggctatgaccgagaggaccaggaagcacctgactcagatgccgaggtggatggtgtggatgaagaggaggaggacgaagaaggagaagatgaggaagacgaggacgatgaggatggtgaagaagaggagtttgatgaagaagatgatgaagatgaagatgtagaaggggatgaggacgacgatgaagtcagtgaggaggaagaagaatttggacttgatgaagaagatgaagatgaggatgaggatgaagaggaggaagaaggtgggaaaggtgaaaagaggaagagagaaacagatgatgaaggagaagatgattaagaccccagatgacctgcagaaacagaactgttcagtattggttggactgctcatggattttgtagctgtttaaaaaaaaaaaaaaggtagctgtgatacaaaccccaggacacccacccacccaaagagccaaagaatagttcctgtgacattccgccttccttccatgtagtccctcttggtaatctaccaccaagcttgtggacttcaccccaacaaaattgtaagcgttgttaggtttttgtgtaagattcttgctgtagcgtggatagctgtgattggtgagtcaaccgtctgtggctaccagttacactgagattgtaacagcatttttactttctgtacaacaaaaaagctttgtaaataaaatcttaacattttgggtct

SEQ ID NO: 343001 - DNA, 2092 bp, Homo sapiens
gcggccgccgagccgagcagcgccgcgcggggccgagtggagccgagcagctgccgcgccgcgtcgccggtttaagcgcagtgcaggccgcggccgggggcggcggtagtgagcccagcgctgcgctccagcccccttttccctccatggtttctctccgctcccgtgagtaacttggctccgggggctccgctcgcctgcccgcacgccgcccgccacccaggaccgcgccgccggcctccgccgctagcaaacccttccgacggccctcgctgcgcaagccgggacgcctctcccccctccgcccccgccgcggaaagttaagtttgaagaggggggaagaggggaacatggacatgaagaggaggatccacctggagctgaggaaccggaccccggcagctgttcgagaacttgtcttggacaattgcaaatcaaatgatggaaaaattgagggcttaacagctgaatttgtgaacttagagttcctcagtttaataaatgtaggcttgatctcagtttcaaatctccccaagctgcctaaattgaaaaagcttgaactcagtgaaaatagaatctttggaggtctggacatgttagctgaaaaacttccaaatctcacacatctaaacttaagtggaaataaactgaaagatatcagcaccttggaacctttgaaaaagttagaatgtctgaaaagcctggacctctttaactgtgaggttaccaacctgaatgactaccgagagagtgtcttcaagctcctgccccagcttacctacttggatggctatgaccgagaggaccaggaagcacctgactcagatgccgaggtggatggtgtggatgaagaggaggaggacgaagaaggagaagatgaggaagacgaggacgatgaggatggtgaagaagaggagtttgatgaagaagatgatgaagatgaagatgtagaaggggatgaggacgacgatgaagtcagtgaggaggaagaagaatttggacttgatgaagaagatgaagatgaggatgaggatgaagaggaggaagaaggtgggaaaggtgaaaagaggaagagagaaacagatgatgaaggagaagatgattaagaccccagatgacctgcagaaacagaactgttcagtattggttggactgctcatggattttgtagctgtttaaaaaaaaaaaaaaggtagctgtgatacaaaccccaggacacccacccacccaaagagccaaagaatagttcctgtgacattccgccttccttccatgtagtccctcttggtaatctaccaccaagcttgtggacttcaccccaacaaaattgtaagcgttgttaggtttttgtgtaagattcttgctgtagcgtggatagctgtgattggtgagtcaaccgtctgtggctaccagttacactgagattgtaacagcatttttactttctgtacaacaaaaaagctttgtaaataaaatcttaacattttgggtctaaaaaaacaaaaaaaaaacaacaaacaaacaacaaaaaaaaaaaaaaaaaacaaacaaaaacacaaaaaaaaaaaaaacaaaaacaacaaacacaaacaaaaaaacaaaaaaaacacaaacacaacagcacaagaaacaaaagcaaaacacaaagaaaagacgagctgggcgctgcgcgcgcgcccgagacagaggaaagagagagacgacccaggcaaaggagaggggagaggcgagcgagagagaacagagaaagacagagacaaagaggggcggcagacatggggcaagggacagaggtgagagagcgagcgcgctccgtggcacgcaccaagcatggtcggcgggggacgacatgcagcacacagcgaaagaacagacaaaacgcgcgaggcggccaggcagaagccagtagacggagcagaggtggcgcacaacaaacaacagaacgaggaaggcgaggggcgcgccaagagacagtagcgagacacagagagcggggggcacgacatagaagaaaacgagacgacgcccagagggggggaagaggcagaaagaaataaagcagcagcaggcgcggcagcccggggggggggac

SEQ ID NO: 343002 - DNA, 2607 bp, Homo sapiens
gcggccgccgagccgagcagcgccgcgcggggccgagtggagccgagcagctgccgcgccgcgtcgccggtttaagcgcagtgcaggccgcggccgggggcggcggtagtgagcccagcgctgcgctccagcccccttttccctccatggtttctctccgctcccgtgagtaacttggctccgggggctccgctcgcctgcccgcacgccgcccgccacccaggaccgcgccgccggcctccgccgctagcaaacccttccgacggccctcgctgcgcaagccgggacgcctctcccccctccgcccccgccgcggaaagttaagtttgaagaggggggaagaggggaacatggacatgaagaggaggatccacctggagctgaggaaccggaccccggcagctgttcgagaacttgtcttggacaattgcaaatcaaatgatggaaaaattgagggcttaacagctgaatttgtgaacttagagttcctcagtttaataaatgtaggcttgatctcagtttcaaatctccccaagctgcctaaattgaaaaagcttgaactcagtgaaaatagaatctttggaggtctggacatgttagctgaaaaacttccaaatctcacacatctaaacttaagtggaaataaactgaaagatatcagcaccttggaacctttgaaaaagttagaatgtctgaaaagcctggacctctttaactgtgaggttaccaacctgaatgactaccgagagagtgtcttcaagctcctgccccagcttacctacttggatggctatgaccgagaggaccaggaagcacctgactcagatgccgaggtggatggtgtggatgaagaggaggaggacgaagaaggagaagatgaggaagacgaggacgatgaggatggtgaagaagaggagtttgatgaagaagaagatgattaagaccccagatgacctgcagaaacagaactgttcagtattggttggactgctcatggattttgtagctgtttaaaaaaaaaaaaaaggtagctgtgatacaaaccccaggacacccacccacccaaagagccaaagaatagttcctgtgacattccgccttccttccatgtagtccctcttggtaatctaccaccaagcttgtggacttcaccccaacaaaattgtaagcgttgttaggtttttgtgtaagattcttgctgtagcgtggatagctgtgattggtgagtcaaccgtctgtggctaccagttacactgagattgtaacagcatttttactttctgtacaacaaaaaagctttgtaaataaaatcttaacattttgggtctgttttttcatgctttgctttttaattattattattattttttttacattaggacattttatgtgacaactgccaaaaaagtatttttaagaatttaagcgaaataaacagttactctttggtaaagcctagttgtatgcttacatttttaaattatactctcattgtaagctcatgttaaaacaccaaagaactggtttatttggcatttttatattagtagttgttgaggggaattgcacaagtgtgtaggatctttgagcatttagatcaaatcctcattgataactgggagtaaatgaagcatactttaaaaaataacgttcaaaatggaatactctggggccctgaaaaccagtaaaatgttaggttcaagtattatgtgaattaagggaaagaagatagtgtaaagcaaaaggccttcaccagaatcccaagagatctgaattctagttctggctctgcccctgattttctgtgtgaccttgtgttgactctgggtcaccacccagtctggaaaattgaaggggtgtgaccaaatggcttctgaagtcacttgtagcactgatgttctgtgacccttgctgacaggaaggtctgaagagaaaaatgggctttccactagtctgaagcatgtagggtttgactgatgggtgaacacagtatggtttgttgccaagacaggcgtgaaaagggggaatgacatgtgaaaagcctcaccaagcagtgggtaggcactgcctgaggtcaactcaggttttccataagatggaaattttctctattcttacagatcttaaagggatttgagaaaggaggatattctgtctgtattcagtgattaaccgtttagcgaaaatagatgtatgactgcattatcaatacagttttttatagtggaagatttaaggattgtttcagtaaattttagcttatagctgctggaatgagtgaggtttttgatgcatgtaaatgcaatatgtaaaattggaatctaatttgaatttataacaagtcacagtctctatggagcccccaaatactgtactttaaaatcaaaatctcccatagactttaaaatggagtttcttttttgcaaagaaaatccaagaaaatttgatttctgattttacaggtattacacatcattttccccaaccataaggccattttggcaaaccttcaatacattgtaaaatggtttcttctgtagcctaagtgtgtccttaaggttttgcttatttgtcaaatatcaaacacagtaactttgagtgattatt

SEQ ID NO: 343003 - DNA, 1100 bp, Homo sapiens
gcggccgccgagccgagcagcgccgcgcggggccgagtggagccgagcagctgccgcgccgcgtcgccggtttaagcgcagtgcaggccgcggccgggggcggcggtagtgagcccagcgctgcgctccagcccccttttccctccatggtttctctccgctcccgtgagtaacttggctccgggggctccgctcgcctgcccgcacgccgcccgccacccaggaccgcgccgccggcctccgccgctagcaaacccttccgacggccctcgctgcgcaagccgggacgcctctcccccctccgcccccgccgcggaaagttaagtttgaagaggggggaagaggggaacatggacatgaagaggaggatccacctggagctgaggaaccggaccccggcagctgttcgagaacttgtcttggacaattgcaaatcaaatgatggaaaaattgagggcttaacagctgaatttgtgaacttagagttcctcagtttaataaatgtaggcttgatctcagtttcaaatctccccaagctgcctaaattgaaaaagcttgaactcagtgaaaatagaatctttggaggtctggacatgttagctgaaaaacttccaaatctcacacatctaaacttaagtggaaataaactgaaagatatcagcaccttggaacctttgaaaaagttagaatgtctgaaaagcctggacctctttaactgtgaggttaccaacctgaatgactaccgagagagtgtcttcaagctcctgccccagcttacctacttggatggctatgaccgagaggaccaggaagcacctgactcagatgccgaggtggatggtgtggatgaagaggaggaggacgaagaaggagaagatgaggaagacgaggacgatgaggatggtgaagaagaggagtttgatgaagaagatgatgaagatgaagatgtagaaggggatgaggacgacgatgaagtcagtgaggagagaagaagaatttgggcttgatgaagacgatgaagattaggattaggattaagaggacgaagaatgtgggaatcgtgaaacgaggaagagtgccgttgatgaacgaggattttt

SEQ ID NO: 343004 - DNA, 1116 bp, Homo sapiens
gcggccgccgagccgagcagcgccgcgcggggccgagtggagccgagcagctgccgcgccgcgtcgccggtttaagcgcagtgcaggccgcggccgggggcggcggtagtgagcccagcgctgcgctccagcccccttttccctccatggtttctctccgctcccgtgagtaacttggctccgggggctccgctcgcctgcccgcacgccgcccgccacccaggaccgcgccgccggcctccgccgctagcaaacccttccgacggccctcgctgcgcaagccgggacgcctctcccccctccgcccccgccgcggaaagttaagtttgaagaggggggaagaggggaacatggacatgaagaggaggatccacctggagctgaggaaccggaccccggcagctgttcgagaacttgtcttggacaattgcaaatcaaatgatggaaaaattgagggcttaacagctgaatttgtgaacttagagttcctcagtttaataaatgtaggcttgatctcagtttcaaatctccccaagctgcctaaattgaaaaagcttgaactcagtgaaaatagaatctttggaggtctggacatgttagctgaaaaacttccaaatctcacacatctaaacttaagtggaaataaactgaaagatatcagcaccttggaacctttgaaaaagttagaatgtctgaaaagcctggacctctttaactgtgaggttaccaacctgaatgactaccgagagagtgtcttcaagctcctgccccagcttacctacttggatggctatgaccgagaggaccaggaagcacctgactcagatgccgaggtggatggtgtggatgaagaggaggaggacgaagaaggagaagatgaggaagacgaggacgatgaggatggtgaagaagaggagtttgatgaagaaggaagaagaatttggacttgatgaagaagatgaagatgaggatgaggatgaagagggacggagacagtgggaccgtcgaaacgcggacagcgaaaccgtgtgacgggcacattgttaaacgcgttgactgggaaacgactgtccgttggtggagcggcacggacggtctcgtaaccaaacggtgcgg

SEQ ID NO: 343005 - DNA, 1387 bp, Homo sapiens
ggagtctccctgccgcgtctggattgcgaacccgtgtgctgcctatccgtatagctccgccgacgggagccgaggtggaagcgctgagtcgggctgcacggggtcggagtagacaggtaagacgacgtagtgacatgccgctagcaaacccttccgacggccctcgctgcgcaagccgggacgcctctcccccctccgcccccgccgcggaaagttaagtttgaagaggggggaagaggggaacatggacatgaagaggaggatccacctggagctgaggaaccggaccccggcagctgttcgagaacttgtcttggacaattgcaaatcaaatgatggaaaaattgagggcttaacagctgaatttgtgaacttagagttcctcagtttaataaatgtaggcttgatctcagtttcaaatctccccaagctgcctaaattgaaaaagcttgaactcagtgaaaatagaatctttggaggtctggacatgttagctgaaaaacttccaaatctcacacatctaaacttaagtggaaataaactgaaagatatcagcaccttggaacctttgaaaaagttagaatgtctgaaaagcctggacctctttaactgtgaggttaccaacctgaatgactaccgagagagtgtcttcaagctcctgccccagcttacctacttggatggctatgaccgagaggaccaggaagcacctgactcagatgccgaggtggatggtgtggatgaagaggaggaggacgaagaaggagaagatgaggaagacgaggacgatgaggatggtgaagaagaggagtttgatgaagaagatgatgaagatgaagatgtagaaggggatgaggacgacgatgaagtcagtgaggaggaagaagaatttggacttgatgaagaagatgaagatgaggatgaggatgaagaggaggaagaaggtgggaaaggtgaaaagaggaagagagaaacagatgatgaaggagaagatgattaagaccccagatgacctgcagaaacagaactgttcagtattggttggactgctcatggattttgtagctgtttaaaaaaaaaaaaaaggtagctgtgatacaaaccccaggacacccacccacccaaagagccaaagaatagttcctgtgacattccgccttccttccatgtagtccctcttggtaatctaccaccaagcttgtggacttcaccccaacaaaattgtaagcgttgttaggtttttgtgtaagattcttgctgtagcgtggatagctgtgattggtgagtcaaccgtctgtggctaccagttacactgagattgtaacagcatttttactttctgtacaacaaaaaagctttgtaaataaaatcttaacattttgggtct

SEQ ID NO: 343006 - DNA, 1217 bp, Homo sapiens
gaagcagaggaagaacaagaagagaaccttgaagcaagtggagactataaatattcaggaaggaagaggggaacatggacatgaagaggaggatccacctggagctgaggaaccggaccccggcagctgttcgagaacttgtcttggacaattgcaaatcaaatgatggaaaaattgagggcttaacagctgaatttgtgaacttagagttcctcagtttaataaatgtaggcttgatctcagtttcaaatctccccaagctgcctaaattgaaaaagcttgaactcagtgaaaatagaatctttggaggtctggacatgttagctgaaaaacttccaaatctcacacatctaaacttaagtggaaataaactgaaagatatcagcaccttggaacctttgaaaaagttagaatgtctgaaaagcctggacctctttaactgtgaggttaccaacctgaatgactaccgagagagtgtcttcaagctcctgccccagcttacctacttggatggctatgaccgagaggaccaggaagcacctgactcagatgccgaggtggatggtgtggatgaagaggaggaggacgaagaaggagaagatgaggaagacgaggacgatgaggatggtgaagaagaggagtttgatgaagaagatgatgaagatgaagatgtagaaggggatgaggacgacgatgaagtcagtgaggaggaagaagaatttggacttgatgaagaagatgaagatgaggatgaggatgaagaggaggaagaaggtgggaaaggtgaaaagaggaagagagaaacagatgatgaaggagaagatgattaagaccccagatgacctgcagaaacagaactgttcagtattggttggactgctcatggattttgtagctgtttaaaaaaaaaaaaaaggtagctgtgatacaaaccccaggacacccacccacccaaagagccaaagaatagttcctgtgacattccgccttccttccatgtagtccctcttggtaatctaccaccaagcttgtggacttcaccccaacaaaattgtaagcgttgttaggtttttgtgtaagattcttgctgtagcgtggatagctgtgattggtgagtcaaccgtctgtggctaccagttacactgagattgtaacagcatttttactttctgtacaacaaaaaagctttgtaaataaaatcttaacattttgggtct

SEQ ID NO: 343007 - DNA, 1037 bp, Homo sapiens
tgactagaggttcccgactagtccaaccattcctcagtttaataaatgtaggcttgatctcagtttcaaatctccccaagctgcctaaattgaaaaagcttgaactcagtgaaaatagaatctttggaggtctggacatgttagctgaaaaacttccaaatctcacacatctaaacttaagtggaaataaactgaaagatatcagcaccttggaacctttgaaaaagttagaatgtctgaaaagcctggacctctttaactgtgaggttaccaacctgaatgactaccgagagagtgtcttcaagctcctgccccagcttacctacttggatggctatgaccgagaggaccaggaagcacctgactcagatgccgaggtggatggtgtggatgaagaggaggaggacgaagaaggagaagatgaggaagacgaggacgatgaggatggtgaagaagaggagtttgatgaagaagatgatgaagatgaagatgtagaaggggatgaggacgacgatgaagtcagtgaggaggaagaagaatttggacttgatgaagaagatgaagatgaggatgaggatgaagaggaggaagaaggtgggaaaggtgaaaagaggaagagagaaacagatgatgaaggagaagatgattaagaccccagatgacctgcagaaacagaactgttcagtattggttggactgctcatggattttgtagctgtttaaaaaaaaaaaaaaggtagctgtgatacaaaccccaggacacccacccacccaaagagccaaagaatagttcctgtgacattccgccttccttccatgtagtccctcttggtaatctaccaccaagcttgtggacttcaccccaacaaaattgtaagcgttgttaggtttttgtgtaagattcttgctgtagcgtggatagctgtgattggtgagtcaaccgtctgtggctaccagttacactgagattgtaacagcatttttactttctgtacaacaaaaaagctttgtaaataaaatcttaacattttgggtct

SEQ ID NO: 343008 - DNA, 873 bp, Homo sapiens
  misc_feature (8)..(8): n is a, c, g, or t
gtgatggngttctagaggatccctactctgaaagatatcagcaccttggaacctttgaaaaagttagaatgtctgaaaagcctggacctctttaactgtgaggttaccaacctgaatgactaccgagagagtgtcttcaagctcctgccccagcttacctacttggatggctatgaccgagaggaccaggaagcacctgactcagatgccgaggtggatggtgtggatgaagaggaggaggacgaagaaggagaagatgaggaagacgaggacgatgaggatggtgaagaagaggagtttgatgaagaagatgatgaagatgaagatgtagaaggggatgaggacgacgatgaagtcagtgaggaggaagaagaatttggacttgatgaagaagatgaagatgaggatgaggatgaagaggaggaagaaggtgggaaaggtgaaaagaggaagagagaaacagatgatgaaggagaagatgattaagaccccagatgacctgcagaaacagaactgttcagtattggttggactgctcatggattttgtagctgtttaaaaaaaaaaaaaaggtagctgtgatacaaaccccaggacacccacccacccaaagagccaaagaatagttcctgtgacattccgccttccttccatgtagtccctcttggtaatctaccaccaagcttgtggacttcaccccaacaaaattgtaagcgttgttaggtttttgtgtaagattcttgctgtagcgtggatagctgtgattggtgagtcaaccgtctgtggctaccagttacactgagattgtaacagcatttttactttctgtacaacaaaaaagctttgtaaataaaatcttaacattttgggtct

SEQ ID NO: 343009 - DNA, 1447 bp, Homo sapiens
gcggccgccgagccgagcagcgccgcgcggggccgagtggagccgagcagctgccgcgccgcgtcgccggtttaagcgcagtgcaggccgcggccgggggcggcggtagtgagcccagcgctgcgctccagcccccttttccctccatggtttctctccgctcccgtgagtaacttggctccgggggctccgctcgcctgcccgcacgccgcccgccacccaggaccgcgccgccggcctccgccgctagcaaacccttccgacggccctcgctgcgcaagccgggacgcctctcccccctccgcccccgccgcggaaagttaagtttgaagaggggggaagaggggaacatggacatgaagaggaggatccacctggagctgaggaaccggaccccggcagctgttcgagaacttgtcttggacaattgcaaatcaaatgatggaaaaattgagggcttaacagctgaatttgtgaacttagagttcctcagtttaataaatgtaggcttgatctcagtttcaaatctccccaagctgcctaaattgaaaaagcttgaactcagtgaaaatagaatctttggaggtctggacatgttagctgaaaaacttccaaatctcacacatctaaacttaagtggaaataaactgaaagatatcagcaccttggaacctttgaaaaagttagaatgtctgaaaagcctggacctctttaactgtgaggttaccaacctgaatgactaccgagagagtgtcttgaccaggaagcacctgactcagatgccgaggtggatggtgtggatgaagaggaggaggacgaagaaggagaagatgaggaagacgaggacgatgaggatggtgaagaagaggagtttgatgaagaagatgatgaagatgaagatgtagaaggggatgaggacgacgatgaagtcagtgaggaggaagaagaatttggacttgatgaagaagatgaagatgaggatgaggatgaagaggaggaagaaggtgggaaaggtgaaaagaggaagagagaaacagatgatgaaggagaagatgattaagaccccagatgacctgcagaaacagaactgttcagtattggttggactgctcatggattttgtagctgtttaaaaaaaaaaaaaaggtagctgtgatacaaaccccaggacacccacccacccaaagagccaaagaatagttcctgtgacattccgccttccttccatgtagtccctcttggtaatctaccaccaagcttgtggacttcaccccaacaaaattgtaagcgttgttaggtttttgtgtaagattcttgctgtagcgtggatagctgtgattggtgagtcaaccgtctgtggctaccagttacactgagattgtaacagcatttttactttctgtacaacaaaaaagctttgtaaataaaatcttaacattttgggtct

SEQ ID NO: 343010 - DNA, 1003 bp, Homo sapiens
gcggccgcctactactactaaattcgcggccgcgtcgactaaactgaaagatatcagcaccttggaacctttgagtttatttccacttaagtttagatgtgtgagatttggaagtttttcagctaacatgtccagtctaaacttaagtggaaataaactgaaagatatcagcaccttggaacctttgaaaaagttagaatgtctgaaaagcctggacctctttaactgtgaggttaccaacctgaatgactaccgagagagtgtcttcaagctcctgccccagcttacctacttggatggctatgaccgagaggaccaggaagcacctgactcagatgccgaggtggatggtgtggatgaagaggaggaggacgaagaaggagaagatgaggaagacgaggacgatgaggatggtgaagaagaggagtttgatgaagaagatgatgaagatgaagatgtagaaggggatgaggacgacgatgaagtcagtgaggaggaagaagaatttggacttgatgaagaagatgaagatgaggatgaggatgaagaggaggaagaaggtgggaaaggtgaaaagaggaagagagaaacagatgatgaaggagaagatgattaagaccccagatgacctgcagaaacagaactgttcagtattggttggactgctcatggattttgtagctgtttaaaaaaaaaaaaaaggtagctgtgatacaaaccccaggacacccacccacccaaagagccaaagaatagttcctgtgacattccgccttccttccatgtagtccctcttggtaatctaccaccaagcttgtggacttcaccccaacaaaattgtaagcgttgttaggtttttgtgtaagattcttgctgtagcgtggatagctgtgattggtgagtcaaccgtctgtggctaccagttacactgagattgtaacagcatttttactttctgtacaacaaaaaagctttgtaaataaaatcttaacattttgggtct

SEQ ID NO: 343011 - DNA, 903 bp, Homo sapiens
ctctagactatcccctgcacacgccgagacaccaatctaaacttaagtggaaataaactgaaagatatcagcaccttggaacctttgaaaaagttagaatgtctgaaaagcctggacctctttaactgtgaggttaccaacctgaatgactaccgagagagtgtcttcaagctcctgccccagcttacctacttggatggctatgaccgagaggaccaggaagcacctgactcagatgccgaggtggatggtgtggatgaagaggaggaggacgaagaaggagaagatgaggaagacgaggacgatgaggatggtgaagaagaggagtttgatgaagaagatgatgaagatgaagatgtagaaggggatgaggacgacgatgaagtcagtgaggaggaagaagaatttggacttgatgaagaagatgaagatgaggatgaggatgaagaggaggaagaaggtgggaaaggtgaaaagaggaagagagaaacagatgatgaaggagaagatgattaagaccccagatgacctgcagaaacagaactgttcagtattggttggactgctcatggattttgtagctgtttaaaaaaaaaaaaaaggtagctgtgatacaaaccccaggacacccacccacccaaagagccaaagaatagttcctgtgacattccgccttccttccatgtagtccctcttggtaatctaccaccaagcttgtggacttcaccccaacaaaattgtaagcgttgttaggtttttgtgtaagattcttgctgtagcgtggatagctgtgattggtgagtcaaccgtctgtggctaccagttacactgagattgtaacagcatttttactttctgtacaacaaaaaagctttgtaaataaaatcttaacattttgggtct

SEQ ID NO: 343012 - DNA, 871 bp, Homo sapiens
  misc_feature (8)..(8): n is a, c, g, or t
  misc_feature (42)..(42): n is a, c, g, or t
  misc_feature (47)..(47): n is a, c, g, or t
gtgatggngttctagaggatccctactctgaaagacatcagnacctnggaacttgaaaaagttagaatgtctgaaaagcctggacctctttaactgtgaggttaccaacctgaatgactaccgagagagtgtcttcaagctcctgccccagcttacctacttggatggctatgaccgagaggaccaggaagcacctgactcagatgccgaggtggatggtgtggatgaagaggaggaggacgaagaaggagaagatgaggaagacgaggacgatgaggatggtgaagaagaggagtttgatgaagaagatgatgaagatgaagatgtagaaggggatgaggacgacgatgaagtcagtgaggaggaagaagaatttggacttgatgaagaagatgaagatgaggatgaggatgaagaggaggaagaaggtgggaaaggtgaaaagaggaagagagaaacagatgatgaaggagaagatgattaagaccccagatgacctgcagaaacagaactgttcagtattggttggactgctcatggattttgtagctgtttaaaaaaaaaaaaaaggtagctgtgatacaaaccccaggacacccacccacccaaagagccaaagaatagttcctgtgacattccgccttccttccatgtagtccctcttggtaatctaccaccaagcttgtggacttcaccccaacaaaattgtaagcgttgttaggtttttgtgtaagattcttgctgtagcgtggatagctgtgattggtgagtcaaccgtctgtggctaccagttacactgagattgtaacagcatttttactttctgtacaacaaaaaagctttgtaaataaaatcttaacattttgggtct

SEQ ID NO: 343013 - DNA, 825 bp, Homo sapiens
ctctaaggatcccctccactcgcaaatcacaccatccacctctttaactgtgaggttaccaacctgaatgactaccgagagagtgtcttcaagctcctgccccagcttacctacttggatggctatgaccgagaggaccaggaagcacctgactcagatgccgaggtggatggtgtggatgaagaggaggaggacgaagaaggagaagatgaggaagacgaggacgatgaggatggtgaagaagaggagtttgatgaagaagatgatgaagatgaagatgtagaaggggatgaggacgacgatgaagtcagtgaggaggaagaagaatttggacttgatgaagaagatgaagatgaggatgaggatgaagaggaggaagaaggtgggaaaggtgaaaagaggaagagagaaacagatgatgaaggagaagatgattaagaccccagatgacctgcagaaacagaactgttcagtattggttggactgctcatggattttgtagctgtttaaaaaaaaaaaaaaggtagctgtgatacaaaccccaggacacccacccacccaaagagccaaagaatagttcctgtgacattccgccttccttccatgtagtccctcttggtaatctaccaccaagcttgtggacttcaccccaacaaaattgtaagcgttgttaggtttttgtgtaagattcttgctgtagcgtggatagctgtgattggtgagtcaaccgtctgtggctaccagttacactgagattgtaacagcatttttactttctgtacaacaaaaaagctttgtaaataaaatcttaacattttgggtct

SEQ ID NO: 343014 - DNA, 778 bp, Homo sapiens
cacagctgcagaactattcaagtcttttgaacgattacatatcaggaaaactgaattggtcattttgtgtcgtatatgcacagatggagcggctgccatggctggacggctttctggtttcactactcgagtcagagaggtcgcttctggataaggagaagatgaggaagacgaggacgatgaggatggtgaagaagaggagtttgatgaagaagatgatgaagatgaagatgtagaaggggatgaggacgacgatgaagtcagtgaggaggaagaagaatttggacttgatgaagaagatgaagatgaggatgaggatgaagaggaggaagaaggtgggaaaggtgaaaagaggaagagagaaacagatgatgaaggagaagatgattaagaccccagatgacctgcagaaacagaactgttcagtattggttggactgctcatggattttgtagctgtttaaaaaaaaaaaaaaggtagctgtgatacaaaccccaggacacccacccacccaaagagccaaagaatagttcctgtgacattccgccttccttccatgtagtccctcttggtaatctaccaccaagcttgtggacttcaccccaacaaaattgtaagcgttgttaggtttttgtgtaagattcttgctgtagcgtggatagctgtgattggtgagtcaaccgtctgtggctaccagttacactgagattgtaacagcatttttactttctgtacaacaaaaaagctttgtaaataaaatcttaacattttgggtct

SEQ ID NO: 343015 - DNA, 2214 bp, Homo sapiens
gcggccgccgagccgagcagcgccgcgcggggccgagtggagccgagcagctgccgcgccgcgtcgccggtttaagcgcagtgcaggccgcggccgggggcggcggtagtgagcccagcgctgcgctccagcccccttttccctccatggtttctctccgctcccgtgagtaacttggctccgggggctccgctcgcctgcccgcacgccgcccgccacccaggaccgcgccgccggcctccgccgctagcaaacccttccgacggccctcgctgcgcaagccgggacgcctctcccccctccgcccccgccgcggaaagttaagtttgaagaggggggaagaggggaacatggacatgaagaggaggatccacctggagctgaggaaccggaccccggcagctgttcgagaacttgtcttggacaattgcaaatcaaatgatggaaaaattgagggcttaacagctgaatttgtgaacttagagttcctcagtttaataaatgtaggcttgatctcagtttcaaatctccccaagctgcctaaattgaaaaagcttgaactcagtgaaaatagaatctttggaggtctggacatgttagctgaaaaacttccaaatctcacacatctaaacttaagtggaaataaactgaaagatatcagcaccttggaacctttgccaaagaatagttcctgtgacattccgccttccttccatgtagtccctcttggtaatctaccaccaagcttgtggacttcaccccaacaaaattgtaagcgttgttaggtttttgtgtaagattcttgctgtagcgtggatagctgtgattggtgagtcaaccgtctgtggctaccagttacactgagattgtaacagcatttttactttctgtacaacaaaaaagctttgtaaataaaatcttaacattttgggtctgttttttcatgctttgctttttaattattattattattttttttacattaggacattttatgtgacaactgccaaaaaagtatttttaagaatttaagcgaaataaacagttactctttggtaaagcctagttgtatgcttacatttttaaattatactctcattgtaagctcatgttaaaacaccaaagaactggtttatttggcatttttatattagtagttgttgaggggaattgcacaagtgtgtaggatctttgagcatttagatcaaatcctcattgataactgggagtaaatgaagcatactttaaaaaataacgttcaaaatggaatactctggggccctgaaaaccagtaaaatgttaggttcaagtattatgtgaattaagggaaagaagatagtgtaaagcaaaaggccttcaccagaatcccaagagatctgaattctagttctggctctgcccctgattttctgtgtgaccttgtgttgactctgggtcaccacccagtctggaaaattgaaggggtgtgaccaaatggcttctgaagtcacttgtagcactgatgttctgtgacccttgctgacaggaaggtctgaagagaaaaatgggctttccactagtctgaagcatgtagggtttgactgatgggtgaacacagtatggtttgttgccaagacaggcgtgaaaagggggaatgacatgtgaaaagcctcaccaagcagtgggtaggcactgcctgaggtcaactcaggttttccataagatggaaattttctctattcttacagatcttaaagggatttgagaaaggaggatattctgtctgtattcagtgattaaccgtttagcgaaaatagatgtatgactgcattatcaatacagttttttatagtggaagatttaaggattgtttcagtaaattttagcttatagctgctggaatgagtgaggtttttgatgcatgtaaatgcaatatgtaaaattggaatctaatttgaatttataacaagtcacagtctctatggagcccccaaatactgtactttaaaatcaaaatctcccatagactttaaaatggagtttcttttttgcaaagaaaatccaagaaaatttgatttctgattttacaggtattacacatcattttccccaaccataaggccattttggcaaaccttcaatacattgtaaaatggtttcttctgtagcctaagtgtgtccttaaggttttgcttatttgtcaaatatcaaacacagtaactttgagtgattatt

SEQ ID NO: 343016 - DNA, 456 bp, Homo sapiens
  misc_feature (8)..(8): n is a, c, g, or t
gtgatggngttctagaggatccctactctgaaagatatcagcaccttggaacctttgaaaaagttagaatgtctgaaaagcctggacctctttaactgtgaggttaccaacctgaatgactaccgagagagtgtcttcaagctcctgccccagcttacctacttggatggctatgaccgagaggaccaggaagcacctgactcagatgccgaggtggatggtgtggatgaagaggaggaggacgaaggtgagtaggctcagcatctggtgaacctgatgtctgcctttcaaagcctctgataaaagctattggatgttggccgggcgcagtggcacacaactgtaatcccagcactttgggtggccgaggcagggggcattgcttgagcccaggagtttgagactagcctgggcaacatggcaataccttgtttctacagaaaatagaaaaaaaaa

SEQ ID NO: 343017 - DNA, 356 bp, Homo sapiens
ctgcagacagaactcagttagtcggggacaatttccctcaatgttaacagcactgttccaccgcaacgtggaacaacagctttaaaacgtgctcttcgtaggcccggctactccaagaacagtgcctcccgccagacccaggcggcttccttcacccgcaacccgagagacgacccgccgggcccgccccgcggaagccgccggttgccaggccaaggagtggactagggtcgccggggaagcgggtgagtggtccccgccctggcgggctgcctctagaacgaggagggcggcgcgtggtcgcggcgcggagccgagtgggagcgaggggtagacgcgccccggacgcgcggccg

SEQ ID NO: 343018 - DNA, 2329 bp, Homo sapiens
ctgcagacagaactcagttagtcggggacaatttccctcaatgttaacagcactgttccaccgcaacgtggaacaacagctttaaaacgtgctcttcgtaggcccggctactccaagaacagtgcctcccgccagacccaggcggcttccttcacccgcaacccgagagacgacccgccgggcccgccccgcggaagccgccggttgccaggccaaggagtggactagggtcgccggggaagcggtttgggagagcccatggtgactgcgtgagtggagcccagctgtgtggatgccccagcatggatgactacatggtcctgagaatgattggggagggctccttcggcagagctcttttggttcagcatgaaagcagtaatcagatgtttgccatgaaagaaataaggcttcccaagtctttctctaatacacagaattctaggaaggaggctgttcttttagccaaaatgaaacaccctaatattgttgccttcaaagaatcatttgaagctgaaggacacttgtatattgtgatggaatactgtgatggaggggatctaatgcaaaagattaaacagcagaaaggaaagttatttcctgaagacatgatacttaattggtttacccaaatgtgccttggagtaaatcacattcacaagaaacgtgtgctacacagagatatcaagtccaagaatatcttcctcactcagaatggaaaagtgaaattgggagactttggatctgcccgtcttctctccaatccgatggcatttgcttgtacctatgtgggaactccttattatgtgcctccagaaatttgggaaaacctgccttataacaataaaagtgacatctggtccttgggttgcatcctgtatgaactctgtacccttaagcatccatttcaggcaaatagttggaaaaatcttatcctcaaagtatgtcaagggtgcatcagtccactgccgtctcattactcctatgaacttcagttcctagtcaagcagatgtttaaaaggaatccctcacatcgcccctcggctacaacgcttctctctcgaggcatcgtagctcggcttgtccagaagtgcttaccccccgagatcatcatggaatatggtgaggaagtattagaagaaataaaaaattcgaagcataacacaccaagaaaaaaaacaaaccccagcagaatcaggatagctttgggaaatgaagcaagcacagtgcaagaggaagaacaagatagaaagggtagccatactgatttggaaagcattaatgaaaatttagttgaaagtgcattgagaagagtaaacagagaagaaaaaggtaataagtcagtccatctgaggaaagccagttcaccaaatcttcatagacgacagtgggagaaaaatgtacccaatacagctcttacagctttggaaaatgcatccatactcacctccagtttaacagcagaggacgatagaggtggttctgtaataaagtacagcaaaaatactactcgtaagcagtggctcaaagagacccctgacactttgttgaacatccttaagaatgctgatctcagcttggcttttcaaacatacacaatatatagaccaggttcagaagggttcttgaaaggccccctgtctgaagaaacagaagcatcggacagtgttgatggaggtcacgattctgtcattttggatccagagcgacttgagcctgggctagatgaggaggacacggactttgaggaggaagatgacaaccccgactgggtgtcagagctgaagaagcgagctggatggcaaggcctgtgcgacagataatgcctgaggaaatgttcctgagtcacgctgaggagagccttcactcaggagttcatgctgagatgatcatgagttcatgcgacgtatattttcctttggaaacagaatgaagcagaggaaactcttaatacttaaaatcgttcttgattagtatcgtgagtttgaaaagtctagaactcctgtaagtttttgaactcaagggagaaggtatagtggaatgagtgtgagcatcgggctttgcagtcccatagaacagaaatgggatgctagcgtgccactacctacttgtgtgattgtgggaaattacttaacctcttcaagccccaatttcctcaaccataaaatgaagataataatgcctacctcagagggatgctgaccacagacctttatagcagcccgtatgatattattcacattatgatatgtgtttattattatgtgactctttttacatttcctaaaggtttgagaattaaatatatttaattatgaaaaaaaaaaaa

SEQ ID NO: 343019 - DNA, 2194 bp, Homo sapiens
ctgcagacagaactcagttagtcggggacaatttccctcaatgttaacagcactgttccaccgcaacgtggaacaacagctttaaaacgtgctcttcgtaggcccggctactccaagaacagtgcctcccgccagacccaggcggcttccttcacccgcaacccgagagacgacccgccgggcccgccccgcggaagccgccggttgccaggccaaggagtggactagggtcgccggggaagcggtttgggagagcccatggtgactgcgtgagtggagcccagctgtgtggatgccccagcatggatgactacatggtcctgagaatgattggggagggctccttcggcagagctcttttggttcagcatgaaagcagtaatcagatgtttgccatgaaagaaataaggcttcccaagtctttctctaatacacagaattctaggaaggaggctgttcttttagccaaaatgaaacaccctaatattgttgccttcaaagaatcatttgaagctgaaggacacttgtatattgtgatggaatactgtgatggaggggatctaatgcaaaagattaaacagcagaaaggaaagttatttcctgaagacatgatacttaattggtttacccaaatgtgccttggagtaaatcacattcacaagaaacgtgtgctacacagagatatcaagtccaagaatatcttcctcactcagaatggaaaagtgaaattgggagactttggatctgcccgtcttctctccaatccgatggcatttgcttgtacctatgtgggaactccttattatgtgcctccagaaatttgggaaaacctgccttataacaataaaagtgacatctggtccttgggttgcatcctgtatgaactctgtacccttaagcatccatttcaggcaaatagttggaaaaatcttatcctcaaagtatgtcaagggtgcatcagtccactgccgtctcattactcctatgaacttcagttcctagtcaagcagatgtttaaaaggaatccctcacatcgcccctcggctacaacgcttctctctcgaggcatcgtagctcggcttgtccagaagtgcttaccccccgagatcatcatggaatatggtgaggaagtattagaagaaataaaaaattcgaagcataacacaccaagaaaaaaaacaaaccccagcagaatcaggatagctttgggaaatgaagcaagcacagtgcaagaggaagaacaagatagaaagggtagccatactgatttggaaagcattaatgaaaatttagttgaaagtgcattgagaagagtaaacagagaagaaaaaggtaataagtcagtccatctgaggaaagccagttcaccaaatcttcatagacgacagtgggagaaaaatgtacccaatacagctcttacagctttggaaaatgcatccatactcacctccagtttaacagcagaggacgatagaggttcagaagggttcttgaaaggccccctgtctgaagaaacagaagcatcggacagtgttgatggaggtcacgattctgtcattttggatccagagcgacttgagcctgggctagatgaggaggacacggactttgaggaggaagatgacaaccccgactgggtgtcagagctgaagaagcgagctggatggcaaggcctgtgcgacagataatgcctgaggaaatgttcctgagtcacgctgaggagagccttcactcaggagttcatgctgagatgatcatgagttcatgcgacgtatattttcctttggaaacagaatgaagcagaggaaactcttaatacttaaaatcgttcttgattagtatcgtgagtttgaaaagtctagaactcctgtaagtttttgaactcaagggagaaggtatagtggaatgagtgtgagcatcgggctttgcagtcccatagaacagaaatgggatgctagcgtgccactacctacttgtgtgattgtgggaaattacttaacctcttcaagccccaatttcctcaaccataaaatgaagataataatgcctacctcagagggatgctgaccacagacctttatagcagcccgtatgatattattcacattatgatatgtgtttattattatgtgactctttttacatttcctaaaggtttgagaattaaatatatttaattatgaaaaaaaaaaaa

SEQ ID NO: 343020 - DNA, 2264 bp, Homo sapiens
ctgcagacagaactcagttagtcggggacaatttccctcaatgttaacagcactgttccaccgcaacgtggaacaacagctttaaaacgtgctcttcgtaggcccggctactccaagaacagtgcctcccgccagacccaggcggcttccttcacccgcaacccgagagacgacccgccgggcccgccccgcggaagccgccggttgccaggccaaggagtggactagggtcgccggggaagcggtttgggagagcccatggtgactgcgtgagtggagcccagctgtgtggatgccccagcatggatgactacatggtcctgagaatgattggggagggctccttcggcagagctcttttggttcagcatgaaagcagtaatcagatgtttgccatgaaagaaataaggcttcccaagtctttctctaatacacagaattctaggaaggaggctgttcttttagccaaaatgaaacaccctaatattgttgccttcaaagaatcatttgaagctgaaggacacttgtatattgtgatggaatactgtgatggaggggatctaatgcaaaagattaaacagcagaaaggaaagttatttcctgaagacatgatacttaattggtttacccaaatgtgccttggagtaaatcacattcacaagaaacgtgtgctacacagagatatcaagtccaagaatatcttcctcactcagaatggaaaagtgaaattgggagactttggatctgcccgtcttctctccaatccgatggcatttgcttgtacctatgtgggaactccttattatgtgcctccagaaatttgggaaaacctgccttataacaataaaagtgacatctggtccttgggttgcatcctgtatgaactctgtacccttaagcatccatttcaggcaaatagttggaaaaatcttatcctcaaagtatgtcaagggtgcatcagtccactgccgtctcattactcctatgaacttcagttcctagtcaagcagatgtttaaaaggaatccctcacatcgcccctcggctacaacgcttctctctcgaggcatcgtagctcggcttgtccagaagtgcttaccccccgagatcatcatggaatatggtgaggaagtattagaagaaataaaaaattcgaagcataacacaccaagaaaaaaaacaaaccccagcagaatcaggatagctttgggaaatgaagcaagcacagtgcaagaggaagaacaagatagaaagggtagccatactgatttggaaagcattaatgaaaatttagttgaaagtgcattgagaagagtaaacagagaagaaaaaggtaataagtcagtccatctgaggaaagccagttcaccaaatcttcatagacgacagtgggagaaaaatgtacccaatacagctcttacagctttggaaaatgcatccatactcacctccagtttaacagcagaggacgatagaggtggttctgtaataaagtacagcaaaaatactactcgtaagcagtggctcaaagagacccctgacactttgttgaacatccttaagaatgctgatctcagcttggcttttcaaacatacacaatatatagaccaggttcagaagggttcttgaaaggccccctgtctgaagaaacagaagcatcggacagtgttgatggaggtcacgattctgtcattttggatccagagcgacttgagcctgggctagatgaggaggacacggactttgaggaggaagatgacaaccccgactgggtgtcagagctgaagaagcgagctggatggcaaggcctgtgcgacagataatgcctgagttcatgcgacgtatattttcctttggaaacagaatgaagcagaggaaactcttaatacttaaaatcgttcttgattagtatcgtgagtttgaaaagtctagaactcctgtaagtttttgaactcaagggagaaggtatagtggaatgagtgtgagcatcgggctttgcagtcccatagaacagaaatgggatgctagcgtgccactacctacttgtgtgattgtgggaaattacttaacctcttcaagccccaatttcctcaaccataaaatgaagataataatgcctacctcagagggatgctgaccacagacctttatagcagcccgtatgatattattcacattatgatatgtgtttattattatgtgactctttttacatttcctaaaggtttgagaattaaatatatttaattatgaaaaaaaaaaaa

SEQ ID NO: 343021 - DNA, 2079 bp, Homo sapiens
ctgcagacagaactcagttagtcggggacaatttccctcaatgttaacagcactgttccaccgcaacgtggaacaacagctttaaaacgtgctcttcgtaggcccggctactccaagaacagtgcctcccgccagacccaggcggcttccttcacccgcaacccgagagacgacccgccgggcccgccccgcggaagccgccggttgccaggccaaggagtggactagggtcgccggggaagcggtttgggagagcccatggtgactgcgtgagtggagcccagctgtgtggatgccccagcatggatgactacatggtcctgagaatgattggggagggctccttcggcagagctcttttggttcagcatgaaagcagtaatcagatgtttgccatgaaagaaataaggcttcccaagtctttctctaatacacagaattctaggaaggaggctgttcttttagccaaaatgaaacaccctaatattgttgccttcaaagaatcatttgaagctgaaggacacttgtatattgtgatggaatactgtgatggaggggatctaatgcaaaagattaaacagcagaaaggaaagttatttcctgaagacatgatacttaattggtttacccaaatgtgccttggagtaaatcacattcacaagaaacgtgtgctacacagagatatcaagtccaagaatatcttcctcactcagaatggaaaagtgaaattgggagactttggatctgcccgtcttctctccaatccgatggcatttgcttgtacctatgtgggaactccttattatgtgcctccagaaatttgggaaaacctgccttataacaataaaagtgacatctggtccttgggttgcatcctgtatgaactctgtacccttaagcatccatttcaggcaaatagttggaaaaatcttatcctcaaagtatgtcaagggtgcatcagtccactgccgtctcattactcctatgaacttcagttcctagtcaagcagatgtttaaaaggaatccctcacatcgcccctcggctacaacgcttctctctcgaggcatcgtagctcggcttgtccagaagtgcttaccccccgagatcatcatggaatatggtgaggaagtattagaagaaataaaaaattcgaagcataacacaccaagaaaaaaaacaagaggaagaacaagatagaaagggtagccatactgatttggaaagcattaatgaaaatttagttgaaagtgcattgagaagagtaaacagagaagaaaaaggtaataagtcagtccatctgaggaaagccagttcaccaaatcttcatagacgacagtgggagaaaaatgtacccaatacagctcttacagctttggaaaatgcatccatactcacctccagtttaacagcagaggacgatagaggttcagaagggttcttgaaaggccccctgtctgaagaaacagaagcatcggacagtgttgatggaggtcacgattctgtcattttggatccagagcgacttgagcctgggctagatgaggaggacacggactttgaggaggaagatgacaaccccgactgggtgtcagagctgaagaagcgagctggatggcaaggcctgtgcgacagataatgcctgagttcatgcgacgtatattttcctttggaaacagaatgaagcagaggaaactcttaatacttaaaatcgttcttgattagtatcgtgagtttgaaaagtctagaactcctgtaagtttttgaactcaagggagaaggtatagtggaatgagtgtgagcatcgggctttgcagtcccatagaacagaaatgggatgctagcgtgccactacctacttgtgtgattgtgggaaattacttaacctcttcaagccccaatttcctcaaccataaaatgaagataataatgcctacctcagagggatgctgaccacagacctttatagcagcccgtatgatattattcacattatgatatgtgtttattattatgtgactctttttacatttcctaaaggtttgagaattaaatatatttaattatgaaaaaaaaaaaa

SEQ ID NO: 343022 - DNA, 1177 bp, Homo sapiens
ctgcagacagaactcagttagtcggggacaatttccctcaatgttaacagcactgttccaccgcaacgtggaacaacagctttaaaacgtgctcttcgtaggcccggctactccaagaacagtgcctcccgccagacccaggcggcttccttcacccgcaacccgagagacgacccgccgggcccgccccgcggaagccgccggttgccaggccaaggagtggactagggtcgccggggaagcggtttgggagagcccatggtgactgcgtgagtggagcccagctgtgtggatgccccagcatggatgactacatggtcctgagaatgattggggagggctccttcggcagagctcttttggttcagcatgaaagcagtaatcagatgtttgccatgaaagaaataaggcttcccaagtctttctctaatacacagaattctaggaaggaggctgttcttttagccaaaatgaaacaccctaatattgttgccttcaaagaatcatttgaagctgaaggacacttgtatattgtgatggaatactgtgatggaggggatctaatgcaaaagattaaacagcagaaaggaaagttatttcctgaagacatgatacttaattggtttacccaaatgtgccttggagtaaatcacattcacaagaaacgtgtgctacacagagatatcaagtccaagaatatcttcctcactcagaatggaaaagtgaaattgggagactttggatctgcccgtcttctctccaatccgatggcatttgcttgtacctatgtgggaactccttattatgtgcctccagaaatttgggaaaacctgccttataacaataaaagtgacatctggtccttgggttgcatcctgtatgaactctgtacccttaagcatccatttcaggcaaatagttggaaaaatcttatcctcaaagtatgtcaagggtgcatcagtccactgccgtctcattactcctatgaacttcagttcctagtcaagcagatgtttaaaaggaatccctcacatcgcccctcggctacaacgcttctctctcgaggcatcgtagctcggcttgtccagaagtgcttaccccccgagatcatcatgaatatgtgaggaatattagaagatataaatattcgaagcatattaaggatcgctctagatca

SEQ ID NO: 343023 - DNA, 636 bp, Homo sapiens
atttcttgattgtaagatgaatcattcagaatttcatcctcatagagtaagttagggataaatggttttggaaacttactttgcttgccatctttgttcatccttgatgcagtaatataccagcatactctttttttatctggaccagtggactcctctaagtgatgcagacagtcaaaacatgaaatccctcactcccttttttttttcttttaggataaaacatttctttttctttttttctacatcacaagtcatcaagcaaaagatacattatttttgatggtaaactggctctctaagtcaggtgatacttaggctgatattaaaactatttacattctgtatgtgtaaggaatgaaaaaagaaaataaaaatacaatgaaggggtcagctcaagcatgaaaatatagccagagttgaaaaatcaacatgcattttctcttgtcatttgacaaacttaagttgagccacagtgtgttataaaactgcatctagcattaaagtgtcatataaaccatgttattgtaaagttatgtattttaaaatgcagtattaagtttatgcttatttaaaatgtttttctagtctttctctaatacacagaattctaggaaggaggctgttcttttagcc

SEQ ID NO: 343024 - DNA, 447 bp, Homo sapiens
tttattgtgctatccaccataaaaagcatagcatactgtgtgtatgtaagtcctcccagggcttcattcttgtataatatagaatatgtaactatatacatattatttttttaactcagtcactgtaatggttcgttttaatttttcattttggatttttttttaaatttcctttgctacttagattagaaagaacattgatctttcaaacatagatctgaatatgaaagagaaaagaaacacttccatatttgttagagtctatgtgtggacagagatggatacataatttcacatgcttggcattcctttttcacactttaaaatcaggtaataagtcagtccatctgaggaaagccagttcaccaaatcttcatagacgacagtgggagaaaaatgtacccaatacagctcttacagctttggaaaatgcatccatactcacct

SEQ ID NO: 343025 - DNA, 2274 bp, Homo sapiens
ccgcaagtccctcgccgccttggggtctgggcgcgcggtgccgtgggggtcagcagggcggagcggcttttccaggagaaagggccctcacgggtgagcggggcgactgggctcccccgcggtgcagttgccccgcgggcgccggccccggctcaacggattcttctcgctcgctgcccggaaagaaccatttgggagagcccatggtgactgcgtgagtggagcccagctgtgtggatgccccagcatggatgactacatggtcctgagaatgattggggagggctccttcggcagagctcttttggttcagcatgaaagcagtaatcagatgtttgccatgaaagaaataaggcttcccaagtctttctctaatacacagaattctaggaaggaggctgttcttttagccaaaatgaaacaccctaatattgttgccttcaaagaatcatttgaagctgaaggacacttgtatattgtgatggaatactgtgatggaggggatctaatgcaaaagattaaacagcagaaaggaaagttatttcctgaagacatgatacttaattggtttacccaaatgtgccttggagtaaatcacattcacaagaaacgtgtgctacacagagatatcaagtccaagaatatcttcctcactcagaatggaaaagtgaaattgggagactttggatctgcccgtcttctctccaatccgatggcatttgcttgtacctatgtgggaactccttattatgtgcctccagaaatttgggaaaacctgccttataacaataaaagtgacatctggtccttgggttgcatcctgtatgaactctgtacccttaagcatccatttcaggcaaatagttggaaaaatcttatcctcaaagtatgtcaagggtgcatcagtccactgccgtctcattactcctatgaacttcagttcctagtcaagcagatgtttaaaaggaatccctcacatcgcccctcggctacaacgcttctctctcgaggcatcgtagctcggcttgtccagaagtgcttaccccccgagatcatcatggaatatggtgaggaagtattagaagaaataaaaaattcgaagcataacacaccaagaaaaaaaacaaaccccagcagaatcaggatagctttgggaaatgaagcaagcacagtgcaagaggaagaacaagatagaaagggtagccatactgatttggaaagcattaatgaaaatttagttgaaagtgcattgagaagagtaaacagagaagaaaaaggtaataagtcagtccatctgaggaaagccagttcaccaaatcttcatagacgacagtgggagaaaaatgtacccaatacagctcttacagctttggaaaatgcatccatactcacctccagtttaacagcagaggacgatagaggtggttctgtaataaagtacagcaaaaatactactcgtaagcagtggctcaaagagacccctgacactttgttgaacatccttaagaatgctgatctcagcttggcttttcaaacatacacaatatatagaccaggttcagaagggttcttgaaaggccccctgtctgaagaaacagaagcatcggacagtgttgatggaggtcacgattctgtcattttggatccagagcgacttgagcctgggctagatgaggaggacacggactttgaggaggaagatgacaaccccgactgggtgtcagagctgaagaagcgagctggatggcaaggcctgtgcgacagataatgcctgaggaaatgttcctgagtcacgctgaggagagccttcactcaggagttcatgctgagatgatcatgagttcatgcgacgtatattttcctttggaaacagaatgaagcagaggaaactcttaatacttaaaatcgttcttgattagtatcgtgagtttgaaaagtctagaactcctgtaagtttttgaactcaagggagaaggtatagtggaatgagtgtgagcatcgggctttgcagtcccatagaacagaaatgggatgctagcgtgccactacctacttgtgtgattgtgggaaattacttaacctcttcaagccccaatttcctcaaccataaaatgaagataataatgcctacctcagagggatgctgaccacagacctttatagcagcccgtatgatattattcacattatgatatgtgtttattattatgtgactctttttacatttcctaaaggtttgagaattaaatatatttaattatgaaaaaaaaaaaa

SEQ ID NO: 343026 - DNA, 2180 bp, Homo sapiens
ctgcagacagaactcagttagtcggggacaatttccctcaatgttaacagcactgttccaccgcaacgtggaacaacagctttaaaacgtgctcttcgtaggcccggctactccaagaacagtgcctcccgccagacccaggcggcttccttcacccgcaacccgagagacgacccgccgggcccgccccgcggaagccgccggttgccaggccaaggagtggactagggtcgccggggaagcggtttgggagagcccatggtgactgcgtgagtggagcccagctgtgtggatgccccagcatggatgactacatggtcctgagaatgattggggagggctccttcggcagagctcttttggttcagcatgaaagcagtaatcagatgtttgccatgaaagaaataaggcttcccaagtctttctctaatacacagaattctaggaaggaggctgttcttttagccaaaatgaaacaccctaatattgttgccttcaaagaatcatttgaagctgaaggacacttgtatattgtgatggaatactgtgatggaggggatctaatgcaaaagattaaacagcagaaaggaaagttatttcctgaagacatgatacttaattggtttacccaaatgtgccttggagtaaatcacattcacaagaaacgtgtgctacacagagatatcaagtccaagaatatcttcctcactcagaatggaaaagtgaaattgggagactttggatctgcccgtcttctctccaatccgatggcatttgcttgtacctatgtgggaactccttattatgtgcctccagaaatttgggaaaacctgccttataacaataaaagtgacatctggtccttgggttgcatcctgtatgaactctgtacccttaagcatccatttcaggcaaatagttggaaaaatcttatcctcaaagtatgtcaagggtgcatcagtccactgccgtctcattactcctatgaacttcagttcctagtcaagcagatgtttaaaaggaatccctcacatcgcccctcggctacaacgcttctctctcgaggcatcgtagctcggcttgtccagaagtgcttaccccccgagatcatcatggaatatggtgaggaagtattagaagaaataaaaaattcgaagcataacacaccaagaaaaaaaacaaaccccagcagaatcaggatagctttgggaaatgaagcaagcacagtgcaagaggaagaacaagatagaaagggtagccatactgatttggaaagcattaatgaaaatttagttgaaagtgcattgagaagagtaaacagagaagaaaaaggtaataagtcagtccatctgaggaaagccagttcaccaaatcttcatagacgacagtgggagaaaaatgtacccaatacagctcttacagctttggaaaatgcatccatactcacctccagtttaacagcagaggacgatagaggtggttctgtaataaagtacagcaaaaatactactcgtaagcagtggctcaaagagacccctgacactttgttgaacatccttaagaatgctgatctcagcttggcttttcaaacatacacaatatatagaccagaaccccgactgggtgtcagagctgaagaagcgagctggatggcaaggcctgtgcgacagataatgcctgaggaaatgttcctgagtcacgctgaggagagccttcactcaggagttcatgctgagatgatcatgagttcatgcgacgtatattttcctttggaaacagaatgaagcagaggaaactcttaatacttaaaatcgttcttgattagtatcgtgagtttgaaaagtctagaactcctgtaagtttttgaactcaagggagaaggtatagtggaatgagtgtgagcatcgggctttgcagtcccatagaacagaaatgggatgctagcgtgccactacctacttgtgtgattgtgggaaattacttaacctcttcaagccccaatttcctcaaccataaaatgaagataataatgcctacctcagagggatgctgaccacagacctttatagcagcccgtatgatattattcacattatgatatgtgtttattattatgtgactctttttacatttcctaaaggtttgagaattaaatatatttaattatgaaaaaaaaaaaa

SEQ ID NO: 343027 - DNA, 2008 bp, Homo sapiens
ctgcagacagaactcagttagtcggggacaatttccctcaatgttaacagcactgttccaccgcaacgtggaacaacagctttaaaacgtgctcttcgtaggcccggctactccaagaacagtgcctcccgccagacccaggcggcttccttcacccgcaacccgagagacgacccgccgggcccgccccgcggaagccgccggttgccaggccaaggagtggactagggtcgccggggaagcggtttgggagagcccatggtgactgcgtgagtggagcccagctgtgtggatgccccagcatggatgactacatggtcctgagaatgattggggagggctccttcggcagagctcttttggttcagcatgaaagcagtaatcagatgtttgccatgaaagaaataaggcttcccaagtctttctctaatacacagaattctaggaaggaggctgttcttttagccaaaatgaaacaccctaatattgttgccttcaaagaatcatttgaagctgaaggacacttgtatattgtgatggaatactgtgatggaggggatctaatgcaaaagattaaacagcagaaaggaaagttatttcctgaagacatgatacttaattggtttacccaaatgtgccttggagtaaatcacattcacaagaaacgtgtgctacacagagatatcaagtccaagaatatcttcctcactcagaatggaaaagtgaaattgggagactttggatctgcccgtcttctctccaatccgatggcatttgcttgtacctatgtgggaactccttattatgtgcctccagaaatttgggaaaacctgccttataacaataaaagtgacatctggtccttgggttgcatcctgtatgaactctgtacccttaagcatccatttcaggcaaatagttggaaaaatcttatcctcaaagtatgtcaagggtgcatcagtccactgccgtctcattactcctatgaacttcagttcctagtcaagcagatgtttaaaaggaatccctcacatcgcccctcggctacaacgcttctctctcgaggcatcgtagctcggcttgtccagaagtgcttaccccccgagatcatcatggaatatggtgaggaagtattagaagaaataaaaaattcgaagcataacacaccaagaaaaaaaacaaaccccagcagaatcaggatagctttgggaaatgaagcaagcacagtgcaagaggaagaacaagatagaaagggtagccatactgatttggaaagcattaatgaaaatttagttgaaagtgcattgagaagagtaaacagagaagaaaaaggtaataagtcagtccatctgaggaaagccagttcaccaaatcttcatagacgacagtgggagaaaaatgtacccaatacagctcttacagctttggaaaatgcatccatactcacctccagtttaacagcagaggacgatagaggtggttctgtaataaagtacagcaaaaatactactcgtaagcagtggctcaaagagacccctgacactttgttgaacatccttaagaatgctgatctcagcttggcttttcaaacatacacaatatatagaccaggttcagaagggttcttgaaaggccccctgtctgaagaaacagaagcatcggacagtgttgatggaggtcacgattctgtcattttggatccagagcgacttgagcctgggctagatgaggaggacacgtacgttgtgatatgcatagaaagctgtagctggggttgggggtgtgtgtgtgtgtgatttaaattagaccatgataatttcagatttagtagggacctcttatattacttttcatcataaatggatatttatatcctgatcttttgtctgggatgggtaatgccttacaatatgattataaaattcctgattgagccctacacctatagcctttcagcttggacttgttattttttaatatattaggatttatatttttaaaagtttta

SEQ ID NO: 343028 - DNA, 3425 bp, Homo sapiens
gctgagattacaggcatgagccaccatactcagccatagtttcctaatccatcattgcttttttgatatcctggactcactccattgtggacagcaccccactttatgtttttttctctcaaatgggagctttcttgatggaaacctgtagtccagaaacctattaagtttgctttccccggttttccgttgttttcttttaggcatctgggaacaaagtcagtcgccagtcagtgttgtgtggaagccagaacatcgttctcaatggcaagaccattgtgatgaatgactgtattatccgaggggatctggcaaatgtaagagttggacgtcattgtgttgtgaaaagtcgtagtgtcataaggccaccattcaagaagttcagcaaaggtgttgcattctttcctttacatattggagaccatgtctttattgaggaagattgtgtggtcaacgcagcacagattggttcctatgttcatgttgggaagaactgtgtgattgggcgccgatgtgtgttgaaagactgctgcaaaattcttgacaacacagtattacctccagaaactgtggttccaccattcactgtcttctcaggctgcccaggactcttctcaggggagctcccggagtgcactcaggagctgatgattgacgtcaccaagagctactaccagaagtttttgcccctgacgcaagtctagcatctctgcctcatgtcttgaatctgcttgagctctaagatgaacctggggacaaagtgagccagtcagcacctacaaagagcttttgtgtctttgacatctaccaccctcctccttttaaaaaatttctttagaatttctcaatcttcaaggctctaagtgcttaagaattcactaacagacagaccatctggaggagctgtcttcaaatgctgtgcttacaccttatctatgaacagtcactttgtaccattatctgtggaacacagaatcatctgttcccaacactccagccccttggtcctgtggatggctggatcccgcctgaaacggacctgcagagcagcagcacccttccggtgtggaggctatgtagctggtgcgctgctcacggccattcactgcccatgctgagcgcctctcacacaggtaatgcccagcttttctgctgctaacacatttggccagttgttgcagttgctcatcatcttgggaaaggtgtttgtgacttttcagagcccagattcctgttgtctattaaaacttgaagggaggggtgaatagtgtttctctcttcttcccaaaatgaccttagctgtcctaggatagttagtaaaagactttttagcattttgacctagggcctttggctttcactaaaagtggggacctcagtatcccagattgtaattttgccaagtgttagatttgagtctctcatgtggatgcattagtcaggtggttactccttgcttcaaggtacttaccttatttcattgaagacaccgcatttgtgaactcttgcttcctggcctagaaccattcagcctaccctgtatttgccataaactccacaattcacaccaaaatgtctgtacttagagctaattcgcatatatacaggaagggctcttagaatcagtttgtgggcacagagcctcaggagtaaatgaagttactagggctgttcttaccatctccttctggccaaatagcacaacatttcctcgttctgctctgacctcttagcttagaaggaagattcagaagtgaggggctaagaaggttgtccttgcctaatgctctgatctgtaagtgaatagggcagaacagttcagccttgaggttagaatttagcaggagctatcctgacttaatatccagttgtggggtttgcaaaacaaaacagctgtatgtaatcattgccactagttccatctagaactcctttctagtttgttatttttaaaatgtttatacataaaaccaccaaaatacatagcttcgacaagatggaagtttatttctctctcccataacagtgcagtgatagtcagctggtccaggccaggcaaggggctggtccatgatgtcatcaggcacccaggttcctactgtcttgccatgtggccacagttagcaacaaaggaggctgtaaatttagtttctacttgggcagccaaaactctgaggaaggagattctgctagtaaaaaggagtgggggaagaatggccattgggagacaacaagcagactcaaccaggcctctttgttggcttcctttcctcctgctgcacatgagccttcgccgtgcatttggagccatgacagctgatagctccagacctgcatcctcctagcttgggggctctgaatgaaaggtttcttcccttccagttcgaatttggaaactcccaaagttctcaatggtttgttgtgagttccatgtcctcttggatcagtcactgtggccatgcatgtttggccacatgattaatccagtctgggtcatgaccttttcttcatccaaaacaaggtgatgggaagacaaaaacaatagctactacaaacaataggagtttataattatgtgctgatgtattcgaagatgtgttgacagtcgtgagtgtgtatcctaggaaaggcgagctggactctgtctccatggtggctctcaccccagggacctaggaacagcctgtcaccacacaattacttttataaccctggagatgaaaatctccttgtcctcaaaatacttccagaagaacaaccagatgggaaggaccttggttgggactctttccagttcacttggggcagagggaatttaatggctcacgtagctgaaaaggatgggctagattgggcttcaggctgcatcccaggactccaaacagggatctgtctctttggctctcagctctgctttcatttgagttggctttattcttgggcttcacagtgtggccccacagcaccagttattgataaaaagagctcccctttgctgacagaactgctggatttggttctcattggtccagacgaggaaggtatccagcctcaagtcatcattgtggccaggaagatggaatacaccaaatggacaggcctggcatgtacccacagagactgagagttggtgctggtggttgtggtggcagatgatattacctgaagaagggacgaatgggtgctgggcaggacaaagcatcagctgtccagttcaggcctctcctctttccctggtgtcttcattttcctccgtctccctgctgtcccttaccctctgcccaatctctcattactcctggtcttgggagttgccttctgaggatactccactgggggtacctgagcctggattagagggcagggggaggatattgcctagccaaagtgggtgttcaataaagaaccatttggagatggtcttc

SEQ ID NO: 343029 - DNA, 2287 bp, Homo sapiens
gcggaagtggaggagcggccggaagtagccggaatctctgaaagactgaccgactgactctgacaggatccggggctgagggaaggaggcggcggccatggagttgggcgagctgctctacaacaagtctgagtacatcgagacggcatctgggaacaaagtcagtcgccagtcagtgttgtgtggaagccagaacatcgttctcaatggcaagaccattgtgatgaatgactgtattatccgaggggatctggcaaatgtaagagttggacgtcattgtgttgtgaaaagtcgtagtgtcataaggccaccattcaagaagttcagcaaaggtgttgcattctttcctttacatattggagaccatgtctttattgaggaagattgtgtggtcaacgcagcacagattggttcctatgttcatgttgggaagaactgtgtgattgggcgccgatgtgtgttgaaagactgctgcaaaattcttgacaacacagtattacctccagaaactgtggttccaccattcactgtcttctcaggctgcccaggactcttctcaggggagctcccggagtgcactcaggagctgatgattgacgtcaccaagagctactaccagaagtttttgcccctgacgcaagtctagcatctctgcctcatgtcttgaatctgcttgagctctaagatgaacctggggacaaagtgagccagtcagcacctacaaagagcttttgtgtctttgacatctaccaccctcctccttttaaaaaatttctttagaatttctcaatcttcaaggctctaagtgcttaagaattcactaacagacagaccatctggaggagctgtcttcaaatgctgtgcttacaccttatctatgaacagtcactttgtaccattatctgtggaacacagaatcatctgttcccaacactccagccccttggtcctgtggatggctggatcccgcctgaaacggacctgcagagcagcagcacccttccggtgtggaggctatgtagctggtgcgctgctcacggccattcactgcccatgctgagcgcctctcacacaggtaatgcccagcttttctgctgctaacacatttggccagttgttgcagttgctcatcatcttgggaaaggtgtttgtgacttttcagagcccagattcctgttgtctattaaaacttgaagggaggggtgaatagtgtttctctcttcttcccaaaatgaccttagctgtcctaggatagttagtaaaagactttttagcattttgacctagggcctttggctttcactaaaagtggggacctcagtatcccagattgtaattttgccaagtgttagatttgagtctctcatgtggatgcattagtcaggtggttactccttgcttcaaggtacttaccttatttcattgaagacaccgcatttgtgaactcttgcttcctggcctagaaccattcagcctaccctgtatttgccataaactccacaattcacaccaaaatgtctgtacttagagctaattcgcatatatacaggaagggctcttagaatcagtttgtgggcacagagcctcaggagtaaatgaagttactagggctgttcttaccatctccttctggccaaatagcacaacatttcctcgttctgctctgacctcttagcttagaaggaagattcagaagtgaggggctaagaaggttgtccttgcctaatgctctgatctgtaagtgaatagggcagaacagttcagccttgaggttagaatttagcaggagctatcctgacttaatatccagttgtggggtttgcaaaacaaaacagctgtatgtaatcattgccactagttccatctagaactcctttctagtttgttatttttaaaatgtttatacataaaaccaccaaaatacatagcttcgacaagatggaatacaccaaatggacaggcctggcatgtacccacagagactgagagttggtgctggtggttgtggtggcagatgatattacctgaagaagggacgaatgggtgctgggcaggacaaagcatcagctgtccagttcaggcctctcctctttccctggtgtcttcattttcctccgtctccctgctgtcccttaccctctgcccaatctctcattactcctggtcttgggagttgccttctgaggatactccactgggggtacctgagcctggattagagggcagggggaggatattgcctagccaaagtgggtgttcaataaagaaccatttggagatggtcttc

SEQ ID NO: 343030 - DNA, 2470 bp, Homo sapiens
gcggaagtggaggagcggccggaagtagccggaatctctgaaagactgaccgactgactctgacaggatccggggctgagggaaggaggcggcggccatggagttgggcgagctgctctacaacaagtctgagtacatcgagacggcatctgggaacaaagtcagtcgccagtcagtgttgtgtggaagccagaacatcgttctcaatggcaagaccattgtgatgaatgactgtattatccgaggggatctggcaaatgtaagagttggacgtcattgtgttgtgaaaagtcgtagtgtcataaggccaccattcaagaagttcagcaaaggtgttgcattctttcctttacatattggagaccatgtctttattgaggaagattgtgtggtcaacgcagcacagattggttcctatgttcatgttgggaagaactgtgtgattgggcgccgatgtgtgttgaaagactgctgcaaaattcttgacaacacagtattacctccagaaactgtggttccaccattcactgtcttctcaggctgcccaggactcttctcaggggagctcccggagtgcactcaggagctgatgattgacgtcaccaagagctactaccagaagtttttgcccctgacgcaagtctagcatctctgcctcatgtcttgaatcttttgtgggcacagagcctcaggagtaaatgaagttactagggctgttcttaccatctccttctggccaaatagcacaacatttcctcgttctgctctgacctcttagcttagaaggaagattcagaagtgaggggctaagaaggttgtccttgcctaatgctctgatctgtaagtgaatagggcagaacagttcagccttgaggttagaatttagcaggagctatcctgacttaatatccagttgtggggtttgcaaaacaaaacagctgtatgtaatcattgccactagttccatctagaactcctttctagtttgttatttttaaaatgtttatacataaaaccaccaaaatacatagcttcgacaagatggaagtttatttctctctcccataacagtgcagtgatagtcagctggtccaggccaggcaaggggctggtccatgatgtcatcaggcacccaggttcctactgtcttgccatgtggccacagttagcaacaaaggaggctgtaaatttagtttctacttgggcagccaaaactctgaggaaggagattctgctagtaaaaaggagtgggggaagaatggccattgggagacaacaagcagactcaaccaggcctctttgttggcttcctttcctcctgctgcacatgagccttcgccgtgcatttggagccatgacagctgatagctccagacctgcatcctcctagcttgggggctctgaatgaaaggtttcttcccttccagttcgaatttggaaactcccaaagttctcaatggtttgttgtgagttccatgtcctcttggatcagtcactgtggccatgcatgtttggccacatgattaatccagtctgggtcatgaccttttcttcatccaaaacaaggtgatgggaagacaaaaacaatagctactacaaacaataggagtttataattatgtgctgatgtattcgaagatgtgttgacagtcgtgagtgtgtatcctaggaaaggcgagctggactctgtctccatggtggctctcaccccagggacctaggaacagcctgtcaccacacaattacttttataaccctggagatgaaaatctccttgtcctcaaaatacttccagaagaacaaccagatgggaaggaccttggttgggactctttccagttcacttggggcagagggaatttaatggctcacgtagctgaaaaggatgggctagattgggcttcaggctgcatcccaggactccaaacagggatctgtctctttggctctcagctctgctttcatttgagttggctttattcttgggcttcacagtgtggccccacagcaccagttattgataaaaagagctcccctttgctgacagaactgctggatttggttctcattggtccagacgaggaaggtatccagcctcaagtcatcattgtggccaggaagatggaatacaccaaatggacaggcctggcatgtacccacagagactgagagttggtgctggtggttgtggtggcagatgatattacctgaagaagggacgaatgggtgctgggcaggacaaagcatcagctgtccagttcaggcctctcctctttccctggtgtcttcattttcctccgtctccctgctgtcccttaccctctgcccaatctctcattactcctggtcttgggagttgccttctgaggatactccactgggggtacctgagcctggattagagggcagggggaggatattgcctagccaaagtgggtgttcaataaagaaccatttggagatggtcttc

SEQ ID NO: 343031 - DNA, 1452 bp, Homo sapiens
cagaacaaaaacaaaagatagacaggccgcgaggtaatcaggccgaggtacagtgcagtgatagtcagctggtccaggccaggcaaggggctggtccatgatgtcatcaggcacccaggttcctactgtcttgccatgtggccacagttagcaacaaaggaggctgtaaatttagtttctacttgggcagccaaaactctgaggaaggagattctgctagtaaaaaggagtgggggaagaatggccattgggagacaacaagcagactcaaccaggcctctttgttggcttcctttcctcctgctgcacatgagccttcgccgtgcatttggagccatgacagctgatagctccagacctgcatcctcctagcttgggggctctgaatgaaaggtttcttcccttccagttcgaatttggaaactcccaaagttctcaatggtttgttgtgagttccatgtcctcttggatcagtcactgtggccatgcatgtttggccacatgattaatccagtctgggtcatgaccttttcttcatccaaaacaaggtgatgggaagacaaaaacaatagctactacaaacaataggagtttataattatgtgctgatgtattcgaagatgtgttgacagtcgtgagtgtgtatcctaggaaaggcgagctggactctgtctccatggtggctctcaccccagggacctaggaacagcctgtcaccacacaattacttttataaccctggagatgaaaatctccttgtcctcaaaatacttccagaagaacaaccagatgggaaggaccttggttgggactctttccagttcacttggggcagagggaatttaatggctcacgtagctgaaaaggatgggctagattgggcttcaggctgcatcccaggactccaaacagggatctgtctctttggctctcagctctgctttcatttgagttggctttattcttgggcttcacagtgtggccccacagcaccagttattgataaaaagagctcccctttgctgacagaactgctggatttggttctcattggtccagacgaggaaggtatccagcctcaagtcatcattgtggccaggaagatggaatacaccaaatggacaggcctggcatgtacccacagagactgagagttggtgctggtggttgtggtggcagatgatattacctgaagaagggacgaatgggtgctgggcaggacaaagcatcagctgtccagttcaggcctctcctctttccctggtgtcttcattttcctccgtctccctgctgtcccttaccctctgcccaatctctcattactcctggtcttgggagttgccttctgaggatactccactgggggtacctgagcctggattagagggcagggggaggatattgcctagccaaagtgggtgttcaataaagaaccatttggagatggtcttc

SEQ ID NO: 343032 - DNA, 607 bp, Homo sapiens
gcggaagtggaggagcggccggaagtagccggaatctctgaaagactgaccgactgactctgacaggatccggggctgagggaaggaggcggcggccatggagttgggcgagctgctctacaacaagtctgagtacatcgagacggcatctgggaacaaagtcagtcgccagtcagtgttgtgtggaagccagaacatcgttctcaatggcaagaactttgtcatttctgttttcctgagcccatatatcagatgtcacagtgcctgcagggatagaaagagatcagatgagtcagtaagactgagtgtgaacaatagagagtggtggggcctggtgaattggagaatgtgaccaatctaagcccaagctggttgttactgtgtgggaatacaggcccacgtggcaacaatcagctttccagagcgtctgattctttttcaaaagcaactggaaatctcactttttaaaatgcaagatgttccactactcaaatagtaatgtttaattttaaatgatttgttaaaatgccacgtgtccttcctgtaggagatagctaaaaaaaattaaaagaaataaataataaaaatgctgcatgagccaaacaaa

SEQ ID NO: 343033 - DNA, 592 bp, Homo sapiens
agctgaaatcatgtagcatatacagaggcacgtcataaattcacagatggaaaataatatgaacagagagatttggacagtatatgatacctaccactgagtggtttaattgtttttccaattaaaaaataaatctcatctctcagatcattgaatctgagtttctaagatgaacaaaatcatcactcagattcttcggggaggcatttggccattctaccgtgtcatgcatctctgcttttgcagaggaggaaggagagacttttgtttagtaatttctccatattggggtcctgctgtgaaaaagtttagctgttcttagcaagcactggaccagaacagcctcagcgattatttaagtgattgtcagacatgcatctgattgaggtgagaaggatattgccagagaaatatcttaacttcttgtaacttcttcaagctccttagagctgggtctttctttccccaggactcttctcaggggagctcccggagtgcactcaggagctgatgattgacgtcaccaagagctactaccagaagtttttgcccctgacgcaagtctagcatctctgcctcatgtcttgaatct

SEQ ID NO: 343034 - DNA, 3367 bp, Homo sapiens
gcggaagtggaggagcggccggaagtagccggaatctctgaaagactgaccgactgactctgacaggatccggggctgagggaaggaggcggcggccatggagttgggcgagctgctctacaacaagtctgagtacatcgagacggcatctgggaacaaagtcagtcgccagtcagtgttgtgtggaagccagaacatcgttctcaatggcaagaccattgtgatgaatgactgtattatccgaggggatctggcaaatgtaagagttggacgtcattgtgttgtgaaaagtcgtagtgtcataaggccaccattcaagaagttcagcaaaggtgttgcattctttcctttacatattggagaccatgtctttattgaggaagattgtgtggtcaacgcagcacagattggttcctatgttcatgttgggaagaactgtgtgattgggcgccgatgtgtgttgaaagactgctgcaaaattcttgacaacacagtattacctccagaaactgtggttccaccattcactgtcttctcaggctgcccaggactcttctcaggggagctcccggagtgcactcaggagctgatgattgacgtcaccaagagctactaccagaagtttttgcccctgacgcaagtctagcatctctgcctcatgtcttgaatctgcttgagctctaagatgaacctggggacaaagtgagccagtcagcacctacaaagagcttttgtgtctttgacatctaccaccctcctccttttaaaaaatttctttagaatttctcaatcttcaaggctctaagtgcttaagaattcactaacagacagaccatctggaggagctgtcttcaaatgctgtgcttacaccttatctatgaacagtcactttgtaccattatctgtggaacacagaatcatctgttcccaacactccagccccttggtcctgtggatggctggatcccgcctgaaacggacctgcagagcagcagcacccttccggtgtggaggctatgtagctggtgcgctgctcacggccattcactgcccatgctgagcgcctctcacacaggtaatgcccagcttttctgctgctaacacatttggccagttgttgcagttgctcatcatcttgggaaaggtgtttgtgacttttcagagcccagattcctgttgtctattaaaacttgaagggaggggtgaatagtgtttctctcttcttcccaaaatgaccttagctgtcctaggatagttagtaaaagactttttagcattttgacctagggcctttggctttcactaaaagtggggacctcagtatcccagattgtaattttgccaagtgttagatttgagtctctcatgtggatgcattagtcaggtggttactccttgcttcaaggtacttaccttatttcattgaagacaccgcatttgtgaactcttgcttcctggcctagaaccattcagcctaccctgtatttgccataaactccacaattcacaccaaaatgtctgtacttagagctaattcgcatatatacaggaagggctcttagaatcagtttgtgggcacagagcctcaggagtaaatgaagttactagggctgttcttaccatctccttctggccaaatagcacaacatttcctcgttctgctctgacctcttagcttagaaggaagattcagaagtgaggggctaagaaggttgtccttgcctaatgctctgatctgtaagtgaatagggcagaacagttcagccttgaggttagaatttagcaggagctatcctgacttaatatccagttgtggggtttgcaaaacaaaacagctgtatgtaatcattgccactagttccatctagaactcctttctagtttgttatttttaaaatgtttatacataaaaccaccaaaatacatagcttcgacaagatggaagtttatttctctctcccataacagtgcagtgatagtcagctggtccaggccaggcaaggggctggtccatgatgtcatcaggcacccaggttcctactgtcttgccatgtggccacagttagcaacaaaggaggctgtaaatttagtttctacttgggcagccaaaactctgaggaaggagattctgctagtaaaaaggagtgggggaagaatggccattgggagacaacaagcagactcaaccaggcctctttgttggcttcctttcctcctgctgcacatgagccttcgccgtgcatttggagccatgacagctgatagctccagacctgcatcctcctagcttgggggctctgaatgaaaggtttcttcccttccagttcgaatttggaaactcccaaagttctcaatggtttgttgtgagttccatgtcctcttggatcagtcactgtggccatgcatgtttggccacatgattaatccagtctgggtcatgaccttttcttcatccaaaacaaggtgatgggaagacaaaaacaatagctactacaaacaataggagtttataattatgtgctgatgtattcgaagatgtgttgacagtcgtgagtgtgtatcctaggaaaggcgagctggactctgtctccatggtggctctcaccccagggacctaggaacagcctgtcaccacacaattacttttataaccctggagatgaaaatctccttgtcctcaaaatacttccagaagaacaaccagatgggaaggaccttggttgggactctttccagttcacttggggcagagggaatttaatggctcacgtagctgaaaaggatgggctagattgggcttcaggctgcatcccaggactccaaacagggatctgtctctttggctctcagctctgctttcatttgagttggctttattcttgggcttcacagtgtggccccacagcaccagttattgataaaaagagctcccctttgctgacagaactgctggatttggttctcattggtccagacgaggaaggtatccagcctcaagtcatcattgtggccaggaagatggaatacaccaaatggacaggcctggcatgtacccacagagactgagagttggtgctggtggttgtggtggcagatgatattacctgaagaagggacgaatgggtgctgggcaggacaaagcatcagctgtccagttcaggcctctcctctttccctggtgtcttcattttcctccgtctccctgctgtcccttaccctctgcccaatctctcattactcctggtcttgggagttgccttctgaggatactccactgggggtacctgagcctggattagagggcagggggaggatattgcctagccaaagtgggtgttcaataaagaaccatttggagatggtcttc

SEQ ID NO: 343035 - DNA, 1498 bp, Homo sapiens
gcggaagtggaggagcggccggaagtagccggaatctctgaaagactgaccgactgactctgacaggatccggggctgagggaaggaggcggcggccatggagttgggcgagctgctctacaacaagtctgagtacatcgagacggcatctgggaacaaagtcagtcgccagtcagtgttgtgtggaagccagaacatcgttctcaatggcaagaccattgtgatgaatgactgtattatccgaggggatctggcaaatgtaagagttggacgtcattgtgttgtgaaaagtcgtagtgtcataaggccaccattcaagaagttcagcaaaggtgttgcattctttcctttacatattggagaccatgtctttattgaggaagattgtgtggtcaacgcagcacagattggttcctatgttcatgttgggaagaactgtgtgattgggcgccgatgtgtgttgaaagactgctgcaaaattcttgacaacacagtattacctccagaaactgtggttccaccattcactgtcttctcaggctgcccaggactcttctcaggggagctcccggagtgcactcaggagctgatgattgacgtcaccaagagctactaccagaagtttttgcccctgacgcaagtctagcatctctgcctcatgtcttgaatctgcttgagctctaagatgaacctggggacaaagtgagccagtcagcacctacaaagagcttttgtgtctttgacatctaccaccctcctccttttaaaaaatttctttagaatttctcaatcttcaaggctctaagtgcttaagaattcactaacagacagaccatctggaggagctgtcttcaaatgctgtgcttacaccttatctatgaacagtcactttgtaccattatctgtggaacacagaatcatctgttcccaacactccagccccttggtcctgtggatggctggatcccgcctgaaacggacctgcagagcagcagcacccttccggtgtggaggctatgtagctggtgcgctgctcacggccattcactgcccatgctgagcgcctctcacacagaactgctggatttggttctcattggtccagacgaggaaggtatccagcctcaagtcatcattgtggccaggaagatggaatacaccaaatggacaggcctggcatgtacccacagagactgagagttggtgctggtggttgtggtggcagatgatattacctgaagaagggacgaatgggtgctgggcaggacaaagcatcagctgtccagttcaggcctctcctctttccctggtgtcttcattttcctccgtctccctgctgtcccttaccctctgcccaatctctcattactcctggtcttgggagttgccttctgaggatactccactgggggtacctgagcctggattagagggcagggggaggatattgcctagccaaagtgggtgttcaataaagaaccatttggagatggtcttc

SEQ ID NO: 343036 - DNA, 1206 bp, Homo sapiens
gcggaagtggaggagcggccggaagtagccggaatctctgaaagactgaccgactgactctgacaggatccggggctgagggaaggaggcggcggccatggagttgggcgagctgctctacaacaagtctgagtacatcgagacggcatctgggaacaaagtcagtcgccagtcagtgttgtgtggaagccagaacatcgttctcaatggcaagaccattgtgatgaatgactgtattatccgaggggatctggcaaatgtaagagttggacgtcattgtgttgtgaaaagtcgtagtgtcataaggccaccattcaagaagttcagcaaaggtgttgcattctttcctttacatattggagaccatgtctttattgaggaagattgtgtggtcaacgcagcacagattggttcctatgttcatgttgggaagaactgtgtgattgggcgccgatgtgtgttgaaagactgctgcaaaattcttgacaacacagtattacctccagaaactgtggttccaccattcactgtcttctcaggctgcccaggactcttctcaggggagctcccggagtgcactcaggagctgatgattgacgtcaccaagagctactaccagaagtttttgcccctgacgcaagtctagcatctctgcctcatgtcttgaatctgcttgagctctaagatgaacctggggacaaagtgagccagtcagcacctacaaagagcttttgtgtctttgacatctaccaccctcctccttttaaaaaatttctttagaatttctcaatcttcaaggctctaagtgcttaagaattcactaacagacagaccatctggaggagctgtcttcaaatgctgtgcttacaccttatctatgaacagtcactttgtaccattatctgtggaacacagaatcatctgttcccaacactccagccccttggtcctgtggatggctggatcccgcctgaaacggacctgcagagcagcagcacccttccggtgtggaggctatgtagctggtgcgctgctcacggccattcactgcccatgctgagcgcctctcacacaggtaatgcccagcttttctgctgctaacacatttggccagttgttgcagttgctcatcatcttgggaaaggtgtttgtgacttttcagagcccagattcctgttgtctattaaaacttgaagggaggggtga

SEQ ID NO: 343037 - DNA, 748 bp, Homo sapiens
ctttggcctccattctctcttctcacctacaagtattggccctttcagatgccagtaggtgcttacacacatacacatacacacacaaacacacacacacacacaaacactctgaccatccctacttcctagttctctaattcagcctctactcattgccctgactccatatgaaaaaggcccaggcactaaactaaccaagagaaacttctccttagaaggtagtgttactaggaaagttgagtaatagacaatagaattctcttttgcagagagaagaggagaaagtccatgaacactcacagtggcatgtggcaagaggtggtggatgctggaagctaatgcctagtagtgctaaatgtcaccactcagatcagctgggcccagcttcagaaaagatgctctttatatccaagttaaacctctgctgcagacagaaccccagcacagccattaataaaccacaccaccctacctccaaaagtttctcaacacactgcctggctatatccatctctacattacctgggataacgcagtaaatagagaggggtatttcccaggtctctgtctatagcagagattcatcttggtgctgggagaagttaacaattacctgaatatgaggaactgtgggcctagcaccatgaagaacttctaaaatagctctgcttgtacaaatagttcgttctgtcactctccatgcactgaggaagtttgggaggcagtgaggactaaaacagagaaa

SEQ ID NO: 343038 - DNA, 612 bp, Homo sapiens
  misc_feature (18)..(18): n is a, c, g, or t
  misc_feature (26)..(26): n is a, c, g, or t
  misc_feature (79)..(79): n is a, c, g, or t
gcctagaagggaaggatnggaggtangtggctttggtgacacactcacttctttctcagcctccaggacactatggccngttttaagagacatcttatttttctaaaggtgaattctcagatgataggtgaacctgagttgcagatataccaacttctgcttgtatttcttaaatgacaaagattacctggctagacccaggataaagacttggttctgcattctatggtgtggtcatcttggctggtcagaaacctaaaacaatgtaatttaaatcaatttactttatcctgataaataaggaatggggtttcattgaactattttaatatactgatccaaaacaatttcacatatgaattccaaggcagctagaagaatggcaaatgcgtgaaattaacttggtgggtgaactagaaccatatcaagaaatatttcaaaaatcacaccaatcttactaaggccactattcagagaacttgtcccttaatgccatggttcagcatcaccattcactgtgatttatatgcctgaactacatagttcactcaaagtcatattgctggtactgtatcagccaggataaagacttggttctgcattctatggtgt

SEQ ID NO: 343039 - DNA, 480 bp, Homo sapiens
  misc_feature (52)..(53): n is a, c, g, or t
atgcagcaaatgaggcacaagaagttagtaccccgctaggtagtaagaggtnntcctgggtctagccaggataaagacttggttctgcattctatggtgtggtcatcttggctggtcagaaacctaaaacaatgtaatttaaatcaatttactttatcctgataaataaggaatggggtttcattgaactattttaatatactgatccaaaacaatttcacatatgaattccaaggcagctagaagaatggcaaatgcgtgaaattaacttggtgggtgaactagaaccatatcaagaaatatttcaaaaatcacaccaatcttactaaggccactattcagagaacttgtcccttaatgccatggttcagcatcaccattcactgtgatttatatgcctgaactacatagttcactcaaagtcatattgctggtactgtatcagccaggataaagacttggttctgcattctatggtgt

SEQ ID NO: 343040 - DNA, 555 bp, Homo sapiens
  misc_feature (12)..(12): n is a, c, g, or t
  misc_feature (19)..(19): n is a, c, g, or t
atggtgtctagnggatccntcgctatcatcggacccttcagcagcttctcatagggcatagaacaaaatccacactcttccctgaggcccacaaagccctgtcccccgtgactgctgcctccctctagggaacacatgccttccagccgttcctgcctcctggcctttgtctctgctgttcctacccccaagacagccttgtgccccagacactaccaggtagctcttcatcactcagccttccctgaccaccattcatcagggcttgctcagccagtcgccctgtcacatcatccagacaagggctttcttcacagtcctggccacctctgaaatgcccctgtttatatttctttatgcattgcctgcctgtctcctcccgccccacactgtatgctcctataaggccagaggtttgccatcttgctctgcactgctacctctgcccttagcacagcacctaagcacatgagcatgcatgaagccttaatgaatggtggttgccttattgtcttccccattggttgggccatgacagatgcaagagagtctgtg

SEQ ID NO: 343041 - DNA, 590 bp, Homo sapiens
cgtctcaaaaaaataaattaataaaaaataaaagcagaaatcagataacattgtatctctgcctagcacccttcagcagcttctcatagggcatagaacaaaatccacactcttccctgaggcccacaaagccctgtcccccgtgactgctgcctccctctagggaacacatgccttccagccgttcctgcctcctggcctttgtctctgctgttcctacccccaagacagccttgtgccccagacactaccaggtagctcttcatcactcagccttccctgaccaccattcatcagggcttgctcagccagtcgccctgtcacatcatccagacaagggctttcttcacagtcctggccacctctgaaatgcccctgtttatatttctttatgcattgcctgcctgtctcctcccgccccacactgtatgctcctataaggccagaggtttgccatcttgctctgcactgctacctctgcccttagcacagcacctaagcacatgagcatgcatgaagccttaatgaatggtggttgccttattgtcttccccattggttgggccatgacagatgcaagagagtctgtg

SEQ ID NO: 343042 - DNA, 398 bp, Homo sapiens
  misc_feature (12)..(12): n is a, c, g, or t
  misc_feature (19)..(19): n is a, c, g, or t
atggtgtctagnggatccntcgctatcatcggacccttcagcagcttctcatagggcatagaacaaaatccacactcttccctgaggcccacaaagccctgtcccccgtgactgctgcctccctctagggaacacatgccttccagccgttcctgcctcctggcctttgtctctgctgttcctacccccaagacagccttgtgccccagacactaccaggtagctcttcatcactcagccttccctgaccaccattcatcagggcttgctcagccagtcgccctctttagcccgatacctcccccagcccgcaggtcaatgggtgataccattgtggtcacataaccagccacaaagcagaagagttctccatgtggtgccgatgaatagcgagggta

SEQ ID NO: 343043 - DNA, 375 bp, Homo sapiens
cattgaacacctgccgtttggtcaagcatttctaggcactggagattcaaagtattcacatattccttttctttataagactagcaagattctgaagattcatgtactcattcactcaacaaatatttgccaatcactactaaggttgccagacactattttagtgcttgggatgtatcagtaaacagaagagagagagaaaacaaatacccttccctgttggagctttcattctaatataaggagaaagatgataaacgtaagagaattatgtaatatgttagaaggcatatggggaaaaaaaaatacaccagggtaaggggtatgaggaaaactggaggaagggggtttgcaattttttttaagagggaatcc

SEQ ID NO: 343044 - DNA, 509 bp, Homo sapiens
tctattgacattgtgtcagagttcacaaatgtatgatgtggagttacacagtgtgacaaagaacactgatatcatgtgcatttagaacaagcttcgtagaaatattgtggctgctctgattcctccactaagccagagcctcatatttggtgtgtagtgggaggcatctcagccccagcaagtgggagggagggttaatgctctaaacaaggaacttcctcttctgttggaggcgtgggttagtgatctgtgctgttgtgtgggaagccttgttgatttatccccttgatcttgcctccacccttcagcttgagggtgtgtgtgtgtgtgtgtgtgtgtgtgtgtgtgtgtgtgtgcatgcgcatgggcaactttctaaataccaaaatatacattctaattataaactagtgccattcgttccttgcccccaccctcccttgtttactttcttttggataaagtgctgcttctttcgaagggcccctgtttctgtggcacagcctatt

SEQ ID NO: 343045 - DNA, 783 bp, Homo sapiens
catgaacatagatttaaaaatcttaaaaaattatcgagtagtatctggtgatatataacatgaataatatatccaaattaggttattctagggatgcaagattaacttaacacatgaaaattagtcaattaccttaccatattaacagaataatacagacaaccacgcataatcatgtgcaatagataacaacaaacattatgcttcggtggaaaatgatggtaaagcttttcatttgagtttagagacaagataaagatgatggaaatgactgcttgtattcaaccagtggaatgggcaagaaaaataaataaatgtataaattagggaaaggaagaaataaaactatcattatttgcggttatgactctataaatagtgcaaaacaaatctacagagatgttcttagaattaatactgagatcgataaggtttctggatacgaggttaatttacaaattaattttatctgtgtatagcaagaaatagaaagtgaatgaggctgccttccactttcatgtcaagtgactttgggcatatcttctaacttctattgtcttagttcactcatctataaaatatggatgataatactatattctactgattttattttttccatattttaacatctttgattaattgtattctgtattttaacatatatgccatattttttcctagtcaaccataaaaaacattttcctccccaaaatggctgtcttctctaatagtttcccaaaggcaaagaggattaaagtcattttagaaatatgattccca

SEQ ID NO: 343046 - DNA, 627 bp, Homo sapiens
ttaatcatcttttgcacacggggttgtaatacacttagaaatttgaagaaatttacagatacgtcaggtgtcactggattacaatgcaaggttgcaggcaaaaaccttcagccaaagaggacggctcttaccttcgagagcagtactagaattcataaagtatgaaattaggtctcagtgtgacactctaggcccaacagaaaccaacatggaatcttgctccacctgactccagtcctaagatggaaattactcagaaggaaggcaggacgaatatcgctgatgagaccagggagatgttttacaaaggctgtcatctgctcgaccatgcccctcaggtccctggtcactcttcctgggggagaaggttggtgtcaaccctttcacgaaaaggcagcagctctacagcttactgcccagtaaggccaatgggcctctggccccctttctgcttctgaatgacagaaaagtgcctatcattggatggcactaccattgtttcactatctcacagggggaccccaacccctctcccattcagcctggtgtttctcagccttcaatccactgccctttggataaaccaaaaaccgctccaaacctcccttcatgttatttgaaatttca

SEQ ID NO: 343047 - DNA, 521 bp, Homo sapiens
ggcggtgtttgtagcttgagagctactagccaggagctctgagtgacaggtcccagacagagtcaacaggcgtctccaacaggtggatgttaagaagacaaggcagagagaagaggaagtctcaccgatgactccaggcttcctggcatggaaatgaggtgtgttggggtgggcggaggctatcttactgattcagaggacactggatcttcctctgtaattttaacattatgcacatgttatgggacacccagattgaatgtttgggtgttataccagcatggagctcacgcttgtgcagaatcccgatgcagaaggaggatctcacctctggggtgcaggtttgaaggtgtgcactggaggctgcctggagacacctaaagagaagtaagcactagggtctgtgcagatgggcctggccttcaacagagacacctggacaggagggatgcctttagcacataagccaacgagtggaatttgagccatgaaagtgcaggagcttcccccttagacagtag

SEQ ID NO: 343048 - DNA, 183 bp, Homo sapiens
catcacctaacaccatacaaaaattaacttgaaatggatcaaagaccgaaatgcaaatgtaaaacaacataatacttagaaggaaatacaggtcaaaagttttatgacattgtatttagcaatgatttctgggatatgactcctaaggcacaaccaacaaaacaaaaaaaattggccgggtgc

SEQ ID NO: 343049 - DNA, 536 bp, Homo sapiens
tttgctgatgggctggatgtagagcaggaaagaaagacatgagaaggcaactgaatttttctacctaagtgactagaatgagaaggcaagacgaaggtgttgcggggaaacagcagggctagctggttctgaacactgtacatccagtcctctaagtgaccatgtcaagtaggtagctggagggatgagtctcaaattggagacatggtctaggatggagatagaaatttggcagtgaccagatcttggggtaataaaggccactggactgatgagacactttagggtatggagatgagggcaggctgagacccgaatgctataatattaaaagattaggttgctgaagagaaaccagcaaaggaaactgattttaaaatgaagaaggagagccaagcaaggtaagggtttaaaggaggagtcagagatcatttgacaaatgctgttgcagggcaaggaggaccaggactgaggactggccgccaggctaaacaacatgggctccctgcattgggaaggctgttccagcggaggga

SEQ ID NO: 343050 - DNA, 504 bp, Homo sapiens
ggcgggccggggatgcgccatggccatggcccggctgggctcgtggctcggggaggcgcagtggctcgcgctggtgtcgctcttcgtcgcggccctggccacggtaggcctgtacctggcgcagtgggcgctggccagggcgcgaccccagccccagcggcgggcggtggagcctggagaggggccgcgcccggggtccgacgcgctgctctcctggatcctgacgctgggcagctggaggagccagtggcaggcggcctgggtgaccgccctgaacgaggaggccgagaggaaaggggtgctccaggccctgggctccgcgagggacaggctggcagttggagggaccgtcagaagtgctcatccgcgccagccagtacctgccttgcctggagtcccggggcgaattcccgtgcccgatcggacacttactgagcttgcacatgatacatgaatagctgtgaccccaatgtgcttccgcctctcatagagctgaatttcacc

SEQ ID NO: 343051 - DNA, 939 bp, Homo sapiens
gtcatgctgttggagaacatcatcctgttgctgttggccaccgactttctccagggggcatctgtggaccagcctgcagaccatagctggggtcctgtctggatttctgattgcacagcaggcttccaccactgtcactctcaggcctgcggtgggaccgtcaaagccagcacctgcacctctcacgtggggcctcgtgcttctgcaacatgggccaggacagagattccccagtcctctgcaacaactcctgccctccctccagagcctgctctctgtcacccacaccctgaagaggtgcctggaagtggcctcgggttcttttcttgctcacagcagccgggggttggatgtggcctgtgtgagtggcctggacctgggaaaggaatgacctggacacaaacacttagtgagatgcaggggctgttcacgggtcagagaaatgtcacacactgtggcttcgtaacaagcatttgagagccacaggccaccctgggtttcagctctgttcttcttcatgagacgtcacgggtcctcacttcttccagcttcaggttttcccccagtggtaatatctcgcaaaacggtggcacaacatcacagccaggatctcaaagtagtacgtcgaggtgcagggagaacccttccatcaccacgaggacccttcatgtggcccccttcctctcgcccctgccacctccttccctcctggcaaccattattctgttctctgtttctattattctatcacttggagaatgcgttgtgaaagtaccacacagtgtgtgcaccctggggatcggtcttgttcacttggcagagctctccggagagcctcccgggttgctccttgcttttgatggctgagtcgcatcccatggtttggacggaccacagcttgtttcatcgtcgacccatggacgggcatctggttcatcc

SEQ ID NO: 343052 - DNA, 333 bp, Homo sapiens
cgacagcagcagtgagcatgagatcattgcattgcagcactgtagcaaactggcaccctgcctttgcacccctttggttcaggagacaaacgtgtgtaatcctcatttctaaagtcagcacagcctggaaggattcctggtctctcccaccttctaccattctgctgccagtgacggcaaggattggtgtagcttctgcgcagtgctttgtgcctggaataccgagaaggaagaaaaagaagacaagcaccctggtccttttctaagaaattacaggcgcccttgaagaaaaaatctgagtgtgtcctactacatgcaagagtgctggaaaaa

SEQ ID NO: 343053 - DNA, 1009 bp, Homo sapiens
agctttgacgggagcttcccgggagccgtttgtgcccggggtaaccccgttccggccaagccgcttcagcgggggacgtagccatgaaggaagagaaggagcacaggcctaaggagaagcgagtaaccctgttaacccccgccggggccacaggcagcggtggtgggacctcgggggacagctccaagggggaagataagcaggatcgcaacaaggagaagaaagaagcgctgagcaaggtgcccggtcggccgctggcccgggagagggcgggacgagtccgcagcgcggggaggatggctgggaatggggctgccccctttctttctcaggttctccttctatctcttcgcctgaatggaagtcgcatcatcctggttcatccattcacccgaaatggggagagcccctcccggccaaatcctgggtgggggtgaggaaaagaggggactccccaaacgggaagggtttaggtcagagctgtgagatgataatgggagggaagagcgacggtataaagaatgaggaactaaaggtgtaattggggagaaatattaaatagtgaaggagacatgagggatgggaatattattcatggaggcgagttgggggagagtgcagggtgattaatggtacaggagggtagatcgagagcatcctattttgagagcaatgggtagatttttcgtattcgttagagttttgaattcttaagttcaatgggcaaggattttgttttaagatgtgttggacgtgggagaaacttgttgctaaatcaagatttcgtggcacccacaaagaccagcgttggcttactaagttattgccactagatctgttaaaaaatgggtgatcgaaaatgatgcacaaacctggtaaactgcagggctgctgtaaagagcaaaacctgcgatttttccttgctccaggtggttctcatttccaagggtttttttaaaccgcgttactattatgtttgactaattctgagcattgggctgcagaagaa

SEQ ID NO: 343054 - DNA, 396 bp, Homo sapiens
cacactttcgttgatacaaaaatgtgttctatccttcactgtacctgtactacaaggacagaacacactttcgttgatacaaaaatttaaatagttatgttacttctgtatccagtgtcctaaagttttaggattagttttagttttttgtttgcttatatgagcttagcgtaaagaatatttttaaacttcgtgttttgtcatcagcatcttttctattaagaggtaaaatgtagtccttgtttgactcttgacaatccagtgtgtttgatcttaggtctcatgatctgagtgcataccctctccaggaaggaaactgcaccagtgtctattcctgttaaatagcaacttttagtctcagcttgtttcgttttgatgtcaataaatagtaacagc

SEQ ID NO: 343055 - DNA, 562 bp, Homo sapiens
gcggggcaatctattccgatctgtgggattccttaccacgcttttgaaggctacctgatacaactgttggaagtggattactcagcttgtctttaatatatgcatacttgtaattgggccagacacctgcgagtacatttacataattgctttcctctctgcagtttgtatcctcatatgtatgccagagcatacatcaactttaaaaaccaagaggacattattttgttcagggatcgctttgatggttatgtattccttgacaataaaggtgagtcctggtaactgaagtaaaaagggaatttctttgtcatttgtatgtttaagacaactcgtgcattgcgttgcttcctagagttttacacatttaataagcttattgcagtcttataaatagacgtgacttttcacagtccttggttatttttattaacctactatttttttagtttgatcaactgagtgaaattgcaactgttttctcctcgtgtgacacattttttgccctggcttaaacctgctgttttgactgtagaatttcagccgcagtactgataagtga

SEQ ID NO: 343056 - DNA, 2514 bp, Homo sapiens
  misc_feature (2384)..(2384): n is a, c, g, or t
agctttgacgggagcttcccgggagccgtttgtgcccggggtaaccccgttccggccaagccgcttcagcgggggacgtagccatgaaggaagagaaggagcacaggcctaaggagaagcgagtaaccctgttaacccccgccggggccacaggcagcggtggtgggacctcgggggacagctccaagggggaagataagcaggatcgcaacaaggagaagaaagaagcgctgagcaaggtggtaattcgaagattacctcccactttgaccaaggagcagcttcaggaacatcttcaacctatgcctgagcatgattattttgagtttttttctaatgatacgagtttgtatcctcatatgtatgccagagcatacatcaactttaaaaaccaagaggacattattttgttcagggatcgctttgatggttatgtattccttgacaataaaggtcaggaatatcccgctatagtagaatttgcaccttttcaaaaagctgcaaaaaagaagactaagaaaagagataccaaagtcgggactatcgatgatgatccagaatatagaaagtttttggaaagttatgccacagataatgagaaaatgacatctactccagagacactgctagaggaaatagaagcaaaaaatagagaattaatagctaaaaagacaaccccacttttgagcttcctgaaaaacaagcagagaatgagagaagaaaagagagaagaaaggaggaggagagaaatagaaagaaaaagacaaagagaagaagagaggaggaaatggaaagaagaagagaaacgaaaaaggaaagatatagaaaagctaaagaagatagacagaattccagaaagggacaaattaaaggatgaaccaaagattaaggtacacaggtttctgttacaagctgtgaatcagaaaaatctgctcaagaagccagaaaaaggagatgaaaaagaattggacaaaagagaaaaagccaagaaattggacaaagagaatctcagtgatgaaagagccagtgggcaaagttgtacattgcccaagcgttctgatagcgaacttaaagatgaaaaaccaaagagacctgaagatgagagcggcagagactatagggagagggaacgggaatatgaacgagatcaggagcgcatacttcgagaaagagagaggctgaagcggcaagaagaagagcgccgtaggcagaaggagcgctatgagaaagagaagacttttaagagaaaagaagaagaaatgaaaaaagagaaagacacacttcgggataaaggaaagaaggctgaaagtacagaatcaataggcagctcagaaaaaactgaaaagaaagaagaagtggtcaagagagatcgaataagaaacaaggatcgtccagcgatgcagctttaccaaccaggagctcgaagccgaaatcgactctgtccccctgatgacagcaccaagtctggagattcagcagcagaaaggaagcaggaaagtggtattagccatagaaaagaaggaggagaggagtgataagtccagatggccttaggtgtcctgactgtctaggcagccaaagagcacacgttaagcaatccagaggtgccttcagggcaaagaatagagagaaagggagccgctgtgctggtggggtacactgcagaggagtaagtcttgtgtcaaagcaggaatctgatcagaggttcagaattggaagtacaatttcattgcttttgcaatttctacaaattaattttaaagtgtcagaaaaaggtgacggcaaggacatgcattgcaatttgcagggggaattgtcaagtgaggacttcatcacatatgacacgagagaaaagtaagagctggttctaaaatcaaaagctgttgttcatcctgaattgaattttctgaatttgggtggagcagagtcgctttgaagccttgttccgatctaattctattgtattgttgatgataagtgttgacattgggtagtgtagaagcaacaagcatgtccttgtagtacaggtacagtgaaggatagaacacactttcgttgatacaaaaatttaaatagttatgttacttctgtatccagtgtcctaaagttttaggattagttttagttttttgtttgcttatatgagcttagcgtaaagaatatttttaaacttcgtgttttgtcatcagcatcttttctattaagaggtaaaatgtagtccttgtttgactcttgacaatccagtgtgtttgatcttaggtctcatgatctgagtgcataccctctccaggaaggaaactgcaccagtgtctattcctgttaaatagcaacttttagtctcagcttgtttcgttttgatgtcaataaatagtaacagcccttcncacaactcctcgttattctagcgcccaaccctaccctatacctatcccccttactttgggggggggccgggacccaattgcccctatggggagtggtttacaattaattgcccgcgttttaaacgtcgga

SEQ ID NO: 343057 - DNA, 2593 bp, Homo sapiens
agctttgacgggagcttcccgggagccgtttgtgcccggggtaaccccgttccggccaagccgcttcagcgggggacgtagccatgaaggaagagaaggagcacaggcctaaggagaagcgagtaaccctgttaacccccgccggggccacaggcagcggtggtgggacctcgggggacagctccaagggggaagataagcaggatcgcaacaaggagaagaaagaagcgctgagcaaggtggtaattcgaagattacctcccactttgaccaaggagcagcttcaggaacatcttcaacctatgcctgagcatgattattttgagtttttttctaatgatacgagtttgtatcctcatatgtatgccagagcatacatcaactttaaaaaccaagaggacattattttgttcagggatcgctttgatggttatgtattccttgacaataaaggtcaggaatatcccgctatagtagaatttgcaccttttcaaaaagctgcaaaaaagaagactaagaaaagagataccaaagtcgggactatcgatgatgatccagaatatagaaagtttttggaaagttatgccacagataatgagaaaatgacatctactccagagacactgctagaggaaatagaagcaaaaaatagagaattaatagctaaaaagacaaccccacttttgagcttcctgaaaaacaagcagagaatgagagaagaaaagagagaagaaaggaggaggagagaaatagaaagaaaaagacaaagagaagaagagaggaggaaatggaaagaagaagagaaacgaaaaaggaaagatatagaaaagctaaagaagatagacagaattccagaaagggacaaattaaaggatgaaccaaagattaaggtacacaggtttctgttacaagctgtgaatcagaaaaatctgctcaagaagccagaaaaaggagatgaaaaagaattggacaaaagagaaaaagccaagaaattggacaaagagaatctcagtgatgaaagagccagtgggcaaagttgtacattgcccaagcgttctgatagcgaacttaaagatgaaaaaccaaagagacctgaagatgagagcggcagagactatagggagagggaacgggaatatgaacgagatcaggagcgcatacttcgagaaagagagaggctgaagcggcaagaagaagagcgccgtaggcagaaggagcgctatgagaaagagaagacttttaagagaaaagaagaagaaatgaaaaaagagaaagacacacttcgggataaaggaaagaaggctgaaagtacagaatcaataggcagctcagaaaaaactgaaaagaaagaagaagtggtcaagagagatcgaataagaaacaaggatcgtccagcgatgcagctttaccaaccaggagctcgaagccgaaatcgactctgtccccctgatgacagcaccaagtctggagattcagcagcagaaaggaagcaggaaagtggtattagccatagaaaagaaggaggagaggagtgataagtccagatggccttaggtgtcctgactgtctaggcagccaaagagcacacgttaagcaatccagaggtgccttcagggcaaagaatagagagaaagggagccgctgtgctggtggggtacactgcagaggagtaagtcttgtgtcaaagcaggaatctgatcagaggttcagaattggaagtacaatttcattgcttttgcaatttctacaaattaattttaaagtgtcagaaaaaggtgacggcaaggacatgcattgcaatttgcagggggaattgtcaagtgaggacttcatcacatatgacacgagagaaaagtaagagctggttctaaaatcaaaagctgttgttcatcctgaattgaattttctgaatttgggtggagcagagtcgctttgaagccttgttccgatctaattctattgtattgttgatgataagtgttgacattgggtagtgtagaagcaacaagcatgtccttgtagtacaggtacagtgaaggatagaacacactttcgttgatacaaaaatttaaatagttatgttacttctgtatccagtgtcctaaagttttaggattagttttagttttttgtttgcttatatgagcttagcgtaaaaactaaagataatcctaattctatggtatggtcgatgataagtgttgacagtgggtagtgtagaagcaacaagcatgtccttgtagtacagggtacagcgaaggatagaacgacatttcgttgatacaaaattttaatagtatggtacctgccggagtcccgcgtcccaacagtccagacgcagccaagacaccgcggccccaaagagggcaaccgcgaacgcacatctctctaaacctcggcgtgtgcgagcacgagcaccactacagaaaaaagggagaacaggggcccgcccagagaaaccttagaaacaaccgcggcgtgaacccccacgcaccccagtccgaggaaaccccccacgcagaacaagaggcgagaacatacatcaccaagaacacacacacccgtcacggcaggatacacacagaccgtcaca

SEQ ID NO: 343058 - DNA, 2306 bp, Homo sapiens
  misc_feature (20)..(20): n is a, c, g, or t
  misc_feature (33)..(33): n is a, c, g, or t
  misc_feature (35)..(35): n is a, c, g, or t
taaaaacgtacggctaggtncgaggccgggtgntngagaaggagcacaggcctaaggagaagcgagtaaccctgttaacccccgccggggccacaggcagcggtggtgggacctcgggggacagctccaagggggaagataagcaggatcgcaacaaggagaagaaagaagcgctgagcaaggtggtaattcgaagattacctcccactttgaccaaggagcagcttcaggaacatcttcaacctatgcctgagcatgattattttgagtttttttctaatgatacgagtttgtatcctcatatgtatgccagagcatacatcaactttaaaaaccaagaggacattattttgttcagggatcgctttgatggttatgtattccttgacaataaaggtcaggaatatcccgctatagtagaatttgcaccttttcaaaaagctgcaaaaaagaagactaagaaaagagataccaaagtcgggactatcgatgatgatccagaatatagaaagtttttggaaagttatgccacagataatgagaaaatgacatctactccagagacactgctagaggaaatagaagcaaaaaatagagaattaatagctaaaaagacaaccccacttttgagcttcctgaaaaacaagcagagaatgagagaagaaaagagagaagaaaggaggaggagagaaatagaaagaaaaagacaaagagaagaagagaggaggaaatggaaagaagaagagaaacgaaaaaggaaagatatagaaaagctaaagaagatagacagaattccagaaagggacaaattaaaggatgaaccaaagattaagctgctcaagaagccagaaaaaggagatgaaaaagaattggacaaaagagaaaaagccaagaaattggacaaagagaatctcagtgatgaaagagccagtgggcaaagttgtacattgcccaagcgttctgatagcgaacttaaagatgaaaaaccaaagagacctgaagatgagagcggcagagactatagggagagggaacgggaatatgaacgagatcaggagcgcatacttcgagaaagagagaggctgaagcggcaagaagaagagcgccgtaggcagaaggagcgctatgagaaagagaagacttttaagagaaaagaagaagaaatgaaaaaagagaaagacacacttcgggataaaggaaagaaggctgaaagtacagaatcaataggcagctcagaaaaaactgaaaagaaagaagaagtggtcaagagagatcgaataagaaacaaggatcgtccagcgatgcagctttaccaaccaggagctcgaagccgaaatcgactctgtccccctgatgacagcaccaagtctggagattcagcagcagaaaggaagcaggaaagtggtattagccatagaaaagaaggaggagaggagtgataagtccagatggccttaggtgtcctgactgtctaggcagccaaagagcacacgttaagcaatccagaggtgccttcagggcaaagaatagagagaaagggagccgctgtgctggtggggtacactgcagaggagtaagtcttgtgtcaaagcaggaatctgatcagaggttcagaattggaagtacaatttcattgcttttgcaatttctacaaattaattttaaagtgtcagaaaaaggtgacggcaaggacatgcattgcaatttgcagggggaattgtcaagtgaggacttcatcacatatgacacgagagaaaagtaagagctggttctaaaatcaaaagctgttgttcatcctgaattgaattttctgaatttgggtggagcagagtcgctttgaagccttgttccgatctaattctattgtattgttgatgataagtgttgacattgggtagtgtagaagcaacaagcatgtccttgtagtacaggtacagtgaaggatagaacacactttcgttgatacaaaaatttaaatagttatgttacttctgtatccagtgtcctaaagttttaggattagttttagttttttgtttgcttatatgagcttagcgtaaagaatatttttaaacttcgtgttttgtcatcagcatcttttctattaagaggtaaaatgtagtccttgtttgactcttgacaatccagtgtgtttgatcttaggtctcatgatctgagtgcataccctctccaggaaggaaactgcaccagtgtctattcctgttaaatagcaacttttagtctcagcttgtttcgttttgatgtcaataaatagtaacagcattcaagtgtgaaaaaaaagtgtg

SEQ ID NO: 343059 - DNA, 2194 bp, Homo sapiens
agctttgacgggagcttcccgggagccgtttgtgcccggggtaaccccgttccggccaagccgcttcagcgggggacgtagccatgaaggaagagaaggagcacaggcctaaggagaagcgagtaaccctgttaacccccgccggggccacaggcagcggtggtgggacctcgggggacagctccaagggggaagataagcaggatcgcaacaaggagaagaaagaagcgctgagcaaggtggtaattcgaagattacctcccactttgaccaaggagcagcttcaggaacatcttcaacctatgcctgagcatgattattttgagtttttttctaatgatacgagtttgtatcctcatatgtatgccagagcatacatcaactttaaaaaccaagaggacattattttgttcagggatcgctttgatggttatgtattccttgacaataaaggtcaggaatatcccgctatagtagaatttgcaccttttcaaaaagctgcaaaaaagaagactaagaaaagagataccaaagtcgggactatcgatgatgatccagaatatagaaagtttttggaaagttatgccacagataatgagaaaatgacatctactccagagacactgctagaggaaatagaagcaaaaaatagagaattaatagctaaaaagacaaccccacttttgagcttcctgaaaaacaagcagagaatgagagaagaaaagagagaagaaaggaggaggagagaaatagaaagaaaaagacaaagagaagaagagaggaggaaatggaaagaagaagagaaacgaaaaaggaaagatatagaaaagctaaagaagatagacagaattccagaaagggacaaattaaaggatgaaccaaagattaaggtacacaggtttctgttacaagctgtgaatcagaaaaatctgctcaagaagccagaaaaaggagatgaaaaagaattggacaaaagagaaaaagccaagaaattggacaaagagaatctcagtgatgaaagagccagtgggcaaagttgtacattgcccaagcgttctgatagcgaacttaaagatgaaaaaccaaagagacctgaagatgagagcggcagagactatagggagagggaacgggaatatgaacgagatcaggagcgcatacttcgagaaagagagaggctgaagcggcaagaagaagagcgccgtaggcagaaggagcgctatgagaaagagaagacttttaagagaaaagaagaagaaatgaaaaaagagaaagacacacttcgggataaaggaaagaaggctgaaagtacagaatcaataggcagctcagaaaaaactgaaaagaaagaagaagtggtcaagagagatcgaataagaaacaaggatcgtccagcgatgcagctttaccaaccaggagctcgaagccgaaatcgactctgtccccctgatgacagcaccaagtctggagattcagcagcagaaaggaagcaggaaagtggtattagccatagaaaagaaggaggagaggagtgataagtccagatggccttaggtgtcctgactgtctaggcagccaaagagcacacgttaagcaatccagaggtgccttcagggcaaagaatagagagaaagggagccgctgtgctggtggggtacactgcagaggagtaagtcttgtgtcaaagcaggaatctgatcagaggttcagaattggaagtacaatttcattgcttttgcaatttctacaaattaattttaaagtgtcagaaaaaggtgacggcaaggacatgcattgcaatttgcagggggaattgtcaagtgaggacttcatcacatatgacacgagagaaaagtaagaacacactttcgttgatacaaaaatttaaatagttatgttacttctgtatccagtgtcctaaagttttaggattagttttagttttttgtttgcttatatgagcttagcgtaaagaatatttttaaacttcgtgttttgtcatcagcatcttttctattaagaggtaaaatgtagtccttgtttgactcttgacaatccagtgtgtttgatcttaggtctcatgatctgagtgcataccctctccaggaaggaaactgcaccagtgtctattcctgttaaatagcaacttttagtctcagcttgtttcgttttgatgtcaataaatagtaacagc

SEQ ID NO: 343060 - DNA, 852 bp, Homo sapiens
agctttgacgggagcttcccgggagccgtttgtgcccggggtaaccccgttccggccaagccgcttcagcgggggacgtagccatgaaggaagagaaggagcacaggcctaaggagaagcgagtaaccctgttaacccccgccggggccacaggcagcggtggtgggacctcgggggacagctccaagggggaagataagcaggatcgcaacaaggagaagaaagaagcgctgagcaaggtggtaattcgaagattacctcccactttgaccaaggagcagcttcaggaacatcttcaacctatgcctgagcatgattattttgagtttttttctaatgatacgagtttgtatcctcatatgtatgccagagcatacatcaactttaaaaaccaagaggacattattttgttcagggatcgctttgatggttatgtattccttgacaataaaggtcaggaatatcccgctatagtagaatttgcaccttttcaaaaagctgcaaaaaagaagactaagaaaagagataccaaagtcgggactatcgatgatgatccagaatatagaaagtttttggaaagttatgccacagataatgagaaaatgacatctactccagagacactgctagaggaaatagaagcaaaaaatagagaattaatagctaaaaagacaaccccacttttgagcttcctgaaaaacaagcagagaatgagagaagaaaagagagacgaccgggggggggagagacactcgaacgaaacaagaccagagaagagagagggggactgggacgagagagaacgaaaggaagatttgaaagctagaagatgacgaatccgagggcctctgg

SEQ ID NO: 343061 - DNA, 687 bp, Homo sapiens
  misc_feature (20)..(20): n is a, c, g, or t
  misc_feature (33)..(33): n is a, c, g, or t
  misc_feature (35)..(35): n is a, c, g, or t
taaaaacgtacggctaggtncgaggccgggtgntngagaaggagcacaggcctaaggagaagcgagtaaccctgttaacccccgccggggccacaggcagcggtggtgggacctcgggggacagctccaagggggaagataagcaggatcgcaacaaggagaagaaagaagcgctgagcaaggtggtaattcgaagattacctcccactttgaccaaggagcagcttcaggaacatcttcaacctatgcctgagcatgattattttgagtttttttctaatgatacgagtttgtatcctcatatgtatgccagagcatacatcaactttaaaaaccaagaggacattattttgttcagggatcgctttgatggttatgtattccttgacaataaaggtgagtcctggtaactgaagtaaaaagggaatttctttgtcatttgtatgtttaagacaactcgtgcattgcgttgcttcctagagttttacacatttaataagcttattgcagtcttataaatagacgtgacttttcacagtccttggttatttttattaacctactatttttttagtttgatcaactgagtgaaattgcaactgttttctcctcgtgtgacacattttttgccctggcttaaacctgctgttttgactgtagaatttcagccgcagtactgataagtga

SEQ ID NO: 343062 - DNA, 544 bp, Homo sapiens
ttgattatggttgtgccagtgtgctttatgcctttgggagaccctcttcagatgactgccatcaaaagagtcatagaaagcaatgggttgattcccttatatccacttttgacattttctttgttatagcaagtgtggtattttttttctaaacaggtcaggaatatcccgctatagtagaatttgcaccttttcaaaaagctgcaaaaaagaagactaagaaaagagataccaaagtcgggactatcgatgatggtacagtatagctctaattatataatgctattgctgtggggtttttaaaaataatatctttgtgagagttaattcgaccccaaaattttaaattagaaaatatacaaaataaagtaagtgagaaatgttatttgccgatggaagctttgcttaattgttagactagagagagtttcttgcacagaatctctgctctctttggctagggcatttcattcttcaaccattgaacaatataatgttgactattgagtaacaaatcaccataggtttattgattagaagatag

SEQ ID NO: 343063 - DNA, 2363 bp, Homo sapiens
agctttgacgggagcttcccgggagccgtttgtgcccggggtaaccccgttccggccaagccgcttcagcgggggacgtagccatgaaggaagagaaggagcacaggcctaaggagaagcgagtaaccctgttaacccccgccggggccacaggcagcggtggtgggacctcgggggacagctccaagggggaagataagcaggatcgcaacaaggagaagaaagaagcgctgagcaaggtggtaattcgaagattacctcccactttgaccaaggagcagcttcaggaacatcttcaacctatgcctgagcatgattattttgagtttttttctaatgatacgagtttgtatcctcatatgtatgccagagcatacatcaactttaaaaaccaagaggacattattttgttcagggatcgctttgatggttatgtattccttgacaataaaggtcaggaatatcccgctatagtagaatttgcaccttttcaaaaagctgcaaaaaagaagactaagaaaagagataccaaagtcgggactatcgatgatgatccagaatatagaaagtttttggaaagttatgccacagataatgagaaaatgacatctactccagagacactgctagaggaaatagaagcaaaaaatagagaattaatagctaaaaagacaaccccacttttgagcttcctgaaaaacaagcagagaatgagagaagaaaagagagaagaaaggaggaggagagaaatagaaagaaaaagacaaagagaagaagagaggaggaaatggaaagaagaagagaaacgaaaaaggaaagatatagaaaagctaaagaagatagacagaattccagaaagggacaaattaaaggatgaaccaaagattaagctgctcaagaagccagaaaaaggagatgaaaaagaattggacaaaagagaaaaagccaagaaattggacaaagagaatctcagtgatgaaagagccagtgggcaaagttgtacattgcccaagcgttctgatagcgaacttaaagatgaaaaaccaaagagacctgaagatgagagcggcagagactatagggagagggaacgggaatatgaacgagatcaggagcgcatacttcgagaaagagagaggctgaagcggcaagaagaagagcgccgtaggcagaaggagcgctatgagaaagagaagacttttaagagaaaagaagaagaaatgaaaaaagagaaagacacacttcgggataaaggaaagaaggctgaaagtacagaatcaataggcagctcagaaaaaactgaaaagaaagaagaagtggtcaagagagatcgaataagaaacaaggatcgtccagcgatgcagctttaccaaccaggagctcgaagccgaaatcgactctgtccccctgatgacagcaccaagtctggagattcagcagcagaaaggaagcaggaaagtggtattagccatagaaaagaaggaggagaggagtgataagtccagatggccttaggtgtcctgactgtctaggcagccaaagagcacacgttaagcaatccagaggtgccttcagggcaaagaatagagagaaagggagccgctgtgctggtggggtacactgcagaggagtaagtcttgtgtcaaagcaggaatctgatcagaggttcagaattggaagtacaatttcattgcttttgcaatttctacaaattaattttaaagtgtcagaaaaaggtgacggcaaggacatgcattgcaatttgcagggggaattgtcaagtgaggacttcatcacatatgacacgagagaaaagtaagagctggttctaaaatcaaaagctgttgttcatcctgaattgaattttctgaatttgggtggagcagagtcgctttgaagccttgttccgatctaattctattgtattgttgatgataagtgttgacattgggtagtgtagaagcaacaagcatgtccttgtagtacaggtacagtgaaggatagaacacactttcgttgatacaaaaatttaaatagttatgttacttctgtatccagtgtcctaaagttttaggattagttttagttttttgtttgcttatatgagcttagcgtaaagaatatttttaaacttcgtgttttgtcatcagcatcttttctattaagaggtaaaatgtagtccttgtttgactcttgacaatccagtgtgtttgatcttaggtctcatgatctgagtgcataccctctccaggaaggaaactgcaccagtgtctattcctgttaaatagcaacttttagtctcagcttgtttcgttttgatgtcaataaatagtaacagcattcaagtgtgaaaaaaaagtgtg

SEQ ID NO: 343064 - DNA, 2378 bp, Homo sapiens
agctttgacgggagcttcccgggagccgtttgtgcccggggtaaccccgttccggccaagccgcttcagcgggggacgtagccatgaaggaagagaaggagcacaggcctaaggagaagcgagtaaccctgttaacccccgccggggccacaggcagcggtggtgggacctcgggggacagctccaagggggaagataagcaggatcgcaacaaggagaagaaagaagcgctgagcaaggtggtaattcgaagattacctcccactttgaccaaggagcagcttcaggaacatcttcaacctatgcctgagcatgattattttgagtttttttctaatgatacgagtttgtatcctcatatgtatgccagagcatacatcaactttaaaaaccaagaggacattattttgttcagggatcgctttgatggttatgtattccttgacaataaaggtcaggaatatcccgctatagtagaatttgcaccttttcaaaaagctgcaaaaaagaagactaagaaaagagataccaaagtcgggactatcgatgatgatccagaatatagaaagtttttggaaagttatgccacagataatgagaaaatgacatctactccagagacactgctagaggaaatagaagcaaaaaatagagaattaatagctaaaaagacaaccccacttttgagcttcctgaaaaacaagcagagaatgagagaagaaaagagagaagaaaggaggaggagagaaatagaaagaaaaagacaaagagaagaagagaggaggaaatggaaagaagaagagaaacgaaaaaggaaagatatagaaaagctaaagaagatagacagaattccagaaagggacaaattaaaggatgaaccaaagattaaggtacacaggtttctgttacaagctgtgaatcagaaaaatctgctcaagaagccagaaaaaggagatgaaaaagaattggacaaaagagaaaaagccaagaaattggacaaagagaatctcagtgatgaaagagccagtgggcaaagttgtacattgcccaagcgttctgatagcgaacttaaagatgaaaaaccaaagagacctgaagatgagagcggcagagactatagggagagggaacgggaatatgaacgagatcaggagcgcatacttcgagaaagagagaggctgaagcggcaagaagaagagcgccgtaggcagaaggagcgctatgagaaagagaagacttttaagagaaaagaagaagaaatgaaaaaagagaaagacacacttcgggataaaggaaagaaggctgaaagtacagaatcaataggcagctcagaaaaaactgaaaagaaagaagaagtggtcaagagagatcgaataagaaacaaggatcgtccagcgatgcagctttaccaaccaggagctcgaagccgaaatcgactctgtccccctgatgacagcaccaagtctggagattcagcagcagaaaggaagcaggaaagtggtattagccatagaaaagaaggaggagaggagtgataagtccagatggccttaggtgtcctgactgtctaggcagccaaagagcacacgttaagcaatccagaggtgccttcagggcaaagaatagagagaaagggagccgctgtgctggtggggtacactgcagaggagtaagtcttgtgtcaaagcaggaatctgatcagaggttcagaattggaagtacaatttcattgcttttgcaatttctacaaattaattttaaagtgtcagaaaaaggtgacggcaaggacatgcattgcaatttgcagggggaattgtcaagtgaggacttcatcacatatgacacgagagaaaagtaagagctggttctaaaatcaaaagctgttgttcatcctgaattgaattttctgaatttgggtggagcagagtcgctttgaagccttgttccgatctaattctattgtattgttgatgataagtgttgacattgggtagtgtagaagcaacaagcatgtccttgtagtacaggtacagtgaaggatagaacacactttcgttgatacaaaaatttaaatagttatgttacttctgtatccagtgtcctaaagttttaggattagttttagttttttgtttgcttatatgagcttagcgtaaagaatatttttaaacttcgtgttttgtcatcagcatcttttctattaagaggtaaaatgtagtccttgtttgactcttgacaatccagtgtgtttgatcttaggtctcatgatctgagtgcataccctctccaggaaggaaactgcaccagtgtctattcctgttaaatagcaacttttagtctcagcttgtttcgttttgatgtcaataaatagtaacagc

SEQ ID NO: 343065 - DNA, 2454 bp, Homo sapiens
agctttgacgggagcttcccgggagccgtttgtgcccggggtaaccccgttccggccaagccgcttcagcgggggacgtagccatgaaggaagagaaggagcacaggcctaaggagaagcgagtaaccctgttaacccccgccggggccacaggcagcggtggtgggacctcgggggacagctccaagggggaagataagcaggatcgcaacaaggagaagaaagaagcgctgagcaaggtggtaattcgaagattacctcccactttgaccaaggagcagcttcaggaacatcttcaacctatgcctgagcatgattattttgagtttttttctaatgatacgagtttgtatcctcatatgtatgccagagcatacatcaactttaaaaaccaagaggacattattttgttcagggatcgctttgatggttatgtattccttgacaataaaggtcaggaatatcccgctatagtagaatttgcaccttttcaaaaagctgcaaaaaagaagactaagaaaagagataccaaagtcgggactatcgatgatgatccagaatatagaaagtttttggaaagttatgccacagataatgagaaaatgacatctactccagagacactgctagaggaaatagaagcaaaaaatagagaattaatagctaaaaagacaaccccacttttgagcttcctgaaaaacaagcagagaatgagagaagaaaagagagaagaaaggaggaggagagaaatagaaagaaaaagacaaagagaagaagagaggaggaaatggaaagaagaagagaaacgaaaaaggaaagatatagaaaagctaaagaagatagacagaattccagaaagggacaaattaaaggatgaaccaaagattaaggtacacaggtttctgttacaagctgtgaatcagaaaaatgtaaggaccaagtacatgatacagagcatctagtatcatgtcacacacacagctgctcaagaagccagaaaaaggagatgaaaaagaattggacaaaagagaaaaagccaagaaattggacaaagagaatctcagtgatgaaagagccagtgggcaaagttgtacattgcccaagcgttctgatagcgaacttaaagatgaaaaaccaaagagacctgaagatgagagcggcagagactatagggagagggaacgggaatatgaacgagatcaggagcgcatacttcgagaaagagagaggctgaagcggcaagaagaagagcgccgtaggcagaaggagcgctatgagaaagagaagacttttaagagaaaagaagaagaaatgaaaaaagagaaagacacacttcgggataaaggaaagaaggctgaaagtacagaatcaataggcagctcagaaaaaactgaaaagaaagaagaagtggtcaagagagatcgaataagaaacaaggatcgtccagcgatgcagctttaccaaccaggagctcgaagccgaaatcgactctgtccccctgatgacagcaccaagtctggagattcagcagcagaaaggaagcaggaaagtggtattagccatagaaaagaaggaggagaggagtgataagtccagatggccttaggtgtcctgactgtctaggcagccaaagagcacacgttaagcaatccagaggtgccttcagggcaaagaatagagagaaagggagccgctgtgctggtggggtacactgcagaggagtaagtcttgtgtcaaagcaggaatctgatcagaggttcagaattggaagtacaatttcattgcttttgcaatttctacaaattaattttaaagtgtcagaaaaaggtgacggcaaggacatgcattgcaatttgcagggggaattgtcaagtgaggacttcatcacatatgacacgagagaaaagtaagagctggttctaaaatcaaaagctgttgttcatcctgaattgaattttctgaatttgggtggagcagagtcgctttgaagccttgttccgatctaattctattgtattgttgatgataagtgttgacattgggtagtgtagaagcaacaagcatgtccttgtagtacaggtacagtgaaggatagaacacactttcgttgatacaaaaatttaaatagttatgttacttctgtatccagtgtcctaaagttttaggattagttttagttttttgtttgcttatatgagcttagcgtaaagaatatttttaaacttcgtgttttgtcatcagcatcttttctattaagaggtaaaatgtagtccttgtttgactcttgacaatccagtgtgtttgatcttaggtctcatgatctgagtgcataccctctccaggaaggaaactgcaccagtgtctattcctgttaaatagcaacttttagtctcagcttgtttcgttttgatgtcaataaatagtaacagcattcaagtgtgaaaaaaaagtgtg

SEQ ID NO: 343066 - DNA, 2318 bp, Homo sapiens
agctttgacgggagcttcccgggagccgtttgtgcccggggtaaccccgttccggccaagccgcttcagcgggggacgtagccatgaaggaagagaaggagcacaggcctaaggagaagcgagtaaccctgttaacccccgccggggccacaggcagcggtggtgggacctcgggggacagctccaagggggaagataagcaggatcgcaacaaggagaagaaagaagcgctgagcaaggtggtaattcgaagattacctcccactttgaccaaggagcagcttcaggaacatcttcaacctatgcctgagcatgattattttgagtttttttctaatgatacgagtttgtatcctcatatgtatgccagagcatacatcaactttaaaaaccaagaggacattattttgttcagggatcgctttgatggttatgtattccttgacaataaaggtcaggaatatcccgctatagtagaatttgcaccttttcaaaaagctgcaaaaaagaagactaagaaaagagataccaaagtcgggactatcgatgatgatccagaatatagaaagtttttggaaagttatgccacagataatgagaaaatgacatctactccagagacactgctagaggaaattttgagcttcctgaaaaacaagcagagaatgagagaagaaaagagagaagaaaggaggaggagagaaatagaaagaaaaagacaaagagaagaagagaggaggaaatggaaagaagaagagaaacgaaaaaggaaagatatagaaaagctaaagaagatagacagaattccagaaagggacaaattaaaggatgaaccaaagattaagctgctcaagaagccagaaaaaggagatgaaaaagaattggacaaaagagaaaaagccaagaaattggacaaagagaatctcagtgatgaaagagccagtgggcaaagttgtacattgcccaagcgttctgatagcgaacttaaagatgaaaaaccaaagagacctgaagatgagagcggcagagactatagggagagggaacgggaatatgaacgagatcaggagcgcatacttcgagaaagagagaggctgaagcggcaagaagaagagcgccgtaggcagaaggagcgctatgagaaagagaagacttttaagagaaaagaagaagaaatgaaaaaagagaaagacacacttcgggataaaggaaagaaggctgaaagtacagaatcaataggcagctcagaaaaaactgaaaagaaagaagaagtggtcaagagagatcgaataagaaacaaggatcgtccagcgatgcagctttaccaaccaggagctcgaagccgaaatcgactctgtccccctgatgacagcaccaagtctggagattcagcagcagaaaggaagcaggaaagtggtattagccatagaaaagaaggaggagaggagtgataagtccagatggccttaggtgtcctgactgtctaggcagccaaagagcacacgttaagcaatccagaggtgccttcagggcaaagaatagagagaaagggagccgctgtgctggtggggtacactgcagaggagtaagtcttgtgtcaaagcaggaatctgatcagaggttcagaattggaagtacaatttcattgcttttgcaatttctacaaattaattttaaagtgtcagaaaaaggtgacggcaaggacatgcattgcaatttgcagggggaattgtcaagtgaggacttcatcacatatgacacgagagaaaagtaagagctggttctaaaatcaaaagctgttgttcatcctgaattgaattttctgaatttgggtggagcagagtcgctttgaagccttgttccgatctaattctattgtattgttgatgataagtgttgacattgggtagtgtagaagcaacaagcatgtccttgtagtacaggtacagtgaaggatagaacacactttcgttgatacaaaaatttaaatagttatgttacttctgtatccagtgtcctaaagttttaggattagttttagttttttgtttgcttatatgagcttagcgtaaagaatatttttaaacttcgtgttttgtcatcagcatcttttctattaagaggtaaaatgtagtccttgtttgactcttgacaatccagtgtgtttgatcttaggtctcatgatctgagtgcataccctctccaggaaggaaactgcaccagtgtctattcctgttaaatagcaacttttagtctcagcttgtttcgttttgatgtcaataaatagtaacagcattcaagtgtgaaaaaaaagtgtg

SEQ ID NO: 343067 - DNA, 693 bp, Homo sapiens
attgagcacctgtcctgggtgctctaaggttaaataagagacagaaaattctactctaaaggttatgaaatacttgattagtgaaaatattcatagaataaataatcagataaataaaaagagagtagtgtagattgaatcagataggaagactgcatagactgaatcttaggctgaaagatgaagaaaatgagaggttattggtaggaagaatgcaaagatgtctttcttaggatagggagagagcaaagcagaaaacttggtaggcaattgtaattttggtgggggacactgaggaaatgaataaggtgtcatcttaatggatattttagcatattagtatactctttacttattcattggttcttctatcattggtgacttttggaggacacaaaagtgtcataccttccctgatgtaaagattgtcatattccatcttatttcacagttgaactatatagtcctccttcagtatctgtggagaattggtttcagaacccctagcagatactagattccagatagaaaatgacatagtaatgggctgggcgtggtggctcacgcctgtaatcctagcaacttgggaggctgaggtgggtggatcacttgagatcaggagttcgagaccagcctggccaacatggtgaaaccccatctctactaaaaatacgaaaattagtcaggtgtggt

SEQ ID NO: 343068 - DNA, 407 bp, Homo sapiens
ctagataagacagggaggggagtgtgatatccttgagtatatctttttatgcagtttgaatttttgagtcatatgaatgttttacaatttcagaaataaattgaaaagttgaaagaagcaaaccgtacaattgaatacattcagaaaaaaaaaaaaccacttgacaagttgataacacaatgatgtaggtgaaaagaatgaaagtaacttttgaagatagtaatgtgaatgggatccatcactcaaagatctgcaataaaatctgaaatagtagatttgttattagaagtggcattagagtactgaaattattttatttgtattgcaggctggagaaaaaattgtgttcaggcagttgggaacttaggtttttccctgtttaagaaaagagatttaaatacaaatgg

SEQ ID NO: 343069 - DNA, 551 bp, Homo sapiens
actcatcaacctagaaagtttctgtcttatgcaaacaggcccctttccttccttgtccttcttctccaaggttcctaaaggggcagaaagaccattatttcccatatgctctacagagctccagtgctttttagtcattcagagcacatctccacagagttgcaagactgaaaagccaaatctccagatcctttactttctgtatgatcctcagaagcatggagagaccaagggaacaataagccataggataaagaggatggagagagggaggaacatgaattataggatagaggaaaatgggcaaaaaatagaaaataaaagacgcagaggaaacttgttacttcctctgtctgggaaagaaagtgatagaaacattagttattaattgtctcctttacctctcccttgaacactgtgcaacctgcagatgtggaaaaagaccaagtgaagttgttacttgatatcctgaaaatgtcagaaactcaaagataaggaagagagaatgtactggaaaggtatttataaaggttcatgaaaatcagactggg

SEQ ID NO: 343070 - DNA, 575 bp, Homo sapiens
taatggagaatttagccctgtgcagatgatattgcagaggaggaatgcttagttaatttaggatacctgtgcaggacatgacatgcaggtttgtcatgtaggtaaacatgtgccatggtggtttgctgcacctgtcgacccatcacctagaaggaaaaaattggacacggagataaggacagaggaaagatgatgtgaagacaggggcagaagtcagccatctacaagtcaaagggagacatgtggaacagattcaccctcacagccctcagatggaagcaacaccactaacactttgctcttggacttctagcttccagaactgagagacaatatctttctgttgcttaagtcattctgtctgtgatactgtgtttatggcagccctggcaaactaatacagtcccacaaagatttggttgttgctttgcaagagaatgtataattcctggttatttctacaaataagggcattgactttataaagctacaagtataccccagtattctgtttctggtttttgtttactttcatatatgctatcttttcattcccaggtgaaatcatagtgcat

SEQ ID NO: 343071 - DNA, 376 bp, Homo sapiens
tcacttgaacttcccggggggcggaggttacagtgaaccgagatcgtgtcactgcactccagcctaggcgacagagcgagaccctgtctcagaaacagaaaataaaacaaacaaaaaaaaactattccatagctgactattttctgaaatgattttgttacttttctaatgagaaaaaaatagatctcgtgtgtggagggaattgaagatgtaatttcagactctgcgtacagctaagctcatcgtagttacttaactaacacttaaggaattaaatggcatatctgtgtttgagaggcacactgagatgagacaccagctctttttatttatttctaatggtttgcttggtgtactggtcatttccccgggaagt

SEQ ID NO: 343072 - DNA, 280 bp, Homo sapiens
aacagctcatacataggatgattaggagtagagatgccattaactcagattagaaataaggagagaaaggagtgaggtggggagaaaaaaacattccattttggacacatgataaattatacagaaatagagattcagaaatagatatatagacacagatattatatagttatgtaacctaagcatatttttaggcaaaagtgggtgacagagggaaggttatcaggtataattgtgagggggttagttggataggagacagcatacctgtttctctgaa

SEQ ID NO: 343073 - DNA, 323 bp, Homo sapiens
aagcacaagttaggcaatgccaggagcaaacaaccggacaaactcagaaggtgggacatcatacatgacaactgccctggacacttcaaaaaatatgtacaaaacaaagaggcaggaaagagaccgttcttattaagatataatcgaggctgggcgtggtggcttatgcctgtaatcccagcactttggaaggctgaggcaggcggatcacaaggtcaggagttcgagaccagcctggccagcatggtgaaaccccgtctctactaaaaataccaaaaattagccaagcatggtcgtgcgcgcctgtagtcccagctattcgg

SEQ ID NO: 343074 - DNA, 785 bp, Homo sapiens
gaattccgcaaaccccccacaaaagccttccctcgtccgaatttggcacaagcacctttttcacccaggtgccacatatgacccctttccacatttggtccacgcagagctgcatccctcttccttctggctccgggggctgctgggggttgtcggggccgccgtggccgcagtcctcagcttctcactctacagggtcctggtgaagagccagtgaggcccctggtacccaagccccctcccctgacctgggtgtgcctcgctgctggggctctgcaggggcagcacagctggggtgcaggccaggctgccactccgggaacgcctttgcgccgggactttttgtttctgaaggcagtcgatctgcagcggggccttatgctgccatgcactgccctggctcctgccggacccccagggtgggccgtggcaggtggctgagcaggagctcccaagtgccggccaccgctgtcagggattgcccacccctgggcatcatgtgtgtggggccggggagcacaggtgtgggagctggtgaccccagacccagaattctcagggctctacccccctttcctggtcctaggtggccagtgggtatgaggagggctggaaggcagagctttgggccaaaagcaggcgttggggggtcccccctcaagtttggagccgtttccgtggttgtagcagaggaccggaggttgggttcctgattaaacttcactgtgtgttttctatctcggatcccagtctctgaagacaacttgctttgattcaacctagaa

SEQ ID NO: 343075 - DNA, 174 bp, Homo sapiens
acacgtaggctaggtacgaggctgggtggcgcggaggttgggttctgattaaccacggaaacggctcaagcgttggggggtcccccctcaagtttggagccgtttccgtggttgtagcagaggaccggaggttgggttcctgattaaacttcactgtgtgttttctatctcgga

SEQ ID NO: 343076 - DNA, 4451 bp, Homo sapiens
agcgggggaaccggaagtgcggggcgggcgcgggggcagagcgaaaggcttgaggaccaggtcggggccgggttccgggtcggggagcggctccgggcggcagctatgaggcgggacgtgcgcatcctgttactgggcgaggcccaggtggggaagacgtcgctgatcctgtccctggtgggcgaggagttccccgaggaggtaaggggcacgcccgccgcgggggtgggagcgggcccagccgggggtccctggtgagcgcgcgggtcccttgcaggtccctccccgcgcggaggagatcacgatccccgcggacgtcaccccggagaaggtgcccacccacatcgtggactactcagaagccgagcagacggacgaggagctgcgggaggagatccacaaggtacccgtggtgcgcgggacgagggaggggctgggcgcgggctcggcctaatccgcttcgcagcctgggggattggaccgaggtgctccgggtgtccttggccctgataattctgtgacctccgcactgagggttgtcggggcccctacagcgcaccccgctgggagccggcaccgctcagtccagtggtgctccagggataacaggacccttccccgcgggctctccctccctcctgccggggtggcagcagcgtttgctcttcctgtgggctctgtgtgcgccacgtccccgtgctgtgtgctccagcccaccgtcccggcctccgggcacccggagctcccagtaccagagcacgtgtgccggggacatctccaggcaagggcacaggccacagccacccagggcagcccctgctgttggcacccctcactgcggtcctgtcactctgtctgtagcgaggggggaggcaggggccaaggcggcggctgtcttgcagggtgttgggttgcaggtgtggccgtgtctgtcctgagccctctgctccaagggtcttgctgaccacagttatgcttctggggcctggtgtccctgcactggcagtgggcggggaagaggcttctctgagggttcagcagcagctcccagtgtgacactggggagtgcctgctctgccaacaccaggctggaggcaggttttagggaaggctgggctttcccggcctcagagctgcacccatgctacctgtgagcttctggggcctcctggagcctcgagatggcgtggaacggccagggtcgtcggtggtgagccagcagccctgtcacccacacctcatcactgttccctcaggcaaacgtggtgtgtgtggtgtatgacgtctctgaggaggccaccattgagaaggtgagccctcagtgcagaccccaacagcagagacacagtggccggtggtggcccaggtggaccttcacccaacccgtggccagtgccatcgctcacagcattttggggagcctgacgtggagttgcctgacgtggagtcacccggccctctcctgtgatcccacttcccctgagagggtctggggcgtcccgcagtctgagccattgaggccggcagtcctctttcttccccagtttccaaacccccggggggggacccgcagagggcctgcgttgggggcggccctaggcttgggccccagtgacttgggggtgtttgggagccattggggtcagacagatgaggctgcacctgctgcctgccttctcccaccagctttgttcctgtggccgggacttgggccctcagtgggccttgacctcccccttctgctctcccccagccaggctcatgctccagctgggagccatgtgcccgcgggcagcctcacttcacagccaggctttgcttttcagattcgaactaagtggatcccactggtgaatggggggaccacgcaggggcccagggtgcccatcatcctagtgggcaacaagtcagacctgcggtcggggagctccatggaggccgtgctccccatcatgagccagtttcccgagattgagacctgcgtggagtgttcggccaagaacctgaggaacatctcagagctgttctactacgcccagaaggccgtcctgcatcccacagcccccctctatgaccctgaggccaagcagttgaggcccgcgtgcgcccaggcgctgacgcgcatcttcaggctctcagatcaggacctggaccaggcgctcagtgacgaagagctcaacgctttccagaaatcctgctttgggcaccccctggccccgcaggccctggaggacgtgaagacggtggtgtgcaggaacgtggcgggcggcgtgcgggaggaccggctgaccctggatggtgaggccgggtgcccgcctgtgcctggggagtgtggggagggggctgtgcctggtgctccccctgctttgtctcggtgcaggtttcctcttcctgaacacgctcttcatccagcgcggccggcacgagaccacctggaccatcctgcggcgcttcggctacagcgatgccctggagctgactgcggactatctctcccctctgatccacgtgccccccggctgcagcacggagctcaaccaccttggctaccagtttgtgcagagagtgtttgagaagcacgaccaggaccgcgacggcgccctctcgcccgtggagctgcaaagccttttcagtgtgttcccagcagcgccctggggccccgagctcccacgcacagtccgcacagaggccggccggttgcccctgcacggatacctctgccagtggaccctggtgacctacctggacgtccggagctgccttggacacctaggctacctgggctaccccaccctctgtgagcaggaccaggcccatgccatcacagtcactcgtgagaagaggctggaccaggagaagggacagacgcagcggagcgtcctcctgtgcaaggtggtaggggcccgtggagtgggcaagtctgccttcctgcaggcctttctcggccgcggcctgggggtaagcaccctagactcccccaccaccccaggggctccaggggcagggcagggcaatctggggggcactgcagccagcgagtgtcaggacttcacctccctcaccaggacacgagggagcagcctcccggctacgccatcgacacggtgcaggtcaatgggcaggagaagtacttgatcgtgagtgctggggcggcgcggcctgtgcccgagggtggacccggggacacccaggcctgcctggcagatctggcccagcatggccctagggggaccgagccccagggacccttcctaaggccgctgtctgtcccagctctgtgaggtgggcacagatggtctgctggccacatcgctggacgccacctgtgacgttgcctgcttgatgtttgatggcagtgacccaaagtcctttgcacattgtgccagcgtctacaagcaccattacatggacgggcagaccccctgcctctttgtctcctccaaggccgacctgcccgaaggtgtcgcggtgtctggcccatcaccggccgagttttgccgcaagcaccggctacccgctcccgtgccgttctcctgtgctggcccagccgagcccagcaccaccatcttcacccagctcgccaccatggccgccttcccgtgggtacccagtagcgcagccctggggactagcagtgtctgtcatccgagcagtgggcagcggtggtgtcaggcctggaactggggactagcagtgtctgtcatccgagcagtgggcagcagtggcgtcaggcctggaactggggccagagtggcggggtggagctttgtgtggcagatgattcttctctcttgcagacatttggtccacgcagagctgcatccctcttccttctggctccgggggctgctgggggttgtcggggccgccgtggccgcagtcctcagcttctcactctacagggtcctggtgaagagccagtgaggcccctggtacccaagccccctcccctgacctgggtgtgcctcgctgctggggctctgcaggggcagcacagctggggtgcaggccaggctgccactccgggaacgcctttgcgccgggactttttgtttctgaaggcagtcgatctgcagcggggccttatgctgccatgcactgccctggctcctgccggacccccagggtgggccgtggcaggtggctgagcaggagctcccaagtgccggccaccgctgtcagggattgcccacccctgggcatcatgtgtgtggggccggggagcacaggtgtgggagctggtgaccccagacccagaattctcagggctctacccccctttcctggtcctaggtggccagtgggtatgaggagggctggaaggcagagctttgggccaaaagcaggcgttggggggtcccccctcaagtttggagccgtttccgtggttgtagcagaggaccggaggttgggttcctgattaaacttcactgtgtgttttctatctcgga

SEQ ID NO: 343077 - DNA, 2530 bp, Homo sapiens
agcgggggaaccggaagtgcggggcgggcgcgggggcagagcgaaaggcttgaggaccaggtcggggccgggttccgggtcggggagcggctccgggcggcagctatgaggcgggacgtgcgcatcctgttactgggcgaggcccaggtggggaagacgtcgctgatcctgtccctggtgggcgaggagttccccgaggaggtccctccccgcgcggaggagatcacgatccccgcggacgtcaccccggagaaggtgcccacccacatcgtggactactcagaagccgagcagacggacgaggagctgcgggaggagatccacaaggcaaacgtggtgtgtgtggtgtatgacgtctctgaggaggccaccattgagaagattcgaactaagtggatcccactggtgaatggggggaccacgcaggggcccagggtgcccatcatcctagtgggcaacaagtcagacctgcggtcggggagctccatggaggccgtgctccccatcatgagccagtttcccgagattgagacctgcgtggagtgttcggccaagaacctgaggaacatctcagagctgttctactacgcccagaaggccgtcctgcatcccacagcccccctctatgaccctgaggccaagcagttgaggcccgcgtgcgcccaggcgctgacgcgcatcttcaggctctcagatcaggacctggaccaggcgctcagtgacgaagagctcaacgctttccagaaatcctgctttgggcaccccctggccccgcaggccctggaggacgtgaagacggtggtgtgcaggaacgtggcgggcggcgtgcgggaggaccggctgaccctggatggtttcctcttcctgaacacgctcttcatccagcgcggccggcacgagaccacctggaccatcctgcggcgcttcggctacagcgatgccctggagctgactgcggactatctctcccctctgatccacgtgccccccggctgcagcacggagctcaaccaccttggctaccagtttgtgcagagagtgtttgagaagcacgaccaggaccgcgacggcgccctctcgcccgtggagctgcaaagccttttcagtgtgttcccagcagcgccctggggccccgagctcccacgcacagtccgcacagaggccggccggttgcccctgcacggatacctctgccagtggaccctggtgacctacctggacgtccggagctgccttggacacctaggctacctgggctaccccaccctctgtgagcaggaccaggcccatgccatcacagtcactcgtgagaagaggctggaccaggagaagggacagacgcagcggagcgtcctcctgtgcaaggtggtaggggcccgtggagtgggcaagtctgccttcctgcaggcctttctcggccgcggcctggggcaccaggacacgagggagcagcctcccggctacgccatcgacacggtgcaggtcaatgggcaggagaagtacttgatcctctgtgaggtgggcacagatggtctgctggccacatcgctggacgccacctgtgacgttgcctgcttgatgtttgatggcagtgacccaaagtcctttgcacattgtgccagcgtctacaagcaccattacatggacgggcagaccccctgcctctttgtctcctccaaggccgacctgcccgaaggtgtcgcggtgtctggcccatcaccggccgagttttgccgcaagcaccggctacccgctcccgtgccgttctcctgtgctggcccagccgagcccagcaccaccatcttcacccagctcgccaccatggccgccttcccacatttggtccacgcagagctgcatccctcttccttctggctccgggggctgctgggggttgtcggggccgccgtggccgcagtcctcagcttctcactctacagggtcctggtgaagagccagtgaggcccctggtacccaagccccctcccctgacctgggtgtgcctcgctgctggggctctgcaggggcagcacagctggggtgcaggccaggctgccactccgggaacgcctttgcgccgggactttttgtttctgaaggcagtcgatctgcagcggggccttatgctgccatgcactgccctggctcctgccggacccccagggtgggccgtggcaggtggctgagcaggagctcccaagtgccggccaccgctgtcagggattgcccacccctgggcatcatgtgtgtggggccggggagcacaggtgtgggagctggtgaccccagacccagaattctcagggctctacccccctttcctggtcctaggtggccagtgggtatgaggagggctggaaggcagagctttgggccaaaagcaggcgttggggggtcccccctcaagtttggagccgtttccgtggttgtagcagaggaccggaggttgggttcctgattaaacttcactgtgtgttttctatctcggatcccagtctctgaagacaacttgctttgattcaacctagaa

SEQ ID NO: 343078 - DNA, 3504 bp, Homo sapiens
agcgggggaaccggaagtgcggggcgggcgcgggggcagagcgaaaggcttgaggaccaggtcggggccgggttccgggtcggggagcggctccgggcggcagctatgaggcgggacgtgcgcatcctgttactgggcgaggcccaggtggggaagacgtcgctgatcctgtccctggtgggcgaggagttccccgaggaggtaaggggcacgcccgccgcgggggtgggagcgggcccagccgggggtccctggtgagcgcgcgggtcccttgcaggtccctccccgcgcggaggagatcacgatccccgcggacgtcaccccggagaaggtgcccacccacatcgtggactactcaggtagcggccgtagcctcccgggggcccggcccgcagcggtccggcgggcctgctgggtccgcagtggagtctctttgtccccctagaagccgagcagacggacgaggagctgcgggaggagatccacaaggtacccgtggtgcgcgggacgagggaggggctgggcgcgggctcggcctaatccgcttcgcagcctgggggattggaccgaggtgctccgggtgtccttggccctgataattctgtgacctccgcactgagggttgtcggggcccctacagcgcaccccgctgggagccggcaccgctcagtccagtggtgctccagggataacaggacccttccccgcgggctctccctccctcctgccggggtggcagcagcgtttgctcttcctgtgggctctgtgtgcgccacgtccccgtgctgtgtgctccagcccaccgtcccggcctccgggcacccggagctcccagtaccagagcacgtgtgccggggacatctccaggcaagggcacaggccacagccacccagggcagcccctgctgttggcacccctcactgcggtcctgtcactctgtctgtagcgaggggggaggcaggggccaaggcggcggctgtcttgcagggtgttgggttgcaggtgtggccgtgtctgtcctgagccctctgctccaagggtcttgctgaccacagttatgcttctggggcctggtgtccctgcactggcagtgggcggggaagaggcttctctgagggttcagcagcagctcccagtgtgacactggggagtgcctgctctgccaacaccaggctggaggcaggttttagggaaggctgggctttcccggcctcagagctgcacccatgctacctgtgagcttctggggcctcctggagcctcgagatggcgtggaacggccagggtcgtcggtggtgagccagcagccctgtcacccacacctcatcactgttccctcaggcaaacgtggtgtgtgtggtgtatgacgtctctgaggaggccaccattgagaagattcgaactaagtggatcccactggtgaatggggggaccacgcaggggcccagggtgcccatcatcctagtgggcaacaagtcagacctgcggtcggggagctccatggaggccgtgctccccatcatgagccagtttcccgagattgagacctgcgtggagtgttcggccaagaacctgaggaacatctcagagctgttctactacgcccagaaggccgtcctgcatcccacagcccccctctatgaccctgaggccaagcagttgaggcccgcgtgcgcccaggcgctgacgcgcatcttcaggctctcagatcaggacctggaccaggcgctcagtgacgaagagctcaacgctttccagaaatcctgctttgggcaccccctggccccgcaggccctggaggacgtgaagacggtggtgtgcaggaacgtggcgggcggcgtgcgggaggaccggctgaccctggatggtttcctcttcctgaacacgctcttcatccagcgcggccggcacgagaccacctggaccatcctgcggcgcttcggctacagcgatgccctggagctgactgcggactatctctcccctctgatccacgtgccccccggctgcagcacggagctcaaccaccttggctaccagtttgtgcagagagtgtttgagaagcacgaccaggaccgcgacggcgccctctcgcccgtggagctgcaaagccttttcagtgtgttcccagcagcgccctggggccccgagctcccacgcacagtccgcacagaggccggccggttgcccctgcacggatacctctgccagtggaccctggtgacctacctggacgtccggagctgccttggacacctaggctacctgggctaccccaccctctgtgagcaggaccaggcccatgccatcacagtcactcgtgagaagaggctggaccaggagaagggacagacgcagcggagcgtcctcctgtgcaaggtggtaggggcccgtggagtgggcaagtctgccttcctgcaggcctttctcggccgcggcctggggcaccaggacacgagggagcagcctcccggctacgccatcgacacggtgcaggtcaatgggcaggagaagtacttgatcctctgtgaggtgggcacagatggtctgctggccacatcgctggacgccacctgtgacgttgcctgcttgatgtttgatggcagtgacccaaagtcctttgcacattgtgccagcgtctacaagcaccattacatggacgggcagaccccctgcctctttgtctcctccaaggccgacctgcccgaaggtgtcgcggtgtctggcccatcaccggccgagttttgccgcaagcaccggctacccgctcccgtgccgttctcctgtgctggcccagccgagcccagcaccaccatcttcacccagctcgccaccatggccgccttcccacatttggtccacgcagagctgcatccctcttccttctggctccgggggctgctgggggttgtcggggccgccgtggccgcagtcctcagcttctcactctacagggtcctggtgaagagccagtgaggcccctggtacccaagccccctcccctgacctgggtgtgcctcgctgctggggctctgcaggggcagcacagctggggtgcaggccaggctgccactccgggaacgcctttgcgccgggactttttgtttctgaaggcagtcgatctgcagcggggccttatgctgccatgcactgccctggctcctgccggacccccagggtgggccgtggcaggtggctgagcaggagctcccaagtgccggccaccgctgtcagggattgcccacccctgggcatcatgtgtgtggggccggggagcacaggtgtgggagctggtgaccccagacccagaattctcagggctctacccccctttcctggtcctaggtggccagtgggtatgaggagggctggaaggcagagctttgggccaaaagcaggcgttggggggtcccccctcaagtttggagccgtttccgtggttgtagcagaggaccggaggttgggttcctgattaaacttcactgtgtgttttctatctcgga

SEQ ID NO: 343079 - DNA, 4020 bp, Homo sapiens
agcgggggaaccggaagtgcggggcgggcgcgggggcagagcgaaaggcttgaggaccaggtcggggccgggttccgggtcggggagcggctccgggcggcagctatgaggcgggacgtgcgcatcctgttactgggcgaggcccaggtggggaagacgtcgctgatcctgtccctggtgggcgaggagttccccgaggaggtaaggggcacgcccgccgcgggggtgggagcgggcccagccgggggtccctggtgagcgcgcgggtcccttgcaggtccctccccgcgcggaggagatcacgatccccgcggacgtcaccccggagaaggtgcccacccacatcgtggactactcaggtagcggccgtagcctcccgggggcccggcccgcagcggtccggcgggcctgctgggtccgcagtggagtctctttgtccccctagaagccgagcagacggacgaggagctgcgggaggagatccacaaggtacccgtggtgcgcgggacgagggaggggctgggcgcgggctcggcctaatccgcttcgcagcctgggggattggaccgaggtgctccgggtgtccttggccctgataattctgtgacctccgcactgagggttgtcggggcccctacagcgcaccccgctgggagccggcaccgctcagtccagtggtgctccagggataacaggacccttccccgcgggctctccctccctcctgccggggtggcagcagcgtttgctcttcctgtgggctctgtgtgcgccacgtccccgtgctgtgtgctccagcccaccgtcccggcctccgggcacccggagctcccagtaccagagcacgtgtgccggggacatctccaggcaagggcacaggccacagccacccagggcagcccctgctgttggcacccctcactgcggtcctgtcactctgtctgtagcgaggggggaggcaggggccaaggcggcggctgtcttgcagggtgttgggttgcaggtgtggccgtgtctgtcctgagccctctgctccaagggtcttgctgaccacagttatgcttctggggcctggtgtccctgcactggcagtgggcggggaagaggcttctctgagggttcagcagcagctcccagtgtgacactggggagtgcctgctctgccaacaccaggctggaggcaggttttagggaaggctgggctttcccggcctcagagctgcacccatgctacctgtgagcttctggggcctcctggagcctcgagatggcgtggaacggccagggtcgtcggtggtgagccagcagccctgtcacccacacctcatcactgttccctcaggcaaacgtggtgtgtgtggtgtatgacgtctctgaggaggccaccattgagaaggtgagccctcagtgcagaccccaacagcagagacacagtggccggtggtggcccaggtggaccttcacccaacccgtggccagtgccatcgctcacagcattttggggagcctgacgtggagttgcctgacgtggagtcacccggccctctcctgtgatcccacttcccctgagagggtctggggcgtcccgcagtctgagccattgaggccggcagtcctctttcttccccagtttccaaacccccggggggggacccgcagagggcctgcgttgggggcggccctaggcttgggccccagtgacttgggggtgtttgggagccattggggtcagacagatgaggctgcacctgctgcctgccttctcccaccagctttgttcctgtggccgggacttgggccctcagtgggccttgacctcccccttctgctctcccccagccaggctcatgctccagctgggagccatgtgcccgcgggcagcctcacttcacagccaggctttgcttttcagattcgaactaagtggatcccactggtgaatggggggaccacgcaggggcccagggtgcccatcatcctagtgggcaacaagtcagacctgcggtcggggagctccatggaggccgtgctccccatcatgagccagtttcccgagattgagacctgcgtggagtgttcggccaagaacctgaggaacatctcagagctgttctactacgcccagaaggccgtcctgcatcccacagcccccctctatgaccctgaggccaagcagttgaggcccgcgtgcgcccaggcgctgacgcgcatcttcaggctctcagatcaggacctggaccaggcgctcagtgacgaagagctcaacgctttccagaaatcctgctttgggcaccccctggccccgcaggccctggaggacgtgaagacggtggtgtgcaggaacgtggcgggcggcgtgcgggaggaccggctgaccctggatggtttcctcttcctgaacacgctcttcatccagcgcggccggcacgagaccacctggaccatcctgcggcgcttcggctacagcgatgccctggagctgactgcggactatctctcccctctgatccacgtgccccccggctgcagcacggagctcaaccaccttggctaccagtttgtgcagagagtgtttgagaagcacgaccaggaccgcgacggcgccctctcgcccgtggagctgcaaagccttttcagtgtgttcccagcagcgccctggggccccgagctcccacgcacagtccgcacagaggccggccggttgcccctgcacggatacctctgccagtggaccctggtgacctacctggacgtccggagctgccttggacacctaggctacctgggctaccccaccctctgtgagcaggaccaggcccatgccatcacagtcactcgtgagaagaggctggaccaggagaagggacagacgcagcggagcgtcctcctgtgcaaggtggtaggggcccgtggagtgggcaagtctgccttcctgcaggcctttctcggccgcggcctggggcaccaggacacgagggagcagcctcccggctacgccatcgacacggtgcaggtcaatgggcaggagaagtacttgatcctctgtgaggtgggcacagatggtctgctggccacatcgctggacgccacctgtgacgttgcctgcttgatgtttgatggcagtgacccaaagtcctttgcacattgtgccagcgtctacaagcaccattacatggacgggcagaccccctgcctctttgtctcctccaaggccgacctgcccgaaggtgtcgcggtgtctggcccatcaccggccgagttttgccgcaagcaccggctacccgctcccgtgccgttctcctgtgctggcccagccgagcccagcaccaccatcttcacccagctcgccaccatggccgccttcccacatttggtccacgcagagctgcatccctcttccttctggctccgggggctgctgggggttgtcggggccgccgtggccgcagtcctcagcttctcactctacagggtcctggtgaagagccagtgaggcccctggtacccaagccccctcccctgacctgggtgtgcctcgctgctggggctctgcaggggcagcacagctggggtgcaggccaggctgccactccgggaacgcctttgcgccgggactttttgtttctgaaggcagtcgatctgcagcggggccttatgctgccatgcactgccctggctcctgccggacccccagggtgggccgtggcaggtggctgagcaggagctcccaagtgccggccaccgctgtcagggattgcccacccctgggcatcatgtgtgtggggccggggagcacaggtgtgggagctggtgaccccagacccagaattctcagggctctacccccctttcctggtcctaggtggccagtgggtatgaggagggctggaaggcagagctttgggccaaaagcaggcgttggggggtcccccctcaagtttggagccgtttccgtggttgtagcagaggaccggaggttgggttcctgattaaacttcactgtgtgttttctatctcgga

SEQ ID NO: 343080 - DNA, 3605 bp, Homo sapiens
agcgggggaaccggaagtgcggggcgggcgcgggggcagagcgaaaggcttgaggaccaggtcggggccgggttccgggtcggggagcggctccgggcggcagctatgaggcgggacgtgcgcatcctgttactgggcgaggcccaggtggggaagacgtcgctgatcctgtccctggtgggcgaggagttccccgaggaggtaaggggcacgcccgccgcgggggtgggagcgggcccagccgggggtccctggtgagcgcgcgggtcccttgcaggtccctccccgcgcggaggagatcacgatccccgcggacgtcaccccggagaaggtgcccacccacatcgtggactactcaggtagcggccgtagcctcccgggggcccggcccgcagcggtccggcgggcctgctgggtccgcagtggagtctctttgtccccctagaagccgagcagacggacgaggagctgcgggaggagatccacaaggtacccgtggtgcgcgggacgagggaggggctgggcgcgggctcggcctaatccgcttcgcagcctgggggattggaccgaggtgctccgggtgtccttggccctgataattctgtgacctccgcactgagggttgtcggggcccctacagcgcaccccgctgggagccggcaccgctcagtccagtggtgctccagggataacaggacccttccccgcgggctctccctccctcctgccggggtggcagcagcgtttgctcttcctgtgggctctgtgtgcgccacgtccccgtgctgtgtgctccagcccaccgtcccggcctccgggcacccggagctcccagtaccagagcacgtgtgccggggacatctccaggcaagggcacaggccacagccacccagggcagcccctgctgttggcacccctcactgcggtcctgtcactctgtctgtagcgaggggggaggcaggggccaaggcggcggctgtcttgcagggtgttgggttgcaggtgtggccgtgtctgtcctgagccctctgctccaagggtcttgctgaccacagttatgcttctggggcctggtgtccctgcactggcagtgggcggggaagaggcttctctgagggttcagcagcagctcccagtgtgacactggggagtgcctgctctgccaacaccaggctggaggcaggttttagggaaggctgggctttcccggcctcagagctgcacccatgctacctgtgagcttctggggcctcctggagcctcgagatggcgtggaacggccagggtcgtcggtggtgagccagcagccctgtcacccacacctcatcactgttccctcaggcaaacgtggtgtgtgtggtgtatgacgtctctgaggaggccaccattgagaagattcgaactaagtggatcccactggtgaatggggggaccacgcaggggcccagggtgcccatcatcctagtgggcaacaagtcagacctgcggtcggggagctccatggaggccgtgctccccatcatgagccagtttcccgagattgagacctgcgtggagtgttcggccaagaacctgaggaacatctcagagctgttctactacgcccagaaggccgtcctgcatcccacagcccccctctatgaccctgaggccaagcagttgaggcccgcgtgcgcccaggcgctgacgcgcatcttcaggctctcagatcaggacctggaccaggcgctcagtgacgaagagctcaacgctttccagaaatcctgctttgggcaccccctggccccgcaggccctggaggacgtgaagacggtggtgtgcaggaacgtggcgggcggcgtgcgggaggaccggctgaccctggatggtttcctcttcctgaacacgctcttcatccagcgcggccggcacgagaccacctggaccatcctgcggcgcttcggctacagcgatgccctggagctgactgcggactatctctcccctctgatccacgtgccccccggctgcagcacggagctcaaccaccttggctaccagtttgtgcagagagtgtttgagaagcacgaccaggaccgcgacggcgccctctcgcccgtggagctgcaaagccttttcagtgtgttcccagcagcgccctggggccccgagctcccacgcacagtccgcacagaggccggccggttgcccctgcacggatacctctgccagtggaccctggtgacctacctggacgtccggagctgccttggacacctaggctacctgggctaccccaccctctgtgagcaggaccaggcccatgccatcacagtcactcgtgagaagaggctggaccaggagaagggacagacgcagcggagcgtcctcctgtgcaaggtggtaggggcccgtggagtgggcaagtctgccttcctgcaggcctttctcggccgcggcctgggggtaagcaccctagactcccccaccaccccaggggctccaggggcagggcagggcaatctggggggcactgcagccagcgagtgtcaggacttcacctccctcaccaggacacgagggagcagcctcccggctacgccatcgacacggtgcaggtcaatgggcaggagaagtacttgatcctctgtgaggtgggcacagatggtctgctggccacatcgctggacgccacctgtgacgttgcctgcttgatgtttgatggcagtgacccaaagtcctttgcacattgtgccagcgtctacaagcaccattacatggacgggcagaccccctgcctctttgtctcctccaaggccgacctgcccgaaggtgtcgcggtgtctggcccatcaccggccgagttttgccgcaagcaccggctacccgctcccgtgccgttctcctgtgctggcccagccgagcccagcaccaccatcttcacccagctcgccaccatggccgccttcccacatttggtccacgcagagctgcatccctcttccttctggctccgggggctgctgggggttgtcggggccgccgtggccgcagtcctcagcttctcactctacagggtcctggtgaagagccagtgaggcccctggtacccaagccccctcccctgacctgggtgtgcctcgctgctggggctctgcaggggcagcacagctggggtgcaggccaggctgccactccgggaacgcctttgcgccgggactttttgtttctgaaggcagtcgatctgcagcggggccttatgctgccatgcactgccctggctcctgccggacccccagggtgggccgtggcaggtggctgagcaggagctcccaagtgccggccaccgctgtcagggattgcccacccctgggcatcatgtgtgtggggccggggagcacaggtgtgggagctggtgaccccagacccagaattctcagggctctacccccctttcctggtcctaggtggccagtgggtatgaggagggctggaaggcagagctttgggccaaaagcaggcgttggggggtcccccctcaagtttggagccgtttccgtggttgtagcagaggaccggaggttgggttcctgattaaacttcactgtgtgttttctatctcgga

SEQ ID NO: 343081 - DNA, 3967 bp, Homo sapiens
agcgggggaaccggaagtgcggggcgggcgcgggggcagagcgaaaggcttgaggaccaggtcggggccgggttccgggtcggggagcggctccgggcggcagctatgaggcgggacgtgcgcatcctgttactgggcgaggcccaggtggggaagacgtcgctgatcctgtccctggtgggcgaggagttccccgaggaggtaaggggcacgcccgccgcgggggtgggagcgggcccagccgggggtccctggtgagcgcgcgggtcccttgcaggtccctccccgcgcggaggagatcacgatccccgcggacgtcaccccggagaaggtgcccacccacatcgtggactactcaggtagcggccgtagcctcccgggggcccggcccgcagcggtccggcgggcctgctgggtccgcagtggagtctctttgtccccctagaagccgagcagacggacgaggagctgcgggaggagatccacaaggtacccgtggtgcgcgggacgagggaggggctgggcgcgggctcggcctaatccgcttcgcagcctgggggattggaccgaggtgctccgggtgtccttggccctgataattctgtgacctccgcactgagggttgtcggggcccctacagcgcaccccgctgggagccggcaccgctcagtccagtggtgctccagggataacaggacccttccccgcgggctctccctccctcctgccggggtggcagcagcgtttgctcttcctgtgggctctgtgtgcgccacgtccccgtgctgtgtgctccagcccaccgtcccggcctccgggcacccggagctcccagtaccagagcacgtgtgccggggacatctccaggcaagggcacaggccacagccacccagggcagcccctgctgttggcacccctcactgcggtcctgtcactctgtctgtagcgaggggggaggcaggggccaaggcggcggctgtcttgcagggtgttgggttgcaggtgtggccgtgtctgtcctgagccctctgctccaagggtcttgctgaccacagttatgcttctggggcctggtgtccctgcactggcagtgggcggggaagaggcttctctgagggttcagcagcagctcccagtgtgacactggggagtgcctgctctgccaacaccaggctggaggcaggttttagggaaggctgggctttcccggcctcagagctgcacccatgctacctgtgagcttctggggcctcctggagcctcgagatggcgtggaacggccagggtcgtcggtggtgagccagcagccctgtcacccacacctcatcactgttccctcaggcaaacgtggtgtgtgtggtgtatgacgtctctgaggaggccaccattgagaaggtgagccctcagtgcagaccccaacagcagagacacagtggccggtggtggcccaggtggaccttcacccaacccgtggccagtgccatcgctcacagcattttggggagcctgacgtggagttgcctgacgtggagtcacccggccctctcctgtgatcccacttcccctgagagggtctggggcgtcccgcagtctgagccattgaggccggcagtcctctttcttccccagtttccaaacccccggggggggacccgcagagggcctgcgttgggggcggccctaggcttgggccccagtgacttgggggtgtttgggagccattggggtcagacagatgaggctgcacctgctgcctgccttctcccaccagctttgttcctgtggccgggacttgggccctcagtgggccttgacctcccccttctgctctcccccagccaggctcatgctccagctgggagccatgtgcccgcgggcagcctcacttcacagccaggctttgcttttcagattcgaactaagtggatcccactggtgaatggggggaccacgcaggggcccagggtgcccatcatcctagtgggcaacaagtcagacctgcggtcggggagctccatggaggccgtgctccccatcatgagccagtttcccgagattgagacctgcgtggagtgttcggccaagaacctgaggaacatctcagagctgttctactacgcccagaaggccgtcctgcatcccacagcccccctctatgaccctgaggccaagcaggcgctgacgcgcatcttcaggctctcagatcaggacctggaccaggcgctcagtgacgaagagctcaacgctttccagaaatcctgctttgggcaccccctggccccgcaggccctggaggacgtgaagacggtggtgtgcaggaacgtggcgggcggcgtgcgggaggaccggctgaccctggatgcgcggccggcacgagaccacctggaccatcctgcggcgcttcggctacagcgatgccctggagctgactgcggactatctctcccctctgatccacgtgccccccggctgcagcacggagctcaaccaccttggctaccagtttgtgcagagagtgtttgagaagcacgaccaggaccgcgacggcgccctctcgcccgtggagctgcaaagccttttcagtgtgttcccagcagcgccctggggccccgagctcccacgcacagtccgcacagaggccggccggttgcccctgcacggatacctctgccagtggaccctggtgacctacctggacgtccggagctgccttggacacctaggctacctgggctaccccaccctctgtgagcaggaccaggcccatgccatcacagtcactcgtgagaagaggctggaccaggagaagggacagacgcagcggagcgtcctcctgtgcaaggtggtaggggcccgtggagtgggcaagtctgccttcctgcaggcctttctcggccgcggcctggggcaccaggacacgagggagcagcctcccggctacgccatcgacacggtgcaggtcaatgggcaggagaagtacttgatcctctgtgaggtgggcacagatggtctgctggccacatcgctggacgccacctgtgacgttgcctgcttgatgtttgatggcagtgacccaaagtcctttgcacattgtgccagcgtctacaagcaccattacatggacgggcagaccccctgcctctttgtctcctccaaggccgacctgcccgaaggtgtcgcggtgtctggcccatcaccggccgagttttgccgcaagcaccggctacccgctcccgtgccgttctcctgtgctggcccagccgagcccagcaccaccatcttcacccagctcgccaccatggccgccttcccacatttggtccacgcagagctgcatccctcttccttctggctccgggggctgctgggggttgtcggggccgccgtggccgcagtcctcagcttctcactctacagggtcctggtgaagagccagtgaggcccctggtacccaagccccctcccctgacctgggtgtgcctcgctgctggggctctgcaggggcagcacagctggggtgcaggccaggctgccactccgggaacgcctttgcgccgggactttttgtttctgaaggcagtcgatctgcagcggggccttatgctgccatgcactgccctggctcctgccggacccccagggtgggccgtggcaggtggctgagcaggagctcccaagtgccggccaccgctgtcagggattgcccacccctgggcatcatgtgtgtggggccggggagcacaggtgtgggagctggtgaccccagacccagaattctcagggctctacccccctttcctggtcctaggtggccagtgggtatgaggagggctggaaggcagagctttgggccaaaagcaggcgttggggggtcccccctcaagtttggagccgtttccgtggttgtagcagaggaccggaggttgggttcctgattaaacttcactgtgtgttttctatctcgga

SEQ ID NO: 343082 - DNA, 4102 bp, Homo sapiens
agcgggggaaccggaagtgcggggcgggcgcgggggcagagcgaaaggcttgaggaccaggtcggggccgggttccgggtcggggagcggctccgggcggcagctatgaggcgggacgtgcgcatcctgttactgggcgaggcccaggtggggaagacgtcgctgatcctgtccctggtgggcgaggagttccccgaggaggtaaggggcacgcccgccgcgggggtgggagcgggcccagccgggggtccctggtgagcgcgcgggtcccttgcaggtccctccccgcgcggaggagatcacgatccccgcggacgtcaccccggagaaggtgcccacccacatcgtggactactcaggtagcggccgtagcctcccgggggcccggcccgcagcggtccggcgggcctgctgggtccgcagtggagtctctttgtccccctagaagccgagcagacggacgaggagctgcgggaggagatccacaaggtacccgtggtgcgcgggacgagggaggggctgggcgcgggctcggcctaatccgcttcgcagcctgggggattggaccgaggtgctccgggtgtccttggccctgataattctgtgacctccgcactgagggttgtcggggcccctacagcgcaccccgctgggagccggcaccgctcagtccagtggtgctccagggataacaggacccttccccgcgggctctccctccctcctgccggggtggcagcagcgtttgctcttcctgtgggctctgtgtgcgccacgtccccgtgctgtgtgctccagcccaccgtcccggcctccgggcacccggagctcccagtaccagagcacgtgtgccggggacatctccaggcaagggcacaggccacagccacccagggcagcccctgctgttggcacccctcactgcggtcctgtcactctgtctgtagcgaggggggaggcaggggccaaggcggcggctgtcttgcagggtgttgggttgcaggtgtggccgtgtctgtcctgagccctctgctccaagggtcttgctgaccacagttatgcttctggggcctggtgtccctgcactggcagtgggcggggaagaggcttctctgagggttcagcagcagctcccagtgtgacactggggagtgcctgctctgccaacaccaggctggaggcaggttttagggaaggctgggctttcccggcctcagagctgcacccatgctacctgtgagcttctggggcctcctggagcctcgagatggcgtggaacggccagggtcgtcggtggtgagccagcagccctgtcacccacacctcatcactgttccctcaggcaaacgtggtgtgtgtggtgtatgacgtctctgaggaggccaccattgagaaggtgagccctcagtgcagaccccaacagcagagacacagtggccggtggtggcccaggtggaccttcacccaacccgtggccagtgccatcgctcacagcattttggggagcctgacgtggagttgcctgacgtggagtcacccggccctctcctgtgatcccacttcccctgagagggtctggggcgtcccgcagtctgagccattgaggccggcagtcctctttcttccccagtttccaaacccccggggggggacccgcagagggcctgcgttgggggcggccctaggcttgggccccagtgacttgggggtgtttgggagccattggggtcagacagatgaggctgcacctgctgcctgccttctcccaccagctttgttcctgtggccgggacttgggccctcagtgggccttgacctcccccttctgctctcccccagccaggctcatgctccagctgggagccatgtgcccgcgggcagcctcacttcacagccaggctttgcttttcagattcgaactaagtggatcccactggtgaatggggggaccacgcaggggcccagggtgcccatcatcctagtgggcaacaagtcagacctgcggtcggggagctccatggaggccgtgctccccatcatgagccagtttcccgagattgagacctgcgtggagtgttcggccaagaacctgaggaacatctcagagctgttctactacgcccagaaggccgtcctgcatcccacagcccccctctatgaccctgaggccaagcagttgaggcccgcgtgcgcccaggcgctgacgcgcatcttcaggctctcagatcaggacctggaccaggcgctcagtgacgaagagctcaacgctttccagaaatcctgctttgggcaccccctggccccgcaggccctggaggacgtgaagacggtggtgtgcaggaacgtggcgggcggcgtgcgggaggaccggctgaccctggatggtgaggccgggtgcccgcctgtgcctggggagtgtggggagggggctgtgcctggtgctccccctgctttgtctcggtgcaggtttcctcttcctgaacacgctcttcatccagcgcggccggcacgagaccacctggaccatcctgcggcgcttcggctacagcgatgccctggagctgactgcggactatctctcccctctgatccacgtgccccccggctgcagcacggagctcaaccaccttggctaccagtttgtgcagagagtgtttgagaagcacgaccaggaccgcgacggcgccctctcgcccgtggagctgcaaagccttttcagtgtgttcccagcagcgccctggggccccgagctcccacgcacagtccgcacagaggccggccggttgcccctgcacggatacctctgccagtggaccctggtgacctacctggacgtccggagctgccttggacacctaggctacctgggctaccccaccctctgtgagcaggaccaggcccatgccatcacagtcactcgtgagaagaggctggaccaggagaagggacagacgcagcggagcgtcctcctgtgcaaggtggtaggggcccgtggagtgggcaagtctgccttcctgcaggcctttctcggccgcggcctggggcaccaggacacgagggagcagcctcccggctacgccatcgacacggtgcaggtcaatgggcaggagaagtacttgatcctctgtgaggtgggcacagatggtctgctggccacatcgctggacgccacctgtgacgttgcctgcttgatgtttgatggcagtgacccaaagtcctttgcacattgtgccagcgtctacaagcaccattacatggacgggcagaccccctgcctctttgtctcctccaaggccgacctgcccgaaggtgtcgcggtgtctggcccatcaccggccgagttttgccgcaagcaccggctacccgctcccgtgccgttctcctgtgctggcccagccgagcccagcaccaccatcttcacccagctcgccaccatggccgccttcccacatttggtccacgcagagctgcatccctcttccttctggctccgggggctgctgggggttgtcggggccgccgtggccgcagtcctcagcttctcactctacagggtcctggtgaagagccagtgaggcccctggtacccaagccccctcccctgacctgggtgtgcctcgctgctggggctctgcaggggcagcacagctggggtgcaggccaggctgccactccgggaacgcctttgcgccgggactttttgtttctgaaggcagtcgatctgcagcggggccttatgctgccatgcactgccctggctcctgccggacccccagggtgggccgtggcaggtggctgagcaggagctcccaagtgccggccaccgctgtcagggattgcccacccctgggcatcatgtgtgtggggccggggagcacaggtgtgggagctggtgaccccagacccagaattctcagggctctacccccctttcctggtcctaggtggccagtgggtatgaggagggctggaaggcagagctttgggccaaaagcaggcgttggggggtcccccctcaagtttggagccgtttccgtggttgtagcagaggaccggaggttgggttcctgattaaacttcactgtgtgttttctatctcgga

SEQ ID NO: 343083 - DNA, 3545 bp, Homo sapiens
agcgggggaaccggaagtgcggggcgggcgcgggggcagagcgaaaggcttgaggaccaggtcggggccgggttccgggtcggggagcggctccgggcggcagctatgaggcgggacgtgcgcatcctgttactgggcgaggcccaggtggggaagacgtcgctgatcctgtccctggtgggcgaggagttccccgaggaggtaaggggcacgcccgccgcgggggtgggagcgggcccagccgggggtccctggtgagcgcgcgggtcccttgcaggtccctccccgcgcggaggagatcacgatccccgcggacgtcaccccggagaaggtgcccacccacatcgtggactactcaggtagcggccgtagcctcccgggggcccggcccgcagcggtccggcgggcctgctgggtccgcagtggagtctctttgtccccctagaagccgagcagacggacgaggagctgcgggaggagatccacaaggtacccgtggtgcgcgggacgagggaggggctgggcgcgggctcggcctaatccgcttcgcagcctgggggattggaccgaggtgctccgggtgtccttggccctgataattctgtgacctccgcactgagggttgtcggggcccctacagcgcaccccgctgggagccggcaccgctcagtccagtggtgctccagggataacaggacccttccccgcgggctctccctccctcctgccggggtggcagcagcgtttgctcttcctgtgggctctgtgtgcgccacgtccccgtgctgtgtgctccagcccaccgtcccggcctccgggcacccggagctcccagtaccagagcacgtgtgccggggacatctccaggcaagggcacaggccacagccacccagggcagcccctgctgttggcacccctcactgcggtcctgtcactctgtctgtagcgaggggggaggcaggggccaaggcggcggctgtcttgcagggtgttgggttgcaggtgtggccgtgtctgtcctgagccctctgctccaagggtcttgctgaccacagttatgcttctggggcctggtgtccctgcactggcagtgggcggggaagaggcttctctgagggttcagcagcagctcccagtgtgacactggggagtgcctgctctgccaacaccaggctggaggcaggttttagggaaggctgggctttcccggcctcagagctgcacccatgctacctgtgagcttctggggcctcctggagcctcgagatggcgtggaacggccagggtcgtcggtggtgagccagcagccctgtcacccacacctcatcactgttccctcaggcaaacgtggtgtgtgtggtgtatgacgtctctgaggaggccaccattgagaagattcgaactaagtggatcccactggtgaatggggggaccacgcaggggcccagggtgcccatcatcctagtgggcaacaagtcagacctgcggtcggggagctccatggaggccgtgctccccatcatgagccagtttcccgagattgagacctgcgtggagtgttcggccaagaacctgaggaacatctcagagctgttctactacgcccagaaggccgtcctgcatcccacagcccccctctatgaccctgaggccaagcagttgaggcccgcgtgcgcccaggcgctgacgcgcatcttcaggctctcagatcaggacctggaccaggcgctcagtgacgaagagctcaacgctttccagaaatcctgctttgggcaccccctggccccgcaggccctggaggacgtgaagacggtggtgtgcaggaacgtggcgggcggcgtgcgggaggaccggctgaccctggatggtttcctcttcctgaacacgctcttcatccagcgcggccggcacgagaccacctggaccatcctgcggcgcttcggctacagcgatgccctggagctgactgcggactatctctcccctctgatccacgtgccccccggctgcagcacggagctcaaccaccttggctaccagtttgtgcagagagtgtttgagaagcacgaccaggaccgcgacggcgccctctcgcccgtggagctgcaaagccttttcagtgtgttcccagcagcgccctggggccccgagctcccacgcacagtccgcacagaggccggccggttgcccctgcacggatacctctgccagtggaccctggtgacctacctggacgtccggagctgccttggacacctaggctacctgggctaccccaccctctgtgagcaggaccaggcccatgccatcacagtcactcgtgagaagaggctggaccaggagaagggacagacgcagcggagcgtcctcctgtgcaaggtggtaggggcccgtggagtgggcaagtctgccttcctgcaggcctttctcggccgcggcctggggcaccaggacacgagggagcagcctcccggctacgccatcgacacggtgcaggtcaatgggcaggagaagtacttgatcctctgtgaggtgggcacagatggtctgctggccacatcgctggacgccacctgtgacgttgcctgcttgatgtttgatggcagtgacccaaagtcctttgcacattgtgccagcgtctacaagcaccattacatggacgggcagaccccctgcctctttgtctcctccaaggccgacctgcccgaaggtgtcgcggtgtctggcccatcaccggccgagttttgccgcaagcaccggctacccgctcccgtgccgttctcctgtgctggcccagccgagcccagcaccaccatcttcacccagctcgccaccatggccgccttcccacatttggtccacgcagagctgcatccctcttccttctggctccgggggctgctgggggttgtcggggccgccgtggccgcagtcctcagcttctcactctacagggtcctggtgaagagccagtgaggcccctggtacccaagccccctcccctgacctgggtgtgcctcgctgctggggctctgcaggggcagcacagctggggtgcaggccaggctgccactccgggaacgcctttgcgccgggactttttgtttctgaaggcagtcgatctgcagcggggccttatgctgccatgcactgccctggctcctgccggacccccagggtgggccgtggcaggtggctgagcaggagctcccaagtgccggccaccgctgtcagggattgcccacccctgggcatcatgtgtgtggggccggggagcacaggtgtgggagctggtgaccccagacccagaattctcagggctctacccccctttcctggtcctaggtggccagtgggtatgaggagggctggaaggcagagctttgggccaaaagcaggcgttggggggtcccccctcaagtttggagccgtttccgtggttgtagcagaggaccggaggttgggttcctgattaaacttcactgtgtgttttctatctcggatcccagtctctgaagacaacttgctttgattcaacctagaa

SEQ ID NO: 343084 - DNA, 3606 bp, Homo sapiens
agcgggggaaccggaagtgcggggcgggcgcgggggcagagcgaaaggcttgaggaccaggtcggggccgggttccgggtcggggagcggctccgggcggcagctatgaggcgggacgtgcgcatcctgttactgggcgaggcccaggtggggaagacgtcgctgatcctgtccctggtgggcgaggagttccccgaggaggtaaggggcacgcccgccgcgggggtgggagcgggcccagccgggggtccctggtgagcgcgcgggtcccttgcaggtccctccccgcgcggaggagatcacgatccccgcggacgtcaccccggagaaggtgcccacccacatcgtggactactcaggtagcggccgtagcctcccgggggcccggcccgcagcggtccggcgggcctgctgggtccgcagtggagtctctttgtccccctagaagccgagcagacggacgaggagctgcgggaggagatccacaaggtacccgtggtgcgcgggacgagggaggggctgggcgcgggctcggcctaatccgcttcgcagcctgggggattggaccgaggtgctccgggtgtccttggccctgataattctgtgacctccgcactgagggttgtcggggcccctacagcgcaccccgctgggagccggcaccgctcagtccagtggtgctccagggataacaggacccttccccgcgggctctccctccctcctgccggggtggcagcagcgtttgctcttcctgtgggctctgtgtgcgccacgtccccgtgctgtgtgctccagcccaccgtcccggcctccgggcacccggagctcccagtaccagagcacgtgtgccggggacatctccaggcaagggcacaggccacagccacccagggcagcccctgctgttggcacccctcactgcggtcctgtcactctgtctgtagcgaggggggaggcaggggccaaggcggcggctgtcttgcagggtgttgggttgcaggtgtggccgtgtctgtcctgagccctctgctccaagggtcttgctgaccacagttatgcttctggggcctggtgtccctgcactggcagtgggcggggaagaggcttctctgagggttcagcagcagctcccagtgtgacactggggagtgcctgctctgccaacaccaggctggaggcaggttttagggaaggctgggctttcccggcctcagagctgcacccatgctacctgtgagcttctggggcctcctggagcctcgagatggcgtggaacggccagggtcgtcggtggtgagccagcagccctgtcacccacacctcatcactgttccctcaggcaaacgtggtgtgtgtggtgtatgacgtctctgaggaggccaccattgagaagattcgaactaagtggatcccactggtgaatggggggaccacgcaggggcccagggtgcccatcatcctagtgggcaacaagtcagacctgcggtcggggagctccatggaggccgtgctccccatcatgagccagtttcccgagattgagacctgcgtggagtgttcggccaagaacctgaggaacatctcagagctgttctactacgcccagaaggccgtcctgcatcccacagcccccctctatgaccctgaggccaagcagttgaggcccgcgtgcgcccaggcgctgacgcgcatcttcaggctctcagatcaggacctggaccaggcgctcagtgacgaagagctcaacgctttccagaaatcctgctttgggcaccccctggccccgcaggccctggaggacgtgaagacggtggtgtgcaggaacgtggcgggcggcgtgcgggaggaccggctgaccctggatggtttcctcttcctgaacacgctcttcatccagcgcggccggcacgagaccacctggaccatcctgcggcgcttcggctacagcgatgccctggagctgactgcggactatctctcccctctgatccacgtgccccccggctgcagcacggagctcaaccaccttggctaccagtttgtgcagagagtgtttgagaagcacgaccaggaccgcgacggcgccctctcgcccgtggagctgcaaagccttttcagtgtgttcccagcagcgccctggggccccgagctcccacgcacagtccgcacagaggccggccggttgcccctgcacggatacctctgccagtggaccctggtgacctacctggacgtccggagctgccttggacacctaggctacctgggctaccccaccctctgtgagcaggaccaggcccatgccatcacagtcactcgtgagaagaggctggaccaggagaagggacagacgcagcggagcgtcctcctgtgcaaggtggtaggggcccgtggagtgggcaagtctgccttcctgcaggcctttctcggccgcggcctggggcaccaggacacgagggagcagcctcccggctacgccatcgacacggtgcaggtcaatgggcaggagaagtacttgatcctctgtgaggtgggcacagatggtctgctggccacatcgctggacgccacctgtgacgttgcctgcttgatgtttgatggcagtgacccaaagtcctttgcacattgtgccagcgtctacaaggtggggccctgcaggggccacgtggccatggggcagggtctgtccctccagctgtgcctcggccaccccaggactgtacctcataccactctctgcccacagcaccattacatggacgggcagaccccctgcctctttgtctcctccaaggccgacctgcccgaaggtgtcgcggtgtctggcccatcaccggccgagttttgccgcaagcaccggctacccgctcccgtgccgttctcctgtgctggcccagccgagcccagcaccaccatcttcacccagctcgccaccatggccgccttcccacatttggtccacgcagagctgcatccctcttccttctggctccgggggctgctgggggttgtcggggccgccgtggccgcagtcctcagcttctcactctacagggtcctggtgaagagccagtgaggcccctggtacccaagccccctcccctgacctgggtgtgcctcgctgctggggctctgcaggggcagcacagctggggtgcaggccaggctgccactccgggaacgcctttgcgccgggactttttgtttctgaaggcagtcgatctgcagcggggccttatgctgccatgcactgccctggctcctgccggacccccagggtgggccgtggcaggtggctgagcaggagctcccaagtgccggccaccgctgtcagggattgcccacccctgggcatcatgtgtgtggggccggggagcacaggtgtgggagctggtgaccccagacccagaattctcagggctctacccccctttcctggtcctaggtggccagtgggtatgaggagggctggaaggcagagctttgggccaaaagcaggcgttggggggtcccccctcaagtttggagccgtttccgtggttgtagcagaggaccggaggttgggttcctgattaaacttcactgtgtgttttctatctcgga

SEQ ID NO: 343085 - DNA, 3329 bp, Homo sapiens
agcgggggaaccggaagtgcggggcgggcgcgggggcagagcgaaaggcttgaggaccaggtcggggccgggttccgggtcggggagcggctccgggcggcagctatgaggcgggacgtgcgcatcctgttactgggcgaggcccaggtggggaagacgtcgctgatcctgtccctggtgggcgaggagttccccgaggaggtaaggggcacgcccgccgcgggggtgggagcgggcccagccgggggtccctggtgagcgcgcgggtcccttgcaggtccctccccgcgcggaggagatcacgatccccgcggacgtcaccccggagaaggtgcccacccacatcgtggactactcaggtagcggccgtagcctcccgggggcccggcccgcagcggtccggcgggcctgctgggtccgcagtggagtctctttgtccccctagaagccgagcagacggacgaggagctgcgggaggagatccacaaggtacccgtggtgcgcgggacgagggaggggctgggcgcgggctcggcctaatccgcttcgcagcctgggggattggaccgaggtgctccgggtgtccttggccctgataattctgtgacctccgcactgagggttgtcggggcccctacagcgcaccccgctgggagccggcaccgctcagtccagtggtgctccagggataacaggacccttccccgcgggctctccctccctcctgccggggtggcagcagcgtttgctcttcctgtgggctctgtgtgcgccacgtccccgtgctgtgtgctccagcccaccgtcccggcctccgggcacccggagctcccagtaccagagcacgtgtgccggggacatctccaggcaagggcacaggccacagccacccagggcagcccctgctgttggcacccctcactgcggtcctgtcactctgtctgtagcgaggggggaggcaggggccaaggcggcggctgtcttgcagggtgttgggttgcaggtgtggccgtgtctgtcctgagccctctgctccaagggtcttgctgaccacagttatgcttctggggcctggtgtccctgcactggcagtgggcggggaagaggcttctctgagggttcagcagcagctcccagtgtgacactggggagtgcctgctctgccaacaccaggctggaggcaggttttagggaaggctgggctttcccggcctcagagctgcacccatgctacctgtgagcttctggggcctcctggagcctcgagatggcgtggaacggccagggtcgtcggtggtgagccagcagccctgtcacccacacctcatcactgttccctcaggcaaacgtggtgtgtgtggtgtatgacgtctctgaggaggccaccattgagaagattcgaactaagtggatcccactggtgaatggggggaccacgcaggggcccagggtgcccatcatcctagtgggcaacaagtcagacctgcggtcggggagctccatggaggccgtgctccccatcatgagccagtttcccgagattgagacctgcgtggagtgttcggccaagaacctgaggaacatctcagagctgttctactacgcccagaaggccgtcctgcatcccacagcccccctctatgaccctgaggccaagcagttgaggcccgcgtgcgcccaggcgctgacgcgcatcttcaggctctcagatcaggacctggaccaggcgctcagtgacgaagagctcaacgctttccagaaatcctgctttgggcaccccctggccccgcaggccctggaggacgtgaagacggtggtgtgcaggaacgtggcgggcggcgtgcgggaggaccggctgaccctggatggtttcctcttcctgaacacgctcttcatccagcgcggccggcacgagaccacctggaccatcctgcggcgcttcggctacagcgatgccctggagctgactgcggactatctctcccctctgatccacgtgccccccggctgcagcacggagctcaaccaccttggctaccagtttgtgcagagagtgtttgagaagcacgaccaggaccgcgacggcgccctctcgcccgtggagctgcaaagccttttcagtgtgttcccagcagcgccctggggccccgagctcccacgcacagtccgcacagaggccggccggttgcccctgcacggatacctctgccagtggaccctggtgacctacctggacgtccggagctgccttggacacctaggctacctgggctaccccaccctctgtgagcaggaccaggcccatgccatcacagtcactcgtgagaagaggctggaccaggagaagggacagacgcagcggagcgtcctcctgtgcaaggtggtaggggcccgtggagtgggcaagtctgccttcctgcaggcctttctcggccgcggcctggggcaccaggacacgagggagcagcctcccggctacgccatcgacacggtgcaggtcaatgggcaggagaagtacttgatcctctgtgaggtgggcacagatggtctgctggccacatcgctggacgccacctgtgacgttgcctgcttgatgtttgatggcagtgacccaaagtcctttgcacattgtgccagcgtctacaagcaccattacatggacgggcagaccccctgcctctttgtctcctccaaggccgacctgcccgaaggtgtcgcggtgtctggcccatcaccggccgagttttgccgcaagcaccggctacccgctcccgtgccgttctcctgtgctggcccagccgagcccagcaccaccatcttcacccagctcgccaccatggccgccttcccacatttggtccacgcagagctgcatccctcttccttctggctccgggggctgctgggggttgtcggggccgccgtggccgcagtcctcagcttctcactctacagcgcggccggcacgagaccacctggaccatcctgcggcgcttcggctacagcgatgccctggagctgactgcggactatctctcccctctgatccacgtgccccccggctgcagcacggagctcaaccaccttggctaccagtttgaggggctctacccccctttcctggtcctaggtggccagtgggtatgaggagggctggaaggcagagctttgggccaaaagcaggcgttggggggtcccccctcaagtttggagccgtttccgtggttgtagcagaggaccggaggttgggttcctgattaaacttcactgtgtgttttctatctcggatcccagtctctgaagacaacttgctttgattcaacctagaa

SEQ ID NO: 343086 - DNA, 3144 bp, Homo sapiens
agcgggggaaccggaagtgcggggcgggcgcgggggcagagcgaaaggcttgaggaccaggtcggggccgggttccgggtcggggagcggctccgggcggcagctatgaggcgggacgtgcgcatcctgttactgggcgaggcccaggtggggaagacgtcgctgatcctgtccctggtgggcgaggagttccccgaggaggtaaggggcacgcccgccgcgggggtgggagcgggcccagccgggggtccctggtgagcgcgcgggtcccttgcaggtccctccccgcgcggaggagatcacgatccccgcggacgtcaccccggagaaggtgcccacccacatcgtggactactcaggtagcggccgtagcctcccgggggcccggcccgcagcggtccggcgggcctgctgggtccgcagtggagtctctttgtccccctagaagccgagcagacggacgaggagctgcgggaggagatccacaaggtacccgtggtgcgcgggacgagggaggggctgggcgcgggctcggcctaatccgcttcgcagcctgggggattggaccgaggtgctccgggtgtccttggccctgataattctgtgacctccgcactgagggttgtcggggcccctacagcgcaccccgctgggagccggcaccgctcagtccagtggtgctccagggataacaggacccttccccgcgggctctccctccctcctgccggggtggcagcagcgtttgctcttcctgtgggctctgtgtgcgccacgtccccgtgctgtgtgctccagcccaccgtcccggcctccgggcacccggagctcccagtaccagagcacgtgtgccggggacatctccaggcaagggcacaggccacagccacccagggcagcccctgctgttggcacccctcactgcggtcctgtcactctgtctgtagcgaggggggaggcaggggccaaggcggcggctgtcttgcagggtgttgggttgcaggtgtggccgtgtctgtcctgagccctctgctccaagggtcttgctgaccacagttatgcttctggggcctggtgtccctgcactggcagtgggcggggaagaggcttctctgagggttcagcagcagctcccagtgtgacactggggagtgcctgctctgccaacaccaggctggaggcaggttttagggaaggctgggctttcccggcctcagagctgcacccatgctacctgtgagcttctggggcctcctggagcctcgagatggcgtggaacggccagggtcgtcggtggtgagccagcagccctgtcacccacacctcatcactgttccctcaggcaaacgtggtgtgtgtggtgtatgacgtctctgaggaggccaccattgagaaggtgagccctcagtgcagaccccaacagcagagacacagtggccggtggtggcccaggtggaccttcacccaacccgtggccagtgccatcgctcacagcattttggggagcctgacgtggagttgcctgacgtggagtcacccggccctctcctgtgatcccacttcccctgagagggtctggggcgtcccgcagtctgagccattgaggccggcagtcctctttcttccccagtttccaaacccccggggggggacccgcagagggcctgcgttgggggcggccctaggcttgggccccagtgacttgggggtgtttgggagccattggggtcagacagatgaggctgcacctgctgcctgccttctcccaccagctttgttcctgtggccgggacttgggccctcagtgggccttgacctcccccttctgctctcccccagccaggctcatgctccagctgggagccatgtgcccgcgggcagcctcacttcacagccaggctttgcttttcagattcgaactaagtggatcccactggtgaatggggggaccacgcaggggcccagggtgcccatcatcctagtgggcaacaagtcagacctgcggtcggggagctccatggaggccgtgctccccatcatgagccagtttcccgagattgagacctgcgtggagtgttcggccaagaacctgaggaacatctcagagctgttctactacgcccagaaggccgtcctgcatcccacagcccccctctatgaccctgaggccaagcagttgaggcccgcgtgcgcccaggcgctgacgcgcatcttcaggctctcagatcaggacctggaccaggcgctcagtgacgaagagctcaacgctttccagaaatcctgctttgggcaccccctggccccgcaggccctggaggacgtgaagacggtggtgtgcaggaacgtggcgggcggcgtgcgggaggaccggctgaccctggatggtttcctcttcctgaacacgctcttcatccagcgcggccggcacgagaccacctggaccatcctgacatttggtccacgcagagctgcatccctcttccttctggctccgggggctgctgggggttgtcggggccgccgtggccgcagtcctcagcttctcactctacagggtcctggtgaagagccagtgaggcccctggtacccaagccccctcccctgacctgggtgtgcctcgctgctggggctctgcaggggcagcacagctggggtgcaggccaggctgccactccgggaacgcctttgcgccgggactttttgtttctgaaggcagtcgatctgcagcggggccttatgctgccatgcactgccctggctcctgccggacccccagggtgggccgtggcaggtggctgagcaggagctcccaagtgccggccaccgctgtcagggattgcccacccctgggcatcatgtgtgtggggccggggagcacaggtgtgggagctggtgaccccagacccagaattctcagggctctacccccctttcctggtcctaggtggccagtgggtatgaggagggctggaaggcagagctttgggccaaaagcaggcgttggggggtcccccctcaagtttggagccgtttccgtggttgtagcagaggaccggaggttgggttcctgattaaacttcactgtgtgttttctatctcggatcccagtctctgaagacaacttgctttgattcaacctagaa

SEQ ID NO: 343087 - DNA, 2592 bp, Homo sapiens
agcgggggaaccggaagtgcggggcgggcgcgggggcagagcgaaaggcttgaggaccaggtcggggccgggttccgggtcggggagcggctccgggcggcagctatgaggcgggacgtgcgcatcctgttactgggcgaggcccaggtggggaagacgtcgctgatcctgtccctggtgggcgaggagttccccgaggaggtaaggggcacgcccgccgcgggggtgggagcgggcccagccgggggtccctggtgagcgcgcgggtcccttgcaggtccctccccgcgcggaggagatcacgatccccgcggacgtcaccccggagaaggtgcccacccacatcgtggactactcaggtagcggccgtagcctcccgggggcccggcccgcagcggtccggcgggcctgctgggtccgcagtggagtctctttgtccccctagaagccgagcagacggacgaggagctgcgggaggagatccacaaggtacccgtggtgcgcgggacgagggaggggctgggcgcgggctcggcctaatccgcttcgcagcctgggggattggaccgaggtgctccgggtgtccttggccctgataattctgtgacctccgcactgagggttgtcggggcccctacagcgcaccccgctgggagccggcaccgctcagtccagtggtgctccagggataacaggacccttccccgcgggctctccctccctcctgccggggtggcagcagcgtttgctcttcctgtgggctctgtgtgcgccacgtccccgtgctgtgtgctccagcccaccgtcccggcctccgggcacccggagctcccagtaccagagcacgtgtgccggggacatctccaggcaagggcacaggccacagccacccagggcagcccctgctgttggcacccctcactgcggtcctgtcactctgtctgtagcgaggggggaggcaggggccaaggcggcggctgtcttgcagggtgttgggttgcaggtgtggccgtgtctgtcctgagccctctgctccaagggtcttgctgaccacagttatgcttctggggcctggtgtccctgcactggcagtgggcggggaagaggcttctctgagggttcagcagcagctcccagtgtgacactggggagtgcctgctctgccaacaccaggctggaggcaggttttagggaaggctgggctttcccggcctcagagctgcacccatgctacctgtgagcttctggggcctcctggagcctcgagatggcgtggaacggccagggtcgtcggtggtgagccagcagccctgtcacccacacctcatcactgttccctcaggcaaacgtggtgtgtgtggtgtatgacgtctctgaggaggccaccattgagaaggtgagccctcagtgcagaccccaacagcagagacacagtggccggtggtggcccaggtggaccttcacccaacccgtggccagtgccatcgctcacagcattttggggagcctgacgtggagttgcctgacgtggagtcacccggccctctcctgtgatcccacttcccctgagagggtctggggcgtcccgcagtctgagccattgaggccggcagtcctctttcttccccagtttccaaacccccggggggggacccgcagagggcctgcgttgggggcggccctaggcttgggccccagtgacttgggggtgtttgggagccattggggtcagacagatgaggctgcacctgctgcctgccttctcccaccagctttgttcctgtggccgggacttgggccctcagtgggccttgacctcccccttctgctctcccccagccaggctcatgctccagctgggagccatgtgcccgcgggcagcctcacttcacagccaggctttgcttttcagattcgaactaagtggatcccactggtgaatggggggaccacgcaggggcccagggtgcccatcatcctagtgggcaacaagtcagacctgcggtcggggagctccatggaggccgtgctccccatcatgagccagtttcccgagattgagacctgcgtggagtgttcggccaagaacctgaggaacatctcagagctgttctactacgcccagaaggccgtcctgcatcccacagcccccctctatgaccctgaggccaagcagaaatcctgctttgggcaccccctggccccgcaggccctggaggacgtgaagacggtggtgtgcaggaacgtggcgggcggcgtgcgggaggaccggctgaccctggatggtttcctcttcctgaacacgctcttcatccagcgcggccggcacgagaccacctggaccatcctgcggcgcttcggctacagcgatgccctggagctgactgcggactatctctcccctctgggctctacccccctttcctggtcctaggtggccagtgggtatgaggagggctggaaggcagagctttgggccaaaagcaggcgttggggggtcccccctcaagtttggagccgtttccgtggttgtagcagaggaccggaggttgggttcctgattaaacttcactgtgtgttttctatctcgga

SEQ ID NO: 343088 - DNA, 1044 bp, Homo sapiens
  misc_feature (1044)..(1044): n is a, c, g, or t
agcgggggaaccggaagtgcggggcgggcgcgggggcagagcgaaaggcttgaggaccaggtcggggccgggttccgggtcggggagcggctccgggcggcagctatgaggcgggacgtgcgcatcctgttactgggcgaggcccaggtggggaagacgtcgctgatcctgtccctggtgggcgaggagttccccgaggaggtccctccccgcgcggaggagatcacgatccccgcggacgtcatgggagaaagggttgccaacccaacaattcgtgggaactaacttcaggaaaggccgaagccaagaagggaagaagggaagcctgtgcggaaaggaaaaatccacaaggaattcgagaagattaggtgtgagttcccaactggctgtgcacttgtgggggggagcaccaacgcgatgggggcccccgagtgtgtgccccatctcattctatagtggggggcacccaaggtctcgagacccgtgcgcgctgcggggagaacgtctcctgtggaagtgccgtgtggttccccagattcttgaggagcccaaggttttcccccgaggaaattgtggagagaccctggggggtggtgaggattggtgttcggggccaaagaaacgcttgaagggagacattctctagagactggttgctacgtaaataagcgcacgacaagagactggtcccgtgcgtttgccatccagaacgaaggcctcactaacctttagttagtttgaaccgccgagtgacagggagcccacatggtcgatggtggagcgttggccccacattagaagagcagaaaacaacgaacaggagtaagcacacaaggagcgcacgacattctggaaacccgctcccagagaatggccgaggaaaacgatagaacttggagaacccaggggatgacagaaccaatccacagagagagtatgggaatgtgggataagacaaaccacagaaagaacaaagagagtaggcgacgttgcggaggaaagaggacaagaaaactccactcgcatatgagggagaagcccccn

SEQ ID NO: 343089 - DNA, 1032 bp, Homo sapiens
agcgggggaaccggaagtgcggggcgggcgcgggggcagagcgaaaggcttgaggaccaggtcggggccgggttccgggtcggggagcggctccgggcggcagctatgaggcgggacgtgcgcatcctgttactgggcgaggcccaggtggggaagacgtcgctgatcctgtccctggtgggcgaggagttccccgaggaggtccctccccgcgcggaggagatcacgatccccgcggacgtcaccccggagaaggtgcccacccacatcgtggactactcagaagccgagcagacggacgaggagctgcgggaggagatccacaaggcaaacgtggtgtgtgtggtgtatgacgtctctgaggaggccaccattgagaagattcgaactaagtggatcccactggtgaatggggggaccacgcaggggcccagggtgcccatcatcctagtgggcaacaagtcagacctgcggtcggggagctccatggaggccgtgctccccatcatgagccagtttcccgagattgagacctgcgtggagtgttcggccaagaacctgaggaacatctcagagctgttctactacgcccagaaggccgtcctgcatcccacagcccccctctatgaccctgaggccaagcagaaatcctgctttgggcaccccctggccccgcaggccctggaggacgtgaagacggtggtgtgcaggaacgtggcgggcggcgtgcgggaggaccggctgaccctggatggtttcctcttcctgaacacgctcttcatccagcgcggccggcacgagaccacctggaccatcctgcggcgcttcggctacagcgatgcctgggatggatgggatatgtttccctctgatcagtgccccggtgaggagggtcaacactggtctccagtggcaaaggttgtaagccgcacggcggaaggcccttgcggagagaagcttaggccacagctggccaaccgcaatcaagggcggccgactcgctgaccggcggggacagggaccggagacaga

SEQ ID NO: 343090 - DNA, 3918 bp, Homo sapiens
agcgggggaaccggaagtgcggggcgggcgcgggggcagagcgaaaggcttgaggaccaggtcggggccgggttccgggtcggggagcggctccgggcggcagctatgaggcgggacgtgcgcatcctgttactgggcgaggcccaggtggggaagacgtcgctgatcctgtccctggtgggcgaggagttccccgaggaggtaaggggcacgcccgccgcgggggtgggagcgggcccagccgggggtccctggtgagcgcgcgggtcccttgcaggtccctccccgcgcggaggagatcacgatccccgcggacgtcaccccggagaaggtgcccacccacatcgtggactactcaggtagcggccgtagcctcccgggggcccggcccgcagcggtccggcgggcctgctgggtccgcagtggagtctctttgtccccctagaagccgagcagacggacgaggagctgcgggaggagatccacaaggtacccgtggtgcgcgggacgagggaggggctgggcgcgggctcggcctaatccgcttcgcagcctgggggattggaccgaggtgctccgggtgtccttggccctgataattctgtgacctccgcactgagggttgtcggggcccctacagcgcaccccgctgggagccggcaccgctcagtccagtggtgctccagggataacaggacccttccccgcgggctctccctccctcctgccggggtggcagcagcgtttgctcttcctgtgggctctgtgtgcgccacgtccccgtgctgtgtgctccagcccaccgtcccggcctccgggcacccggagctcccagtaccagagcacgtgtgccggggacatctccaggcaagggcacaggccacagccacccagggcagcccctgctgttggcacccctcactgcggtcctgtcactctgtctgtagcgaggggggaggcaggggccaaggcggcggctgtcttgcagggtgttgggttgcaggtgtggccgtgtctgtcctgagccctctgctccaagggtcttgctgaccacagttatgcttctggggcctggtgtccctgcactggcagtgggcggggaagaggcttctctgagggttcagcagcagctcccagtgtgacactggggagtgcctgctctgccaacaccaggctggaggcaggttttagggaaggctgggctttcccggcctcagagctgcacccatgctacctgtgagcttctggggcctcctggagcctcgagatggcgtggaacggccagggtcgtcggtggtgagccagcagccctgtcacccacacctcatcactgttccctcaggcaaacgtggtgtgtgtggtgtatgacgtctctgaggaggccaccattgagaaggtgagccctcagtgcagaccccaacagcagagacacagtggccggtggtggcccaggtggaccttcacccaacccgtggccagtgccatcgctcacagcattttggggagcctgacgtggagttgcctgacgtggagtcacccggccctctcctgtgatcccacttcccctgagagggtctggggcgtcccgcagtctgagccattgaggccggcagtcctctttcttccccagtttccaaacccccggggggggacccgcagagggcctgcgttgggggcggccctaggcttgggccccagtgacttgggggtgtttgggagccattggggtcagacagatgaggctgcacctgctgcctgccttctcccaccagctttgttcctgtggccgggacttgggccctcagtgggccttgacctcccccttctgctctcccccagccaggctcatgctccagctgggagccatgtgcccgcgggcagcctcacttcacagccaggctttgcttttcagattcgaactaagtggatcccactggtgaatggggggaccacgcaggggcccagggtgcccatcatcctagtgggcaacaagtcagacctgcggtcggggagctccatggaggccgtgctccccatcatgagccagtttcccgagattgagacctgcgtggagttgaggcccgcgtgcgcccaggcgctgacgcgcatcttcaggctctcagatcaggacctggaccaggcgctcagtgacgaagagctcaacgctttccagaaatcctgctttgggcaccccctggccccgcaggccctggaggacgtgaagacggtggtgtgcaggaacgtggcgggcggcgtgcgggaggaccggctgaccctggatggtttcctcttcctgaacacgctcttcatccagcgcggccggcacgagaccacctggaccatcctgcggcgcttcggctacagcgatgccctggagctgactgcggactatctctcccctctgatccacgtgccccccggctgcagcacggagctcaaccaccttggctaccagtttgtgcagagagtgtttgagaagcacgaccaggaccgcgacggcgccctctcgcccgtggagctgcaaagccttttcagtgtgttcccagcagcgccctggggccccgagctcccacgcacagtccgcacagaggccggccggttgcccctgcacggatacctctgccagtggaccctggtgacctacctggacgtccggagctgccttggacacctaggctacctgggctaccccaccctctgtgagcaggaccaggcccatgccatcacagtcactcgtgagaagaggctggaccaggagaagggacagacgcagcggagcgtcctcctgtgcaaggtggtaggggcccgtggagtgggcaagtctgccttcctgcaggcctttctcggccgcggcctggggcaccaggacacgagggagcagcctcccggctacgccatcgacacggtgcaggtcaatgggcaggagaagtacttgatcctctgtgaggtgggcacagatggtctgctggccacatcgctggacgccacctgtgacgttgcctgcttgatgtttgatggcagtgacccaaagtcctttgcacattgtgccagcgtctacaagcaccattacatggacgggcagaccccctgcctctttgtctcctccaaggccgacctgcccgaaggtgtcgcggtgtctggcccatcaccggccgagttttgccgcaagcaccggctacccgctcccgtgccgttctcctgtgctggcccagccgagcccagcaccaccatcttcacccagctcgccaccatggccgccttcccacatttggtccacgcagagctgcatccctcttccttctggctccgggggctgctgggggttgtcggggccgccgtggccgcagtcctcagcttctcactctacagggtcctggtgaagagccagtgaggcccctggtacccaagccccctcccctgacctgggtgtgcctcgctgctggggctctgcaggggcagcacagctggggtgcaggccaggctgccactccgggaacgcctttgcgccgggactttttgtttctgaaggcagtcgatctgcagcggggccttatgctgccatgcactgccctggctcctgccggacccccagggtgggccgtggcaggtggctgagcaggagctcccaagtgccggccaccgctgtcagggattgcccacccctgggcatcatgtgtgtggggccggggagcacaggtgtgggagctggtgaccccagacccagaattctcagggctctacccccctttcctggtcctaggtggccagtgggtatgaggagggctggaaggcagagctttgggccaaaagcaggcgttggggggtcccccctcaagtttggagccgtttccgtggttgtagcagaggaccggaggttgggttcctgattaaacttcactgtgtgttttctatctcgga

SEQ ID NO: 343091 - DNA, 4036 bp, Homo sapiens
agcgggggaaccggaagtgcggggcgggcgcgggggcagagcgaaaggcttgaggaccaggtcggggccgggttccgggtcggggagcggctccgggcggcagctatgaggcgggacgtgcgcatcctgttactgggcgaggcccaggtggggaagacgtcgctgatcctgtccctggtgggcgaggagttccccgaggaggtaaggggcacgcccgccgcgggggtgggagcgggcccagccgggggtccctggtgagcgcgcgggtcccttgcaggtccctccccgcgcggaggagatcacgatccccgcggacgtcaccccggagaaggtgcccacccacatcgtggactactcaggtagcggccgtagcctcccgggggcccggcccgcagcggtccggcgggcctgctgggtccgcagtggagtctctttgtccccctagaagccgagcagacggacgaggagctgcgggaggagatccacaaggtacccgtggtgcgcgggacgagggaggggctgggcgcgggctcggcctaatccgcttcgcagcctgggggattggaccgaggtgctccgggtgtccttggccctgataattctgtgacctccgcactgagggttgtcggggcccctacagcgcaccccgctgggagccggcaccgctcagtccagtggtgctccagggataacaggacccttccccgcgggctctccctccctcctgccggggtggcagcagcgtttgctcttcctgtgggctctgtgtgcgccacgtccccgtgctgtgtgctccagcccaccgtcccggcctccgggcacccggagctcccagtaccagagcacgtgtgccggggacatctccaggcaagggcacaggccacagccacccagggcagcccctgctgttggcacccctcactgcggtcctgtcactctgtctgtagcgaggggggaggcaggggccaaggcggcggctgtcttgcagggtgttgggttgcaggtgtggccgtgtctgtcctgagccctctgctccaagggtcttgctgaccacagttatgcttctggggcctggtgtccctgcactggcagtgggcggggaagaggcttctctgagggttcagcagcagctcccagtgtgacactggggagtgcctgctctgccaacaccaggctggaggcaggttttagggaaggctgggctttcccggcctcagagctgcacccatgctacctgtgagcttctggggcctcctggagcctcgagatggcgtggaacggccagggtcgtcggtggtgagccagcagccctgtcacccacacctcatcactgttccctcaggcaaacgtggtgtgtgtggtgtatgacgtctctgaggaggccaccattgagaaggtgagccctcagtgcagaccccaacagcagagacacagtggccggtggtggcccaggtggaccttcacccaacccgtggccagtgccatcgctcacagcattttggggagcctgacgtggagttgcctgacgtggagtcacccggccctctcctgtgatcccacttcccctgagagggtctggggcgtcccgcagtctgagccattgaggccggcagtcctctttcttccccagtttccaaacccccggggggggacccgcagagggcctgcgttgggggcggccctaggcttgggccccagtgacttgggggtgtttgggagccattggggtcagacagatgaggctgcacctgctgcctgccttctcccaccagctttgttcctgtggccgggacttgggccctcagtgggccttgacctcccccttctgctctcccccagccaggctcatgctccagctgggagccatgtgcccgcgggcagcctcacttcacagccaggctttgcttttcagattcgaactaagtggatcccactggtgaatggggggaccacgcaggggcccagggtgcccatcatcctagtgggcaacaagtcagacctgcggtcggggagctccatggaggccgtgctccccatcatgagccagtttcccgagattgagacctgcgtggagttgaggcccgcgtgcgcccaggcgctgacgcgcatcttcaggctctcagatcaggacctggaccaggcgctcagtgacgaagagctcaacgctttccaggtgtgcccctgccccaccctcggtgcccagcccccttgaacctccgctgccgttagtgactggaacgggtcgtctccgggtggctggctgactcccaacaacgttctctcggaagcagaaatcctgctttgggcaccccctggccccgcaggccctggaggacgtgaagacggtggtgtgcaggaacgtggcgggcggcgtgcgggaggaccggctgaccctggatggtttcctcttcctgaacacgctcttcatccagcgcggccggcacgagaccacctggaccatcctgcggcgcttcggctacagcgatgccctggagctgactgcggactatctctcccctctgatccacgtgccccccggctgcagcacggagctcaaccaccttggctaccagtttgtgcagagagtgtttgagaagcacgaccaggaccgcgacggcgccctctcgcccgtggagctgcaaagccttttcagtgtgttcccagcagcgccctggggccccgagctcccacgcacagtccgcacagaggccggccggttgcccctgcacggatacctctgccagtggaccctggtgacctacctggacgtccggagctgccttggacacctaggctacctgggctaccccaccctctgtgagcaggaccaggcccatgccatcacagtcactcgtgagaagaggctggaccaggagaagggacagacgcagcggagcgtcctcctgtgcaaggtggtaggggcccgtggagtgggcaagtctgccttcctgcaggcctttctcggccgcggcctggggcaccaggacacgagggagcagcctcccggctacgccatcgacacggtgcaggtcaatgggcaggagaagtacttgatcctctgtgaggtgggcacagatggtctgctggccacatcgctggacgccacctgtgacgttgcctgcttgatgtttgatggcagtgacccaaagtcctttgcacattgtgccagcgtctacaagcaccattacatggacgggcagaccccctgcctctttgtctcctccaaggccgacctgcccgaaggtgtcgcggtgtctggcccatcaccggccgagttttgccgcaagcaccggctacccgctcccgtgccgttctcctgtgctggcccagccgagcccagcaccaccatcttcacccagctcgccaccatggccgccttcccacatttggtccacgcagagctgcatccctcttccttctggctccgggggctgctgggggttgtcggggccgccgtggccgcagtcctcagcttctcactctacagggtcctggtgaagagccagtgaggcccctggtacccaagccccctcccctgacctgggtgtgcctcgctgctggggctctgcaggggcagcacagctggggtgcaggccaggctgccactccgggaacgcctttgcgccgggactttttgtttctgaaggcagtcgatctgcagcggggccttatgctgccatgcactgccctggctcctgccggacccccagggtgggccgtggcaggtggctgagcaggagctcccaagtgccggccaccgctgtcagggattgcccacccctgggcatcatgtgtgtggggccggggagcacaggtgtgggagctggtgaccccagacccagaattctcagggctctacccccctttcctggtcctaggtggccagtgggtatgaggagggctggaaggcagagctttgggccaaaagcaggcgttggggggtcccccctcaagtttggagccgtttccgtggttgtagcagaggaccggaggttgggttcctgattaaacttcactgtgtgttttctatctcgga

SEQ ID NO: 343092 - DNA, 1483 bp, Homo sapiens
gcctgggccggcttctggaacttctgcagagagtgtttgagaagcacgaccaggaccgcgacggcgccctctcgcccgtggagctgcaaagccttttcagtgtgttcccagcagcgccctggggccccgagctcccacgcacagtccgcacagaggccggccggttgcccctgcacggatacctctgccagtggaccctggtgacctacctggacgtccggagctgccttggacacctaggctacctgggctaccccaccctctgtgagcaggaccaggcccatgccatcacagtcactcgtgagaagaggctggaccaggagaagggacagacgcagcggagcgtcctcctgtgcaaggtggtaggggcccgtggagtgggcaagtctgccttcctgcaggcctttctcggccgcggcctggggcaccaggacacgagggagcagcctcccggctacgccatcgacacggtgcaggtcaatgggcaggagaagtacttgatcctctgtgaggtgggcacagatggtctgctggccacatcgctggacgccacctgtgacgttgcctgcttgatgtttgatggcagtgacccaaagtcctttgcacattgtgccagcgtctacaagcaccattacatggacgggcagaccccctgcctctttgtctcctccaaggccgacctgcccgaaggtgtcgcggtgtctggcccatcaccggccgagttttgccgcaagcaccggctacccgctcccgtgccgttctcctgtgctggcccagccgagcccagcaccaccatcttcacccagctcgccaccatggccgccttcccacatttggtccacgcagagctgcatccctcttccttctggctccgggggctgctgggggttgtcggggccgccgtggccgcagtcctcagcttctcactctacagggtcctggtgaagagccagtgaggcccctggtacccaagccccctcccctgacctgggtgtgcctcgctgctggggctctgcaggggcagcacagctggggtgcaggccaggctgccactccgggaacgcctttgcgccgggactttttgtttctgaaggcagtcgatctgcagcggggccttatgctgccatgcactgccctggctcctgccggacccccagggtgggccgtggcaggtggctgagcaggagctcccaagtgccggccaccgctgtcagggattgcccacccctgggcatcatgtgtgtggggccggggagcacaggtgtgggagctggtgaccccagacccagaattctcagggctctacccccctttcctggtcctaggtggccagtgggtatgaggagggctggaaggcagagctttgggccaaaagcaggcgttggggggtcccccctcaagtttggagccgtttccgtggttgtagcagaggaccggaggttgggttcctgattaaacttcactgtgtgttttctatctcgga

SEQ ID NO: 343093 - DNA, 3741 bp, Homo sapiens
agcgggggaaccggaagtgcggggcgggcgcgggggcagagcgaaaggcttgaggaccaggtcggggccgggttccgggtcggggagcggctccgggcggcagctatgaggcgggacgtgcgcatcctgttactgggcgaggcccaggtggggaagacgtcgctgatcctgtccctggtgggcgaggagttccccgaggaggtaaggggcacgcccgccgcgggggtgggagcgggcccagccgggggtccctggtgagcgcgcgggtcccttgcaggtccctccccgcgcggaggagatcacgatccccgcggacgtcaccccggagaaggtgcccacccacatcgtggactactcaggtagcggccgtagcctcccgggggcccggcccgcagcggtccggcgggcctgctgggtccgcagtggagtctctttgtccccctagaagccgagcagacggacgaggagctgcgggaggagatccacaaggtacccgtggtgcgcgggacgagggaggggctgggcgcgggctcggcctaatccgcttcgcagcctgggggattggaccgaggtgctccgggtgtccttggccctgataattctgtgacctccgcactgagggttgtcggggcccctacagcgcaccccgctgggagccggcaccgctcagtccagtggtgctccagggataacaggacccttccccgcgggctctccctccctcctgccggggtggcagcagcgtttgctcttcctgtgggctctgtgtgcgccacgtccccgtgctgtgtgctccagcccaccgtcccggcctccgggcacccggagctcccagtaccagagcacgtgtgccggggacatctccaggcaagggcacaggccacagccacccagggcagcccctgctgttggcacccctcactgcggtcctgtcactctgtctgtagcgaggggggaggcaggggccaaggcggcggctgtcttgcagggtgttgggttgcaggtgtggccgtgtctgtcctgagccctctgctccaagggtcttgctgaccacagttatgcttctggggcctggtgtccctgcactggcagtgggcggggaagaggcttctctgagggttcagcagcagctcccagtgtgacactggggagtgcctgctctgccaacaccaggctggaggcaggttttagggaaggctgggctttcccggcctcagagctgcacccatgctacctgtgagcttctggggcctcctggagcctcgagatggcgtggaacggccagggtcgtcggtggtgagccagcagccctgtcacccacacctcatcactgttccctcaggcaaacgtggtgtgtgtggtgtatgacgtctctgaggaggccaccattgagaagattcgaactaagtggatcccactggtgaatggggggaccacgcaggggcccagggtgcccatcatcctagtgggcaacaagtcagacctgcggtcggggagctccatggaggccgtgctccccatcatgagccagtttcccgagattgagacctgcgtggagtgttcggccaagaacctgaggaacatctcagagctgttctactacgcccagaaggccgtcctgcatcccacagcccccctctatgaccctgaggccaagcagttgaggcccgcgtgcgcccaggcgctgacgcgcatcttcaggctctcagatcaggacctggaccaggcgctcagtgacgaagagctcaacgctttccagaaatcctgctttgggcaccccctggccccgcaggccctggaggacgtgaagacggtggtgtgcaggaacgtggcgggcggcgtgcgggaggaccggctgaccctggatggtttcctcttcctgaacacgctcttcatccagcgcggccggcacgagaccacctggaccatcctgcggcgcttcggctacagcgatgccctggagctgactgcggactatctctcccctctgatccacgtgccccccggctgcagcacggagctcaaccaccttggctaccagtttgtgcagagagtgtttgagaagcacgaccaggaccgcgacggcgccctctcgcccgtggagctgcaaagccttttcagtgtgttcccagcagcgccctggggccccgagctcccacgcacagtccgcacagaggccggccggttgcccctgcacggatacctctgccagtggaccctggtgacctacctggacgtccggagctgccttggacacctaggctacctgggctaccccaccctctgtgagcaggaccaggcccatgccatcacagtcactcgtgagaagaggctggaccaggagaagggacagacgcagcggagcgtcctcctgtgcaaggtggtaggggcccgtggagtgggcaagtctgccttcctgcaggcctttctcggccgcggcctgggggtaagcaccctagactcccccaccaccccaggggctccaggggcagggcagggcaatctggggggcactgcagccagcgagtgtcaggacttcacctccctcaccaggacacgagggagcagcctcccggctacgccatcgacacggtgcaggtcaatgggcaggagaagtacttgatcgtgagtgctggggcggcgcggcctgtgcccgagggtggacccggggacacccaggcctgcctggcagatctggcccagcatggccctagggggaccgagccccagggacccttcctaaggccgctgtctgtcccagctctgtgaggtgggcacagatggtctgctggccacatcgctggacgccacctgtgacgttgcctgcttgatgtttgatggcagtgacccaaagtcctttgcacattgtgccagcgtctacaagcaccattacatggacgggcagaccccctgcctctttgtctcctccaaggccgacctgcccgaaggtgtcgcggtgtctggcccatcaccggccgagttttgccgcaagcaccggctacccgctcccgtgccgttctcctgtgctggcccagccgagcccagcaccaccatcttcacccagctcgccaccatggccgccttcccacatttggtccacgcagagctgcatccctcttccttctggctccgggggctgctgggggttgtcggggccgccgtggccgcagtcctcagcttctcactctacagggtcctggtgaagagccagtgaggcccctggtacccaagccccctcccctgacctgggtgtgcctcgctgctggggctctgcaggggcagcacagctggggtgcaggccaggctgccactccgggaacgcctttgcgccgggactttttgtttctgaaggcagtcgatctgcagcggggccttatgctgccatgcactgccctggctcctgccggacccccagggtgggccgtggcaggtggctgagcaggagctcccaagtgccggccaccgctgtcagggattgcccacccctgggcatcatgtgtgtggggccggggagcacaggtgtgggagctggtgaccccagacccagaattctcagggctctacccccctttcctggtcctaggtggccagtgggtatgaggagggctggaaggcagagctttgggccaaaagcaggcgttggggggtcccccctcaagtttggagccgtttccgtggttgtagcagaggaccggaggttgggttcctgattaaacttcactgtgtgttttctatctcgga

SEQ ID NO: 343094 - DNA, 3665 bp, Homo sapiens
agcgggggaaccggaagtgcggggcgggcgcgggggcagagcgaaaggcttgaggaccaggtcggggccgggttccgggtcggggagcggctccgggcggcagctatgaggcgggacgtgcgcatcctgttactgggcgaggcccaggtggggaagacgtcgctgatcctgtccctggtgggcgaggagttccccgaggaggtaaggggcacgcccgccgcgggggtgggagcgggcccagccgggggtccctggtgagcgcgcgggtcccttgcaggtccctccccgcgcggaggagatcacgatccccgcggacgtcaccccggagaaggtgcccacccacatcgtggactactcaggtagcggccgtagcctcccgggggcccggcccgcagcggtccggcgggcctgctgggtccgcagtggagtctctttgtccccctagaagccgagcagacggacgaggagctgcgggaggagatccacaaggtacccgtggtgcgcgggacgagggaggggctgggcgcgggctcggcctaatccgcttcgcagcctgggggattggaccgaggtgctccgggtgtccttggccctgataattctgtgacctccgcactgagggttgtcggggcccctacagcgcaccccgctgggagccggcaccgctcagtccagtggtgctccagggataacaggacccttccccgcgggctctccctccctcctgccggggtggcagcagcgtttgctcttcctgtgggctctgtgtgcgccacgtccccgtgctgtgtgctccagcccaccgtcccggcctccgggcacccggagctcccagtaccagagcacgtgtgccggggacatctccaggcaagggcacaggccacagccacccagggcagcccctgctgttggcacccctcactgcggtcctgtcactctgtctgtagcgaggggggaggcaggggccaaggcggcggctgtcttgcagggtgttgggttgcaggtgtggccgtgtctgtcctgagccctctgctccaagggtcttgctgaccacagttatgcttctggggcctggtgtccctgcactggcagtgggcggggaagaggcttctctgagggttcagcagcagctcccagtgtgacactggggagtgcctgctctgccaacaccaggctggaggcaggttttagggaaggctgggctttcccggcctcagagctgcacccatgctacctgtgagcttctggggcctcctggagcctcgagatggcgtggaacggccagggtcgtcggtggtgagccagcagccctgtcacccacacctcatcactgttccctcaggcaaacgtggtgtgtgtggtgtatgacgtctctgaggaggccaccattgagaagattcgaactaagtggatcccactggtgaatggggggaccacgcaggggcccagggtgcccatcatcctagtgggcaacaagtcagacctgcggtcggggagctccatggaggccgtgctccccatcatgagccagtttcccgagattgagacctgcgtggagtgttcggccaagaacctgaggaacatctcagagctgttctactacgcccagaaggccgtcctgcatcccacagcccccctctatgaccctgaggccaagcagttgaggcccgcgtgcgcccaggcgctgacgcgcatcttcaggctctcagatcaggacctggaccaggcgctcagtgacgaagagctcaacgctttccagaaatcctgctttgggcaccccctggccccgcaggccctggaggacgtgaagacggtggtgtgcaggaacgtggcgggcggcgtgcgggaggaccggctgaccctggatggtttcctcttcctgaacacgctcttcatccagcgcggccggcacgagaccacctggaccatcctgcggcgcttcggctacagcgatgccctggagctgactgcggactatctctcccctctgatccacgtgccccccggctgcagcacggagctcaaccaccttggctaccagtttgtgcagagagtgtttgagaagcacgaccaggaccgcgacggcgccctctcgcccgtggagctgcaaagccttttcagtgtgttcccagcagcgccctggggccccgagctcccacgcacagtccgcacagaggccggccggttgcccctgcacggatacctctgccagtggaccctggtgacctacctggacgtccggagctgccttggacacctaggctacctgggctaccccaccctctgtgagcaggaccaggcccatgccatcacagtcactcgtgagaagaggctggaccaggagaagggacagacgcagcggagcgtcctcctgtgcaaggtggtaggggcccgtggagtgggcaagtctgccttcctgcaggcctttctcggccgcggcctggggcaccaggacacgagggagcagcctcccggctacgccatcgacacggtgcaggtcaatgggcaggagaagtacttgatcctctgtgaggtgggcacagatggtctgctggccacatcgctggacgccacctgtgacgttgcctgcttgatgtttgatggcagtgacccaaagtcctttgcacattgtgccagcgtctacaagcaccattacatggacgggcagaccccctgcctctttgtctcctccaaggccgacctgcccgaaggtgtcgcggtgtctggcccatcaccggccgagttttgccgcaagcaccggctacccgctcccgtgccgttctcctgtgctggcccagccgagcccagcaccaccatcttcacccagctcgccaccatggccgccttcccgtgggtacccagtagcgcagccctggggactagcagtgtctgtcatccgagcagtgggcagcggtggtgtcaggcctggaactggggactagcagtgtctgtcatccgagcagtgggcagcagtggcgtcaggcctggaactggggccagagtggcggggtggagctttgtgtggcagagggaggcagtgcccaggcatgtccctccagggcctggcctccaccggctgtgcctctggtctgggatccccgcctgtggggccctgtgagtccaggacatgggagggtgcccagcagcaagctgggggcatgtgcctgaggtatctgcagatgattcttctctcttgcagacatttggtccacgcagagctgcatccctcttccttctggggaacgcctttgcgccgggactttttgtttctgaaggcagtcgatctgcagcggggccttatgctgccatgcactgccctggctcctgccggacccccagggtgggccgtggcaggtggctgagcaggagctcccaagtgccggccaccgctgtcagggattgcccacccctgggcatcatgtgtgtggggccggggagcacaggtgtgggagctggtgaccccagacccagaattctcagggctctacccccctttcctggtcctaggtggccagtgggtatgaggagggctggaaggcagagctttgggccaaaagcaggcgttggggggtcccccctcaagtttggagccgtttccgtggttgtagcagaggaccggaggttgggttcctgattaaacttcactgtgtgttttctatctcgga

SEQ ID NO: 343095 - DNA, 2643 bp, Homo sapiens
agcgggggaaccggaagtgcggggcgggcgcgggggcagagcgaaaggcttgaggaccaggtcggggccgggttccgggtcggggagcggctccgggcggcagctatgaggcgggacgtgcgcatcctgttactgggcgaggcccaggtggggaagacgtcgctgatcctgtccctggtgggcgaggagttccccgaggaggtaaggggcacgcccgccgcgggggtgggagcgggcccagccgggggtccctggtgagcgcgcgggtcccttgcaggtccctccccgcgcggaggagatcacgatccccgcggacgtcaccccggagaaggtgcccacccacatcgtggactactcaggtagcggccgtagcctcccgggggcccggcccgcagcggtccggcgggcctgctgggtccgcagtggagtctctttgtccccctagaagccgagcagacggacgaggagctgcgggaggagatccacaaggtacccgtggtgcgcgggacgagggaggggctgggcgcgggctcggcctaatccgcttcgcagcctgggggattggaccgaggtgctccgggtgtccttggccctgataattctgtgacctccgcactgagggttgtcggggcccctacagcgcaccccgctgggagccggcaccgctcagtccagtggtgctccagggataacaggacccttccccgcgggctctccctccctcctgccggggtggcagcagcgtttgctcttcctgtgggctctgtgtgcgccacgtccccgtgctgtgtgctccagcccaccgtcccggcctccgggcacccggagctcccagtaccagagcacgtgtgccggggacatctccaggcaagggcacaggccacagccacccagggcagcccctgctgttggcacccctcactgcggtcctgtcactctgtctgtagcgaggggggaggcaggggccaaggcggcggctgtcttgcagggtgttgggttgcaggtgtggccgtgtctgtcctgagccctctgctccaagggtcttgctgaccacagttatgcttctggggcctggtgtccctgcactggcagtgggcggggaagaggcttctctgagggttcagcagcagctcccagtgtgacactggggagtgcctgctctgccaacaccaggctggaggcaggttttagggaaggctgggctttcccggcctcagagctgcacccatgctacctgtgagcttctggggcctcctggagcctcgagatggcgtggaacggccagggtcgtcggtggtgagccagcagccctgtcacccacacctcatcactgttccctcaggcaaacgtggtgtgtgtggtgtatgacgtctctgaggaggccaccattgagaagattcgaactaagtggatcccactggtgaatggggggaccacgcaggggcccagggtgcccatcatcctagtgggcaacaagtcagacctgcggtcggggagctccatggaggccgtgctccccatcatgagccagtttcccgagattgagacctgcgtggagtgttcggccaagaacctgaggaacatctcagagctgttctactacgcccagaaggccgtcctgcatcccacagcccccctctatgaccctgaggccaagcagttgaggcccgcgtgcgcccaggcgctgacgcgcatcttcaggctctcagatcaggacctggaccaggcgctcagtgacgaagagctcaacgctttccagaaatcctgctttgggcaccccctggccccgcaggccctggaggacgtgaagacggtggtgtgcaggaacgtggcgggcggcgtgcgggaggaccggctgaccctggatggtttcctcttcctgaacacgctcttcatccagcgcggccggcacgagaccacctggaccatcctgcggcgcttcggctacagcgatgccctggagctgactgcggactatctctcccctctgatccacgtgccccccggctgcagcacggagctcaaccaccttggctaccagtttgtgcagagagtgtttgagaagcacgaccaggaccgcgacggcgccctctcgcccgtggagctgcaaagccttttcagtgtgttcccagcagcgccctggggccccgagctcccacgcacagtccgcacagaggccggccggttgcccctgcacggatacctctgccagtggacggaacgcctttgcgccgggactttttgtttctgaaggcagtcgatctgcagcggggccttatgctgccatgcactgccctggctcctgccggacccccagggtgggccgtggcaggtggctgagcaggagctcccaagtgccggccaccgctgtcagggattgcccacccctgggcatcatgtgtgtggggccggggagcacaggtgtgggagctggtgaccccagacccagaattctcagggctctacccccctttcctggtcctaggtggccagtgggtatgaggagggctggaaggcagagctttgggccaaaagcaggcgttggggggtcccccctcaagtttggagccgtttccgtggttgtagcagaggaccggaggttgggttcctgattaaacttcactgtgtgttttctatctcgga

SEQ ID NO: 343096 - DNA, 337 bp, Homo sapiens
ctcggtgcaggtttcctcttcctgaacacgctcttcatccagcgcggccggcacgagaccacctggaccatcctgcggcgcttcggctacagcgatgccctggagctgactgcggactatctctcccctcttgtgagtgatgccggggcttgaggcctgccctccccgagggtcaggagctgactgccgactatctctcccctccatgagtgacgctggggtttgaggcctgccctccctgagggtcagtgaaggtctcgctcagcaggccatctggggtcgtgcccttgcctggctgtgccctgaacccctcagcatccacagagctctgagtcgg

SEQ ID NO: 343097 - DNA, 449 bp, Homo sapiens
agccttgttttctctagatctgagagatggcttctggattcatctttccctgcaatccagcttctcctcctggggccctcatactggagactgggatcatcatccaggcttttgcactgggccaggaatttgggagtcatcctggatccgtctgcccctgtcaacctttcgctgtcaacggatatttattgggcgtcctcaacagccaggccctgttcatggtactgaagaacagcttgtataaaacaaccctgccctcacagggcgatcaccagtgacctgtggtgtggagtctccttttacctatgtctcctccttcccactgtcaccatccttggtcctcctctgtcacctggaatactccacttggtaaccagcatgatcttataacgctagttttacccttgtcagcactttgccaaaaacctcaaataaagactttttttaaa

SEQ ID NO: 343098 - DNA, 485 bp, Homo sapiens
agccttgttttctctagatctgagagatggcttctggattcatctttccctgcaatccagcttctcctcctggggccctcatactggagactgggatcatcatccaggcttttgcactgggccaggaatttgggagtcatcctggatccgtctgcccctgtcaacctttcgctgtcaacggatatttattgggcgtcctcaacagccaggccctgttcatggtactgaagaacagcttgtataaaacaaccctgccctcacagggcgatcaccagtgacctgtggtgtggagtctccttttacctatgtctcctccttcccactgtcaccatccttggtcctcctctgtcacctggaatactccacttggtaaccagcatgatcttataacgctagttttacccttgtcagcactttgccaaaaacctcaaataaagactttttttaaagggggaaaaaaaaagaaaatgggctcggtggcctca

SEQ ID NO: 343099 - DNA, 711 bp, Homo sapiens
agccatagacagtatataaatggtatgactgtattccagtaattatttatggacatggaattggaacttcatataatttgcacatgttacaatattattcttttgacttttttccccaaccaagtaaaaaaatataaaaaccattcttaggtctcagactgtacaaagataggcaacaggctggatttagtttataggctagagtttgctgacccctggtatgtatgaaagcacttggttatcagtaaaaattatccacatgtcatctgacatagcatcttgtgattaactgtgtttttatggttaagtgatcctatcttgagtgcaagttaggcagaagattttggaagcaaagctccgtgcctgtggggaaacagtttttggcatggctcactctctgttcttattgtttcttcctctggacaccagctcagcatggaagggatgactgttagcacgttcttgaggtccaaaaactttcagtgaggctgtggtttgacttcatcaggtgaatgcttatgtgtgcccgtgtgcgtgtcggcacatgcacacacacacatctgttcaaataagaggcttagtgttaaacgccagtgtggtcaggctctctcagtgatctgaacatgagatattatgattgcctttcctgagcacatatctttttacatagctttgcaaccttggtttaaaccaaatagctcataaattggc

SEQ ID NO: 343100 - DNA, 642 bp, Homo sapiens
ctttttatttttatttttggggcagagtctcactctgttgcccaggctggagtgcagtggcacaatgtcgactcactgcaacctctgcctcttgggttcaagcaattcttgtgcttcagcctccagagtagctgggattacaggcgtgcgccatcacacccagctaatttttgtatttttagtagagaccgggtttcactatgttggctaggctggtctcaaactcctgtcctcatgtgatcggcacacctcggcctcccaaagtgctgggattacaggcatgagccaccgcgcccggccagatttccatctttttaggctgaatagtatctcatatatctatatcacataatgacatttcagtcaatgatgggcctcaaatacaataatggtcccatcagactataatagaactgaaaaattcctataacagtggcgtcgtaaccatcagaatggtgacagcacaacacatgaagtgtttggcatgatgcttgtgtaaacaaacctactgcactgccagtcctataaaaggtacagtactacccattgtattacagttgcctacaggattcagttgtataatatgccatacaggtttgtagcctaggggtcgacgcggccgcgaatttagtagtagtaggc

SEQ ID NO: 343101 - DNA, 746 bp, Homo sapiens
cgaagacttgcattcccctttgagcatccacctcactcagttagaagaaatgtgtctccaagcactgccagcctgtgaataagcacttcccaagtgccaggtacaaagttagacacttcccatctttcacctcgttgatcgcctcaaaatcccgtgaggtttttaatcactgactcagtagcattgattgagagatctactccgtgttaggcttagactacatagtgatgaccaaaacagtctttggattcatggcaattactgccaggtagagaaagcgaatgctgttattttgctctaagaggaaactaaggttcaaagaaccaatactttctcaatgccatataactggtaaagggtgtggccacgattacaccaccatgattctactccaaagactgtcttccctccaccatgccctactaccttcctataggaagcttaatctgcggttctacttaaaatatgaggaaacatctggaatattagttttcaaccacatttcagacacagaaagtggagcctaaggaatagcccagttggctcctctctgagagcgggtaagagtagaaaagaattgctgatctcaagcattttgttaccagaataaccccacaggagaggcctggctgaacggggatttgtgtgggccagacaatgtaggggatttatttccaaggctggaggacagagcttggactcgggtccagctcggcgtcctccctcgggtcctgctcgctgaagag

SEQ ID NO: 343102 - DNA, 736 bp, Homo sapiens
gcttccgccctgcgcgtcgtattagacggaaaccgagcgggcccatttttcatgggtttgcggacccaccagcgaaggcgggaggtgtcgcagggacatcttctggctgtttccgtcgcctgcgtggcccttgcaccccggtcttccattagcggcgcagacgtttgggcctaagcgctgggcgaggcgaggccctgcccctccccgccaacggccattctctggacctgtctttcttccgggaggcggtgacagctgctgagacgtgttgcagccagagtctctccgctttaatgcgctcccattagtgccgtcccccactggaaaaccgtggcttctgtattatttgccatctttgttgtgtaggagcagggagggcttcctcccggggtcctaggcggcggtgcagtccgtcgtagaagaattagagtagaagttgtcggggtccgctcttaggacgcagccgcctcatgggggtccaggggctctggaagctgctggagtgctccgggcggcaggtcagccccgaagcgctggaagggaagatcctggctgttggtatccttaacgccgcgttgggacttggggtgcagggattcggggctggattcctcgcggggctctgccttgggcacagtggcatctgcaggatgatggtcttgggtcggggtcggggtcgctatagaatctctgtcactaggttttctaagtacagtcgtccctcggtatccccggg

SEQ ID NO: 343103 - DNA, 401 bp, Homo sapiens
tgtgactcctaaattgggtgaggtgactccctattgcatctctagtgacctgcccttcccttgtggtggaagttattagatcccactctaattgcttacttacacgtgtcccccaccagaccatgagaccagtagtggcacagatcttgctgttttattcaccactgtagcccgtataacgagcagagccttgcatacaagtatttttgtaaggggtccttaaaaatcatagatatcgtaaaagtatgtttgactttcagttcagaagaggaagatgaaaaagaatggcaagaaagaatgaatcaaaaacaagcattacaggaagagaaggtagagaaaaaggaagagaaaccataggatgtgccagagaagaaggtagaaggtccagttaatccgggggg

SEQ ID NO: 343104 - DNA, 4080 bp, Homo sapiens
gcttccgccctgcgcgtcgtattagacggaaaccgagcgggcccatttttcatgggtttgcggacccaccagcgaaggcgggaggtgtcgcagggacatcttctggctgtttccgtcgcctgcgtggcccttgcaccccggtcttccattagcggcgcagacgtttgggcctaagcgctgggcgaggcgaggccctgcccctccccgccaacggccattctctggacctgtctttcttccgggaggcggtgacagctgctgagacgtgttgcagccagagtctctccgctttaatgcgctcccattagtgccgtcccccactggaaaaccgtggcttctgtattatttgccatctttgttgtgtaggagcagggagggcttcctcccggggtcctaggcggcggtgcagtccgtcgtagaagaattagagtagaagttgtcggggtccgctcttaggacgcagccgcctcatgggggtccaggggctctggaagctgctggagtgctccgggcggcaggtcagccccgaagcgctggaagggaagatcctggctgttgatattagcatttggttaaaccaagcacttaaaggagtccgggatcgccacgggaactcaatagaaaatcctcatcttctcactttgtttcatcggctctgcaaactcttattttttcgaattcgtcctatttttgtgtttgatggggatgctccactattgaagaaacagactttggtgaagagaaggcagagaaaggacttagcgtccagtgactccaggaaaacgacagagaagcttctgaaaacatttttgaaaagacaagccatcaaaactgccttcagaagcaaaagagatgaagcactacccagtcttacccaagttcgaagagaaaacgacctctatgttttgcctcctttacaagaggaagaaaaacacagttcagaagaggaagatgaaaaagaatggcaagaaagaatgaatcaaaaacaagcattacaggaagagttctttcataatcctcaagcgatagatattgagtctgaggacttcagcagcctgccccctgaagtaaagcatgaaatcttgactgatatgaaagagttcaccaagcgcagaagaacattatttgaagcaatgccagaggagtctgatgacttttcacagtaccaactcaaaggcttgcttaaaaagaactatctgaaccagcatatagaacatgtccaaaaggaaatgaatcagcaacattcaggacacatccgaaggcagtatgaagatgaagggggctttctgaaggaggtagagtcaaggagagtggtctctgaagacacttcacattacatcttgataaaagcaaaatgcacggcatgtcttttgacgtgaagtcatctccatgtgaaaaactgaagacagagaaagagcctgatgctacccctccttctccaagaactttactagctatgcaagctgccctgctgggaagtagctcagaagaggagctggagagtgaaaatcgaaggcaggcccgtgggaggaacgcacctgctgctgtagacgaaggctccatatcaccccggactctttcagccattaagagagctcttgacgatgacgaagatgtaaaagtgtgtgctggggatgatgtgcagacgggagggccaggagcagaagaaatgcgtataaacagctccaccgagaacagtgatgaaggacttaaagtgagagatggaaaaggaataccgtttactgcaacacttgcgtcatctagtgtgaactctgcagaggagcacgtagccagcactaatgaggggagagagcccacagactcagttccaaaagaacaaatgtcacttgttcacgtggggactgaagcctttccgataagtgatgagtctatgattaaggacagaaaagatcggctgcctctggagagtgcagtggttagacatagtgacgcacctgggctcccgaatggaagggaactgacaccggcatctccaacttgtacaaattctgtgtcaaagaatgaaacacatgctgaagtgcttgagcagcagaacgaactttgcccatatgagagtaaattcgattcttctcttctttcaagtgatgatgaaacaaaatgtaaaccgaattctgcttctgaagtcattggccctgtcagtttgcaagaaacaagtagcatagtaagtgtcccttcagaggcagtagataatgtggaaaatgtggtgtcatttaatgctaaagagcatgagaattttctggaaaccatccaagaacagcagaccactgaatctgcaggccaggatttaatttccattccaaaggccgtggaaccaatggaaattgactcggaagaaagtgaatctgatggaagtttcattgaagtgcaaagtgtgattagtgatgaggaacttcaagcagaattccctgaaacttccaaacctccctcagaacaaggcgaagaggaactggtaggaactagggagggagaagcccctgctgagtccgagagcctcctgagggacaactctgagagggacgacgtggatggtgagccacaggaagctgagaaagatgcggaagattcgctccatgaatggcaagatattaatttggaggagttggaaactctggagagcaacctcttagcacagcagaattcactgaaagctcaaaaacagcagcaagaacggatcgctgctactgtcaccggacagatgttcctggaaagccaggaactcctgcgcctgttcggcattccctacatccaggctcccatggaagcagaggcgcagtgcgccatcctggacctgactgatcagacttccggaaccatcactgatgacagtgatatctggctgtttggagcgcggcatgtctatagaaacttttttaataaaaacaagtttgtagaatattatcaatatgtggactttcacaatcaattgggattggaccggaataagttaataaatttggcttatttgcttggaagtgattataccgaaggaataccaactgtgggttgtgtaaccgccatggaaattctcaatgaattccctgggcatggcctggaacctctcctaaaattctcagaatggtggcatgaagctcaaaaaaatccaaagataagacctaatcctcatgacaccaaagtgaaaaaaaaattacggacattgcaactcacccctggctttcctaacccagctgttgccgaggcctacctcaaacccgtggtggatgactcgaagggatcctttctgtgggggaaacctgatctcgacaaaattagagaattttgtcagcggtatttcggctggaacagaacgaagacagatgaatctctgtttcctgtattaaagcaactcgatgcccagcagacacagctccgaattgattccttctttagattagcacaacaggagaaagaagatgctaaacgtattaagagccagagactaaacagagctgtgacatgtatgctaaggaaagagaaagaagcagcagccagcgaaatagaagcagtttctgttgccatggagaaagaatttgagctacttgataaggcaaaacgaaaaacccagaagagaggcataacaaataccttagaagagtcatcaagcctgaaaagaaagaggctttcagattctaaacgaaagaatacatgcggtggatttttgggggagacctgcctctcagaatcatctgatggatcttcaagtgaagatgctgaaagttcatctttaatgaatgtacaaaggagaacagctgcgaaagagccaaaaaccagtgcttcagattcgcagaactcagtgaaggaagctcccgtgaagaatggaggtgcgaccaccagcagctctagtgatagtgatgacgatggagggaaagagaagatggtcctcgtgaccgccagatctgtgtttgggaagaaaagaaggaaactaagacgtgcgaggggaagaaaaaggaaaacctaattaaaaaatatgtatcctctataattagttatgacagccatttgtaatgaatttgtcgcaaagacgtaataaaattaactggtagcacggtctttgtatttagt

SEQ ID NO: 343105 - DNA, 3204 bp, Homo sapiens
ggtcgactactactactaaattcgcggccgggtcgacgaaagaatgaatcaaaaacaagcattacaggaagagttctttcataatcctcaagcgatagatattgagtctgaggacttcagcagcctgccccctgaagtaaagcatgaaatcttgactgatatgaaagagttcaccaagcgcagaagaacattatttgaagcaatgccagaggagtctgatgacttttcacagtaccaactcaaaggcttgcttaaaaagaactatctgaaccagcatatagaacatgtccaaaaggaaatgaatcagcaacattcaggacacatccgaaggcagtatgaagatgaagggggctttctgaaggaggtagagtcaaggagagtggtctctgaagacacttcacattacatcttgataaaaggtattcaagctaagacagttgcagaagtggattcagagtctcttccttcttccagcaaaatgcacggcatgtcttttgacgtgaagtcatctccatgtgaaaaactgaagacagagaaagagcctgatgctacccctccttctccaagaactttactagctatgcaagctgccctgctgggaagtagctcagaagaggagctggagagtgaaaatcgaaggcaggcccgtgggaggaacgcacctgctgctgtagacgaaggctccatatcaccccggactctttcagccattaagagagctcttgacgatgacgaagatgtaaaagtgtgtgctggggatgatgtgcagacgggagggccaggagcagaagaaatgcgtataaacagctccaccgagaacagtgatgaaggacttaaagtgagagatggaaaaggaataccgtttactgcaacacttgcgtcatctagtgtgaactctgcagaggagcacgtagccagcactaatgaggggagagagcccacagactcagttccaaaagaacaaatgtcacttgttcacgtggggactgaagcctttccgataagtgatgagtctatgattaaggacagaaaagatcggctgcctctggagagtgcagtggttagacatagtgacgcacctgggctcccgaatggaagggaactgacaccggcatctccaacttgtacaaattctgtgtcaaagaatgaaacacatgctgaagtgcttgagcagcagaacgaactttgcccatatgagagtaaattcgattcttctcttctttcaagtgatgatgaaacaaaatgtaaaccgaattctgcttctgaagtcattggccctgtcagtttgcaagaaacaagtagcatagtaagtgtcccttcagaggcagtagataatgtggaaaatgtggtgtcatttaatgctaaagagcatgagaattttctggaaaccatccaagaacagcagaccactgaatctgcaggccaggatttaatttccattccaaaggccgtggaaccaatggaaattgactcggaagaaagtgaatctgatggaagtttcattgaagtgcaaagtgtgattagtgatgaggaacttcaagcagaattccctgaaacttccaaacctccctcagaacaaggcgaagaggaactggtaggaactagggagggagaagcccctgctgagtccgagagcctcctgagggacaactctgagagggacgacgtggatggtgagccacaggaagctgagaaagatgcggaagattcgctccatgaatggcaagatattaatttggaggagttggaaactctggagagcaacctcttagcacagcagaattcactgaaagctcaaaaacagcagcaagaacggatcgctgctactgtcaccggacagatgttcctggaaagccaggaactcctgcgcctgttcggcattccctacatccaggctcccatggaagcagaggcgcagtgcgccatcctggacctgactgatcagacttccggaaccatcactgatgacagtgatatctggctgtttggagcgcggcatgtctatagaaacttttttaataaaaacaagtttgtagaatattatcaatatgtggactttcacaatcaattgggattggaccggaataagttaataaatttggcttatttgcttggaagtgattataccgaaggaataccaactgtgggttgtgtaaccgccatggaaattctcaatgaattccctgggcatggcctggaacctctcctaaaattctcagaatggtggcatgaagctcaaaaaaatccaaagataagacctaatcctcatgacaccaaagtgaaaaaaaaattacggacattgcaactcacccctggctttcctaacccagctgttgccgaggcctacctcaaacccgtggtggatgactcgaagggatcctttctgtgggggaaacctgatctcgacaaaattagagaattttgtcagcggtatttcggctggaacagaacgaagacagatgaatctctgtttcctgtattaaagcaactcgatgcccagcagacacagctccgaattgattccttctttagattagcacaacaggagaaagaagatgctaaacgtattaagagccagagactaaacagagctgtgacatgtatgctaaggaaagagaaagaagcagcagccagcgaaatagaagcagtttctgttgccatggagaaagaatttgagctacttgataaggcaaaacgaaaaacccagaagagaggcataacaaataccttagaagagtcatcaagcctgaaaagaaagaggctttcagattctaaacgaaagaatacatgcggtggatttttgggggagacctgcctctcagaatcatctgatggatcttcaagtgaagatgctgaaagttcatctttaatgaatgtacaaaggagaacagctgcgaaagagccaaaaaccagtgcttcagattcgcagaactcagtgaaggaagctcccgtgaagaatggaggtgcgaccaccagcagctctagtgatagtgatgacgatggagggaaagagaagatggtcctcgtgaccgccagatctgtgtttgggaagaaaagaaggaaactaagacgtgcgaggggaagaaaaaggaaaacctaattaaaaaatatgtatcctctataattagttatgacagccatttgtaatgaatttgtcgcaaagacgtaataaaattaactggtagcacggtctttgtatttagt

SEQ ID NO: 343106 - DNA, 3990 bp, Homo sapiens
gcttccgccctgcgcgtcgtattagacggaaaccgagcgggcccatttttcatgggtttgcggacccaccagcgaaggcgggaggtgtcgcagggacatcttctggctgtttccgtcgcctgcgtggcccttgcaccccggtcttccattagcggcgcagacgtttgggcctaagcgctgggcgaggcgaggccctgcccctccccgccaacggccattctctggacctgtctttcttccgggaggcggtgacagctgctgagacgtgttgcagccagagtctctccgctttaatgcgctcccattagtgccgtcccccactggaaaaccgtggcttctgtattatttgccatctttgttgtgtaggagcagggagggcttcctcccggggtcctaggcggcggtgcagtccgtcgtagaagaattagagtagaagttgtcggggtccgctcttaggacgcagccgcctcatgggggtccaggggctctggaagctgctggagtgctccgggcggcaggtcagccccgaagcgctggaagggaagatcctggctgttgatattagcatttggttaaaccaagcacttaaaggagtccgggatcgccacgggaactcaatagaaaatcctcatcttctcactttgtttcatcggctctgcaaactcttattttttcgaattcgtcctatttttgtgtttgatggggatgctccactattgaagaaacagactttggtgaagagaaggcagagaaaggacttagcgtccagtgactccaggaaaacgacagagaagcttctgaaaacatttttgaaaagacaagccatcaaaactgccttcagaagcaaaagagatgaagcactacccagtcttacccaagttcgaagagaaaacgacctctatgttttgcctcctttacaagaggaagaaaaacacagttcagaagaggaagatgaaaaagaatggcaagaaagaatgaatcaaaaacaagcattacaggaagagttctttcataatcctcaagcgatagatattgagtctgaggacttcagcagcctgccccctgaagtaaagcatgaaatcttgactgatatgaaagagttcaccaagcgcagaagaacattatttgaagcaatgccagaggagtctgatgacttttcacagtaccaactcaaaggcttgcttaaaaagaactatctgaaccagcatatagaacatgtccaaaaggaaatgaatcagcaacattcaggacacatccgaaggcagtatgaagatgaagggggctttctgaaggaggtagagtcaaggagagtggtctctgaagacacttcacattacatcttgataaaaggtattcaagctaagacagttgcagaagtggattcagagtctcttccttcttccagcaaaatgcacggcatgtcttttgacgtgaagtcatctccatgtgaaaaactgaagacagagaaagagcctgatgctacccctccttctccaagaactttactagctatgcaagctgccctgctgggaagtagctcagaagaggagctggagagtgaaaatcgaaggcaggcccgtgggaggaacgcacctgctgctgtagacgaaggctccatatcaccccggactctttcagccattaagagagctcttgacgatgacgaagatgtaaaagtgtgtgctggggatgatgtgcagacgggagggccaggagcagaagaaatgcgtataaacagctccaccgagaacagtgatgaaggacttaaagtgagagatggaaaaggaataccgtttactgcaacacttgcgtcatctagtgtgaactctgcagaggagcacgtagccagcactaatgaggggagagagcccacagactcagttccaaaagaacaaatgtcacttgttcacgtggggactgaagcctttccgataagtgatgagtctatgattaaggacagaaaagatcggctgcctctggagagtgcagtggttagacatagtgacgcacctgggctcccgaatggaagggaactgacaccggcatctccaacttgtacaaattctgtgtcaaagaatgaaacacatgctgaagtgcttgagcagcagaacgaactttgcccatatgagagtaaattcgattcttctcttctttcaagtgatgatgaaacaaaatgtaaaccgaattctgcttctgaagtcattggccctgtcagtttgcaagaaacaagtagcatagtaagtgtcccttcagaggcagtagataatgtggaaaatgtggtgtcatttaatgctaaagagcatgagaattttctggaaaccatccaagaacagcagaccactgaatctgcaggccaggatttaatttccattccaaaggccgtggaaccaatggaaattgactcggaagaaagtgaatctgatggaagtttcattgaagtgcaaagtgtgattagtgatgaggaacttcaagcagaattccctgaaacttccaaacctccctcagaacaaggcgaagaggaactggtaggaactagggagggagaagcccctgctgagtccgagagcctcctgagggacaactctgagagggacgacgtggatggtgagccacaggaagctgagaaagatgcggaagattcgctccatgaatggcaagatattaatttggaggagttggaaactctggagagcaacctcttagcacagcagaattcactgaaagctcaaaaacagcagcaagaacggatcgctgctactgtcaccggacagatgttcctggaaagccaggaactcctgcgcctgttcggcattccctacatccaggctcccatggaagcagaggcgcagtgcgccatcctggacctgactgatcagacttccggaaccatcactgatgacagtgatatctggctgtttggagcgcggcatgtctatagaaacttttttaataaaaacaagtttgtagaatattatcaatatgtggactttcacaatcaattggagaatggtggcatgaagctcaaaaaaatccaaagataagacctaatcctcatgacaccaaagtgaaaaaaaaattacggacattgcaactcacccctggctttcctaacccagctgttgccgaggcctacctcaaacccgtggtggatgactcgaagggatcctttctgtgggggaaacctgatctcgacaaaattagagaattttgtcagcggtatttcggctggaacagaacgaagacagatgaatctctgtttcctgtattaaagcaactcgatgcccagcagacacagctccgaattgattccttctttagattagcacaacaggagaaagaagatgctaaacgtattaagagccagagactaaacagagctgtgacatgtatgctaaggaaagagaaagaagcagcagccagcgaaatagaagcagtttctgttgccatggagaaagaatttgagctacttgataaggcaaaacgaaaaacccagaagagaggcataacaaataccttagaagagtcatcaagcctgaaaagaaagaggctttcagattctaaacgaaagaatacatgcggtggatttttgggggagacctgcctctcagaatcatctgatggatcttcaagtgaagatgctgaaagttcatctttaatgaatgtacaaaggagaacagctgcgaaagagccaaaaaccagtgcttcagattcgcagaactcagtgaaggaagctcccgtgaagaatggaggtgcgaccaccagcagctctagtgatagtgatgacgatggagggaaagagaagatggtcctcgtgaccgccagatctgtgtttgggaagaaaagaaggaaactaagacgtgcgaggggaagaaaaaggaaaacctaattaaaaaatatgtatcctctataattagttatgacagccatttgtaatgaatttgtcgcaaagacgtaataaaattaactggtagcacggtctttgtatttagt

SEQ ID NO: 343107 - DNA, 1184 bp, Homo sapiens
acagaggaagacttccataaatgtttgccatcattatacattgtggctaatagtactaaaattaataaaatattctatatagcatacaatttgagttagaacttgagtttacatgttctaagtttagttcttcatccatagtgtatgaactataatgtctcattgctgtgtaagtaattgtttcctttattttacagagaatggtggcatgaagctcaaaaaaatccaaagataagacctaatcctcatgacaccaaagtgaaaaaaaaattacggacattgcaactcacccctggctttcctaacccagctgttgccgaggcctacctcaaacccgtggtggatgactcgaagggatcctttctgtgggggaaacctgatctcgacaaaattagagaattttgtcagcggtatttcggctggaacagaacgaagacagatgaatctctgtttcctgtattaaagcaactcgatgcccagcagacacagctccgaattgattccttctttagattagcacaacaggagaaagaagatgctaaacgtattaagagccagagactaaacagagctgtgacatgtatgctaaggaaagagaaagaagcagcagccagcgaaatagaagcagtttctgttgccatggagaaagaatttgagctacttgataaggcaaaacgaaaaacccagaagagaggcataacaaataccttagaagagtcatcaagcctgaaaagaaagaggctttcagattctaaacgaaagaatacatgcggtggatttttgggggagacctgcctctcagaatcatctgatggatcttcaagtgaagatgctgaaagttcatctttaatgaatgtacaaaggagaacagctgcgaaagagccaaaaaccagtgcttcagattcgcagaactcagtgaaggaagctcccgtgaagaatggaggtgcgaccaccagcagctctagtgatagtgatgacgatggagggaaagagaagatggtcctcgtgaccgccagatctgtgtttgggaagaaaagaaggaaactaagacgtgcgaggggaagaaaaaggaaaacctaattaaaaaatatgtatcctctataattagttatgacagccatttgtaatgaatttgtcgcaaagacgtaataaaattaactggtagcacggtctttgtatttagt

SEQ ID NO: 343108 - DNA, 3860 bp, Homo sapiens
gcttccgccctgcgcgtcgtattagacggaaaccgagcgggcccatttttcatgggtttgcggacccaccagcgaaggcgggaggtgtcgcagggacatcttctggctgtttccgtcgcctgcgtggcccttgcaccccggtcttccattagcggcgcagacgtttgggcctaagcgctgggcgaggcgaggccctgcccctccccgccaacggccattctctggacctgtctttcttccgggaggcggtgacagctgctgagacgtgttgcagccagagtctctccgctttaatgcgctcccattagtgccgtcccccactggaaaaccgtggcttctgtattatttgccatctttgttgtgtaggagcagggagggcttcctcccggggtcctaggcggcggtgcagtccgtcgtagaagaattagagtagaagttgtcggggtccgctcttaggacgcagccgcctcatgggggtccaggggctctggaagctgctggagtgctccgggcggcaggtcagccccgaagcgctggaagggaagatcctggctgttgatattagcatttggttaaaccaagcacttaaaggagtccgggatcgccacgggaactcaatagaaaatcctcatcttctcactttgtttcatcggctctgcaaactcttattttttcgaattcgtcctatttttgtgtttgatggggatgctccactattgaagaaacagactttggtgaagagaaggcagagaaaggacttagcgtccagtgactccaggaaaacgacagagaagcttctgaaaacatttttgaaaagacaagccatcaaaactgccttcagaagcaaaagagatgaagcactacccagtcttacccaagttcgaagagaaaacgacctctatgttttgcctcctttacaagaggaagaaaaacacagttcagaagaggaagatgaaaaagaatggcaagaaagaatgaatcaaaaacaagcattacaggaagagttctttcataatcctcaagcgatagatattgagtctgaggacttcagcagcctgccccctgaagtaaagcatgaaatcttgactgatatgaaagagttcaccaagcgcagaagaacattatttgaagcaatgccagaggagtctgatgacttttcacagtaccaactcaaaggcttgcttaaaaagaactatctgaaccagcatatagaacatgtccaaaaggaaatgaatcagcaacattcaggacacatccgaaggcagtatgaagatgaagggggctttctgaaggaggtagagtcaaggagagtggtctctgaagacacttcacattacatcttgataaaaggtattcaagctaagacagttgcagaagtggattcagagtctcttccttcttccagcaaaatgcacggcatgtcttttgacgtgaagtcatctccatgtgaaaaactgaagacagagaaagagcctgatgctacccctccttctccaagaactttactagctatgcaagctgccctgctgggaagtagctcagaagaggagctggagagtgaaaatcgaaggcaggcccgtgggaggaacgcacctgctgctgtagacgaaggctccatatcaccccggactctttcagccattaagagagctcttgacgatgacgaagatgtaaaagtgtgtgctggggatgatgtgcagacgggagggccaggagcagaagaaatgcgtataaacagctccaccgagaacagtgatgaaggacttaaagtgagagatggaaaaggaataccgtttactgcaacacttgcgtcatctagtgtgaactctgcagaggagcacgtagccagcactaatgaggggagagagcccacagactcagttccaaaagaacaaatgtcacttgttcacgtggggactgaagcctttccgataagtgatgagtctatgattaaggacagaaaagatcggctgcctctggagagtgcagtggttagacatagtgacgcacctgggctcccgaatggaagggaactgacaccggcatctccaacttgtacaaattctgtgtcaaagaatgaaacacatgctgaagtgcttgagcagcagaacgaactttgcccatatgagagtaaattcgattcttctcttctttcaagtgatgatgaaacaaaatgtaaaccgaattctgcttctgaagtcattggccctgtcagtttgcaagaaacaagtagcatagtaagtgtcccttcagaggcagtagataatgtggaaaatgtggtgtcatttaatgctaaagagcatgagaattttctggaaaccatccaagaacagcagaccactgaatctgcaggccaggatttaatttccattccaaaggccgtggaaccaatggaaattgactcggaagaaagtgaatctgatggaagtttcattgaagtgcaaagtgtgattagtgatgaggaacttcaagcagaattccctgaaacttccaaacctccctcagaacaaggcgaagaggaactggtaggaactagggagggagaagcccctgctgagtccgagagcctcctgagggacaactctgagagggacgacgtggatggtgagccacaggaagctgagaaagatgcggaagattcgctccatgaatggcaagatattaatttggaggagttggaaactctggagagcaacctcttagcacagcagaattcactgaaagctcaaaaacagcagcaagaacggatcgctgctactgtcaccggacagatgttcctggaaagccaggaactcctgcgcctgttcggcattccctacatccaggctcccatggaagcagaggcgcagtgcgccatcctggacctgactgatcagacttccggaaccatcactgatgacagtgatatctggctgtttggagcgcggcatgtctatagaaacttttttaataaaaacaagtttgtagaatattatcaatatgtggactttcacaatcaattgggattggaccggaataagttaataaatttggcttatttgcttggaagtgattataccgaaggaataccaactgtgggttgtgtaaccgccatggaaattctcaatgaattccctgggcatggcctggaacctctcctaaaattctcagaatggtggcatgaagctcaaaaaaatccaaagataagacctaatcctcatgacaccaaagtgaaaaaaaaattacggacattgcaactcacccctggctttcctaacccagctgttgccgaggcctacctcaaacccgtggtggatgactcgaagggatcctttctgtgggggaaacctgatctcgacaaaattagagaattttgtcagcggtatttcggctggaacagaacgaagacagatgaatctctgtttcctgtattaaagcaactcgatgcccagcagacacagctccgaattgattccttctttagattagcacaacaggagaaagaagatgctaaacgtattaagagccagagactaaacagagctgtgacatgtatgctaaggaaagagaaagaagcagcagccagcgaaatagaagcagtttctgttgccatggagaaagaatttgagctacttgataaggcaaaacgaaaaacccagaagagaggcataacaaataccttagaagagtcatcaagcctgaaaagaaagaggctttcagattctaaacgaaagaatacatgcggtggatttttgggggagacctgcctctcagaatcatctgatggatcttcaagtgaagatgctgaaagttcatctttaatgaatgtacaaaggagaacagctgcgaaagagccaggaggtgcgaccaccagcagctct

SEQ ID NO: 343109 - DNA, 2936 bp, Homo sapiens
gcttccgccctgcgcgtcgtattagacggaaaccgagcgggcccatttttcatgggtttgcggacccaccagcgaaggcgggaggtgtcgcagggacatcttctggctgtttccgtcgcctgcgtggcccttgcaccccggtcttccattagcggcgcagacgtttgggcctaagcgctgggcgaggcgaggccctgcccctccccgccaacggccattctctggacctgtctttcttccgggaggcggtgacagctgctgagacgtgttgcagccagagtctctccgctttaatgcgctcccattagtgccgtcccccactggaaaaccgtggcttctgtattatttgccatctttgttgtgtaggagcagggagggcttcctcccggggtcctaggcggcggtgcagtccgtcgtagaagaattagagtagaagttgtcggggtccgctcttaggacgcagccgcctcatgggggtccaggggctctggaagctgctggagtgctccgggcggcaggtcagccccgaagcgctggaagggaagatcctggctgttgatattagcatttggttaaaccaagcacttaaaggagtccgggatcgccacgggaactcaatagaaaatcctcatcttctcactttgtttcatcggctctgcaaactcttattttttcgaattcgtcctatttttgtgtttgatggggatgctccactattgaagaaacagactttggtgaagagaaggcagagaaaggacttagcgtccagtgactccaggaaaacgacagagaagcttctgaaaacatttttgaaaagacaagccatcaaaactgccttcagaagcaaaagagatgaagcactacccagtcttacccaagttcgaagagaaaacgacctctatgttttgcctcctttacaagaggaagaaaaacacagttcagaagaggaagatgaaaaagaatggcaagaaagaatgaatcaaaaacaagcattacaggaagagttctttcataatcctcaagcgatagatattgagtctgaggacttcagcagcctgccccctgaagtaaagcatgaaatcttgactgatatgaaagagttcaccaagcgcagaagaacattatttgaagcaatgccagaggagtctgatgacttttcacagtaccaactcaaaggcttgcttaaaaagaactatctgaaccagcatatagaacatgtccaaaaggaaatgaatcagcaacattcaggacacatccgaaggcagtatgaagatgaagggggctttctgaaggaggtagagtcaaggagagtggtctctgaagacacttcacattacatcttgataaaaggtattcaagctaagacagttgcagaagtggattcagagtctcttccttcttccagcaaaatgcacggcatgtcttttgacgtgaagtcatctccatgtgaaaaactgaagacagagaaagagcctgatgctacccctccttctccaagaactttactagctatgcaagctgccctgctgggaagtagctcagaagaggagctggagagtgaaaatcgaaggcaggcccgtgggaggaacgcacctgctgctgtagacgaaggctccatatcaccccggactctttcagccattaagagagctcttgacgatgacgaagatgtaaaagtgtgtgctggggatgatgtgcagacgggagggccaggagcagaagaaatgcgtataaacagctccaccgagaacagtgatgaaggacttaaagtgagagatggaaaaggaataccgtttactgcaacacttgcgtcatctagtgtgaactctgcagaggagcacgtagccagcactaatgaggggagagagcccacagactcagttccaaaagaacaaatgtcacttgttcacgtggggactgaagcctttccgataagtgatgagtctatgattaaggacagaaaagatcggctgcctctggagagtgcagtggttagacatagtgacgcacctgggctcccgaatggaagggaactgacaccggcatctccaacttgtacaaattctgtgtcaaagaatgaaacacatgctgaagtgcttgagcagcagaacgaactttgcccatatgagagtaaattcgattcttctcttctttcaagtgatgatgaaacaaaatgtaaaccgaattctgcttctgaagtcattggccctgtcagtttgcaagaaacaagtagcatagtaagtgtcccttcagaggcagtagataatgtggaaaatgtggtgtcatttaatgctaaagagcatgagaattttctggaaaccatccaagaacagcagaccactgaatctgcaggccaggatttaatttccattccaaaggccgtggaaccaatggaaattgactcggaagaaagtgaatctgatggaagtttcattgaagtgcaaagtgtgattagtgatgaggaacttcaagcagaattccctgaaacttccaaacctccctcagaacaaggcgaagaggaactggtaggaactagggagggagaagcccctgctgagtccgagagcctcctgagggacaactctgagagggacgacgtggatggtgagccacaggaagctgagaaagatgcggaagattcgctccatgaatggcaagatattaatttggaggagttggaaactctgcaaccagttctgttcctactgtagtaacaactggcattcatcaccagcctcctcctgctccaccctctctttttactgcagttttgtattaccagatacatatgacacagatggctacaattctgaagcccaggcataacaaacacttccagactatgtatagcacagagtcatgccaaaggccaacctgataggctacatcaggggtatgattgccaccaggaaagcctccaataaagcagttgaggt

SEQ ID NO: 343110 - DNA, 1665 bp, Homo sapiens
gcttccgccctgcgcgtcgtattagacggaaaccgagcgggcccatttttcatgggtttgcggacccaccagcgaaggcgggaggtgtcgcagggacatcttctggctgtttccgtcgcctgcgtggcccttgcaccccggtcttccattagcggcgcagacgtttgggcctaagcgctgggcgaggcgaggccctgcccctccccgccaacggccattctctggacctgtctttcttccgggaggcggtgacagctgctgagacgtgttgcagccagagtctctccgctttaatgcgctcccattagtgccgtcccccactggaaaaccgtggcttctgtattatttgccatctttgttgtgtaggagcagggagggcttcctcccggggtcctaggcggcggtgcagtccgtcgtagaagaattagagtagaagttgtcggggtccgctcttaggacgcagccgcctcatgggggtccaggggctctggaagctgctggagtgctccgggcggcaggtcagccccgaagcgctggaagggaagatcctggctgttgatattagcatttggttaaaccaagcacttaaaggagtccgggatcgccacgggaactcaatagaaaatcctcatcttctcactttgtttcatcggctctgcaaactcttattttttcgaattcgtcctatttttgtgtttgatggggatgctccactattgaagaaacagactttggtgaagagaaggcagagaaaggacttagcgtccagtgactccaggaaaacgacagagaagcttctgaaaacatttttgaaaagacaagccatcaaaactgccttcagaagcaaaagagatgaagcactacccagtcttacccaagttcgaagagaaaacgacctctatgttttgcctcctttacaagaggaagaaaaacacagttcagaagaggaagatgaaaaagaatggcaagaaagaatgaatcaaaaacaagcattacaggaagagttctttcataatcctcaagcgatagatattgagtctgaggacttcagcagcctgccccctgaagtaaagcatgaaatcttgactgatatgaaagagttcaccaagcgcagaagaacattatttgaagcaatgccagaggagtctgatgacttttcacagtaccaactcaaaggcttgcttaaaaagaactatctgaaccagcatatagaacatgtccaaaaggaaatgaatcagcaacattcaggacacatccgaaggcagtatgaagatgaagggggctttctgaaggaggtagagtcaaggagagtggtctctgaagacacttcacattacatcttgataaaaggtattcaagctaagacagttgcagaagtggattcagagtctcttccttcttccagcaaaatgcacggcatgtcttttgacgtgaagtcatctccatgtgaaaaactgaagacagagaaagagcctgatgctacccctccttctccaagaactttactagctatgcaagctgccctgctgggaagtagctcagaagaggagctggagagtgaaaatcgaaggcaggcccgtgggaggaacgcgccccatgggcctgaagaaggccactgcaagtgggagctgggcctgccgaagcggccgagagcaggagctttgg

SEQ ID NO: 343111 - DNA, 465 bp, Homo sapiens
caaagtgaaaaaaaaattacggacattgcaactcacccctggctttcctaacccagctgttgccgaggcctacctcaaacccgtggtggatgactcgaagggatcctttctgtgggggaaacctgatctcgacaaaattagagaatatcctttgcttcttaaaagagaaggaaacaccttgtcaaatatgtgtttggtttaaaacttatggaagagaaacttggatcatttttttcttatatcccgttaatcccattttcttaatatcccgctctccttttcactctttcttccctctcctcagttgttgttttttgtttgtttgtttgttttaaaggaacagtgtatcactctgtcacccagcctggagtgcagtggtgcaatcatagctcactgcagccaccacttcctgggctcaaggaatcctcctgcctcagcctcctaagtagcacaagccactgcatc

SEQ ID NO: 343112 - DNA, 457 bp, Homo sapiens
atataaagcgaatatacaaatcttaagagagtttcctactttcaaagacagtgccagtttacctaattgaaaaggcttgttttgaagttacaggcatttgtgattacatttatttattaataacgctactattacatgtattctgttatagtcatatctttcctttttaggatgtagcatttttcaggttcctccagaaagctcttgatgattgcaggatcattttaatgttttgattgtagatgaagtgaccttttaattttggtacaggaagtttcattgaagtgcaaagtgtgattagtgatgaggaacttcaagcagaattccctgaaacttccaaacctccctcagaacaaggcgaagaggaactggtaggaactagggagggagaagcccctgctgagtccgagagcctcctgagggacaactctgagagggacgacgtggatggtgagcc

SEQ ID NO: 343113 - DNA, 4135 bp, Homo sapiens
gcttccgccctgcgcgtcgtattagacggaaaccgagcgggcccatttttcatgggtttgcggacccaccagcgaaggcgggaggtgtcgcagggacatcttctggctgtttccgtcgcctgcgtggcccttgcaccccggtcttccattagcggcgcagacgtttgggcctaagcgctgggcgaggcgaggccctgcccctccccgccaacggccattctctggacctgtctttcttccgggaggcggtgacagctgctgagacgtgttgcagccagagtctctccgctttaatgcgctcccattagtgccgtcccccactggaaaaccgtggcttctgtattatttgccatctttgttgtgtaggagcagggagggcttcctcccggggtcctaggcggcggtgcagtccgtcgtagaagaattagagtagaagttgtcggggtccgctcttaggacgcagccgcctcatgggggtccaggggctctggaagctgctggagtgctccgggcggcaggtcagccccgaagcgctggaagggaagatcctggctgttgatattagcatttggttaaaccaagcacttaaaggagtccgggatcgccacgggaactcaatagaaaatcctcatcttctcactttgtttcatcggctctgcaaactcttattttttcgaattcgtcctatttttgtgtttgatggggatgctccactattgaagaaacagactttggtgaagagaaggcagagaaaggacttagcgtccagtgactccaggaaaacgacagagaagcttctgaaaacatttttgaaaagacaagccatcaaaactgccttcagaagcaaaagagatgaagcactacccagtcttacccaagttcgaagagaaaacgacctctatgttttgcctcctttacaagaggaagaaaaacacagttcagaagaggaagatgaaaaagaatggcaagaaagaatgaatcaaaaacaagcattacaggaagagttctttcataatcctcaagcgatagatattgagtctgaggacttcagcagcctgccccctgaagtaaagcatgaaatcttgactgatatgaaagagttcaccaagcgcagaagaacattatttgaagcaatgccagaggagtctgatgacttttcacagtaccaactcaaaggcttgcttaaaaagaactatctgaaccagcatatagaacatgtccaaaaggaaatgaatcagcaacattcaggacacatccgaaggcagtatgaagatgaagggggctttctgaaggaggtagagtcaaggagagtggtctctgaagacacttcacattacatcttgataaaaggtattcaagctaagacagttgcagaagtggattcagagtctcttccttcttccagcaaaatgcacggcatgtcttttgacgtgaagtcatctccatgtgaaaaactgaagacagagaaagagcctgatgctacccctccttctccaagaactttactagctatgcaagctgccctgctgggaagtagctcagaagaggagctggagagtgaaaatcgaaggcaggcccgtgggaggaacgcacctgctgctgtagacgaaggctccatatcaccccggactctttcagccattaagagagctcttgacgatgacgaagatgtaaaagtgtgtgctggggatgatgtgcagacgggagggccaggagcagaagaaatgcgtataaacagctccaccgagaacagtgatgaaggacttaaagtgagagatggaaaaggaataccgtttactgcaacacttgcgtcatctagtgtgaactctgcagaggagcacgtagccagcactaatgaggggagagagcccacagactcagttccaaaagaacaaatgtcacttgttcacgtggggactgaagcctttccgataagtgatgagtctatgattaaggacagaaaagatcggctgcctctggagagtgcagtggttagacatagtgacgcacctgggctcccgaatggaagggaactgacaccggcatctccaacttgtacaaattctgtgtcaaagaatgaaacacatgctgaagtgcttgagcagcagaacgaactttgcccatatgagagtaaattcgattcttctcttctttcaagtgatgatgaaacaaaatgtaaaccgaattctgcttctgaagtcattggccctgtcagtttgcaagaaacaagtagcatagtaagtgtcccttcagaggcagtagataatgtggaaaatgtggtgtcatttaatgctaaagagcatgagaattttctggaaaccatccaagaacagcagaccactgaatctgcaggccaggatttaatttccattccaaaggccgtggaaccaatggaaattgactcggaagaaagtgaatctgatggaagtttcattgaagtgcaaagtgtgattagtgatgaggaacttcaagcagaattccctgaaacttccaaacctccctcagaacaaggcgaagaggaactggtaggaactagggagggagaagcccctgctgagtccgagagcctcctgagggacaactctgagagggacgacgtggatggtgagccacaggaagctgagaaagatgcggaagattcgctccatgaatggcaagatattaatttggaggagttggaaactctggagagcaacctcttagcacagcagaattcactgaaagctcaaaaacagcagcaagaacggatcgctgctactgtcaccggacagatgttcctggaaagccaggaactcctgcgcctgttcggcattccctacatccaggctcccatggaagcagaggcgcagtgcgccatcctggacctgactgatcagacttccggaaccatcactgatgacagtgatatctggctgtttggagcgcggcatgtctatagaaacttttttaataaaaacaagtttgtagaatattatcaatatgtggactttcacaatcaattgggattggaccggaataagttaataaatttggcttatttgcttggaagtgattataccgaaggaataccaactgtgggttgtgtaaccgccatggaaattctcaatgaattccctgggcatggcctggaacctctcctaaaattctcagaatggtggcatgaagctcaaaaaaatccaaagataagacctaatcctcatgacaccaaagtgaaaaaaaaattacggacattgcaactcacccctggctttcctaacccagctgttgccgaggcctacctcaaacccgtggtggatgactcgaagggatcctttctgtgggggaaacctgatctcgacaaaattagagaattttgtcagcggtatttcggctggaacagaacgaagacagatgaatctctgtttcctgtattaaagcaactcgatgcccagcagacacagctccgaattgattccttctttagattagcacaacaggagaaagaagatgctaaacgtattaagagccagagactaaacagagctgtgacatgtatgctaaggaaagagaaagaagcagcagccagcgaaatagaagcagtttctgttgccatggagaaagaatttgagctacttgataaggcaaaacgaaaaacccagaagagaggcataacaaataccttagaagagtcatcaagcctgaaaagaaagaggctttcagattctaaacgaaagaatacatgcggtggatttttgggggagacctgcctctcagaatcatctgatggatcttcaagtgaagatgctgaaagttcatctttaatgaatgtacaaaggagaacagctgcgaaagagccaaaaaccagtgcttcagattcgcagaactcagtgaaggaagctcccgtgaagaatggaggtgcgaccaccagcagctctagtgatagtgatgacgatggagggaaagagaagatggtcctcgtgaccgccagatctgtgtttgggaagaaaagaaggaaactaagacgtgcgaggggaagaaaaaggaaaacctaattaaaaaatatgtatcctctataattagttatgacagccatttgtaatgaatttgtcgcaaagacgtaataaaattaactggtagcacggtctttgtatttagt

SEQ ID NO: 343114 - DNA, 4172 bp, Homo sapiens
gcttccgccctgcgcgtcgtattagacggaaaccgagcgggcccatttttcatgggtttgcggacccaccagcgaaggcgggaggtgtcgcagggacatcttctggctgtttccgtcgcctgcgtggcccttgcaccccggtcttccattagcggcgcagacgtttgggcctaagcgctgggcgaggcgaggccctgcccctccccgccaacggccattctctggacctgtctttcttccgggaggcggtgacagctgctgagacgtgttgcagccagagtctctccgctttaatgcgctcccattagtgccgtcccccactggaaaaccgtggcttctgtattatttgccatctttgttgtgtaggagcagggagggcttcctcccggggtcctaggcggcggtgcagtccgtcgtagaagaattagagtagaagttgtcggggtccgctcttaggacgcagccgcctcatgggggtccaggggctctggaagctgctggagtgctccgggcggcagactatacttgtagcaagcagaaacatcgatctaatacaagacagatgcacatcaacaccaagttctacctctgagatatattagcatttggttaaaccaagcacttaaaggagtccgggatcgccacgggaactcaatagaaaatcctcatcttctcactttgtttcatcggctctgcaaactcttattttttcgaattcgtcctatttttgtgtttgatggggatgctccactattgaagaaacagactttggtgaagagaaggcagagaaaggacttagcgtccagtgactccaggaaaacgacagagaagcttctgaaaacatttttgaaaagacaagccatcaaaactgccttcagaagcaaaagagatgaagcactacccagtcttacccaagttcgaagagaaaacgacctctatgttttgcctcctttacaagaggaagaaaaacacagttcagaagaggaagatgaaaaagaatggcaagaaagaatgaatcaaaaacaagcattacaggaagagttctttcataatcctcaagcgatagatattgagtctgaggacttcagcagcctgccccctgaagtaaagcatgaaatcttgactgatatgaaagagttcaccaagcgcagaagaacattatttgaagcaatgccagaggagtctgatgacttttcacagtaccaactcaaaggcttgcttaaaaagaactatctgaaccagcatatagaacatgtccaaaaggaaatgaatcagcaacattcaggacacatccgaaggcagtatgaagatgaagggggctttctgaaggaggtagagtcaaggagagtggtctctgaagacacttcacattacatcttgataaaaggtattcaagctaagacagttgcagaagtggattcagagtctcttccttcttccagcaaaatgcacggcatgtcttttgacgtgaagtcatctccatgtgaaaaactgaagacagagaaagagcctgatgctacccctccttctccaagaactttactagctatgcaagctgccctgctgggaagtagctcagaagaggagctggagagtgaaaatcgaaggcaggcccgtgggaggaacgcacctgctgctgtagacgaaggctccatatcaccccggactctttcagccattaagagagctcttgacgatgacgaagatgtaaaagtgtgtgctggggatgatgtgcagacgggagggccaggagcagaagaaatgcgtataaacagctccaccgagaacagtgatgaaggacttaaagtgagagatggaaaaggaataccgtttactgcaacacttgcgtcatctagtgtgaactctgcagaggagcacgtagccagcactaatgaggggagagagcccacagactcagttccaaaagaacaaatgtcacttgttcacgtggggactgaagcctttccgataagtgatgagtctatgattaaggacagaaaagatcggctgcctctggagagtgcagtggttagacatagtgacgcacctgggctcccgaatggaagggaactgacaccggcatctccaacttgtacaaattctgtgtcaaagaatgaaacacatgctgaagtgcttgagcagcagaacgaactttgcccatatgagagtaaattcgattcttctcttctttcaagtgatgatgaaacaaaatgtaaaccgaattctgcttctgaagtcattggccctgtcagtttgcaagaaacaagtagcatagtaagtgtcccttcagaggcagtagataatgtggaaaatgtggtgtcatttaatgctaaagagcatgagaattttctggaaaccatccaagaacagcagaccactgaatctgcaggccaggatttaatttccattccaaaggccgtggaaccaatggaaattgactcggaagaaagtgaatctgatggaagtttcattgaagtgcaaagtgtgattagtgatgaggaacttcaagcagaattccctgaaacttccaaacctccctcagaacaaggcgaagaggaactggtaggaactagggagggagaagcccctgctgagtccgagagcctcctgagggacaactctgagagggacgacgtggatggtgagccacaggaagctgagaaagatgcggaagattcgctccatgaatggcaagatattaatttggaggagttggaaactctggagagcaacctcttagcacagcagaattcactgaaagctcaaaaacagcagcaagaacggatcgctgctactgtcaccggacagatgttcctggaaagccaggaactcctgcgcctgttcggcattccctacatccaggctcccatggaagcagaggcgcagtgcgccatcctggacctgactgatcagacttccggaaccatcactgatgacagtgatatctggctgtttggagcgcggcatgtctatagaaacttttttaataaaaacaagtttgtagaatattatcaatatgtggactttcacaatcaattgggattggaccggaataagttaataaatttggcttatttgcttggaagtgattataccgaaggaataccaactgtgggttgtgtaaccgccatggaaattctcaatgaattccctgggcatggcctggaacctctcctaaaattctcagaatggtggcatgaagctcaaaaaaatccaaagataagacctaatcctcatgacaccaaagtgaaaaaaaaattacggacattgcaactcacccctggctttcctaacccagctgttgccgaggcctacctcaaacccgtggtggatgactcgaagggatcctttctgtgggggaaacctgatctcgacaaaattagagaattttgtcagcggtatttcggctggaacagaacgaagacagatgaatctctgtttcctgtattaaagcaactcgatgcccagcagacacagctccgaattgattccttctttagattagcacaacaggagaaagaagatgctaaacgtattaagagccagagactaaacagagctgtgacatgtatgctaaggaaagagaaagaagcagcagccagcgaaatagaagcagtttctgttgccatggagaaagaatttgagctacttgataaggcaaaacgaaaaacccagaagagaggcataacaaataccttagaagagtcatcaagcctgaaaagaaagaggctttcagattctaaacgaaagaatacatgcggtggatttttgggggagacctgcctctcagaatcatctgatggatcttcaagtgaagatgctgaaagttcatctttaatgaatgtacaaaggagaacagctgcgaaagagccaaaaaccagtgcttcagattcgcagaactcagtgaaggaagctcccgtgaagaatggaggtgcgaccaccagcagctctagtgatagtgatgacgatggagggaaagagaagatggtcctcgtgaccgccagatctgtgtttgggaagaaaagaaggaaactaagacgtgcgaggggaagaaaaaggaaaacctaattaaaaaatatgtatcctctataattagttatgacagccatttgtaatgaatttgtcgcaaagacgtaataaaattaactggtagcacggtctttgtatttagt

SEQ ID NO: 343115 - DNA, 1785 bp, Homo sapiens
gctgaggaagccaggttaagtaggttttgagttttaaggagttggtggatgagtatttagtagctatttgcagtacatcttgtggttgctgatggcttcatttttgtgtaggttactggctgggatagactccgttttccatgtggtttagtgatgaatctctaaagatattacagagtcttggttagacatccagtggagtacttcctaaggagaaagagcttattggtaatttcagtcagactaaatgcaggctttttgtaaacaaaactcatttggattattaatataaatctataaatgaaaaaacattttataggaggagttggaaactctggagagcaacctcttagcacagcagaattcactgaaagctcaaaaacagcagcaagaacggatcgctgctactgtcaccggacagatgttcctggaaagccaggaactcctgcgcctgttcggcattccctacatccaggctcccatggaagcagaggcgcagtgcgccatcctggacctgactgatcagacttccggaaccatcactgatgacagtgatatctggctgtttggagcgcggcatgtctatagaaacttttttaataaaaacaagtttgtagaatattatcaatatgtggactttcacaatcaattgggattggaccggaataagttaataaatttggcttatttgcttggaagtgattataccgaaggaataccaactgtgggttgtgtaaccgccatggaaattctcaatgaattccctgggcatggcctggaacctctcctaaaattctcagaatggtggcatgaagctcaaaaaaatccaaagataagacctaatcctcatgacaccaaagtgaaaaaaaaattacggacattgcaactcacccctggctttcctaacccagctgttgccgaggcctacctcaaacccgtggtggatgactcgaagggatcctttctgtgggggaaacctgatctcgacaaaattagagaattttgtcagcggtatttcggctggaacagaacgaagacagatgaatctctgtttcctgtattaaagcaactcgatgcccagcagacacagctccgaattgattccttctttagattagcacaacaggagaaagaagatgctaaacgtattaagagccagagactaaacagagctgtgacatgtatgctaaggaaagagaaagaagcagcagccagcgaaatagaagcagtttctgttgccatggagaaagaatttgagctacttgataaggcaaaacgaaaaacccagaagagaggcataacaaataccttagaagagtcatcaagcctgaaaagaaagaggctttcagattctaaacgaaagaatacatgcggtggatttttgggggagacctgcctctcagaatcatctgatggatcttcaagtgaagatgctgaaagttcatctttaatgaatgtacaaaggagaacagctgcgaaagagccaaaaaccagtgcttcagattcgcagaactcagtgaaggaagctcccgtgaagaatggaggtgcgaccaccagcagctctagtgatagtgatgacgatggagggaaagagaagatggtcctcgtgaccgccagatctgtgtttgggaagaaaagaaggaaactaagacgtgcgaggggaagaaaaaggaaaacctaattaaaaaatatgtatcctctataattagttatgacagccatttgtaatgaatttgtcgcaaagacgtaataaaattaactggtagcacggtctttgtatttagt

SEQ ID NO: 343116 - DNA, 4088 bp, Homo sapiens
gcttccgccctgcgcgtcgtattagacggaaaccgagcgggcccatttttcatgggtttgcggacccaccagcgaaggcgggaggtgtcgcagggacatcttctggctgtttccgtcgcctgcgtggcccttgcaccccggtcttccattagcggcgcagacgtttgggcctaagcgctgggcgaggcgaggccctgcccctccccgccaacggccattctctggacctgtctttcttccgggaggcggtgacagctgctgagacgtgttgcagccagagtctctccgctttaatgcgctcccattagtgccgtcccccactggaaaaccgtggcttctgtattatttgccatctttgttgtgtaggagcagggagggcttcctcccggggtcctaggcggcggtgcagtccgtcgtagaagaattagagtagaagttgtcggggtccgctcttaggacgcagccgcctcatgggggtccaggggctctggaagctgctggagtgctccgggcggcaggtcagccccgaagcgctggaagggaagatcctggctgttgatattagcatttggttaaaccaagcacttaaaggagtccgggatcgccacgggaactcaatagaaaatcctcatcttctcactttgtttcatcggctctgcaaactcttattttttcgaattcgtcctatttttgtgtttgatggggatgctccactattgaagaaacagactttggtgaagagaaggcagagaaaggacttagcgtccagtgactccaggaaaacgacagagaagcttctgaaaacatttttgaaaagacaagccatcaaaactgccttcagaagcaaaagagatgaagcactacccagtcttacccaagttcgaagagaaaacgacctctatgttttgcctcctttacaagaggaagaaaaacacagttcagaagaggaagatgaaaaagaatggcaagaaagaatgaatcaaaaacaagcattacaggaagagttctttcataatcctcaagcgatagatattgagtctgaggacttcagcagcctgccccctgaagtaaagcatgaaatcttgactgatatgaaagagttcaccaagcgcagaagaacattatttgaagcaatgccagaggagtctgatgacttttcacagtaccaactcaaaggcttgcttaaaaagaactatctgaaccagcatatagaacatgtccaaaaggaaatgaatcagcaacattcaggacacatccgaaggcagtatgaagatgaagggggctttctgaaggaggtagagtcaaggagagtggtctctgaagacacttcacattacatcttgataaaaggtattcaagctaagacagttgcagaagtggattcagagtctcttccttcttccagcaaaatgcacggcatgtcttttgacgtgaagtcatctccatgtgaaaaactgaagacagagaaagagcctgatgctacccctccttctccaagaactttactagctatgcaagctgccctgctgggaagtagctcagaagaggagctggagagtgaaaatcgaaggcaggcccgtgggaggaacgcacctgctgctgtagacgaaggctccatatcaccccggactctttcagccattaagagagctcttgacgatgacgaagatgtaaaagtgtgtgctggggatgatgtgcagacgggagggccaggagcagaagaaatgcgtataaacagctccaccgagaacagtgatgaaggacttaaagtgagagatggaaaaggaataccgtttactgcaacacttgcgtcatctagtgtgaactctgcagaggagcacgtagccagcactaatgaggggagagagcccacagactcagttccaaaagaacaaatgtcacttgttcacgtggggactgaagcctttccgataagtgatgagtctatgattaaggacagaaaagatcggctgcctctggagagtgcagtggttagacatagtgacgcacctgggctcccgaatggaagggaactgacaccggcatctccaacttgtacaaattctgtgtcaaagaatgaaacacatgctgaagtgcttgagcagcagaacgaactttgcccatatgagagtaaattcgattcttctcttctttcaagtgatgatgaaacaaaatgtaaaccgaattctgcttctgaagtcattggccctgtcagtttgcaagaaacaagtagcatagtaagtgtcccttcagaggcagtagataatgtggaaaatgtggtgtcatttaatgctaaagagcatgagaattttctggaaaccatccaagaacagcagaccactgaatctgcaggccaggatttaatttccattccaaaggccgtggaaccaatggaaattgactcggaagaaagtgaatctgatggaagtttcattgaagtgcaaagtgtgattagtgatgaggaacttcaagcagaattccctgaaacttccaaacctccctcagaacaaggcgaagaggaactggtaggaactagggagggagaagcccctgctgagtccgagagcctcctgagggacaactctgagagggacgacgtggatggtgagccacaggaagctgagaaagatgcggaagattcgctccatgaatggcaagatattaatttggaggagttggaaactctggagagcaacctcttagcacagcagaattcactgaaagctcaaaaacagcagcaagaacggatcgctgctactgtcaccggacagatgttcctggaaagccaggaactcctgcgcctgttcggcattccctacatccaggctcccatggaagcagaggcgcagtgcgccatcctggacctgactgatcagacttccggaaccatcactgatgacagtgatatctggctgtttggagcgcggcatgtctatagaaacttttttaataaaaacaagtttgtagaatattatcaatatgtggactttcacaatcaattgggattggaccggaataagttaataaatttggcttatttgcttggaagtgattataccgaaggaataccaactgtgggttgtgtaaccgccatggaaattctcaatgaattccctgggcatggcctggaacctctcctaaaattctcagaatggtggcatgaagctcaaaaaaatccaaagataagacctaatcctcatgacaccaaagtgaaaaaaaaattacggacattgcaactcacccctggctttcctaacccagctgttgccgaggcctacctcaaacccgtggtggatgactcgaagggatcctttctgtgggggaaacctgatctcgacaaaattagagaattttgtcagcggtatttcggctggaacagaacgaagacagatgaatctctgtttcctgtattaaagcaactcgatgcccagcagacacagctccgaattgattccttctttagattagcacaacaggagaaagaagatgctaaacgtattaagagccagagactaaacagagctgtgacatgtatgctaaggaaagagaaagaagcagcagccagcgaaatagaagcagtttctgttgccatggagaaagaatttgagctacttgataaggcaaaacgaaaaacccagaagagaggcataacaaataccttagaagagtcatcaagcctgaaaagaaagaggctttcagattctaaacgaaagaatacatgcggtggatttttgggggagacctgcctctcagaatcatctgatggatcttcaagtgaagatgctgaaagttcatctttaatgaatgtacaaaggagaacagctgcgaaagagccaaaaaccagtgcttcagattcgcagaactcagtgaaggaagctcccgtgaagaatggaggtgcgaccaccagcagctctagtgatagtgatgacgatggagggaaagagaagatggtcctcgtgaccgccagatctgtgtttgggaagaaaagaaggaaactaagacgtgcgaggggaagaaaaaggaaaacctaattagttaagcaactggcaaccaaagccgacaatgactaatggttcgcaggccctcgt

SEQ ID NO: 343117 - DNA, 3117 bp, Homo sapiens
gcttccgccctgcgcgtcgtattagacggaaaccgagcgggcccatttttcatgggtttgcggacccaccagcgaaggcgggaggtgtcgcagggacatcttctggctgtttccgtcgcctgcgtggcccttgcaccccggtcttccattagcggcgcagacgtttgggcctaagcgctgggcgaggcgaggccctgcccctccccgccaacggccattctctggacctgtctttcttccgggaggcggtgacagctgctgagacgtgttgcagccagagtctctccgctttaatgcgctcccattagtgccgtcccccactggaaaaccgtggcttctgtattatttgccatctttgttgtgtaggagcagggagggcttcctcccggggtcctaggcggcggtgcagtccgtcgtagaagaattagagtagaagttgtcggggtccgctcttaggacgcagccgcctcatgggggtccaggggctctggaagctgctggagtgctccgggcggcaggtcagccccgaagcgctggaagggaagatcctggctgttgatattagcatttggttaaaccaagcacttaaaggagtccgggatcgccacgggaactcaatagaaaatcctcatcttctcactttgtttcatcggctctgcaaactcttattttttcgaattcgtcctatttttgtgtttgatggggatgctccactattgaagaaacagactttggtgaagagaaggcagagaaaggacttagcgtccagtgactccaggaaaacgacagagaagcttctgaaaacatttttgaaaagacaagccatcaaaactgccttcagaagcaaaagagatgaagcactacccagtcttacccaagttcgaagagaaaacgacctctatgttttgcctcctttacaagaggaagaaaaacacagttcagaagaggaagatgaaaaagaatggcaagaaagaatgaatcaaaaacaagcattacaggaagagttctttcataatcctcaagcgatagatattgagtctgaggacttcagcagcctgccccctgaagtaaagcatgaaatcttgactgatatgaaagagttcaccaagcgcagaagaacattatttgaagcaatgccagaggagtctgatgacttttcacagtaccaactcaaaggcttgcttaaaaagaactatctgaaccagcatatagaacatgtccaaaaggaaatgaatcagcaacattcaggacacatccgaaggcagtatgaagatgaagggggctttctgaaggaggtagagtcaaggagagtggtctctgaagacacttcacattacatcttgataaaaggtattcaagctaagacagttgcagaagtggattcagagtctcttccttcttccagcaaaatgcacggcatgtcttttgacgtgaagtcatctccatgtgaaaaactgaagacagagaaagagcctgatgctacccctccttctccaagaactttactagctatgcaagctgccctgctgggaagtagctcagaagaggagctggagagtgaaaatcgaaggcaggcccgtgggaggaacgcacctgctgctgtagacgaaggctccatatcaccccggactctttcagccattaagagagctcttgacgatgacgaagatgtaaaagtgtgtgctggggatgatgtgcagacgggagggccaggagcagaagaaatgcgtataaacagctccaccgagaacagtgatgaaggacttaaagtgagagatggaaaaggaataccgtttactgcaacacttgcgtcatctagtgtgaactctgcagaggagcacgtagccagcactaatgaggggagagagcccacagactcagttccaaaagaacaaatgtcacttgttcacgtggggactgaagcctttccgataagtgatgagtctatgattaaggacagaaaagatcggctgcctctggagagtgcagtggttagacatagtgacgcacctgggctcccgaatggaagggaactgacaccggcatctccaacttgtacaaattctgtgtcaaagaatgaaacacatgctgaagtgcttgagcagcagaacgaactttgcccatatgagagtaaattcgattcttctcttctttcaagtgatgatgaaacaaaatgtaaaccgaattctgcttctgaagtcattggccctgtcagtttgcaagaaacaagtagcatagtaagtgtcccttcagaggcagtagataatgtggaaaatgtggtgtcatttaatgctaaagagcatgagaattttctggaaaccatccaagaacagcagaccactgaatctgcaggccaggatttaatttccattccaaaggccgtggaaccaatggaaattgactcggaagaaagtgaatctgatggaagtttcattgaagtgcaaagtgtgattagtgatgaggaacttcaagcagaattccctgaaacttccaaacctccctcagaacaaggcgaagaggaactggtaggaactagggagggagaagcccctgctgagtccgagagcctcctgagggacaactctgagagggacgacgtggatggtgagccacaggaagctgagaaagatgcggaagattcgctccatgaatggcaagatattaatttggaggagttggaaactctggagagcaacctcttagcacagcagaattcactgaaagctcaaaaacagcagcaagaacggatcgctgctactgtcaccggacagatgttcctggaaagccaggaactcctgcgcctgttcggcattccctacatccaggctcccatggaagcagaggcgcagtgcgccatcctggacctgactgatcagacttccggaaccatcactgatgacagtgatatctggctgtttggagcgcggcatgtctatagaaactcctctaatacccgggccttaccatcatatacatatgtggctcttcacaatcccatgcgcactcgactgacttccgctactcaccggcttcactcttctaggcgctgcctaccgctctacgtctcctctcaccttctcaccctctcttccggcctcgcttcattccttctcccct

SEQ ID NO: 343118 - DNA, 918 bp, Homo sapiens
gcttccgccctgcgcgtcgtattagacggaaaccgagcgggcccatttttcatgggtttgcggacccaccagcgaaggcgggaggtgtcgcagggacatcttctggctgtttccgtcgcctgcgtggcccttgcaccccggtcttccattagcggcgcagacgtttgggcctaagcgctgggcgaggcgaggccctgcccctccccgccaacggccattctctggacctgtctttcttccgggaggcggtgacagctgctgagacgtgttgcagccagagtctctccgctttaatgcgctcccattagtgccgtcccccactggaaaaccgtggcttctgtattatttgccatctttgttgtgtaggagcagggagggcttcctcccggggtcctaggcggcggtgcagtccgtcgtagaagaattagagtagaagttgtcggggtccgctcttaggacgcagccgcctcatgggggtccaggggctctggaagctgctggagtgctccgggcggcaggtcagccccgaagcgctggaagggaagatcctggctgttgatattagcatttggttaaaccaagcacttaaaggagtccgggatcgccacgggaactcaatagaaaatcctcatcttctcactttgtttcatcggctctgcaaactcttattttttcgaattcgtcctatttttgtgtttgatggggatgctccactattgaagaaacagactttggtgaagagaaggcagagaaaggacttagcgtccagtgactccaggaaaacgacagagaagcttctgaaaacatttttgaaaagacaagccatcaaaactgccttcagaagcaaaaggcaagaggaaaattatagtcgtgttagagatgaagttttaaaaaagtgatttttgtcttgatttcctg

SEQ ID NO: 343119 - DNA, 1313 bp, Homo sapiens
aaccgcacagtcaacgacgcttagcaatccggagagaaatagggtgttttcttcccgagagaggactgctaagagggggttaaagggggacgatgtgaaggagagaacctgtggtccttcagaaggcgaagaagaaagaaaggggaagcagtgaagaaagggacggagatactgggacagggagaaaaaagttgtggagagtagcttttaaggagtcatttggtggccatggatccaacgtgctcttctgagtgcatttataacctcatacccagtgacttgaaggagcctccccagcctcctaggtacatatccatttttaaggcaactgtaaaagatgacatgcaaaaagctaaaactgcaatgaaaactatgggaccagcaaaagttgaagtaccttctccaaaggatttcctaaagaaacattcaaaggaaaaaactctaccacccaaaaaaaactttgatcggaacgtgcccaaaaagcctgctgtgccattgaagactgatcatcctgtcatgggaatacagagtggaaaaaattttataaatacaaatgcagctgatatcatcatgggagtggctaaaaagcctaaaccaatttatgttgataaaagaactggagacaagcatgatcttgagccttcaggactagttccaaagtacatcaataaaaaggattatggtgtcacacctgaatacatatgtaagcgaaacgaggaaataaagaaagcccaagaagactatgatcgttatatccaggaaaaccttaagaaagcagctatgaaaaggctctccgatgaagaaagggaggcagttttgcaggggctgaaaaagaactgggaagaggtgcataaagaattccagtccctctcggtctttatagattctataccaaagaagatccgcaagcagaggctggaagaagaaatgaaacaactagaacacgacattggcataattgaaaagcacaagattatttatattgccaataagtaagaatggatctttaaagtataacaatttcaatgtaggggaaaaaaacatggaaaatataaaaaactccaagtttttcaaaaaggaaaatactatgaagagaataaaaatagtcttaatcagaatgcttaggcaatatgcaaagaataattgagttattcacttacacaagaagaaattttgtttttactagtgtcacgttttccacatataaactattaaatttgagaatatgtgttccagttccacaatgtaattcattattattatgtacttgtttcacataaacattaatttctaggtcctgaaaaataaagtca

SEQ ID NO: 343120 - DNA, 321 bp, Homo sapiens
aggagagaacctgtggtccttcagaaggcgaagaagaaagaaaggggaagcagtgaagaaagggacggagatactgggacagggagaaaaaagttgtggagagtagcttttaaggagtcatttggtggccatggatccaacgtgctcttctgagtgcatttataacctcatacccagtgacttgaaggagcctccccagcctcctaggtatgtggataagcaaagactatcacttgaaacaagaatggggaatactcagtattaattaagcatacatatactggaatttttaataataaataaaatgtatttttgcctcga

SEQ ID NO: 343121 - DNA, 372 bp, Homo sapiens
tgctgggattacaggtgtgagccactatgcctgggcaataacaactccattttaaaaggcaggaatctactagctctcaatggagggaaaaaagtcactgaattttgtcaatttacagggttttgaacaaaggatttagtctgtaccatttctttttcttccatcatcagttgatacgtacccatatgtaagattgcatacaaaatattgattacttttttctgcaaaatctttttaggattatggtgtcacacctgaatacatatgtaagcgaaacgaggaaataaagaaagcccaagaagactatgatcgttatatccaggaaaaccttaagaaagcagctatgaaaaggctctccgatgaagaaaggga

SEQ ID NO: 343122 - DNA, 1167 bp, Homo sapiens
aaccgcacagtcaacgacgcttagcaatccggagagaaatagggtgttttcttcccgagagaggactgctaagagggggttaaagggggacgatgtgaaggagagaacctgtggtccttcagaaggcgaagaagaaagaaaggggaagcagtgaagaaagggacggagatactgggacagggagaaaaaagttgtggagagtagcttttaaggagtcatttggtggccatggatccaacgtgctcttctgagtgcatttataacctcatacccagtgacttgaaggagcctccccagcctcctagaaaaaaactttgatcggaacgtgcccaaaaagcctgctgtgccattgaagactgatcatcctgtcatgggaatacagagtggaaaaaattttataaatacaaatgcagctgatatcatcatgggagtggctaaaaagcctaaaccaatttatgttgataaaagaactggagacaagcatgatcttgagccttcaggactagttccaaagtacatcaataaaaaggattatggtgtcacacctgaatacatatgtaagcgaaacgaggaaataaagaaagcccaagaagactatgatcgttatatccaggaaaaccttaagaaagcagctatgaaaaggctctccgatgaagaaagggaggcagttttgcaggggctgaaaaagaactgggaagaggtgcataaagaattccagtccctctcggtctttatagattctataccaaagaagatccgcaagcagaggctggaagaagaaatgaaacaactagaacacgacattggcataattgaaaagcacaagattatttatattgccaataagtaagaatggatctttaaagtataacaatttcaatgtaggggaaaaaaacatggaaaatataaaaaactccaagtttttcaaaaaggaaaatactatgaagagaataaaaatagtcttaatcagaatgcttaggcaatatgcaaagaataattgagttattcacttacacaagaagaaattttgtttttactagtgtcacgttttccacatataaactattaaatttgagaatatgtgttccagttccacaatgtaattcattattattatgtacttgtttcacataaacattaatttctaggtcctgaaaaataaagtca

SEQ ID NO: 343123 - DNA, 172 bp, Homo sapiens
aatggaaataaaacttaaattagtttctggtacttcttagtgctccatctcagttagctagtctgagtgttgccatgaaataaactctctgcgggaaagcagtggactctaacataataaacatcacctgtcttgtctttttttttttttttttaaacagtctcactcctgt

SEQ ID NO: 343124 - DNA, 871 bp, Homo sapiens
actaggaaaattgaaatgggcacagaaattccttgttcgagagccttctggttatactttaaaaagaagggagcctagcatcttgtcaaatctttgagcccactcactcagagggcctgtcactcatccagaattgaatctgctggtttaacaggtcaggcagtgtgatttgacagcgtgaatcttagagtccagcctttgaacctggcgctgaatcctgactttactgcttattcagggggccactagctaagttaatttgtgagcctgggcaacatggcgtgacccatctctacaaaagatacaaaagttaactggatgtggtggtgcatgcctgtggttcatagctactctggaggctgaggcgggaggatgacctgagtgcgggaggttggggttgcagtgagctgaagttgcgccactgcactccagcctgggtgacagagtgagaccttatcttaatctaaaaaataaaatttctgagccttattttcctcatctgtaaaatgaagagaatacctagctcatggagttaggaacaagtatgttaaatatttatcagagtgtgcctgacagtgagttgaaaatatctactctctttggatgaaaaatatttaacacttcactctcagatataattattagctgactttttagattcttttttcttttacatgatgtagttctcagatatatacgggatttctagttcttaaatgccagtattttttttctgttaaaatatttatgaactatttcaaacattcagaaaaactcaggatcatacccataaacccactgtttagattttaaaaagttcaatgtttttctgtattttatctcttcattttaaaataaagttttgcacatg

SEQ ID NO: 343125 - DNA, 574 bp, Homo sapiens
caggaaaacagcccccatgatccaatcacctcccaccaggttcttcccttgacctgtgagaattatggggattacaattcaagatgtacttcccataatccccacatgacctggatgtgagacatggagtcaacatttgcagcctgacgatgtggtagaaaagaaaaacccatattctggggagaaattcaagctggctacagaaatttgcataagaaacaaggagccaaatgttaatcaccaagacagcggggaaaatgtctctagggcatctcagagactttcacagcagcccctcccatcacaggcccagaggcctaggaggtaaaaaatggttttatgggcagggtccagggcccccctgcagtgtgcagcctcgggacttggggcatcccacctgctccagctgtgggtaaaagaggccaaggtacagctcaggctgttatttcaggggatgcaagccccagttacaattccagatgagatttgggtaaggacacggagccaaactatatcatcccttccctagcacccggagatgctcttgtcaccacgcaccactgctgggggtcag

SEQ ID NO: 343126 - DNA, 233 bp, Homo sapiens
cagtgcactctggcctgagagacagagtgagactcggtctcaaaaaaaacaaaacaaaacaagaaatgtgttgggattgggatactcagatctctggtccagtgtcatcagctgggtcactgcacctgatcatcagtacagacccaaaatatcaatatagttttctcccacatggcctcaatgtggtatagacacccagagccactgcacctatattcatacttcttggtgga

SEQ ID NO: 343127 - DNA, 544 bp, Homo sapiens
attaacgtgggaccaggtgtggtggcttatgcctgtaatcccagcactttgggaggctcaggcaagagcatcacttcagcgcaggagtttgacaccagcctgggcaacatatggagaacccatctctacaaagtttaaaaattagtggtggtgtgcacccgtagtcccagctactcaggaggctgaggtaggaggatcccttgagcccaggaggtcgaggctgcaatgggccatgttcacaccaagacactccagcctaggtgacagagcaagaccctgtctcaaaacaaaagaaaacaaaaacaaacaaaaaaatgtggtaaaagattaaatgatgaagatgtggcttaaaacttaaaagaagcttgatggtagacagaaagacatagcaaatatcttaaaaagatagtcaagagaaaatatgagtcttttttttttttcattggaaaaagacttaaacgtatttgtagatttacagaagaacccattgtagaaggacaggggaaaaactggaaaggcaccagaaagaggataattcattaat

SEQ ID NO: 343128 - DNA, 188 bp, Homo sapiens
atttttattattctggaaaccaaaatgtaatgcatacccacgtattcttctcaaggtgcattcctcaaagcttaggcaaataactgcgtatctctatgtcttcttctgaaatgtgatttaaaaataattgttctaagcaatggcataaacaaaacaaaatacagtgttgtggggatggaaggttgggc

SEQ ID NO: 343129 - DNA, 460 bp, Homo sapiens
ccccgccggtttccaaggatgcaactatgaagagacacagtgggggctacgattgggtcgtgactgtggcccacgccaggcgagcgtccccgccccagcccctctgccatctgcgtgcctgttctcccgctacctgcccccgcgccaggatccaggcttgcaaacgtccccatgccatgcgcaggcacatctcgggcggccagccaggcacacgctgcggggtgtcattagctgcagtgccgcctaaacgcggcggcccgtgcagaaccacggccaggccacctgcacgggccagggaggtgatggggacagcgagagacatgccaaaccccactggggggttgggaggggaggcgctttcatcctaaggtgacttccgtttttttttctaataaaaaaatattttaaacatggggataaatagagaaaaagacaaaatagaccccatcatagcaatgcc

SEQ ID NO: 343130 - DNA, 323 bp, Homo sapiens
tttccacttcatctaagtaatctaatttggttggcatgcagttgttcatagtagtcccttttgatcctttttatttctgtaatgtgggtagtaatgcctatgttttcatccatcattttagtaatttcagtttttctccttttttcttgattattctctctaaacatttttatcactttggttcaatgaactgttgatttttttccgttctttttctatttcaataatttctggtcttttattatttcttttccttctacatgctttggtttagtttgtttgctcttctttttcttttttccttttttttttttttttttttt

SEQ ID NO: 343131 - DNA, 352 bp, Homo sapiens
acacacacacacacacacacacacacatattcgataggtaaatgcttgggcacaagctctctagaagacgtaataaagtatccaggtgtttgtcttgtaagaatgtgatcccgacaaccccagagccaggccaagcctggagcacaggaccagtgactcagacactaccggcttggcgtcatggtgccgtggttttccatactggtgaaaaacgctcagtaaatttctaggcacaacaacacacgttgactgactctgggttcctgcatattccgctcatactaaaccaggcgataatgctctatgattacgtgtcagagagttagggcctagggtaggtaattagcaactg

SEQ ID NO: 343132 - DNA, 250 bp, Homo sapiens
ttatttcatccaatttcgtgggcctgctacttacatttcaaggctgatatccacacagaatttttaagtattatataaaacttacattttaggtctgtagtgcaaaacacttagatcaatcattaccttttaattttcaaaaagaaatttttcactatagacttatgccacctatatccctgggctcatagaacaaaggaagaggtggcagggagagattgtactggatggatacaggtcagagaccttt

SEQ ID NO: 343133 - DNA, 208 bp, Homo sapiens
agaaccaccggtgtggcgtgctgggaaaaatcaaggtagagtctgcctttcacacccccacaggtgacgtcagaaggcatggaggcccagacacaaagctccgtcactctacagtgcagtttggagaatacacaagacccggtttagcatcttggtcgggaggcacaagctcagaacaaaaatctgacaaggaaacatgtgttcacca

SEQ ID NO: 343134 - DNA, 377 bp, Homo sapiens
aaggccaagccccagtctaaatgagaccagccagcttccttaaaatccctttaatttgtattacatataatcgtgtatgtttaaaaaatattttatttttttgagacagtttgtgtcacccaggctggagtccagtggcatgctcacagctctctgcagcctcgacctgggcttgagcgatcttgccaccttagcctcccgagtagctgggacccatgggtgcatgccaccacacctggctaattaaaaaaaaaatttttttttgtagaggtggcgggtctcactatgttgcccagtctggtctcgaattcctgggttcaagcagtcccagagtgttgggattacagatgtgagccattgcacctggcctaaaaatg

SEQ ID NO: 343135 - DNA, 5788 bp, Homo sapiens
aagcttgcggccgccgggccccggggttgaggcgaggagcccgcgggcggccggtcgggcggggcggcggcgctgacagcatcctgaggttagcattacacttctcccagtggagcccatgacttctgatcaggacgctaaggttgtggctgaaccgcagacgcagagagtccaggagggcaaggacagcgctcatctgatgaatggtcctatatctcaaaccacttctcagacaagttccatcccacctttgagtcagaaaacactcctcagctaccggtgtcagaggacggtgttgtttggggatggcatgatagagacggacagttcgtaccagcaactaaggtttcagagctgaaccctaatgcagaagtgtggggggctcctgtgttacatctggaagcaagcagtgctgctgacggtgtgagtgctgcatgggaggaggtggctggccaccacgcagaccgtggcccgcagggatcggatgccaatggtgatggtgaccagggccatgagaatgccgcattgccagacccgcaggagtcggacccagcagacatgaacgctctcgctctgggtccctcagaatatgactctctgcctgaaaatagcgagacaggaggaaatgagtctcaaccagacagccaggaagacccccgagaagtacttaaaaaaacattggaattctgcttatctagggagaaccttgctagtgacatgtatcttatatcacagatggatagtgaccagtatgtgccaatcacaacggtggctaacctcgaccacatcaagaagctcagcactgatgtggacttgattgtggaagtgctaagatctttacctttagtccaagtggatgaaaagggagaaaaagtaaggccaaatcaaaatcgctgcatagtaatattgcgtgaaatatctgaatctacccccgtggaagaagtagaagcactatttaaaggagataatttaccaaaatttataaactgtgaatttgcatataatgataattggtttattacatttgaaacagaagctgatgcacaacaggcttacaaataccttcgagaagaagtcaaaacttttcaaggaaaaccaattaaggcacggataaaagcaaaggcaatagctataaacacatttttgccaaagaatggatttagacccctggacgtgagcctgtatgcccagcagcgctacgcgacgtcgttctacttccctcccatgtacagcccccagcagcagttccccctgtacagcctgatcactccccagacgtggtcagcaacgcacagctatcttgacccacccttggtaactccatttccaaatactggatttataaatgggtttacgtctccagcgttcaagcctgcggcgtctcctctgacttctctcagacagtatcctcctcgaagcaggaatcctagtaaatctcatctgcggcatgcgattcctagtgcagagaggggacctgggttattagaaagtccttcaatatttaacttcactgcagatcgattaattaatggtgtccggagtccacaaacaaggcaagcaggtcaaactagaacacggattcaaaacccttcagcatatgccaagagagaggctgggcctgggcgtgtggagccaggcagtctcgaatcctctcctggtttagggaggggaaggaagaattcctttggctaccggaagaaaagggaggagaagtttacaagcagccagacacagtctccaacgccaccaaagcctccgtcgccaagcttcgagctggggctgtccagcttccctccattacctggagctgccggcaatttgaagacagaggacttgtttgaaaacaggctatctagcttgataataggaccatccaaagaaaggaccctcagtgcagacgcaagcgtgaacacccttcctgtagtggtctccagagagccctcggtgccggcttcttgtgctgtatcagcaacgtacgagcgatccccctccccagctcatttacccgatgatcccaaggtggcggagaaacagagggaaacccacagtgtggacagacttccttccgccctcactgcgaccgcgtgtaaatcggtgcaggtgaacggagccgccacggaattgcgaaagcccagctacgcagagatttgtcagagaacgagtaaagagcctccttcttccccattgcaaccccaaaaagaacaaaagccaaacactgttggttgtgggaaggaggaaaagaagctggcagagcccgcagagagataccgggagcccccagccctcaagtccacacctggagcccccagagaccagaggcggccggcggggggccggccctcgccctcggccatggggaagcgtctcagccgagagcagagcactccccccaagtctcctcagtgaaaaccgtacgtctgggaggggtcgcagagcgctgtgttaaccacaaacgagacactctcccactcagtgcgagggcgagccgctggttaggagcttgcagtgtctgaggcctgtgggatcctcaagttggttttcttctgtgagttggattctccccctcttgaaaaaaaatcgatttttcaggatttaattaatacaaaccttattttaggttggtgcttaactggaggtgatgcataagtctgatttttttttccaagatagaaaaagcatttatcctaacaaattggtattttttattaagcctccatgtggctctgaatgcaagctatatatagtgagtttttctaaattaagggaactctgcttttttttttttttttttaagtaactggtctgtaagtgcatatctctagaacgtccccgcagatgaatgagggccagtggccttggcagaggcaggtgtggcctcgtagaggcagtgctggccgcgccagggcatcagtgctgatgtgggagctgtgcttccacctaagccgttggtaggggactgtggcatttaagaatgtagagagcgcatcctttttgatctcctgggcggagtgaacctgcaggggccaccccagaaaccttggttctgatgcactgcaagcaagtaaccagcttctcactccagtttcaagtggctattatgtaatataaattcaaagcacattgtgaatagaacctacatgaaaacatacactttgttgcccactgacatgttaccagaagttgtaccatgatgttgttttgacccctgtgagctgatggccccggccctgctctgtgcacatttctgtccgtgttccccagcactctggttggagagagtccacatcttcagctccgtgtggacatctccctgtacctctgcatcagcacatggatttaagagttatgtaatcgtgagagaatggtgtttgtggtttttccccctctttggctggtggaggataaagttcctgctcttttacctccaagacgagggcctcattgattcacttccagaagtgctgcacttctgaagaacaaggatgcactaaagttagcaagtttataataaagttaaatataaattattttgttttaaaatgcctcaaatttttctttattctaagcagcaaacattaaaataagaatatttcctgctaaatgtaaccatacactttattccacaaaatgttatttaacaagactgagggttttttttaagaaaaaattatttccatccaatatttaaagacttgaattttatttaaacttgaaaatgactttgccttaacttttgtataagacagcttagagtccatggagcccggccctgggttggcgtgagtgggtcagagttactcagttactgcgtggatctcctgtcgctagttttactgagtaagcatactgtagtacaagagctagtagtagtttttgtaatataccttaaagatcttcaacagttgatcttttttcagaatgttggaaaatcctgtaaatgcaaatagtcaatactgtattaaatacgtgcacttggagtgtgcttcgcttgtacagttgtaaataatcagaacatatgaaaaaggtaccctacagagaaaattctgatacagattattgatatattataaatgttgctgttgagcgggatgtagataaactaaatgttgtggtttgaatattattttgatttgttgagattttcttttttctcttacatcggtgtgttgaactgattctgcctctttgctgcaaaagggaattggaaagtcttattaaaagcctccagatgttttcatactcttttaaaatgtatgtaaatgcatactaatcatatctaatgtgaaagagttttaaagtatatagagagcaaaaactggcaggatcgtaagtgaaggtgactagtaatctaattaaaatcacctgcagctaagcatgattgaccctgccagaggaaaacatgcctatttgaccatttcctttaaagcagttgccattattcaaatacagagaaatagccacagggctagtgtttttcaaatgcattttaaagaacatggggatttttttttgtagttgtcagttcactgaccaaaaaaaaaaaaaaaatcagaaataattgatctgtgaaacccaaactctcaatactcagaaagctgggaggcaacctcgaggcctgggcctacgagctgcatcttcgctacggaagggccagggcgccatcagccattcccaaaacacaaggcctgcccgtccgccagtgagtccttggtttttaataatgagaagtcctttcccccaaggtgtgagcattgcagcgcagtgtgtgtgtgtggttagagccagcttagtccttcactttgtcgaccgaagtgggagctcaacagctgcatgaggagggcagcgcgtgcattagccagtcgccactggagggctctgctgccctccggtcaatacactgtagttactgcctagccagcagcagtcttctgcatcaagaactgaaaccttgctcggaggtgatttttatagcatcctttttaattaaaggtgaaatacagattgctatataatgtctgaaaaaacctgatactacttcaagagtttctgctcagaagaaaatgagagttatcataataggaagctgtggcggtccatgccaactgtgctgtgtcacatacagcgatgagagtggctttcatactttttttttttttaagttaacaccctcctttacccccagcagtatctcaggttatagaatcagagatgcagcagtgacaaatggcattttaacttgtaaaatcgtgtgatgatgcttatcattttgaaatagaagaataaaaacctggtcccgtttcaccagacatgaatttcaagtggagtcgtcgttctctgagagtgagtgtcttgacattttcacccaggccctcctgtcatcacatcaccggctgtcactggcgggtggccgtaaacgtcctgcgttgctatattaggatctctgcagttcaggcttcaaaaccagttcagtgtatccgggcgacgggtagtggtggtgcatgcctgtctgtgtgccccgctggcgagctgtagttgcggcttgcgtgcctcgcggcccactacagggctgcagacaatcgaggcgagggcgctggccgccagcagctcacagcgcgggggtcatgtggtcgctcctcgagggtttcgtttttgttctgcttcattaagactggaatcaagcttacatgtaaactattggtaatttaagtttccttttgtgtcattcagtgtaaaactgtctaatttgaaaaaaaatgtaggttatgaaaataaagatttaggcactgtt

SEQ ID NO: 343136 - DNA, 5862 bp, Homo sapiens
tgtaaatgagaggaagcaaagatttttatggagactatcaataatctcaagaaaatacatattcaaaatggaattaaagccgtgcagtaagattgcatgtgaaacatcaacaggaagttgccttttcctcctctggactctgggtatactttgtttgccatctgcgagatcagtccatggctgagagatggcataagtgagcctgagtgcagcagtgagcagagcatcctgaggttagcattacacttctcccagtggagcccatgacttctgatcaggacgctaaggttgtggctgaaccgcagacgcagagagtccaggagggcaaggacagcgctcatctgatgaatggtcctatatctcaaaccacttctcagacaagttccatcccacctttgagtcaggtaccagcaactaaggtttcagagctgaaccctaatgcagaagtgtggggggctcctgtgttacatctggaagcaagcagtgctgctgacggtgtgagtgctgcatgggaggaggtggctggccaccacgcagaccgtggcccgcagggatcggatgccaatggtgatggtgaccagggccatgagaatgccgcattgccagacccgcaggagtcggacccagcagacatgaacgctctcgctctgggtccctcagaatatgactctctgcctgaaaatagcgagacaggaggaaatgagtctcaaccagacagccaggaagacccccgagaagtacttaaaaaaacattggaattctgcttatctagggagaaccttgctagtgacatgtatcttatatcacagatggatagtgaccagtatgtgccaatcacaacggtggctaacctcgaccacatcaagaagctcagcactgatgtggacttgattgtggaagtgctaagatctttacctttagtccaagtggatgaaaagggagaaaaagtaaggccaaatcaaaatcgctgcatagtaatattgcgtgaaatatctgaatctacccccgtggaagaagtagaagcactatttaaaggagataatttaccaaaatttataaactgtgaatttgcatataatgataattggtttattacatttgaaacagaagctgatgcacaacaggcttacaaataccttcgagaagaagtcaaaacttttcaaggaaaaccaattaaggcacggataaaagcaaaggcaatagctataaacacatttttgccaaagaatggatttagacccctggacgtgagcctgtatgcccagcagcgctacgcgacgtcgttctacttccctcccatgtacagcccccagcagcagttccccctgtacagcctgatcactccccagacgtggtcagcaacgcacagctatcttgacccacccttggtaactccatttccaaatactggatttataaatgggtttacgtctccagcgttcaagcctgcggcgtctcctctgacttctctcagacagtatcctcctcgaagcaggaatcctagtaaatctcatctgcggcatgcgattcctagtgcagagaggggacctgggttattagaaagtccttcaatatttaacttcactgcagatcgattaattaatggtgtccggagtccacaaacaaggcaagcaggtcaaactagaacacggattcaaaacccttcagcatatgccaagagagaggctgggcctgggcgtgtggagccaggcagtctcgaatcctctcctggtttagggaggggaaggaagaattcctttggctaccggaagaaaagggaggagaagtttacaagcagccagacacagtctccaacgccaccaaagcctccgtcgccaagcttcgagctggggctgtccagcttccctccattacctggagctgccggcaatttgaagacagaggacttgtttgaaaacaggctatctagcttgataataggaccatccaaagaaaggaccctcagtgcagacgcaagcgtgaacacccttcctgtagtggtctccagagagccctcggtgccggcttcttgtgctgtatcagcaacgtacgagcgatccccctccccagctcatttacccgatgatcccaaggtggcggagaaacagagggaaacccacagtgtggacagacttccttccgccctcactgcgaccgcgtgtaaatcggtgcaggtgaacggagccgccacggaattgcgaaagcccagctacgcagagatttgtcagagaacgagtaaagagcctccttcttccccattgcaaccccaaaaagaacaaaagccaaacactgttggttgtgggaaggaggaaaagaagctggcagagcccgcagagagataccgggagcccccagccctcaagtccacacctggagcccccagagaccagaggcggccggcggggggccggccctcgccctcggccatggggaagcgtctcagccgagagcagagcactccccccaagtctcctcagtgaaaaccgtacgtctgggaggggtcgcagagcgctgtgttaaccacaaacgagacactctcccactcagtgcgagggcgagccgctggttaggagcttgcagtgtctgaggcctgtgggatcctcaagttggttttcttctgtgagttggattctccccctcttgaaaaaaaatcgatttttcaggatttaattaatacaaaccttattttaggttggtgcttaactggaggtgatgcataagtctgatttttttttccaagatagaaaaagcatttatcctaacaaattggtattttttattaagcctccatgtggctctgaatgcaagctatatatagtgagtttttctaaattaagggaactctgcttttttttttttttttttaagtaactggtctgtaagtgcatatctctagaacgtccccgcagatgaatgagggccagtggccttggcagaggcaggtgtggcctcgtagaggcagtgctggccgcgccagggcatcagtgctgatgtgggagctgtgcttccacctaagccgttggtaggggactgtggcatttaagaatgtagagagcgcatcctttttgatctcctgggcggagtgaacctgcaggggccaccccagaaaccttggttctgatgcactgcaagcaagtaaccagcttctcactccagtttcaagtggctattatgtaatataaattcaaagcacattgtgaatagaacctacatgaaaacatacactttgttgcccactgacatgttaccagaagttgtaccatgatgttgttttgacccctgtgagctgatggccccggccctgctctgtgcacatttctgtccgtgttccccagcactctggttggagagagtccacatcttcagctccgtgtggacatctccctgtacctctgcatcagcacatggatttaagagttatgtaatcgtgagagaatggtgtttgtggtttttccccctctttggctggtggaggataaagttcctgctcttttacctccaagacgagggcctcattgattcacttccagaagtgctgcacttctgaagaacaaggatgcactaaagttagcaagtttataataaagttaaatataaattattttgttttaaaatgcctcaaatttttctttattctaagcagcaaacattaaaataagaatatttcctgctaaatgtaaccatacactttattccacaaaatgttatttaacaagactgagggttttttttaagaaaaaattatttccatccaatatttaaagacttgaattttatttaaacttgaaaatgactttgccttaacttttgtataagacagcttagagtccatggagcccggccctgggttggcgtgagtgggtcagagttactcagttactgcgtggatctcctgtcgctagttttactgagtaagcatactgtagtacaagagctagtagtagtttttgtaatataccttaaagatcttcaacagttgatcttttttcagaatgttggaaaatcctgtaaatgcaaatagtcaatactgtattaaatacgtgcacttggagtgtgcttcgcttgtacagttgtaaataatcagaacatatgaaaaaggtaccctacagagaaaattctgatacagattattgatatattataaatgttgctgttgagcgggatgtagataaactaaatgttgtggtttgaatattattttgatttgttgagattttcttttttctcttacatcggtgtgttgaactgattctgcctctttgctgcaaaagggaattggaaagtcttattaaaagcctccagatgttttcatactcttttaaaatgtatgtaaatgcatactaatcatatctaatgtgaaagagttttaaagtatatagagagcaaaaactggcaggatcgtaagtgaaggtgactagtaatctaattaaaatcacctgcagctaagcatgattgaccctgccagaggaaaacatgcctatttgaccatttcctttaaagcagttgccattattcaaatacagagaaatagccacagggctagtgtttttcaaatgcattttaaagaacatggggatttttttttgtagttgtcagttcactgaccaaaaaaaaaaaaaaaatcagaaataattgatctgtgaaacccaaactctcaatactcagaaagctgggaggcaacctcgaggcctgggcctacgagctgcatcttcgctacggaagggccagggcgccatcagccattcccaaaacacaaggcctgcccgtccgccagtgagtccttggtttttaataatgagaagtcctttcccccaaggtgtgagcattgcagcgcagtgtgtgtgtgtggttagagccagcttagtccttcactttgtcgaccgaagtgggagctcaacagctgcatgaggagggcagcgcgtgcattagccagtcgccactggagggctctgctgccctccggtcaatacactgtagttactgcctagccagcagcagtcttctgcatcaagaactgaaaccttgctcggaggtgatttttatagcatcctttttaattaaaggtgaaatacagattgctatataatgtctgaaaaaacctgatactacttcaagagtttctgctcagaagaaaatgagagttatcataataggaagctgtggcggtccatgccaactgtgctgtgtcacatacagcgatgagagtggctttcatactttttttttttttaagttaacaccctcctttacccccagcagtatctcaggttatagaatcagagatgcagcagtgacaaatggcattttaacttgtaaaatcgtgtgatgatgcttatcattttgaaatagaagaataaaaacctggtcccgtttcaccagacatgaatttcaagtggagtcgtcgttctctgagagtgagtgtcttgacattttcacccaggccctcctgtcatcacatcaccggctgtcactggcgggtggccgtaaacgtcctgcgttgctatattaggatctctgcagttcaggcttcaaaaccagttcagtgtatccgggcgacgggtagtggtggtgcatgcctgtctgtgtgccccgctggcgagctgtagttgcggcttgcgtgcctcgcggcccactacagggctgcagacaatcgaggcgagggcgctggccgccagcagctcacagcgcgggggtcatgtggtcgctcctcgagggtttcgtttttgttctgcttcattaagactggaatcaagcttacatgtaaactattggtaatttaagtttccttttgtgtcattcagtgtaaaactgtctaatttgaaaaaaaatgtaggttatgaaaataaagatttaggcactgtt

SEQ ID NO: 343137 - DNA, 5822 bp, Homo sapiens
aagcttgcggccgccgggccccggggttgaggcgaggagcccgcgggcggccggtcgggcggggcggcggcgctgacagcatcctgaggttagcattacacttctcccagtggagcccatgacttctgatcaggacgctaaggttgtggctgaaccgcagacgcagagagtccaggagggcaaggacagcgctcatctgatgaatggtcctatatctcaaaccacttctcagacaagttccatcccacctttgagtcaggtaccagcaactaaggtttcagagctgaaccctaatgcagaagtgtggggggctcctgtgttacatctggaagcaagcagtgctgctgacggtgtgagtgctgcatgggaggaggtggctggccaccacgcagaccgtggcccgcagggatcggatgccaatggtgatggtgaccagggccatgagaatgccgcattgccagacccgcaggagtcggacccagcagacatgaacgctctcgctctgggtccctcagaatatgactctctgcctgaaaatagcgagacaggaggaaatgagtctcaaccagacagccaggaagacccccgagaagtacttaaaaaaacattggaattctgcttatctagggagaaccttgctagtgacatgtatcttatatcacagatggatagtgaccagtatgtgccaatcacaacggtggctaacctcgaccacatcaagaagctcagcactgatgtggacttgattgtggaagtgctaagatctttacctttagtccaagtggatgaaaagggagaaaaagtaaggccaaatcaaaatcgctgcatagtaatattgcgtgaaatatctgaatctacccccgtggaagaagtagaagcactatttaaaggagataatttaccaaaatttataaactgtgaatttgcatataatgataattggtttattacatttgaaacagaagctgatgcacaacaggcttacaaataccttcgagaagaagtcaaaacttttcaaggaaaaccaattaaggcacggataaaagcaaaggcaatagctataaacacatttttgccaaagaatggatttagacccctggacgtgagcctgtatgcccagcagcgctacgcgacgtcgttctacttccctcccatgtacagcccccagcagcagttccccctgtacagcctgatcactccccagacgtggtcagcaacgcacagctatcttgacccacccttggtaactccatttccaaatactggatttataaatgggtttacgtctccagcgttcaagcctgcggcgtctcctctgacttctctcagacagtatcctcctcgaagcaggaatcctagtaaatctcatctgcggcatgcgattcctagtgcagagaggggacctgggttattagaaagtccttcaatatttaacttcactgcagatcgattaattaatggtgtccggagtccacaaacaaggcaagcaggtcaaactagaacacggattcaaaacccttcagcatatgccaagagagaggctgggcctgggcgtgtggagccaggcagtctcgaatcctctcctggtttagggaggggaaggaagaattcctttggctaccggaagaaaagggaggagaagtttacaagcagccagacacagtctccaacgccaccaaagcctccgtcgccaagcttcgagctggggctgtccagcttccctccattacctggagctgccggcaatttgaagacagaggacttgtttgaaaacaggctatctagcttgataataggaccatccaaagaaaggaccctcagtgcagacgcaagcgtgaacacccttcctgtagtggtctccagagagccctcggtgccggcttcttgtgctgtatcagcaacgtacgagcgatccccctccccagctcatttacccgatgatcccaaggtggcggagaaacagagggaaacccacagtgtggacagacttccttccgccctcactgcgaccgcgtgtaaatcggtgcaggtgaacggagccgccacggtacgtacctcgtgcctgccttcctgcacgacagccgcgaggctctggtgtgaacagacgctgcgcactcctgcacctgctcgttttttaatcacatctaatttggaattgcgaaagcccagctacgcagagatttgtcagagaacgagtaaagagcctccttcttccccattgcaaccccaaaaagaacaaaagccaaacactgttggttgtgggaaggaggaaaagaagctggcagagcccgcagagagataccgggagcccccagccctcaagtccacacctggagcccccagagaccagaggcggccggcggggggccggccctcgccctcggccatggggaagcgtctcagccgagagcagagcactccccccaagtctcctcagtgaaaaccgtacgtctgggaggggtcgcagagcgctgtgttaaccacaaacgagacactctcccactcagtgcgagggcgagccgctggttaggagcttgcagtgtctgaggcctgtgggatcctcaagttggttttcttctgtgagttggattctccccctcttgaaaaaaaatcgatttttcaggatttaattaatacaaaccttattttaggttggtgcttaactggaggtgatgcataagtctgatttttttttccaagatagaaaaagcatttatcctaacaaattggtattttttattaagcctccatgtggctctgaatgcaagctatatatagtgagtttttctaaattaagggaactctgcttttttttttttttttttaagtaactggtctgtaagtgcatatctctagaacgtccccgcagatgaatgagggccagtggccttggcagaggcaggtgtggcctcgtagaggcagtgctggccgcgccagggcatcagtgctgatgtgggagctgtgcttccacctaagccgttggtaggggactgtggcatttaagaatgtagagagcgcatcctttttgatctcctgggcggagtgaacctgcaggggccaccccagaaaccttggttctgatgcactgcaagcaagtaaccagcttctcactccagtttcaagtggctattatgtaatataaattcaaagcacattgtgaatagaacctacatgaaaacatacactttgttgcccactgacatgttaccagaagttgtaccatgatgttgttttgacccctgtgagctgatggccccggccctgctctgtgcacatttctgtccgtgttccccagcactctggttggagagagtccacatcttcagctccgtgtggacatctccctgtacctctgcatcagcacatggatttaagagttatgtaatcgtgagagaatggtgtttgtggtttttccccctctttggctggtggaggataaagttcctgctcttttacctccaagacgagggcctcattgattcacttccagaagtgctgcacttctgaagaacaaggatgcactaaagttagcaagtttataataaagttaaatataaattattttgttttaaaatgcctcaaatttttctttattctaagcagcaaacattaaaataagaatatttcctgctaaatgtaaccatacactttattccacaaaatgttatttaacaagactgagggttttttttaagaaaaaattatttccatccaatatttaaagacttgaattttatttaaacttgaaaatgactttgccttaacttttgtataagacagcttagagtccatggagcccggccctgggttggcgtgagtgggtcagagttactcagttactgcgtggatctcctgtcgctagttttactgagtaagcatactgtagtacaagagctagtagtagtttttgtaatataccttaaagatcttcaacagttgatcttttttcagaatgttggaaaatcctgtaaatgcaaatagtcaatactgtattaaatacgtgcacttggagtgtgcttcgcttgtacagttgtaaataatcagaacatatgaaaaaggtaccctacagagaaaattctgatacagattattgatatattataaatgttgctgttgagcgggatgtagataaactaaatgttgtggtttgaatattattttgatttgttgagattttcttttttctcttacatcggtgtgttgaactgattctgcctctttgctgcaaaagggaattggaaagtcttattaaaagcctccagatgttttcatactcttttaaaatgtatgtaaatgcatactaatcatatctaatgtgaaagagttttaaagtatatagagagcaaaaactggcaggatcgtaagtgaaggtgactagtaatctaattaaaatcacctgcagctaagcatgattgaccctgccagaggaaaacatgcctatttgaccatttcctttaaagcagttgccattattcaaatacagagaaatagccacagggctagtgtttttcaaatgcattttaaagaacatggggatttttttttgtagttgtcagttcactgaccaaaaaaaaaaaaaaaatcagaaataattgatctgtgaaacccaaactctcaatactcagaaagctgggaggcaacctcgaggcctgggcctacgagctgcatcttcgctacggaagggccagggcgccatcagccattcccaaaacacaaggcctgcccgtccgccagtgagtccttggtttttaataatgagaagtcctttcccccaaggtgtgagcattgcagcgcagtgtgtgtgtgtggttagagccagcttagtccttcactttgtcgaccgaagtgggagctcaacagctgcatgaggagggcagcgcgtgcattagccagtcgccactggagggctctgctgccctccggtcaatacactgtagttactgcctagccagcagcagtcttctgcatcaagaactgaaaccttgctcggaggtgatttttatagcatcctttttaattaaaggtgaaatacagattgctatataatgtctgaaaaaacctgatactacttcaagagtttctgctcagaagaaaatgagagttatcataataggaagctgtggcggtccatgccaactgtgctgtgtcacatacagcgatgagagtggctttcatactttttttttttttaagttaacaccctcctttacccccagcagtatctcaggttatagaatcagagatgcagcagtgacaaatggcattttaacttgtaaaatcgtgtgatgatgcttatcattttgaaatagaagaataaaaacctggtcccgtttcaccagacatgaatttcaagtggagtcgtcgttctctgagagtgagtgtcttgacattttcacccaggccctcctgtcatcacatcaccggctgtcactggcgggtggccgtaaacgtcctgcgttgctatattaggatctctgcagttcaggcttcaaaaccagttcagtgtatccgggcgacgggtagtggtggtgcatgcctgtctgtgtgccccgctggcgagctgtagttgcggcttgcgtgcctcgcggcccactacagggctgcagacaatcgaggcgagggcgctggccgccagcagctcacagcgcgggggtcatgtggtcgctcctcgagggtttcgtttttgttctgcttcattaagactggaatcaagcttacatgtaaactattggtaatttaagtttccttttgtgtcattcagtgtaaaactgtctaatttgaaaaaaaatgtaggttatgaaaataaagatttaggcactgtt

SEQ ID NO: 343138 - DNA, 6413 bp, Homo sapiens
aagcttgcggccgccgggccccggggttgaggcgaggagcccgcgggcggccggtcgggcggggcggcggcgctgacagcatcctgaggttagcattacacttctcccagtggagcccatgacttctgatcaggacgctaaggttgtggctgaaccgcagacgcagagagtccaggagggcaaggacagcgctcatctgatgaatggtcctatatctcaaaccacttctcagacaagttccatcccacctttgagtcaggtaccagcaactaaggtttcagagctgaaccctaatgcagaagtgtggggggctcctgtgttacatctggaagcaagcagtgctgctgacggtgtgagtgctgcatgggaggaggtggctggccaccacgcagaccgtggcccgcagggatcggatgccaatggtgatggtgaccagggccatgagaatgccgcattgccagacccgcaggagtcggacccagcagacatgaacgctctcgctctgggtccctcagaatatgactctctgcctgaaaatagcgagacaggaggaaatgagtctcaaccagacagccaggaagacccccgagaagtacttaaaaaaacattggaattctgcttatctagggagaaccttgctagtgacatgtatcttatatcacagatggatagtgaccagtatgtgccaatcacaacggtggctaacctcgaccacatcaagaagctcagcactgatgtggacttgattgtggaagtgctaagatctttacctttagtccaagtggatgaaaagggagaaaaagtaaggccaaatcaaaatcgctgcatagtaatattgcgtgaaatatctgaatctacccccgtggaagaagtagaagcactatttaaaggagataatttaccaaaatttataaactgtgaatttgcatataatgataattggtttattacatttgaaacagaagctgatgcacaacaggcttacaaataccttcgagaagaagtcaaaacttttcaaggaaaaccaattaaggcacggataaaagcaaaggcaatagctataaacacatttttgccaaagaatggatttagacccctggacgtgagcctgtatgcccagcagcgctacgcgacgtcgttctacttccctcccatgtacagcccccagcagcagttccccctgtacagcctgatcactccccagacgtggtcagcaacgcacagctatcttgacccacccttggtaactccatttccaaatactggatttataaatgggtttacgtctccagcgttcaagcctgcggcgtctcctctgacttctctcagacagtatcctcctcgaagcaggaatcctagtaaatctcatctgcggcatgcgattcctagtgcagagaggggacctgggttattagaaagtccttcaatatttaacttcactgcagatcgattaattaatggtgtccggagtccacaaacaaggcaagcaggtcaaactagaacacggattcaaaacccttcagcatatgccaagagagaggctgggcctgggcgtgtggagccaggcagtctcgaatcctctcctggtttagggaggggaaggaagaattcctttggctaccggaagaaaagggaggagaagtttacaagcagccagacacagtctccaacgccaccaaagcctccgtcgccaagcttcgagctggggctgtccagcttccctccattacctggagctgccggcaatttgaagacagaggacttgtttgaaaacaggctatctagcttgataataggaccatccaaagaaaggaccctcagtgcagacgcaagcgtgaacacccttcctgtagtggtctccagagagccctcggtgccggcttcttgtgctgtatcagcaacgtacgagcgatccccctccccagctcatttacccgatgatcccaaggtggcggagaaacagagggaaacccacagtgtggacagacttccttccgccctcactgcgaccgcgtgtaaatcggtgcaggtgaacggagccgccacggaattgcgaaagcccagctacgcagagatttgtcagagaacgagtaaagagcctccttcttccccattgcaaccccaaaaagaacaaaagccaaacactgttggttgtgggaaggaggaaaagaagctggcagagcccgcagagagataccgggagcccccagccctcaagtccacacctggagcccccagagaccagaggcggccggcggggggccggccctcgccctcggccatggggaagcgtctcagccgagagcagagcactccccccaagtctcctcagtgaaaaccgtacgtctgggaggggtcgcagagcgctgtgttaaccacaaacgagacactctcccactcagtgcgagggcgagccgctggttaggagcttgcagtgtctgaggcctgtgggatcctcaagttggttttcttctgtgagttggattctccccctcttgaaaaaaaatcgatttttcaggatttaattaatacaaaccttattttaggttggtgcttaactggaggtgatgcataagtctgatttttttttccaagatagaaaaagcatttatcctaacaaattggtattttttattaagcctccatgtggctctgaatgcaagctatatatagtgagtttttctaaattaagggaactctgcttttttttttttttttttaagtaactggtctgtaagtgcatatctctagaacgtccccgcagatgaatgagggccagtggccttggcagaggcaggtgtggcctcgtagaggcagtgctggccgcgccagggcatcagtgctgatgtgggagctgtgcttccacctaagccgttggtaggggactgtggcatttaagaatgtagagagcgcatcctttttgatctcctgggcggagtgaacctgcaggggccaccccagaaaccttggttctgatgcactgcaagcaagtaaccagcttctcactccagtttcaagtggctattatgtaatataaattcaaagcacattgtgaatagaacctacatgaaaacatacactttgttgcccactgacatgttaccagaagttgtaccatgatgttgttttgacccctgtgagctgatggccccggccctgctctgtgcacatttctgtccgtgttccccagcactctggttggagagagtccacatcttcagctccgtgtggacatctccctgtacctctgcatcagcacatggatttaagagttatgtaatcgtgagagaatggtgtttgtggtttttccccctctttggctggtggaggataaagttcctgctcttttacctccaagacgagggcctcattgattcacttccagaagtgctgcacttctgaagaacaaggatgcactaaagttagcaagtttataataaagttaaatataaattattttgttttaaaatgcctcaaatttttctttattctaagcagcaaacattaaaataagaatatttcctgctaaatgtaaccatacactttattccacaaaatgttatttaacaagactgagggttttttttaagaaaaaattatttccatccaatatttaaagacttgaattttatttaaacttgaaaatgactttgccttaacttttgtataagacagcttagagtccatggagcccggccctgggttggcgtgagtgggtcagagttactcagttactgcgtggatctcctgtcgctagttttactgagtaagcatactgtagtacaagagctagtagtagtttttgtaatataccttaaagatcttcaacagttgatcttttttcagaatgttggaaaatcctgtaaatgcaaatagtcaatactgtattaaatacgtgcacttggagtgtgcttcgcttgtacagttgtaaataatcagaacatatgaaaaaggtaccctacagagaaaattctgatacagattattgatatattataaatgttgctgttgagcgggatgtagataaactaaatgttgtggtttgaatattattttgatttgttgagattttcttttttctcttacatcggtgtgttgaactgattctgcctctttgctgcaaaagggaattggaaagtcttattaaaagcctccagatgttttcatactcttttaaaatgtatgtaaatgcatactaatcatatctaatgtgaaagagttttaaagtatatagagagcaaaaactggcaggatcgtaagtgaaggtgactagtaatctaattaaaatcacctgcagctaagcatgattgaccctgccagaggaaaacatgcctatttgaccatttcctttaaagcagttgccattattcaaatacagagaaatagccacagggctagtgtttttcaaatgcattttaaagaacatggggatttttttttgtagttgtcagttcactgaccaaaaaaaaaaaaaaaatcagaaataattgatctgtgaaacccaaactctcaatactcagaaagctgggaggcaacctcgaggcctgggcctacgagctgcatcttcgctacggaagggccagggcgccatcagccattcccaaaacacaaggcctgcccgtccgccagtgagtccttggtttttaataatgagaagtcctttcccccaaggtgtgagcattgcagcgcagtgtgtgtgtgtggttagagccagcttagtccttcactttgtcgaccgaagtgggagctcaacagctgcatgaggagggcagcgcgtgcattagccagtcgccactggagggctctgctgccctccggtcaatacactgtagttactgcctagccagcagcagtcttctgcatcaagaactgaaaccttgctcggaggtgatttttatagcatcctttttaattaaaggtgaaatacagattgctatataatgtctgaaaaaacctgatactacttcaagagtttctgctcagaagaaaatgagagttatcataataggaagctgtggcggtccatgccaactgtgctgtgtcacatacagcgatgagagtggctttcatactttttttttttttaagttaacaccctcctttacccccagcagtatctcaggttatagaatcagagatgcagcagtgacaaatggcattttaacttgtaaaatcgtgtgatgatgcttatcattttgaaatagaagaataaaaacctggtcccgtttcaccagacatgaatttcaagtggagtcgtcgttctctgagagtgagtgtcttgacattttcacccaggccctcctgtcatcacatcaccggctgtcactggcgggtggccgtaaacgtcctgcgttgctatattaggatctctgcagttcaggcttcaaaaccagttcagtgtatccgggcgacgggtagtggtggtgcatgcctgtctgtgtgccccgctggcgagctgtagttgcggcttgcgtgcctcgcggcccactacagggctgcagacaatcgaggcgagggcgctggccgccagcagctcacagcgcgggggtcatgtggtcgctcctcgagggtttcgtttttgttctgcttcattaagactggaatcaagcttacatgtaaactattggtaatttaagtttccttttgtgtcattcagtgtaaaactgtctaatttgaaaaaaaatgtaggttatgaaaataaagatttaggcactgttcaatttttcttttgattttttttaaattaaaatttcttcaataatgaaaattttctaaacatagttttttgtctgttcccataagtgcatgagaaagaaacacgggcctcatatatgattggatcctaaagccttctcacctacgtgggggctggctgtggcacacggggctcaccctttgtgttttagtggttcagagtgagcattaacatcagatgctcatgcggagacagccattactgtgactgccaagatgtactgcaaaaatacatgttcctgtatcaggactttgattttgttaaaatggcactctctccaaagctgtgtccatgaagctgtttggagctaacgttgggtcttcatggtgatggactcatccttaggcagcagtgatgtctgcactaggaagaggctggcgggaggcggggcccctcctgtgccaggcaccgagtggatgggggactgattaacatgttgctgccttcctcctctgtgcattgccttttcatgtcgtcttcccatttttactctttttctgatggaattaatattcttgatctgttaaggctattaatcctttgtcatatatgttacaaatattttctttcaatctaccatttgtcttaactctttatttagaatagtatcttttacggtgtttaattattgtgtagtaaaatctatcaatcttctcct

SEQ ID NO: 343139 - DNA, 5219 bp, Homo sapiens
aaccattgcccctgtttccgaattcgggccggggacccatccggtttcccccaaaaaaaaaaaaaaaaaaagttgtgcagttatcagcccagaacatgatatgatagttttcacattaatctagcttaatggtatcttgagagtaggggaagctgtaagttgtgtgactgcttttctctatggcattgtgattctgattctggaagccctgctgaaccctcatccttttgggaagagagatttactaggcatcatggtacgtttgtttaaggatagttccttaagagaatgcatttgttaaaaaaattttgggtgaggacaaaaactgacattgttgagaattaatttctaacatctctatttcctgtaggaagtagaagcactatttaaaggagataatttaccaaaatttataaactgtgaatttgcatataatgataattggtttattacatttgaaacagaagctgatgcacaacaggcttacaaataccttcgagaagaagtcaaaacttttcaaggaaaaccaattaaggcacggataaaagcaaaggcaatagctataaacacatttttgccaaagaatggatttagacccctggacgtgagcctgtatgcccagcagcgctacgcgacgtcgttctacttccctcccatgtacagcccccagcagcagttccccctgtacagcctgatcactccccagacgtggtcagcaacgcacagctatcttgacccacccttggtaactccatttccaaatactggatttataaatgggtttacgtctccagcgttcaagcctgcggcgtctcctctgacttctctcagacagtatcctcctcgaagcaggaatcctagtaaatctcatctgcggcatgcgattcctagtgcagagaggggacctgggttattagaaagtccttcaatatttaacttcactgcagatcgattaattaatggtgtccggagtccacaaacaaggcaagcaggtcaaactagaacacggattcaaaacccttcagcatatgccaagagagaggctgggcctgggcgtgtggagccaggcagtctcgaatcctctcctggtttagggaggggaaggaagaattcctttggctaccggaagaaaagggaggagaagtttacaagcagccagacacagtctccaacgccaccaaagcctccgtcgccaagcttcgagctggggctgtccagcttccctccattacctggagctgccggcaatttgaagacagaggacttgtttgaaaacaggctatctagcttgataataggaccatccaaagaaaggaccctcagtgcagacgcaagcgtgaacacccttcctgtagtggtctccagagagccctcggtgccggcttcttgtgctgtatcagcaacgtacgagcgatccccctccccagctcatttacccgatgatcccaaggtggcggagaaacagagggaaacccacagtgtggacagacttccttccgccctcactgcgaccgcgtgtaaatcggtgcaggtgaacggagccgccacggaattgcgaaagcccagctacgcagagatttgtcagagaacgagtaaagagcctccttcttccccattgcaaccccaaaaagaacaaaagccaaacactgttggttgtgggaaggaggaaaagaagctggcagagcccgcagagagataccgggagcccccagccctcaagtccacacctggagcccccagagaccagaggcggccggcggggggccggccctcgccctcggccatggggaagcgtctcagccgagagcagagcactccccccaagtctcctcagtgaaaaccgtacgtctgggaggggtcgcagagcgctgtgttaaccacaaacgagacactctcccactcagtgcgagggcgagccgctggttaggagcttgcagtgtctgaggcctgtgggatcctcaagttggttttcttctgtgagttggattctccccctcttgaaaaaaaatcgatttttcaggatttaattaatacaaaccttattttaggttggtgcttaactggaggtgatgcataagtctgatttttttttccaagatagaaaaagcatttatcctaacaaattggtattttttattaagcctccatgtggctctgaatgcaagctatatatagtgagtttttctaaattaagggaactctgcttttttttttttttttttaagtaactggtctgtaagtgcatatctctagaacgtccccgcagatgaatgagggccagtggccttggcagaggcaggtgtggcctcgtagaggcagtgctggccgcgccagggcatcagtgctgatgtgggagctgtgcttccacctaagccgttggtaggggactgtggcatttaagaatgtagagagcgcatcctttttgatctcctgggcggagtgaacctgcaggggccaccccagaaaccttggttctgatgcactgcaagcaagtaaccagcttctcactccagtttcaagtggctattatgtaatataaattcaaagcacattgtgaatagaacctacatgaaaacatacactttgttgcccactgacatgttaccagaagttgtaccatgatgttgttttgacccctgtgagctgatggccccggccctgctctgtgcacatttctgtccgtgttccccagcactctggttggagagagtccacatcttcagctccgtgtggacatctccctgtacctctgcatcagcacatggatttaagagttatgtaatcgtgagagaatggtgtttgtggtttttccccctctttggctggtggaggataaagttcctgctcttttacctccaagacgagggcctcattgattcacttccagaagtgctgcacttctgaagaacaaggatgcactaaagttagcaagtttataataaagttaaatataaattattttgttttaaaatgcctcaaatttttctttattctaagcagcaaacattaaaataagaatatttcctgctaaatgtaaccatacactttattccacaaaatgttatttaacaagactgagggttttttttaagaaaaaattatttccatccaatatttaaagacttgaattttatttaaacttgaaaatgactttgccttaacttttgtataagacagcttagagtccatggagcccggccctgggttggcgtgagtgggtcagagttactcagttactgcgtggatctcctgtcgctagttttactgagtaagcatactgtagtacaagagctagtagtagtttttgtaatataccttaaagatcttcaacagttgatcttttttcagaatgttggaaaatcctgtaaatgcaaatagtcaatactgtattaaatacgtgcacttggagtgtgcttcgcttgtacagttgtaaataatcagaacatatgaaaaaggtaccctacagagaaaattctgatacagattattgatatattataaatgttgctgttgagcgggatgtagataaactaaatgttgtggtttgaatattattttgatttgttgagattttcttttttctcttacatcggtgtgttgaactgattctgcctctttgctgcaaaagggaattggaaagtcttattaaaagcctccagatgttttcatactcttttaaaatgtatgtaaatgcatactaatcatatctaatgtgaaagagttttaaagtatatagagagcaaaaactggcaggatcgtaagtgaaggtgactagtaatctaattaaaatcacctgcagctaagcatgattgaccctgccagaggaaaacatgcctatttgaccatttcctttaaagcagttgccattattcaaatacagagaaatagccacagggctagtgtttttcaaatgcattttaaagaacatggggatttttttttgtagttgtcagttcactgaccaaaaaaaaaaaaaaaatcagaaataattgatctgtgaaacccaaactctcaatactcagaaagctgggaggcaacctcgaggcctgggcctacgagctgcatcttcgctacggaagggccagggcgccatcagccattcccaaaacacaaggcctgcccgtccgccagtgagtccttggtttttaataatgagaagtcctttcccccaaggtgtgagcattgcagcgcagtgtgtgtgtgtggttagagccagcttagtccttcactttgtcgaccgaagtgggagctcaacagctgcatgaggagggcagcgcgtgcattagccagtcgccactggagggctctgctgccctccggtcaatacactgtagttactgcctagccagcagcagtcttctgcatcaagaactgaaaccttgctcggaggtgatttttatagcatcctttttaattaaaggtgaaatacagattgctatataatgtctgaaaaaacctgatactacttcaagagtttctgctcagaagaaaatgagagttatcataataggaagctgtggcggtccatgccaactgtgctgtgtcacatacagcgatgagagtggctttcatactttttttttttttaagttaacaccctcctttacccccagcagtatctcaggttatagaatcagagatgcagcagtgacaaatggcattttaacttgtaaaatcgtgtgatgatgcttatcattttgaaatagaagaataaaaacctggtcccgtttcaccagacatgaatttcaagtggagtcgtcgttctctgagagtgagtgtcttgacattttcacccaggccctcctgtcatcacatcaccggctgtcactggcgggtggccgtaaacgtcctgcgttgctatattaggatctctgcagttcaggcttcaaaaccagttcagtgtatccgggcgacgggtagtggtggtgcatgcctgtctgtgtgccccgctggcgagctgtagttgcggcttgcgtgcctcgcggcccactacagggctgcagacaatcgaggcgagggcgctggccgccagcagctcacagcgcgggggtcatgtggtcgctcctcgagggtttcgtttttgttctgcttcattaagactggaatcaagcttacatgtaaactattggtaatttaagtttccttttgtgtcattcagtgtaaaactgtctaatttgaaaaaaaatgtaggttatgaaaataaagatttaggcactgtt

SEQ ID NO: 343140 - DNA, 4102 bp, Homo sapiens
ttaaagactgtttttggagtttgcctttcagggttgagtaccgtgtgagggtccattgcccaccgtgggcacctgggacacccttctgttgtcctgagctggcggagccagtgtgggcagcatccggactcttcctaggcttccgcattgcccaagcaggcatagggctgggtagggatggtgttgagtcagcactcttcttcgtcatgccttttctaattttatccattactacagtagcacagagggagtgttctgctgcaggggaaactaaatcattagattttatgaactttttaaaagttaaaaacactagtgaagatggaaacttagttacagttgaaaactcttttatcttaagtgaacttgatttcctgtcttgtccctagagacaccatttcacacaggtaacccaggattgtctgtttccaggaattgcgaaagcccagctacgcagagatttgtcagagaacgagtaaagagcctccttcttccccattgcaaccccaaaaagaacaaaagccaaacactgttggttgtgggaaggaggaaaagaagctggcagagcccgcagagagataccgggagcccccagccctcaagtccacacctggagcccccagagaccagaggcggccggcggggggccggccctcgccctcggccatggggaagcgtctcagccgagagcagagcactccccccaagtctcctcagtgaaaaccgtacgtctgggaggggtcgcagagcgctgtgttaaccacaaacgagacactctcccactcagtgcgagggcgagccgctggttaggagcttgcagtgtctgaggcctgtgggatcctcaagttggttttcttctgtgagttggattctccccctcttgaaaaaaaatcgatttttcaggatttaattaatacaaaccttattttaggttggtgcttaactggaggtgatgcataagtctgatttttttttccaagatagaaaaagcatttatcctaacaaattggtattttttattaagcctccatgtggctctgaatgcaagctatatatagtgagtttttctaaattaagggaactctgcttttttttttttttttttaagtaactggtctgtaagtgcatatctctagaacgtccccgcagatgaatgagggccagtggccttggcagaggcaggtgtggcctcgtagaggcagtgctggccgcgccagggcatcagtgctgatgtgggagctgtgcttccacctaagccgttggtaggggactgtggcatttaagaatgtagagagcgcatcctttttgatctcctgggcggagtgaacctgcaggggccaccccagaaaccttggttctgatgcactgcaagcaagtaaccagcttctcactccagtttcaagtggctattatgtaatataaattcaaagcacattgtgaatagaacctacatgaaaacatacactttgttgcccactgacatgttaccagaagttgtaccatgatgttgttttgacccctgtgagctgatggccccggccctgctctgtgcacatttctgtccgtgttccccagcactctggttggagagagtccacatcttcagctccgtgtggacatctccctgtacctctgcatcagcacatggatttaagagttatgtaatcgtgagagaatggtgtttgtggtttttccccctctttggctggtggaggataaagttcctgctcttttacctccaagacgagggcctcattgattcacttccagaagtgctgcacttctgaagaacaaggatgcactaaagttagcaagtttataataaagttaaatataaattattttgttttaaaatgcctcaaatttttctttattctaagcagcaaacattaaaataagaatatttcctgctaaatgtaaccatacactttattccacaaaatgttatttaacaagactgagggttttttttaagaaaaaattatttccatccaatatttaaagacttgaattttatttaaacttgaaaatgactttgccttaacttttgtataagacagcttagagtccatggagcccggccctgggttggcgtgagtgggtcagagttactcagttactgcgtggatctcctgtcgctagttttactgagtaagcatactgtagtacaagagctagtagtagtttttgtaatataccttaaagatcttcaacagttgatcttttttcagaatgttggaaaatcctgtaaatgcaaatagtcaatactgtattaaatacgtgcacttggagtgtgcttcgcttgtacagttgtaaataatcagaacatatgaaaaaggtaccctacagagaaaattctgatacagattattgatatattataaatgttgctgttgagcgggatgtagataaactaaatgttgtggtttgaatattattttgatttgttgagattttcttttttctcttacatcggtgtgttgaactgattctgcctctttgctgcaaaagggaattggaaagtcttattaaaagcctccagatgttttcatactcttttaaaatgtatgtaaatgcatactaatcatatctaatgtgaaagagttttaaagtatatagagagcaaaaactggcaggatcgtaagtgaaggtgactagtaatctaattaaaatcacctgcagctaagcatgattgaccctgccagaggaaaacatgcctatttgaccatttcctttaaagcagttgccattattcaaatacagagaaatagccacagggctagtgtttttcaaatgcattttaaagaacatggggatttttttttgtagttgtcagttcactgaccaaaaaaaaaaaaaaaatcagaaataattgatctgtgaaacccaaactctcaatactcagaaagctgggaggcaacctcgaggcctgggcctacgagctgcatcttcgctacggaagggccagggcgccatcagccattcccaaaacacaaggcctgcccgtccgccagtgagtccttggtttttaataatgagaagtcctttcccccaaggtgtgagcattgcagcgcagtgtgtgtgtgtggttagagccagcttagtccttcactttgtcgaccgaagtgggagctcaacagctgcatgaggagggcagcgcgtgcattagccagtcgccactggagggctctgctgccctccggtcaatacactgtagttactgcctagccagcagcagtcttctgcatcaagaactgaaaccttgctcggaggtgatttttatagcatcctttttaattaaaggtgaaatacagattgctatataatgtctgaaaaaacctgatactacttcaagagtttctgctcagaagaaaatgagagttatcataataggaagctgtggcggtccatgccaactgtgctgtgtcacatacagcgatgagagtggctttcatactttttttttttttaagttaacaccctcctttacccccagcagtatctcaggttatagaatcagagatgcagcagtgacaaatggcattttaacttgtaaaatcgtgtgatgatgcttatcattttgaaatagaagaataaaaacctggtcccgtttcaccagacatgaatttcaagtggagtcgtcgttctctgagagtgagtgtcttgacattttcacccaggccctcctgtcatcacatcaccggctgtcactggcgggtggccgtaaacgtcctgcgttgctatattaggatctctgcagttcaggcttcaaaaccagttcagtgtatccgggcgacgggtagtggtggtgcatgcctgtctgtgtgccccgctggcgagctgtagttgcggcttgcgtgcctcgcggcccactacagggctgcagacaatcgaggcgagggcgctggccgccagcagctcacagcgcgggggtcatgtggtcgctcctcgagggtttcgtttttgttctgcttcattaagactggaatcaagcttacatgtaaactattggtaatttaagtttccttttgtgtcattcagtgtaaaactgtctaatttgaaaaaaaatgtaggttatgaaaataaagatttaggcactgtt

SEQ ID NO: 343141 - DNA, 2878 bp, Homo sapiens
aagcttgcggccgccgggccccggggttgaggcgaggagcccgcgggcggccggtcgggcggggcggcggcgctgacagcatcctgaggttagcattacacttctcccagtggagcccatgacttctgatcagctgatgcactgcaagcaagtaaccagcttctcactccagtttcaagtggctattatgtaatataaattcaaagcacattgtgaatagaacctacatgaaaacatacactttgttgcccactgacatgttaccagaagttgtaccatgatgttgttttgacccctgtgagctgatggccccggccctgctctgtgcacatttctgtccgtgttccccagcactctggttggagagagtccacatcttcagctccgtgtggacatctccctgtacctctgcatcagcacatggatttaagagttatgtaatcgtgagagaatggtgtttgtggtttttccccctctttggctggtggaggataaagttcctgctcttttacctccaagacgagggcctcattgattcacttccagaagtgctgcacttctgaagaacaaggatgcactaaagttagcaagtttataataaagttaaatataaattattttgttttaaaatgcctcaaatttttctttattctaagcagcaaacattaaaataagaatatttcctgctaaatgtaaccatacactttattccacaaaatgttatttaacaagactgagggttttttttaagaaaaaattatttccatccaatatttaaagacttgaattttatttaaacttgaaaatgactttgccttaacttttgtataagacagcttagagtccatggagcccggccctgggttggcgtgagtgggtcagagttactcagttactgcgtggatctcctgtcgctagttttactgagtaagcatactgtagtacaagagctagtagtagtttttgtaatataccttaaagatcttcaacagttgatcttttttcagaatgttggaaaatcctgtaaatgcaaatagtcaatactgtattaaatacgtgcacttggagtgtgcttcgcttgtacagttgtaaataatcagaacatatgaaaaaggtaccctacagagaaaattctgatacagattattgatatattataaatgttgctgttgagcgggatgtagataaactaaatgttgtggtttgaatattattttgatttgttgagattttcttttttctcttacatcggtgtgttgaactgattctgcctctttgctgcaaaagggaattggaaagtcttattaaaagcctccagatgttttcatactcttttaaaatgtatgtaaatgcatactaatcatatctaatgtgaaagagttttaaagtatatagagagcaaaaactggcaggatcgtaagtgaaggtgactagtaatctaattaaaatcacctgcagctaagcatgattgaccctgccagaggaaaacatgcctatttgaccatttcctttaaagcagttgccattattcaaatacagagaaatagccacagggctagtgtttttcaaatgcattttaaagaacatggggatttttttttgtagttgtcagttcactgaccaaaaaaaaaaaaaaaatcagaaataattgatctgtgaaacccaaactctcaatactcagaaagctgggaggcaacctcgaggcctgggcctacgagctgcatcttcgctacggaagggccagggcgccatcagccattcccaaaacacaaggcctgcccgtccgccagtgagtccttggtttttaataatgagaagtcctttcccccaaggtgtgagcattgcagcgcagtgtgtgtgtgtggttagagccagcttagtccttcactttgtcgaccgaagtgggagctcaacagctgcatgaggagggcagcgcgtgcattagccagtcgccactggagggctctgctgccctccggtcaatacactgtagttactgcctagccagcagcagtcttctgcatcaagaactgaaaccttgctcggaggtgatttttatagcatcctttttaattaaaggtgaaatacagattgctatataatgtctgaaaaaacctgatactacttcaagagtttctgctcagaagaaaatgagagttatcataataggaagctgtggcggtccatgccaactgtgctgtgtcacatacagcgatgagagtggctttcatactttttttttttttaagttaacaccctcctttacccccagcagtatctcaggttatagaatcagagatgcagcagtgacaaatggcattttaacttgtaaaatcgtgtgatgatgcttatcattttgaaatagaagaataaaaacctggtcccgtttcaccagacatgaatttcaagtggagtcgtcgttctctgagagtgagtgtcttgacattttcacccaggccctcctgtcatcacatcaccggctgtcactggcgggtggccgtaaacgtcctgcgttgctatattaggatctctgcagttcaggcttcaaaaccagttcagtgtatccgggcgacgggtagtggtggtgcatgcctgtctgtgtgccccgctggcgagctgtagttgcggcttgcgtgcctcgcggcccactacagggctgcagacaatcgaggcgagggcgctggccgccagcagctcacagcgcgggggtcatgtggtcgctcctcgagggtttcgtttttgttctgcttcattaagactggaatcaagcttacatgtaaactattggtaatttaagtttccttttgtgtcattcagtgtaaaactgtctaatttgaaaaaaaatgtaggttatgaaaataaagatttaggcactgtt

SEQ ID NO: 343142 - DNA, 4052 bp, Homo sapiens
aagcttgcggccgccgggccccggggttgaggcgaggagcccgcgggcggccggtcgggcggggcggcggcgctgacagcatcctgaggttagcattacacttctcccagtggagcccatgacttctgatcaggacgctaaggttgtggctgaaccgcagacgcagagagtccaggagggcaaggacagcgctcatctgatgaatggtcctatatctcaaaccacttctcagacaagttccatcccacctttgagtcaggtaccagcaactaaggtttcagagctgaaccctaatgcagaagtgtggggggctcctgtgttacatctggaagcaagcagtgctgctgacggtgtgagtgctgcatgggaggaggtggctggccaccacgcagaccgtggcccgcagggatcggatgccaatggtgatggtgaccagggccatgagaatgccgcattgccagacccgcaggagtcggacccagcagacatgaacgctctcgctctgggtccctcagaatatgactctctgcctgaaaatagcgagacaggaggaaatgagtctcaaccagacagccaggaagacccccgagaagtacttaaaaaaacattggaattctgcttatctagggagaaccttgctagtgacatgtatcttatatcacagatggatagtgaccagtatgtgccaatcacaacggtggctaacctcgaccacatcaagaagctcagcactgatgtggacttgattgtggaagtgctaagatctttacctttagtccaagtggatgaaaagggagaaaaagtaaggccaaatcaaaatcgctgcatagtaatattgcgtgaaatatctgaatctacccccgtggaagaagtagaagcactatttaaaggagataatttaccaaaatttataaactgtgaatttgcatataatgataattggtttattacatttgaaacagaagctgatgcacaacaggcttacaaataccttcgagaagaagtcaaaacttttcaaggaaaaccaattaaggcacggataaaagcaaaggcaatagctataaacacatttttgccaaagaatggatttagacccctggacgtgagcctgtatgcccagcagcgctacgcgacgtcgttctacttccctcccatgtacagcccccagcagcagttccccctgtacagcctgatcactccccagacgtggtcagcaacgcacagctatcttgacccacccttggtaactccatttccaaatactggatttataaatgggtttacgtctccagcgttcaagcctgcggcgtctcctctgacttctctcagacagtatcctcctcgaagcaggaatcctagtaaatctcatctgcggcatgcgattcctagtgcagagaggggacctgggttattagaaagtccttcaatatttaacttcactgcagatcgattaattaatggtgtccggagtccacaaacaaggcaagcaggtcaaactagaacacggattcaaaacccttcagcatatgccaagagagaggctgggcctgggcgtgtggagccaggcagtctcgaatcctctcctggtttagggaggggaaggaagaattcctttggctaccggaagaaaagggaggagaagtttacaagcagccagacacagtctccaacgccaccaaagcctccgtcgccaagcttcgagctggggctgtccagcttccctccattacctggagctgccggcaatttgaagacagaggacttgtttgaaaacaggctatctagcttgataataggaccatccaaagaaaggaccctcagtgcagacgcaagcgtgaacacccttcctgtagtggtctccagagagccctcggtgccggcttcttgtgctgtatcagcaacgtacgagcgatccccctccccagctcatttacccgatgatcccaaggtggcggagaaacagagggaaacccacagtgtggacagacttccttccgccctcactgcgaccgcgtgtaaatcggtgcaggtgaacggagccgccacggaattgcgaaagcccagctacgcagagatttgtcagagaacgagtaaagagcctccttcttccccattgcaaccccaaaaagaacaaaagccaaacactgttggttgtgggaaggaggaaaagaagctggcagagcccgcagagagataccgggagcccccagccctcaagtccacacctggagcccccagagaccagaggcggccggcggggggccggccctcgccctcggccatggggaagcgtctcagccgagagcagagcactccccccaagtctcctcagtgaaaaccgtacgtctgggaggggtcgcagagcgctgtgttaaccacaaacgagacactctcccactcagtgcgagggcgagccgctggttaggagcttgcagtgtctgaggcctgtgggatcctcaagttggttttcttctgtgagttggattctccccctcttgaaaaaaaatcgatttttcaggatttaattaatacaaaccttattttaggttggtgcttaactggaggtgatgcataagtctgatttttttttccaagatagaaaaagcatttatcctaacaaattggtattttttattaagcctccatgtggctctgaatgcaagctatatatagtgagtttttctaaattaagggaactctgcttttttttttttttttttaagtaactggtctgtaagtgcatatctctagaacgtccccgcagatgaatgagggccagtggccttggcagaggcaggtgtggcctcgtagaggcagtgctggccgcgccagggcatcagtgctgatgtgggagctgtgcttccacctaagccgttggtaggggactgtggcatttaagaatgtagagagcgcatcctttttgatctcctgggcggagtgaacctgcaggggccaccccagaaaccttggttctgatgcactgcaagcaagtaaccagcttctcactccagtttcaagtggctattatgtaatataaattcaaagcacattgtgaatagaacctacatgaaaacatacactttgttgcccactgacatgttaccagaagttgtaccatgatgttgttttgacccctgtgagctgatggccccggccctgctctgtgcacatttctgtccgtgttccccagcactctggttggagagagtccacatcttcagctccgtgtggacatctccctgtacctctgcatcagcacatggatttaagagttatgtaatcgtgagagaatggtgtttgtggtttttccccctctttggctggtggaggataaagttcctgctcttttacctccaagacgagggcctcattgattcacttccagaagtgctgcacttctgaagaacaaggatgcactaaagttagcaagtttataataaagttaaatataaattattttgttttaaaatgcctcaaatttttctttattctaagcagcaaacattaaaataagaatatttcctgctaaatgtaaccatacactttattccacaaaatgttatttaacaagactgagggttttttttaagaaaaaattatttccatccaatatttaaagacttgaattttatttaaacttgaaaatgactttgccttaacttttgtataagacagcttagagtccatggagcccggccctgggttggcgtgagtgggtcagagttactcagttactgcgtggatctcctgtcgctagttttactgagtaagcatactgtagtacaagagctagtagtagtttttgtaatataccttaaagatcttcaacagttgatcttttttcagaatgttggaaaatcctgtaaatgcaaatagtcaatactgtattaaatacgtgcacttggagtgtgcttcgcttgtacagttgtaaataatcagaacatatgaaaaaggtaccctacagagaaaattctgatacagattattgatatattataaatgttgctgttgagcgggatgtagataaactaaatgttgtggtttgaatatta

SEQ ID NO: 343143 - DNA, 3466 bp, Homo sapiens
aagcttgcggccgccgggccccggggttgaggcgaggagcccgcgggcggccggtcgggcggggcggcggcgctgacagcatcctgaggttagcattacacttctcccagtggagcccatgacttctgatcaggacgctaaggttgtggctgaaccgcagacgcagagagtccaggagggcaaggacagcgctcatctgatgaatggtcctatatctcaaaccacttctcagacaagttccatcccacctttgagtcaggtaccagcaactaaggtttcagagctgaaccctaatgcagaagtgtggggggctcctgtgttacatctggaagcaagcagtgctgctgacggtgtgagtgctgcatgggaggaggtggctggccaccacgcagaccgtggcccgcagggatcggatgccaatggtgatggtgaccagggccatgagaatgccgcattgccagacccgcaggagtcggacccagcagacatgaacgctctcgctctgggtccctcagaatatgactctctgcctgaaaatagcgagacaggaggaaatgagtctcaaccagacagccaggaagacccccgagaagtacttaaaaaaacattggaattctgcttatctagggagaaccttgctagtgacatgtatcttatatcacagatggatagtgaccagtatgtgccaatcacaacggtggctaacctcgaccacatcaagaagctcagcactgatgtggacttgattgtggaagtgctaagatctttacctttagtccaagtggatgaaaagggagaaaaagtaaggccaaatcaaaatcgctgcatagtaatattgcgtgaaatatctgaatctacccccgtggaagaagtagaagcactatttaaaggagataatttaccaaaatttataaactgtgaatttgcatataatgataattggtttattacatttgaaacagaagctgatgcacaacaggcttacaaataccttcgagaagaagtcaaaacttttcaaggaaaaccaattaaggcacggataaaagcaaaggcaatagctataaacacatttttgccaaagaatggatttagacccctggacgtgagcctgtatgcccagcagcgctacgcgacgtcgttctacttccctcccatgtacagcccccagcagcagttccccctgtacagcctgatcactccccagacgtggtcagcaacgcacagctatcttgacccacccttggtaactccatttccaaatactggatttataaatgggtttacgtctccagcgttcaagcctgcggcgtctcctctgacttctctcagacagtatcctcctcgaagcaggaatcctagtaaatctcatctgcggcatgcgattcctagtgcagagaggggacctgggttattagaaagtccttcaatatttaacttcactgcagatcgattaattaatggtgtccggagtccacaaacaaggcaagcaggtcaaactagaacacggattcaaaacccttcagcatatgccaagagagaggctgggcctgggcgtgtggagccaggcagtctcgaatcctctcctggtttagggaggggaaggaagaattcctttggctaccggaagaaaagggaggagaagtttacaagcagccagacacagtctccaacgccaccaaagcctccgtcgccaagcttcgagctggggctgtccagcttccctccattacctggagctgccggcaatttgaagacagaggacttgtttgaaaacaggctatctagcttgataataggaccatccaaagaaaggaccctcagtgcagacgcaagcgtgaacacccttcctgtagtggtctccagagagccctcggtgccggcttcttgtgctgtatcagcaacgtacgagcgatccccctccccagctcatttacccgatgatcccaaggtggcggagaaacagagggaaacccacagtgtggacagacttccttccgccctcactgcgaccgcgtgtaaatcggtgcaggtgaacggagccgccacggaattgcgaaagcccagctacgcagagatttgtcagagaacgagtaaagagcctccttcttccccattgcaaccccaaaaagaacaaaagccaaacactgttggttgtgggaaggaggaaaagaagctggcagagcccgcagagagataccgggagcccccagccctcaagtccacacctggagcccccagagaccagaggcggccggcggggggccggccctcgccctcggccatggggaagcgtctcagccgagagcagagcactccccccaagtctcctcagtgaaaaccgtacgtctgggaggggtcgcagagcgctgtgttaaccacaaacgagacactctcccactcagtgcgagggcgagccgctggttaggagcttgcagtgtctgaggcctgtgggatcctcaagttggttttcttctgtgagttggattctccccctcttgaaaaaaaatcgatttttcaggatttaattaatacaaaccttattttaggttggtgcttaactggaggtgatgcataagtctgatttttttttccaagatagaaaaagcatttatcctaacaaattggtattttttattaagcctccatgtggctctgaatgcaagctatatatagtgagtttttctaaattaagggaactctgcttttttttttttttttttaagtaactggtctgtaagtgcatatctctagaacgtccccgcagatgaatgagggccagtggccttggcagaggcaggtgtggcctcgtagaggcagtgctggccgcgccagggcatcagtgctgatgtgggagctgtgcttccacctaagccgttggtaggggactgtggcatttaagaatgtagagagcgcatcctttttgatctcctgggcggagtgaacctgcaggggccaccccagaaaccttggttctgatgcactgcaagcaagtaaccagcttctcactccagtttcaagtggctattatgtaatataaattcaaagcacattgtgaatagaacctacatgaaaacatacactttgttgcccactgacatgttaccagaagttgtaccatgatgttgttttgacccctgtgagctgatggccccggccctgctctgtgcacatttctgtccgtgttccccagcactctggttggagagagtccacatcttcagctccgtgtggacatctccctgtacctctgcatcagcacatggatttaagagttatgtaatcgtgagagaatggtgtttgtggtttttccccctctttggctggtggaggataaagttcctgctcttttacctccaagacgagggcctcattgattcacttccagaagtgctgcacttctgaagaacaaggatgcactaaagttagcaagtttataataaagttaaatataaattattttgtttta

SEQ ID NO: 343144 - DNA, 2092 bp, Homo sapiens
aagcttgcggccgccgggccccggggttgaggcgaggagcccgcgggcggccggtcgggcggggcggcggcgctgacagcatcctgaggttagcattacacttctcccagtggagcccatgacttctgatcaggacgctaaggttgtggctgaaccgcagacgcagagagtccaggagggcaaggacagcgctcatctgatgaatggtcctatatctcaaaccacttctcagacaagttccatcccacctttgagtcaggtaccagcaactaaggtttcagagctgaaccctaatgcagaagtgtggggggctcctgtgttacatctggaagcaagcagtgctgctgacggtgtgagtgctgcatgggaggaggtggctggccaccacgcagaccgtggcccgcagggatcggatgccaatggtgatggtgaccagggccatgagaatgccgcattgccagacccgcaggagtcggacccagcagacatgaacgctctcgctctgggtccctcagaatatgactctctgcctgaaaatagcgagacaggaggaaatgagtctcaaccagacagccaggaagacccccgagaagtacttaaaaaaacattggaattctgcttatctagggagaaccttgctagtgacatgtatcttatatcacagatggatagtgaccagtatgtgccaatcacaacggtggctaacctcgaccacatcaagaagctcagcactgatgtggacttgattgtggaagtgctaagatctttacctttagtccaagtggatgaaaagggagaaaaagtaaggccaaatcaaaatcgctgcatagtaatattgcgtgaaatatctgaatctacccccgtggaagaagtagaagcactatttaaaggagataatttaccaaaatttataaactgtgaatttgcatataatgataattggtttattacatttgaaacagaagctgatgcacaacaggcttacaaataccttcgagaagaagtcaaaacttttcaaggaaaaccaattaaggcacggataaaagcaaaggcaatagctataaacacatttttgccaaagaatggatttagacccctggacgtgagcctgtatgcccagcagcgctacgcgacgtcgttctacttccctcccatgtacagcccccagcagcagttccccctgtacagcctgatcactccccagacgtggtcagcaacgcacagctatcttgacccacccttggtaactccatttccaaatactggatttataaatgggtttacgtctccagcgttcaagcctgcggcgtctcctctgacttctctcagacagtatcctcctcgaagcaggaatcctagtaaatctcatctgcggcatgcgattcctagtgcagagaggggacctgggttattagaaagtccttcaatatttaacttcactgcagatcgattaattaatggtgtccggagtccacaaacaaggcaagcaggtcaaactagaacacggattcaaaacccttcagcatatgccaagagagaggctgggcctgggcgtgtggagccaggcagtctcgaatcctctcctggtttagggaggggaaggaagaattcctttggctaccggaagaaaagggaggagaagtttacagtgagtacataaagcatatacctcttcacaagacatttaaatctaatttataccaaacctgagatttaattaaatggattaaggttaaggcacaagaatgagcatttcaaaagacttgtaacgtgaaatccactaagtaataactgacaccctggctggcctaggaggaagcaactgtagaggttttggaaatagcgatgtgctgcacaggactccacagtgcacaggcgtgttgtgctgtggcacaggcatggccaggaacttgctgtcgcatgcactgcagcctacacacgggtgtgcacgtgagctcttctgtgtggcagctgtaccggagagtctgaaatgactggagccattcatttcaatgagcagagtaagcatcttccacggagcaatttgtttgtcggtgtttttccttcaaaactttcgaatactctcccactg

SEQ ID NO: 343145 - DNA, 600 bp, Homo sapiens
aagcttgcggccgccgggccccggggttgaggcgaggagcccgcgggcggccggtcgggcggggcggcggcgctgacagcatcctgaggttagcattacacttctcccagtggagcccatgacttctgatcaggacgctaaggttgtggctgaaccgcagacgcagagagtccaggagggcaaggacagcgctcatctgatgaatggtcctatatctcaaaccacttctcagacaagttccatcccacctttgagtcaggtaccagcaactaaggtttcagagctgaaccctaatgcagaagtgtggggggctcctgtgttacatctggaagcaagcagtgctgctgacggtgtgagtgctgcatgggaggaggtggctggccaccacgcagaccgtggcccgcagggatcggatgccaatggtgatggtgaccagggccatgagaatgccgcattgccagacccgcaggagtcggacccagcagacatgaacgctctcgctctgggtccctcagaatatgactctctgcctgaaaatagcgagacaggaggaaatgagtctcaaccagacagtcaggagctggtcgaccggtaccggcc

SEQ ID NO: 343146 - DNA, 1349 bp, Homo sapiens
gttatgtgtattaagtctatcgtatctgtcatttctaggtctaatcttttgcattataggtcatattttctatttctttgcatgctttgtgatttttgaggagatgctcggagttttaaattttactttactgaatatttttgtattctaataaatattcttgagctttgttttgaaatgcagtgaagttacctggaaccaactttctaggtggaatcagagcagccttttctctagggctcattttccccactgcggaagcagtgcccttctgagcactgtccctgctatcctgtgtgtttaggagagttttccactgtggccggtgggaaaacaaaccattcctctcttggtgagccttccctgggcttgttccctctcatccctcaggcggttgtttcccaggctgaagatgtggggaaggccatctgcaggcttaccctgccggctctgcggcccaggcactgaaggccaactcccctgttcatgtccctctcagggatcacactcgtgttcacgctggggttcagggcctgaaactgttcttcatgtattttgtctttggttttttaattgagtcatctgggagagtaaatctagtccatcatggccagaagcaaaagtccaagcaaattttttttcttaaattgcctttaaaaaaaaaaaaaaaaaaaaagttgtgcagttatcagcccagaacatgatatgatagttttcacattaatctagcttaatggtatcttgagagtaggggaagctgtaagttgtgtgactgcttttctctatggcattgtgattctgattctggaagccctgctgaaccctcatccttttgggaagagagatttactaggcatcatggtacgtttgtttaaggatagttccttaagagaatgcatttgttaaaaaaattttgggtgaggacaaaaactgacattgttgagaattaatttctaacatctctatttcctgtaggaagtagaagcactatttaaaggagataatttaccaaaatttataaactgtgaatttgcatataatgataattggtttattacatttgaaacagaagctgatgcacaacaggtaagttctttccaccatcaccctatgaattgcatagtttaccagtttttactattagtgcatgttgggactaaacttgggcattgagattacttgtgatggtaagtttgaatataatctgcagaggaaatcaagttgtagaaacttaaatatttgagtgtatttgtatggacaatttttatagcaatataaaaagcatgtgattttactttctaaggacaacaagctaagcaacctaggaaaatcagttttgttcttctatc

SEQ ID NO: 343147 - DNA, 589 bp, Homo sapiens
gaaagtcctgagccccatcagtctgaaaaatgtagaggtagcttagtagaggaaactataagtagtagatgataacaaaaacaaaattgttatagctctagatactcaaatccatttattttttaaatcaaggatatgtagtgatttgtaaatagtttaataacattatagtcactatagtaggatgtatttaaagagttaggattttaatatacatttttttgactacttttgttcatttaaacattttatgtcaagcagtaatatttaaagttccaaagtggctttgagcaaagtagcttttcttagttttccccattgaatctacaaagaactttatctatgatgttcattcagaatttaaaaattttaagcctcctacattctgaatatcttatgaattcatgaatttgtcatgtgaaatgtgcatttcttggtgggtttagttttgcctaattactgtggtttgaaaatatgttgtttctttttaaacattgtactgatgttgtctttgttttcaattttacagatgaatggtcctatatctcaaaccacttctcagacaagttccatcccacctttgagtcag

SEQ ID NO: 343148 - DNA, 428 bp, Homo sapiens
tagtgccccaagtgggaaaggtgcagagtgctttgaaggaactagtgtgaacaaggctgaaggaagagaacgcggctgggaggtaggtggagagttttattttacagagcttgggaggtcccatataggttgattattttgccctttatcctaagaccagtgggaagcagttggaggattttatgtcatagaattgtcttttttaaatgattctgctttgcagagtcgtgtggaagcagggagtggtcacatgtgggtgttactgggcggcaaggtagggaatctctttcttcttgtgtacacctctcttcatagttgaaaaggccaagccccagtctaaatgagaccagccagcttccttaaaatccctttaatttgtattacatataatcgtgtatgtttaaaaaatattttatttttttgagaca

SEQ ID NO: 343149 - DNA, 466 bp, Homo sapiens
atcacttgcctggacttccacgttagtcccttgctgtcaactttgtgttgttctgcttacgcttcctgaagttgggattttagaattgaaagtcatctttgaaaggtttcaaagtgataaagactgaattgatgtgtactttgattatgtgagtgcaaacgtgctcaataataaattctccaagtgggaaaaaaataacagtctttcactttccactcctctaggaagaattcctttggctaccggaagaaaagggaggagaagtttacagtgagtacataaagcatatacctcttcacaagacatttaaatctaatttataccaaacctgagatttaattaaatggattaaggttaaggcacaagaatgagcatttcaaaagacttgtaacgtgaaatccactaagtaataactgacaccctggctggcctaggaggaagcaactgtagaggttttggaaatagc

SEQ ID NO: 343150 - DNA, 5717 bp, Homo sapiens
aagcttgcggccgccgggccccggggttgaggcgaggagcccgcgggcggccggtcgggcggggcggcggcgctgacagcatcctgaggttagcattacacttctcccagtggagcccatgacttctgatcaggacgctaaggttgtggctgaaccgcagacgcagagagtccaggagggcaaggacagcgctcatctgatgaatggtcctatatctcaaaccacttctcagacaagttccatcccacctttgagtcaggtaccagcaactaaggtttcagagctgaaccctaatgcagaagtgtggggggctcctgtgttacatctggaagcaagcagtgctgctgacggtgtgagtgctgcatgggaggaggtggctggccaccacgcagaccgtggcccgcagggatcggatgccaatggtgatggtgaccagggccatgagaatgccgcattgccagacccgcaggagtcggacccagcagacatgaacgctctcgctctgggtccctcagaatatgactctctgcctgaaaatagcgagacaggaggaaatgagtctcaaccagacagccaggaagacccccgagaagtacttaaaaaaacattggaattctgcttatctagggagaaccttgctagtgacatgtatcttatatcacagatggatagtgaccagtatgtgccaatcacaacggtggctaacctcgaccacatcaagaagctcagcactgatgtggacttgattgtggaagtgctaagatctttacctttagtccaagtggatgaaaagggagaaaaagtaaggccaaatcaaaatcgctgcatagtaatattgcgtgaaatatctgaatctacccccgtggaagaagtagaagcactatttaaaggagataatttaccaaaatttataaactgtgaatttgcatataatgataattggtttattacatttgaaacagaagctgatgcacaacaggcttacaaataccttcgagaagaagtcaaaacttttcaaggaaaaccaattaaggcacggataaaagcaaaggcaatagctataaacacatttttgccaaagaatggatttagacccctggacgtgagcctgtatgcccagcagcgctacgcgacgtcgttctacttccctcccatgtacagcccccagcagcagttccccctgtacagcctgatcactccccagacgtggtcagcaacgcacagctatcttgacccacccttggtaactccatttccaaatactggatttataaatgggtttacgtctccagcgttcaagcctgcggcgtctcctctgacttctctcagacagtatcctcctcgaagcaggaatcctagtaaatctcatctgcggcatgcgattcctagtgcagagaggggacctgggttattagaaagtccttcaatatttaacttcactgcagatcgattaattaatggtgtccggagtccacaaacaaggcaagcaggtcaaactagaacacggattcaaaacccttcagcatatgccaagagagaggctgggcctgggcgtgtggagccaggcagtctcgaatcctctcctggtttagggaggggaaggaagaattcctttggctaccggaagaaaagggaggagaagtttacaagcagccagacacagtctccaacgccaccaaagcctccgtcgccaagcttcgagctggggctgtccagcttccctccattacctggagctgccggcaatttgaagacagaggacttgtttgaaaacaggctatctagcttgataataggaccatccaaagaaaggaccctcagtgcagacgcaagcgtgaacacccttcctgtagtggtctccagagagccctcggtgccggcttcttgtgctgtatcagcaacgtacgagcgatccccctccccagctcatttacccgatgatcccaaggtggcggagaaacagagggaaacccacagtgtggacagacttccttccgccctcactgcgaccgcgtgtaaatcggtgcaggtgaacggagccgccacggaattgcgaaagcccagctacgcagagatttgtcagagaacgagtaaagagcctccttcttccccattgcaaccccaaaaagaacaaaagccaaacactgttggttgtgggaaggaggaaaagaagctggcagagcccgcagagagataccgggagcccccagccctcaagtccacacctggagcccccagagaccagaggcggccggcggggggccggccctcgccctcggccatggggaagcgtctcagccgagagcagagcactccccccaagtctcctcagtgaaaaccgtacgtctgggaggggtcgcagagcgctgtgttaaccacaaacgagacactctcccactcagtgcgagggcgagccgctggttaggagcttgcagtgtctgaggcctgtgggatcctcaagttggttttcttctgtgagttggattctccccctcttgaaaaaaaatcgatttttcaggatttaattaatacaaaccttattttaggttggtgcttaactggaggtgatgcataagtctgatttttttttccaagatagaaaaagcatttatcctaacaaattggtattttttattaagcctccatgtggctctgaatgcaagctatatatagtgagtttttctaaattaagggaactctgcttttttttttttttttttaagtaactggtctgtaagtgcatatctctagaacgtccccgcagatgaatgagggccagtggccttggcagaggcaggtgtggcctcgtagaggcagtgctggccgcgccagggcatcagtgctgatgtgggagctgtgcttccacctaagccgttggtaggggactgtggcatttaagaatgtagagagcgcatcctttttgatctcctgggcggagtgaacctgcaggggccaccccagaaaccttggttctgatgcactgcaagcaagtaaccagcttctcactccagtttcaagtggctattatgtaatataaattcaaagcacattgtgaatagaacctacatgaaaacatacactttgttgcccactgacatgttaccagaagttgtaccatgatgttgttttgacccctgtgagctgatggccccggccctgctctgtgcacatttctgtccgtgttccccagcactctggttggagagagtccacatcttcagctccgtgtggacatctccctgtacctctgcatcagcacatggatttaagagttatgtaatcgtgagagaatggtgtttgtggtttttccccctctttggctggtggaggataaagttcctgctcttttacctccaagacgagggcctcattgattcacttccagaagtgctgcacttctgaagaacaaggatgcactaaagttagcaagtttataataaagttaaatataaattattttgttttaaaatgcctcaaatttttctttattctaagcagcaaacattaaaataagaatatttcctgctaaatgtaaccatacactttattccacaaaatgttatttaacaagactgagggttttttttaagaaaaaattatttccatccaatatttaaagacttgaattttatttaaacttgaaaatgactttgccttaacttttgtataagacagcttagagtccatggagcccggccctgggttggcgtgagtgggtcagagttactcagttactgcgtggatctcctgtcgctagttttactgagtaagcatactgtagtacaagagctagtagtagtttttgtaatataccttaaagatcttcaacagttgatcttttttcagaatgttggaaaatcctgtaaatgcaaatagtcaatactgtattaaatacgtgcacttggagtgtgcttcgcttgtacagttgtaaataatcagaacatatgaaaaaggtaccctacagagaaaattctgatacagattattgatatattataaatgttgctgttgagcgggatgtagataaactaaatgttgtggtttgaatattattttgatttgttgagattttcttttttctcttacatcggtgtgttgaactgattctgcctctttgctgcaaaagggaattggaaagtcttattaaaagcctccagatgttttcatactcttttaaaatgtatgtaaatgcatactaatcatatctaatgtgaaagagttttaaagtatatagagagcaaaaactggcaggatcgtaagtgaaggtgactagtaatctaattaaaatcacctgcagctaagcatgattgaccctgccagaggaaaacatgcctatttgaccatttcctttaaagcagttgccattattcaaatacagagaaatagccacagggctagtgtttttcaaatgcattttaaagaacatggggatttttttttgtagttgtcagttcactgaccaaaaaaaaaaaaaaaatcagaaataattgatctgtgaaacccaaactctcaatactcagaaagctgggaggcaacctcgaggcctgggcctacgagctgcatcttcgctacggaagggccagggcgccatcagccattcccaaaacacaaggcctgcccgtccgccagtgagtccttggtttttaataatgagaagtcctttcccccaaggtgtgagcattgcagcgcagtgtgtgtgtgtggttagagccagcttagtccttcactttgtcgaccgaagtgggagctcaacagctgcatgaggagggcagcgcgtgcattagccagtcgccactggagggctctgctgccctccggtcaatacactgtagttactgcctagccagcagcagtcttctgcatcaagaactgaaaccttgctcggaggtgatttttatagcatcctttttaattaaaggtgaaatacagattgctatataatgtctgaaaaaacctgatactacttcaagagtttctgctcagaagaaaatgagagttatcataataggaagctgtggcggtccatgccaactgtgctgtgtcacatacagcgatgagagtggctttcatactttttttttttttaagttaacaccctcctttacccccagcagtatctcaggttatagaatcagagatgcagcagtgacaaatggcattttaacttgtaaaatcgtgtgatgatgcttatcattttgaaatagaagaataaaaacctggtcccgtttcaccagacatgaatttcaagtggagtcgtcgttctctgagagtgagtgtcttgacattttcacccaggccctcctgtcatcacatcaccggctgtcactggcgggtggccgtaaacgtcctgcgttgctatattaggatctctgcagttcaggcttcaaaaccagttcagtgtatccgggcgacgggtagtggtggtgcatgcctgtctgtgtgccccgctggcgagctgtagttgcggcttgcgtgcctcgcggcccactacagggctgcagacaatcgaggcgagggcgctggccgccagcagctcacagcgcgggggtcatgtggtcgctcctcgagggtttcgtttttgttctgcttcattaagactggaatcaagcttacatgtaaactattggtaatttaagtttccttttgtgtcattcagtgtaaaactgtctaatttgaaaaaaaatgtaggttatgaaaataaagatttaggcactgtt

SEQ ID NO: 343151 - DNA, 5768 bp, Homo sapiens
aagcttgcggccgccgggccccggggttgaggcgaggagcccgcgggcggccggtcgggcggggcggcggcgctgacagtcgtgtggaagcagggagtggtcacatgtgggtgttactgggcggcaagagcatcctgaggttagcattacacttctcccagtggagcccatgacttctgatcaggacgctaaggttgtggctgaaccgcagacgcagagagtccaggagggcaaggacagcgctcatctgatgaatggtcctatatctcaaaccacttctcagacaagttccatcccacctttgagtcaggtaccagcaactaaggtttcagagctgaaccctaatgcagaagtgtggggggctcctgtgttacatctggaagcaagcagtgctgctgacggtgtgagtgctgcatgggaggaggtggctggccaccacgcagaccgtggcccgcagggatcggatgccaatggtgatggtgaccagggccatgagaatgccgcattgccagacccgcaggagtcggacccagcagacatgaacgctctcgctctgggtccctcagaatatgactctctgcctgaaaatagcgagacaggaggaaatgagtctcaaccagacagccaggaagacccccgagaagtacttaaaaaaacattggaattctgcttatctagggagaaccttgctagtgacatgtatcttatatcacagatggatagtgaccagtatgtgccaatcacaacggtggctaacctcgaccacatcaagaagctcagcactgatgtggacttgattgtggaagtgctaagatctttacctttagtccaagtggatgaaaagggagaaaaagtaaggccaaatcaaaatcgctgcatagtaatattgcgtgaaatatctgaatctacccccgtggaagaagtagaagcactatttaaaggagataatttaccaaaatttataaactgtgaatttgcatataatgataattggtttattacatttgaaacagaagctgatgcacaacaggcttacaaataccttcgagaagaagtcaaaacttttcaaggaaaaccaattaaggcacggataaaagcaaaggcaatagctataaacacatttttgccaaagaatggatttagacccctggacgtgagcctgtatgcccagcagcgctacgcgacgtcgttctacttccctcccatgtacagcccccagcagcagttccccctgtacagcctgatcactccccagacgtggtcagcaacgcacagctatcttgacccacccttggtaactccatttccaaatactggatttataaatgggtttacgtctccagcgttcaagcctgcggcgtctcctctgacttctctcagacagtatcctcctcgaagcaggaatcctagtaaatctcatctgcggcatgcgattcctagtgcagagaggggacctgggttattagaaagtccttcaatatttaacttcactgcagatcgattaattaatggtgtccggagtccacaaacaaggcaagcaggtcaaactagaacacggattcaaaacccttcagcatatgccaagagagaggctgggcctgggcgtgtggagccaggcagtctcgaatcctctcctggtttagggaggggaaggaagaattcctttggctaccggaagaaaagggaggagaagtttacaagcagccagacacagtctccaacgccaccaaagcctccgtcgccaagcttcgagctggggctgtccagcttccctccattacctggagctgccggcaatttgaagacagaggacttgtttgaaaacaggctatctagcttgataataggaccatccaaagaaaggaccctcagtgcagacgcaagcgtgaacacccttcctgtagtggtctccagagagccctcggtgccggcttcttgtgctgtatcagcaacgtacgagcgatccccctccccagctcatttacccgatgatcccaaggtggcggagaaacagagggaaacccacagtgtggacagacttccttccgccctcactgcgaccgcgtgtaaatcggtgcaggtgaacggagccgccacggaattgcgaaagcccagctacgcagagatttgtcagagaacgagtaaagagcctccttcttccccattgcaaccccaaaaagaacaaaagccaaacactgttggttgtgggaaggaggaaaagaagctggcagagcccgcagagagataccgggagcccccagccctcaagtccacacctggagcccccagagaccagaggcggccggcggggggccggccctcgccctcggccatggggaagcgtctcagccgagagcagagcactccccccaagtctcctcagtgaaaaccgtacgtctgggaggggtcgcagagcgctgtgttaaccacaaacgagacactctcccactcagtgcgagggcgagccgctggttaggagcttgcagtgtctgaggcctgtgggatcctcaagttggttttcttctgtgagttggattctccccctcttgaaaaaaaatcgatttttcaggatttaattaatacaaaccttattttaggttggtgcttaactggaggtgatgcataagtctgatttttttttccaagatagaaaaagcatttatcctaacaaattggtattttttattaagcctccatgtggctctgaatgcaagctatatatagtgagtttttctaaattaagggaactctgcttttttttttttttttttaagtaactggtctgtaagtgcatatctctagaacgtccccgcagatgaatgagggccagtggccttggcagaggcaggtgtggcctcgtagaggcagtgctggccgcgccagggcatcagtgctgatgtgggagctgtgcttccacctaagccgttggtaggggactgtggcatttaagaatgtagagagcgcatcctttttgatctcctgggcggagtgaacctgcaggggccaccccagaaaccttggttctgatgcactgcaagcaagtaaccagcttctcactccagtttcaagtggctattatgtaatataaattcaaagcacattgtgaatagaacctacatgaaaacatacactttgttgcccactgacatgttaccagaagttgtaccatgatgttgttttgacccctgtgagctgatggccccggccctgctctgtgcacatttctgtccgtgttccccagcactctggttggagagagtccacatcttcagctccgtgtggacatctccctgtacctctgcatcagcacatggatttaagagttatgtaatcgtgagagaatggtgtttgtggtttttccccctctttggctggtggaggataaagttcctgctcttttacctccaagacgagggcctcattgattcacttccagaagtgctgcacttctgaagaacaaggatgcactaaagttagcaagtttataataaagttaaatataaattattttgttttaaaatgcctcaaatttttctttattctaagcagcaaacattaaaataagaatatttcctgctaaatgtaaccatacactttattccacaaaatgttatttaacaagactgagggttttttttaagaaaaaattatttccatccaatatttaaagacttgaattttatttaaacttgaaaatgactttgccttaacttttgtataagacagcttagagtccatggagcccggccctgggttggcgtgagtgggtcagagttactcagttactgcgtggatctcctgtcgctagttttactgagtaagcatactgtagtacaagagctagtagtagtttttgtaatataccttaaagatcttcaacagttgatcttttttcagaatgttggaaaatcctgtaaatgcaaatagtcaatactgtattaaatacgtgcacttggagtgtgcttcgcttgtacagttgtaaataatcagaacatatgaaaaaggtaccctacagagaaaattctgatacagattattgatatattataaatgttgctgttgagcgggatgtagataaactaaatgttgtggtttgaatattattttgatttgttgagattttcttttttctcttacatcggtgtgttgaactgattctgcctctttgctgcaaaagggaattggaaagtcttattaaaagcctccagatgttttcatactcttttaaaatgtatgtaaatgcatactaatcatatctaatgtgaaagagttttaaagtatatagagagcaaaaactggcaggatcgtaagtgaaggtgactagtaatctaattaaaatcacctgcagctaagcatgattgaccctgccagaggaaaacatgcctatttgaccatttcctttaaagcagttgccattattcaaatacagagaaatagccacagggctagtgtttttcaaatgcattttaaagaacatggggatttttttttgtagttgtcagttcactgaccaaaaaaaaaaaaaaaatcagaaataattgatctgtgaaacccaaactctcaatactcagaaagctgggaggcaacctcgaggcctgggcctacgagctgcatcttcgctacggaagggccagggcgccatcagccattcccaaaacacaaggcctgcccgtccgccagtgagtccttggtttttaataatgagaagtcctttcccccaaggtgtgagcattgcagcgcagtgtgtgtgtgtggttagagccagcttagtccttcactttgtcgaccgaagtgggagctcaacagctgcatgaggagggcagcgcgtgcattagccagtcgccactggagggctctgctgccctccggtcaatacactgtagttactgcctagccagcagcagtcttctgcatcaagaactgaaaccttgctcggaggtgatttttatagcatcctttttaattaaaggtgaaatacagattgctatataatgtctgaaaaaacctgatactacttcaagagtttctgctcagaagaaaatgagagttatcataataggaagctgtggcggtccatgccaactgtgctgtgtcacatacagcgatgagagtggctttcatactttttttttttttaagttaacaccctcctttacccccagcagtatctcaggttatagaatcagagatgcagcagtgacaaatggcattttaacttgtaaaatcgtgtgatgatgcttatcattttgaaatagaagaataaaaacctggtcccgtttcaccagacatgaatttcaagtggagtcgtcgttctctgagagtgagtgtcttgacattttcacccaggccctcctgtcatcacatcaccggctgtcactggcgggtggccgtaaacgtcctgcgttgctatattaggatctctgcagttcaggcttcaaaaccagttcagtgtatccgggcgacgggtagtggtggtgcatgcctgtctgtgtgccccgctggcgagctgtagttgcggcttgcgtgcctcgcggcccactacagggctgcagacaatcgaggcgagggcgctggccgccagcagctcacagcgcgggggtcatgtggtcgctcctcgagggtttcgtttttgttctgcttcattaagactggaatcaagcttacatgtaaactattggtaatttaagtttccttttgtgtcattcagtgtaaaactgtctaatttgaaaaaaaatgtaggttatgaaaataaagatttaggcactgtt

SEQ ID NO: 343152 - DNA, 5663 bp, Homo sapiens
aagcttgcggccgccgggccccggggttgaggcgaggagcccgcgggcggccggtcgggcggggcggcggcgctgacagcatcctgaggttagcattacacttctcccagtggagcccatgacttctgatcaggacgctaaggttgtggctgaaccgcagacgcagagagtccaggagggcaaggacagcgctcatctgatgaatggtcctatatctcaaaccacttctcagacaagttccatcccacctttgagtcaggtaccagcaactaaggtttcagagctgaaccctaatgcagaagtgtggggggctcctgtgttacatctggaagcaagcagtgctgctgacggtgtgagtgctgcatgggaggaggtggctggccaccacgcagaccgtggcccgcagggatcggatgccaatggtgatggtgaccagggccatgagaatgccgcattgccagacccgcaggagtcggacccagcagacatgaacgctctcgctctgggtccctcagaatatgactctctgcctgaaaatagcgagacaggaggaaatgagtctcaaccagacagccaggaagacccccgagaagtacttaaaaaaacattggaattctgcttatctagggagaaccttgctagtgacatgtatcttatatcacagatggatagtgaccagtatgtgccaatcacaacggtggctaacctcgaccacatcaagaagctcagcactgatgtggacttgattgtggaagtgctaagatctttacctttagtccaagtggatgaaaagggagaaaaagtaaggccaaatcaaaatcgctgcatagtaatattgcgtgaaatatctgaatctacccccgtggaagaagtagaagcactatttaaaggagataatttaccaaaatttataaactgtgaatttgcatataatgataattggtttattacatttgaaacagaagctgatgcacaacaggcttacaaataccttcgagaagaagtcaaaacttttcaaggaaaaccaattaaggcacggataaaagcaaaggcaatagctataaacacatttttgccaaagaatggatttagacccctggacgtgagcctgtatgcccagcagcgctacgcgacgtcgttctacttccctcccatgtacagcccccagcagcagttccccctgtacagcctgatcactccccagacgtggtcagcaacgcacagctatcttgacccacccttggtaactccatttccaaatactggatttataaatgggtttacgtctccagcgttcaagcctgcggcgtctcctctgacttctctcagacagtatcctcctcgaagcaggaatcctagtaaatctcatctgcggcatgcgattcctagtgcagagaggggacctgggttattagaaagtccttcaatatttaacttcactgcagatcgattaattaatggtgtccggagtccacaaacaaggcaagcaggtcaaactagaacacggattcaaaacccttcagcatatgccaagagagaggctgggcctgggcgtgtggagccaggcagtctcgaatcctctcctggtttagggaggggaaggaagaattcctttggctaccggaagaaaagggaggagaagtttacaagcagccagacacagtctccaacgccaccaaagcctccgtcgccaagcttcgagctggggctgtccagcttccctccattacctggagctgccggcaatttgaagacagaggacttgtttgaaaacaggctatctagcttgataataggaccatccaaagaaaggaccctcagtgcagacgcaagcgtgaacacccttcctgtagtggtctccagagagccctcggtgccggcttcttgtgctgtatcagcaacgtacgagcgatccccctccccagctcatttacccgatgatcccaaggtggcggagaaacagagggaaacccacagtgtggacagacttccttccgccctcactgcgaccgcgtgtaaatcggtgcaggtgaacggagccgccacggaattgcgaaagcccagctacgcagagatttgtcagagaacgagtaaagagcctccttcttccccattgcaaccccaaaaagaacaaaagccaaacactgttggttgtgggaaggaggaaaagaagctggcagagcccgcagagagataccgggagcccccagccctcaagtccacacctggagcccccagagaccagaggcggccggcggggggccggccctcgccctcggccatggggaagcgtctcagccgagagcagagcactccccccaagtctcctcagtgaaaaccgtacgtctgggaggggtcgcagagcgctgtgttaaccacaaacgagacactctcccactcagtgcgagggcgagccgctggttaggagcttgcagtgtctgaggcctgtgggatcctcaagttggttttcttctgtgagttggattctccccctcttgaaaaaaaatcgatttttcaggatttaattaatacaaaccttattttaggttggtgcttaactggaggtgatgcataagtctgatttttttttccaagatagagaatgcaagctatatatagtgagtttttctaaattaagggaactctgcttttttttttttttttttaagtaactggtctgtaagtgcatatctctagaacgtccccgcagatgaatgagggccagtggccttggcagaggcaggtgtggcctcgtagaggcagtgctggccgcgccagggcatcagtgctgatgtgggagctgtgcttccacctaagccgttggtaggggactgtggcatttaagaatgtagagagcgcatcctttttgatctcctgggcggagtgaacctgcaggggccaccccagaaaccttggttctgatgcactgcaagcaagtaaccagcttctcactccagtttcaagtggctattatgtaatataaattcaaagcacattgtgaatagaacctacatgaaaacatacactttgttgcccactgacatgttaccagaagttgtaccatgatgttgttttgacccctgtgagctgatggccccggccctgctctgtgcacatttctgtccgtgttccccagcactctggttggagagagtccacatcttcagctccgtgtggacatctccctgtacctctgcatcagcacatggatttaagagttatgtaatcgtgagagaatggtgtttgtggtttttccccctctttggctggtggaggataaagttcctgctcttttacctccaagacgagggcctcattgattcacttccagaagtgctgcacttctgaagaacaaggatgcactaaagttagcaagtttataataaagttaaatataaattattttgttttaaaatgcctcaaatttttctttattctaagcagcaaacattaaaataagaatatttcctgctaaatgtaaccatacactttattccacaaaatgttatttaacaagactgagggttttttttaagaaaaaattatttccatccaatatttaaagacttgaattttatttaaacttgaaaatgactttgccttaacttttgtataagacagcttagagtccatggagcccggccctgggttggcgtgagtgggtcagagttactcagttactgcgtggatctcctgtcgctagttttactgagtaagcatactgtagtacaagagctagtagtagtttttgtaatataccttaaagatcttcaacagttgatcttttttcagaatgttggaaaatcctgtaaatgcaaatagtcaatactgtattaaatacgtgcacttggagtgtgcttcgcttgtacagttgtaaataatcagaacatatgaaaaaggtaccctacagagaaaattctgatacagattattgatatattataaatgttgctgttgagcgggatgtagataaactaaatgttgtggtttgaatattattttgatttgttgagattttcttttttctcttacatcggtgtgttgaactgattctgcctctttgctgcaaaagggaattggaaagtcttattaaaagcctccagatgttttcatactcttttaaaatgtatgtaaatgcatactaatcatatctaatgtgaaagagttttaaagtatatagagagcaaaaactggcaggatcgtaagtgaaggtgactagtaatctaattaaaatcacctgcagctaagcatgattgaccctgccagaggaaaacatgcctatttgaccatttcctttaaagcagttgccattattcaaatacagagaaatagccacagggctagtgtttttcaaatgcattttaaagaacatggggatttttttttgtagttgtcagttcactgaccaaaaaaaaaaaaaaaatcagaaataattgatctgtgaaacccaaactctcaatactcagaaagctgggaggcaacctcgaggcctgggcctacgagctgcatcttcgctacggaagggccagggcgccatcagccattcccaaaacacaaggcctgcccgtccgccagtgagtccttggtttttaataatgagaagtcctttcccccaaggtgtgagcattgcagcgcagtgtgtgtgtgtggttagagccagcttagtccttcactttgtcgaccgaagtgggagctcaacagctgcatgaggagggcagcgcgtgcattagccagtcgccactggagggctctgctgccctccggtcaatacactgtagttactgcctagccagcagcagtcttctgcatcaagaactgaaaccttgctcggaggtgatttttatagcatcctttttaattaaaggtgaaatacagattgctatataatgtctgaaaaaacctgatactacttcaagagtttctgctcagaagaaaatgagagttatcataataggaagctgtggcggtccatgccaactgtgctgtgtcacatacagcgatgagagtggctttcatactttttttttttttaagttaacaccctcctttacccccagcagtatctcaggttatagaatcagagatgcagcagtgacaaatggcattttaacttgtaaaatcgtgtgatgatgcttatcattttgaaatagaagaataaaaacctggtcccgtttcaccagacatgaatttcaagtggagtcgtcgttctctgagagtgagtgtcttgacattttcacccaggccctcctgtcatcacatcaccggctgtcactggcgggtggccgtaaacgtcctgcgttgctatattaggatctctgcagttcaggcttcaaaaccagttcagtgtatccgggcgacgggtagtggtggtgcatgcctgtctgtgtgccccgctggcgagctgtagttgcggcttgcgtgcctcgcggcccactacagggctgcagacaatcgaggcgagggcgctggccgccagcagctcacagcgcgggggtcatgtggtcgctcctcgagggtttcgtttttgttctgcttcattaagactggaatcaagcttacatgtaaactattggtaatttaagtttccttttgtgtcattcagtgtaaaactgtctaatttgaaaaaaaatgtaggttatgaaaataaagatttaggcactgtt

SEQ ID NO: 343153 - DNA, 5663 bp, Homo sapiens
aagcttgcggccgccgggccccggggttgaggcgaggagcccgcgggcggccggtcgggcggggcggcggcgctgacagcatcctgaggttagcattacacttctcccagtggagcccatgacttctgatcaggacgctaaggttgtggctgaaccgcagacgcagagagtccaggagggcaaggacagcgctcatctgatgaatggtcctatatctcaaaccacttctcagacaagttccatcccacctttgagtcaggtaccagcaactaaggtttcagagctgaaccctaatgcagaagtgtggggggctcctgtgttacatctggaagcaagcagtgctgctgacggtgtgagtgctgcatgggaggaggtggctggccaccacgcagaccgtggcccgcagggatcggatgccaatggtgatggtgaccagggccatgagaatgccgcattgccagacccgcaggagtcggacccagcagacatgaacgctctcgctctgggtccctcagaatatgactctctgcctgaaaatagcgagacaggaggaaatgagtctcaaccagacagccaggaagacccccgagaagtacttaaaaaaacattggaattctgcttatctagggagaaccttgctagtgacatgtatcttatatcacagatggatagtgaccagtatgtgccaatcacaacggtggctaacctcgaccacatcaagaagctcagcactgatgtggacttgattgtggaagtgctaagatctttacctttagtccaagtggatgaaaagggagaaaaagtaaggccaaatcaaaatcgctgcatagtaatattgcgtgaaatatctgaatctacccccgtggaagaagtagaagcactatttaaaggagataatttaccaaaatttataaactgtgaatttgcatataatgataattggtttattacatttgaaacagaagctgatgcacaacaggcttacaaataccttcgagaagaagtcaaaacttttcaaggaaaaccaattaaggcacggataaaagcaaaggcaatagctataaacacatttttgccaaagaatggatttagacccctggacgtgagcctgtatgcccagcagcgctacgcgacgtcgttctacttccctcccatgtacagcccccagcagcagttccccctgtacagcctgatcactccccagacgtggtcagcaacgcacagctatcttgacccacccttggtaactccatttccaaatactggatttataaatgggtttacgtctccagcgttcaagcctgcggcgtctcctctgacttctctcagacagtatcctcctcgaagcaggaatcctagtaaatctcatctgcggcatgcgattcctagtgcagagaggggacctgggttattagaaagtccttcaatatttaacttcactgcagatcgattaattaatggtgtccggagtccacaaacaaggcaagcaggtcaaactagaacacggattcaaaacccttcagcatatgccaagagagaggctgggcctgggcgtgtggagccaggcagtctcgaatcctctcctggtttagggaggggaaggaagaattcctttggctaccggaagaaaagggaggagaagtttacaagcagccagacacagtctccaacgccaccaaagcctccgtcgccaagcttcgagctggggctgtccagcttccctccattacctggagctgccggcaatttgaagacagaggacttgtttgaaaacaggctatctagcttgataataggaccatccaaagaaaggaccctcagtgcagacgcaagcgtgaacacccttcctgtagtggtctccagagagccctcggtgccggcttcttgtgctgtatcagcaacgtacgagcgatccccctccccagctcatttacccgatgatcccaaggtggcggagaaacagagggaaacccacagtgtggacagacttccttccgccctcactgcgaccgcgtgtaaatcggtgcaggtgaacggagccgccacggaattgcgaaagcccagctacgcagagatttgtcagagaacgagtaaagagcctccttcttccccattgcaaccccaaaaagaacaaaagccaaacactgttggttgtgggaaggaggaaaagaagctggcagagcccgcagagagataccgggagcccccagccctcaagtccacacctggagcccccagagaccagaggcggccggcggggggccggccctcgccctcggccatggggaagcgtctcagccgagagcagagcactccccccaagtctcctcagtgaaaaccgtacgtctgggaggggtcgcagagcgctgtgttaaccacaaacgagacactctcccactcagtgcgagggcgagccgctggttaggagcttgcagtgtctgaggcctgtgggatcctcaagttggttttcttctgtgagttggattctccccctcttgaaaaaaaatcgatttttcaggatttaattaatacaaaccttattttaggttggtgcttaactggaggtgatgcataagtctgatttttttttccaagatagaaaaagcatttatcctaacaaattggtattttttattaagcctccatgtggctctgaatgcaagctatatatagtgagtttttctaaattaagggaactctgcttttttttttttttttttaagtaactggtctgtaagtgcatatctctagaacgtccccgcagatgaatgagggccagtggccttggcagaggcaggtgtggcctcgtagaggcagtgctggccgcgccagggcatcagtgctgatgtgggagctgtgcttccacctaagccgttggtaggggactgtggcatttaagaatgtagagagcgcatcctttttgatctcctgggcggagtgaacctgcaggggccaccccagaaaccttggttctgatgcactgcaagcaagtaaccagcttctcactccagtttcaagtggctattatgtaatataaattcaaagcacattgtgaatagaacctacatgaaaacatacactttgttgcccactgacatgttaccagaagttgtaccatgatgttgttttgacccctgtgagctgatggccccggccctgctctgtgcacatttctgtccgtgttccccagcactctggttggagagagtccacatcttcagctccgtgtggacatctccctgtacctctgcatcagcacatggatttaagagttatgtaatcgtgagagaatggtgtttgtggtttttccccctctttggctggtggaggataaagttcctgctcttttacctccaagacgagggcctcattgattcacttccagaagtgctgcacttctgaagaacaaggatgcactaaagttagcaagtttataataaagttaaatataaattattttgttttaaaatgcctcaaatttttctttattctaagcagcaaacattaaaataagaatatttcctgctaaatgtaaccatacactttattccacaaaatgttatttaacaagactgagggttttttttaagaaaaaattatttccatccaatatttaaagacttgaattttatttaaacttgaaaatgactttgccttaacttttgtataagacagcttagagtccatggagcccggccctgggttggcgtgagtgggtcagagttactcagttactgcgtggatctcctgtcgctagttttactgagtaagcatactgtagtacaagagctagtagtagtttttgtaatataccttaaagatcttcaacagttgatcttttttcagaatgttggaaaatcctgtaaatgcaaatagtcaatactgtattaaatacgtgcacttggagtgtgcttcgcttgtacagttgtaaataatcagaacatatgaaaaaggtaccctacagagaaaattctgatacagattattgatatattataaatgttgctgttgagcgggatgtagataaactaaatgttgtggtttgaatattattttgatttgttgagattttcttttttctcttacatcggtgtgttgaactgattctgcctctttgctgcaaaagggaattggaaagtcttattaaaagcctccagatgttttcatactcttttaaaatgtatgtaaatgcatactaatcatatctaatgtgaaagagttttaaagtatatagagagcaaaaactggcaggatcgtaagtgaaggtgactagtaatctaattaaaatcacctgcagctaagcatgattgaccctgccagaggaaaacatgcctatttgaccatttcctttaaagcagttgccattattcaaatacagagaaatagccacagggctagtgtttttcaaatgcattttaaagaacatggggatttttttttgtagttgtcagttcactgaccaaaaaaaaaaaaaaaatcagaaataattgatctgtgaaacccaaactctcaatactcagaaagctgggaggcaacctcgaggcctgggcctacgagctgcatcttcgctacggaagggccagggcgccatcagccattcccatcctttcccccaaggtgtgagcattgcagcgcagtgtgtgtgtgtggttagagccagcttagtccttcactttgtcgaccgaagtgggagctcaacagctgcatgaggagggcagcgcgtgcattagccagtcgccactggagggctctgctgccctccggtcaatacactgtagttactgcctagccagcagcagtcttctgcatcaagaactgaaaccttgctcggaggtgatttttatagcatcctttttaattaaaggtgaaatacagattgctatataatgtctgaaaaaacctgatactacttcaagagtttctgctcagaagaaaatgagagttatcataataggaagctgtggcggtccatgccaactgtgctgtgtcacatacagcgatgagagtggctttcatactttttttttttttaagttaacaccctcctttacccccagcagtatctcaggttatagaatcagagatgcagcagtgacaaatggcattttaacttgtaaaatcgtgtgatgatgcttatcattttgaaatagaagaataaaaacctggtcccgtttcaccagacatgaatttcaagtggagtcgtcgttctctgagagtgagtgtcttgacattttcacccaggccctcctgtcatcacatcaccggctgtcactggcgggtggccgtaaacgtcctgcgttgctatattaggatctctgcagttcaggcttcaaaaccagttcagtgtatccgggcgacgggtagtggtggtgcatgcctgtctgtgtgccccgctggcgagctgtagttgcggcttgcgtgcctcgcggcccactacagggctgcagacaatcgaggcgagggcgctggccgccagcagctcacagcgcgggggtcatgtggtcgctcctcgagggtttcgtttttgttctgcttcattaagactggaatcaagcttacatgtaaactattggtaatttaagtttccttttgtgtcattcagtgtaaaactgtctaatttgaaaaaaaatgtaggttatgaaaataaagatttaggcactgtt

SEQ ID NO: 343154 - DNA, 5824 bp, Homo sapiens
gttatgtgtattaagtctatcgtatctgtcatttctaggtctaatcttttgcattataggtcatattttctatttctttgcatgctttgtgatttttgaggagatgctcggagttttaaattttactttactgaatatttttgtattctaataaatattcttgagctttgttttgaaatgcagtgaagttacctggaaccaactttctaggtggaatcagagcagccttttctctagggctcattttccccactgcggaagcagtgcccttctgagcactgtccctgctatcctgtgtgtttaggagagttttccactgtggccggtgggaaaacaaaccattcctctcttggtgagccttccctgggcttgttccctctcatccctcaggcggttgtttcccaggctgaagatgtggggaaggccatctgcaggcttaccctgccggctctgcggcccaggcactgaaggccaactcccctgttcatgtccctctcagggatcacactcgtgttcacgctggggttcagggcctgaaactgttcttcatgtattttgtctttggttttttaattgagtcatctgggagagtaaatctagtccatcatggccagaagcaaaagtccaagcaaattttttttcttaaattgcctttaaaaaaaaaaaaaaaaaaaaagttgtgcagttatcagcccagaacatgatatgatagttttcacattaatctagcttaatggtatcttgagagtaggggaagctgtaagttgtgtgactgcttttctctatggcattgtgattctgattctggaagccctgctgaaccctcatccttttgggaagagagatttactaggcatcatggtacgtttgtttaaggatagttccttaagagaatgcatttgttaaaaaaattttgggtgaggacaaaaactgacattgttgagaattaatttctaacatctctatttcctgtaggaagtagaagcactatttaaaggagataatttaccaaaatttataaactgtgaatttgcatataatgataattggtttattacatttgaaacagaagctgatgcacaacaggcttacaaataccttcgagaagaagtcaaaacttttcaaggaaaaccaattaaggcacggataaaagcaaaggcaatagctataaacacatttttgccaaagaatggatttagacccctggacgtgagcctgtatgcccagcagcgctacgcgacgtcgttctacttccctcccatgtacagcccccagcagcagttccccctgtacagcctgatcactccccagacgtggtcagcaacgcacagctatcttgacccacccttggtaactccatttccaaatactggatttataaatgggtttacgtctccagcgttcaagcctgcggcgtctcctctgacttctctcagacagtatcctcctcgaagcaggaatcctagtaaatctcatctgcggcatgcgattcctagtgcagagaggggacctgggttattagaaagtccttcaatatttaacttcactgcagatcgattaattaatggtgtccggagtccacaaacaaggcaagcaggtcaaactagaacacggattcaaaacccttcagcatatgccaagagagaggctgggcctgggcgtgtggagccaggcagtctcgaatcctctcctggtttagggaggggaaggaagaattcctttggctaccggaagaaaagggaggagaagtttacaagcagccagacacagtctccaacgccaccaaagcctccgtcgccaagcttcgagctggggctgtccagcttccctccattacctggagctgccggcaatttgaagacagaggacttgtttgaaaacaggctatctagcttgataataggaccatccaaagaaaggaccctcagtgcagacgcaagcgtgaacacccttcctgtagtggtctccagagagccctcggtgccggcttcttgtgctgtatcagcaacgtacgagcgatccccctccccagctcatttacccgatgatcccaaggtggcggagaaacagagggaaacccacagtgtggacagacttccttccgccctcactgcgaccgcgtgtaaatcggtgcaggtgaacggagccgccacggaattgcgaaagcccagctacgcagagatttgtcagagaacgagtaaagagcctccttcttccccattgcaaccccaaaaagaacaaaagccaaacactgttggttgtgggaaggaggaaaagaagctggcagagcccgcagagagataccgggagcccccagccctcaagtccacacctggagcccccagagaccagaggcggccggcggggggccggccctcgccctcggccatggggaagcgtctcagccgagagcagagcactccccccaagtctcctcagtgaaaaccgtacgtctgggaggggtcgcagagcgctgtgttaaccacaaacgagacactctcccactcagtgcgagggcgagccgctggttaggagcttgcagtgtctgaggcctgtgggatcctcaagttggttttcttctgtgagttggattctccccctcttgaaaaaaaatcgatttttcaggatttaattaatacaaaccttattttaggttggtgcttaactggaggtgatgcataagtctgatttttttttccaagatagaaaaagcatttatcctaacaaattggtattttttattaagcctccatgtggctctgaatgcaagctatatatagtgagtttttctaaattaagggaactctgcttttttttttttttttttaagtaactggtctgtaagtgcatatctctagaacgtccccgcagatgaatgagggccagtggccttggcagaggcaggtgtggcctcgtagaggcagtgctggccgcgccagggcatcagtgctgatgtgggagctgtgcttccacctaagccgttggtaggggactgtggcatttaagaatgtagagagcgcatcctttttgatctcctgggcggagtgaacctgcaggggccaccccagaaaccttggttctgatgcactgcaagcaagtaaccagcttctcactccagtttcaagtggctattatgtaatataaattcaaagcacattgtgaatagaacctacatgaaaacatacactttgttgcccactgacatgttaccagaagttgtaccatgatgttgttttgacccctgtgagctgatggccccggccctgctctgtgcacatttctgtccgtgttccccagcactctggttggagagagtccacatcttcagctccgtgtggacatctccctgtacctctgcatcagcacatggatttaagagttatgtaatcgtgagagaatggtgtttgtggtttttccccctctttggctggtggaggataaagttcctgctcttttacctccaagacgagggcctcattgattcacttccagaagtgctgcacttctgaagaacaaggatgcactaaagttagcaagtttataataaagttaaatataaattattttgttttaaaatgcctcaaatttttctttattctaagcagcaaacattaaaataagaatatttcctgctaaatgtaaccatacactttattccacaaaatgttatttaacaagactgagggttttttttaagaaaaaattatttccatccaatatttaaagacttgaattttatttaaacttgaaaatgactttgccttaacttttgtataagacagcttagagtccatggagcccggccctgggttggcgtgagtgggtcagagttactcagttactgcgtggatctcctgtcgctagttttactgagtaagcatactgtagtacaagagctagtagtagtttttgtaatataccttaaagatcttcaacagttgatcttttttcagaatgttggaaaatcctgtaaatgcaaatagtcaatactgtattaaatacgtgcacttggagtgtgcttcgcttgtacagttgtaaataatcagaacatatgaaaaaggtaccctacagagaaaattctgatacagattattgatatattataaatgttgctgttgagcgggatgtagataaactaaatgttgtggtttgaatattattttgatttgttgagattttcttttttctcttacatcggtgtgttgaactgattctgcctctttgctgcaaaagggaattggaaagtcttattaaaagcctccagatgttttcatactcttttaaaatgtatgtaaatgcatactaatcatatctaatgtgaaagagttttaaagtatatagagagcaaaaactggcaggatcgtaagtgaaggtgactagtaatctaattaaaatcacctgcagctaagcatgattgaccctgccagaggaaaacatgcctatttgaccatttcctttaaagcagttgccattattcaaatacagagaaatagccacagggctagtgtttttcaaatgcattttaaagaacatggggatttttttttgtagttgtcagttcactgaccaaaaaaaaaaaaaaaatcagaaataattgatctgtgaaacccaaactctcaatactcagaaagctgggaggcaacctcgaggcctgggcctacgagctgcatcttcgctacggaagggccagggcgccatcagccattcccaaaacacaaggcctgcccgtccgccagtgagtccttggtttttaataatgagaagtcctttcccccaaggtgtgagcattgcagcgcagtgtgtgtgtgtggttagagccagcttagtccttcactttgtcgaccgaagtgggagctcaacagctgcatgaggagggcagcgcgtgcattagccagtcgccactggagggctctgctgccctccggtcaatacactgtagttactgcctagccagcagcagtcttctgcatcaagaactgaaaccttgctcggaggtgatttttatagcatcctttttaattaaaggtgaaatacagattgctatataatgtctgaaaaaacctgatactacttcaagagtttctgctcagaagaaaatgagagttatcataataggaagctgtggcggtccatgccaactgtgctgtgtcacatacagcgatgagagtggctttcatactttttttttttttaagttaacaccctcctttacccccagcagtatctcaggttatagaatcagagatgcagcagtgacaaatggcattttaacttgtaaaatcgtgtgatgatgcttatcattttgaaatagaagaataaaaacctggtcccgtttcaccagacatgaatttcaagtggagtcgtcgttctctgagagtgagtgtcttgacattttcacccaggccctcctgtcatcacatcaccggctgtcactggcgggtggccgtaaacgtcctgcgttgctatattaggatctctgcagttcaggcttcaaaaccagttcagtgtatccgggcgacgggtagtggtggtgcatgcctgtctgtgtgccccgctggcgagctgtagttgcggcttgcgtgcctcgcggcccactacagggctgcagacaatcgaggcgagggcgctggccgccagcagctcacagcgcgggggtcatgtggtcgctcctcgagggtttcgtttttgttctgcttcattaagactggaatcaagcttacatgtaaactattggtaatttaagtttccttttgtgtcattcagtgtaaaactgtctaatttgaaaaaaaatgtaggttatgaaaataaagatttaggcactgtt

SEQ ID NO: 343155 - DNA, 4074 bp, Homo sapiens
gggcagaggatagtcctgggctctgtgacatttttgctggagaagaccctcttcccctatgtccttgtgctgctctcccaaggctgttcacgggtggggtgaacgggcactggtaccagctccgcttagtgccggcaggactctgatgaacactcttgaccctgtttcagaccctcagtgcagacgcaagcgtgaacacccttcctgtagtggtctccagagagccctcggtgccggcttcttgtgctgtatcagcaacgtacgagcgatccccctccccagctcatttacccgatgatcccaaggtggcggagaaacagagggaaacccacagtgtggacagacttccttccgccctcactgcgaccgcgtgtaaatcggtgcaggtgaacggagccgccacggaattgcgaaagcccagctacgcagagatttgtcagagaacgagtaaagagcctccttcttccccattgcaaccccaaaaagaacaaaagccaaacactgttggttgtgggaaggaggaaaagaagctggcagagcccgcagagagataccgggagcccccagccctcaagtccacacctggagcccccagagaccagaggcggccggcggggggccggccctcgccctcggccatggggaagcgtctcagccgagagcagagcactccccccaagtctcctcagtgaaaaccgtacgtctgggaggggtcgcagagcgctgtgttaaccacaaacgagacactctcccactcagtgcgagggcgagccgctggttaggagcttgcagtgtctgaggcctgtgggatcctcaagttggttttcttctgtgagttggattctccccctcttgaaaaaaaatcgatttttcaggatttaattaatacaaaccttattttaggttggtgcttaactggaggtgatgcataagtctgatttttttttccaagatagaaaaagcatttatcctaacaaattggtattttttattaagcctccatgtggctctgaatgcaagctatatatagtgagtttttctaaattaagggaactctgcttttttttttttttttttaagtaactggtctgtaagtgcatatctctagaacgtccccgcagatgaatgagggccagtggccttggcagaggcaggtgtggcctcgtagaggcagtgctggccgcgccagggcatcagtgctgatgtgggagctgtgcttccacctaagccgttggtaggggactgtggcatttaagaatgtagagagcgcatcctttttgatctcctgggcggagtgaacctgcaggggccaccccagaaaccttggttctgatgcactgcaagcaagtaaccagcttctcactccagtttcaagtggctattatgtaatataaattcaaagcacattgtgaatagaacctacatgaaaacatacactttgttgcccactgacatgttaccagaagttgtaccatgatgttgttttgacccctgtgagctgatggccccggccctgctctgtgcacatttctgtccgtgttccccagcactctggttggagagagtccacatcttcagctccgtgtggacatctccctgtacctctgcatcagcacatggatttaagagttatgtaatcgtgagagaatggtgtttgtggtttttccccctctttggctggtggaggataaagttcctgctcttttacctccaagacgagggcctcattgattcacttccagaagtgctgcacttctgaagaacaaggatgcactaaagttagcaagtttataataaagttaaatataaattattttgttttaaaatgcctcaaatttttctttattctaagcagcaaacattaaaataagaatatttcctgctaaatgtaaccatacactttattccacaaaatgttatttaacaagactgagggttttttttaagaaaaaattatttccatccaatatttaaagacttgaattttatttaaacttgaaaatgactttgccttaacttttgtataagacagcttagagtccatggagcccggccctgggttggcgtgagtgggtcagagttactcagttactgcgtggatctcctgtcgctagttttactgagtaagcatactgtagtacaagagctagtagtagtttttgtaatataccttaaagatcttcaacagttgatcttttttcagaatgttggaaaatcctgtaaatgcaaatagtcaatactgtattaaatacgtgcacttggagtgtgcttcgcttgtacagttgtaaataatcagaacatatgaaaaaggtaccctacagagaaaattctgatacagattattgatatattataaatgttgctgttgagcgggatgtagataaactaaatgttgtggtttgaatattattttgatttgttgagattttcttttttctcttacatcggtgtgttgaactgattctgcctctttgctgcaaaagggaattggaaagtcttattaaaagcctccagatgttttcatactcttttaaaatgtatgtaaatgcatactaatcatatctaatgtgaaagagttttaaagtatatagagagcaaaaactggcaggatcgtaagtgaaggtgactagtaatctaattaaaatcacctgcagctaagcatgattgaccctgccagaggaaaacatgcctatttgaccatttcctttaaagcagttgccattattcaaatacagagaaatagccacagggctagtgtttttcaaatgcattttaaagaacatggggatttttttttgtagttgtcagttcactgaccaaaaaaaaaaaaaaaatcagaaataattgatctgtgaaacccaaactctcaatactcagaaagctgggaggcaacctcgaggcctgggcctacgagctgcatcttcgctacggaagggccagggcgccatcagccattcccaaaacacaaggcctgcccgtccgccagtgagtccttggtttttaataatgagaagtcctttcccccaaggtgtgagcattgcagcgcagtgtgtgtgtgtggttagagccagcttagtccttcactttgtcgaccgaagtgggagctcaacagctgcatgaggagggcagcgcgtgcattagccagtcgccactggagggctctgctgccctccggtcaatacactgtagttactgcctagccagcagcagtcttctgcatcaagaactgaaaccttgctcggaggtgatttttatagcatcctttttaattaaaggtgaaatacagattgctatataatgtctgaaaaaacctgatactacttcaagagtttctgctcagaagaaaatgagagttatcataataggaagctgtggcggtccatgccaactgtgctgtgtcacatacagcgatgagagtggctttcatactttttttttttttaagttaacaccctcctttacccccagcagtatctcaggttatagaatcagagatgcagcagtgacaaatggcattttaacttgtaaaatcgtgtgatgatgcttatcattttgaaatagaagaataaaaacctggtcccgtttcaccagacatgaatttcaagtggagtcgtcgttctctgagagtgagtgtcttgacattttcacccaggccctcctgtcatcacatcaccggctgtcactggcgggtggccgtaaacgtcctgcgttgctatattaggatctctgcagttcaggcttcaaaaccagttcagtgtatccgggcgacgggtagtggtggtgcatgcctgtctgtgtgccccgctggcgagctgtagttgcggcttgcgtgcctcgcggcccactacagggctgcagacaatcgaggcgagggcgctggccgccagcagctcacagcgcgggggtcatgtggtcgctcctcgagggtttcgtttttgttctgcttcattaagactggaatcaagcttacatgtaaactattggtaatttaagtttccttttgtgtcattcagtgtaaaactgtctaatttgaaaaaaaatgtaggttatgaaaataaagatttaggcactgtt

SEQ ID NO: 343156 - DNA, 5733 bp, Homo sapiens
aagcttgcggccgccgggccccggggttgaggcgaggagcccgcgggcggccggtcgggcggggcggcggcgctgacagcatcctgaggttagcattacacttctcccagtggagcccatgacttctgatcaggacgctaaggttgtggctgaaccgcagacgcagagagtccaggagggcaaggacagcgctcatctgatgaatggtcctatatctcaaaccacttctcagacaagttccatcccacctttgagtcaggtaccagcaactaaggtttcagagctgaaccctaatgcagaagtgtggggggctcctgtgttacatctggaagcaagcagtgctgctgacggtgtgagtgctgcatgggaggaggtggctggccaccacgcagaccgtggcccgcagggatcggatgccaatggtgatggtgaccagggccatgagaatgccgcattgccagacccgcaggagtcggacccagcagacatgaacgctctcgctctgggtccctcagaatatgactctctgcctgaaaatagcgagacaggaggaaatgagtctcaaccagacagccaggaagacccccgagaagtacttaaaaaaacattggaattctgcttatctagggagaaccttgctagtgacatgtatcttatatcacagatggatagtgaccagtatgtgccaatcacaacggtggctaacctcgaccacatcaagaagctcagcactgatgtggacttgattgtggaagtgctaagatctttacctttagtccaagtggatgaaaagggagaaaaagtaaggccaaatcaaaatcgctgcatagtaatattgcgtgaaatatctgaatctacccccgtggaagaagtagaagcactatttaaaggagataatttaccaaaatttataaactgtgaatttgcatataatgataattggtttattacatttgaaacagaagctgatgcacaacaggcttacaaataccttcgagaagaagtcaaaacttttcaaggaaaaccaattaaggcacggataaaagcaaaggcaatagctataaacacatttttgccaaagaatggatttagacccctggacgtgagcctgtatgcccagcagcgctacgcgacgtcgttctacttccctcccatgtacagcccccagcagcagttccccctgtacagcctgatcactccccagacgtggtcagcaacgcacagctatcttgacccacccttggtaactccatttccaaatactggatttataaatgggtttacgtctccagcgttcaagcctgcggcgtctcctctgacttctctcagacagtatcctcctcgaagcaggaatcctagtaaatctcatctgcggcatgcgattcctagtgcagagaggggacctgggttattagaaagtccttcaatatttaacttcactgcagatcgattaattaatggtgtccggagtccacaaacaaggcaagcaggtcaaactagaacacggattcaaaacccttcagcatatgccaagagagaggctgggcctgggcgtgtggagccaggcagtctcgaatcctctcctggtttagggaggggaaggaagaattcctttggctaccggaagaaaagggaggagaagtttacaagcagccagacacagtctccaacgccaccaaagcctccgtcgccaagcttcgagctggggctgtccagcttccctccattacctggagctgccggcaatttgaagacagaggacttgtttgaaaacaggctatctagcttgataataggaccatccaaagaaaggaccctcagtgcagacgcaagcgtgaacacccttcctgtagtggtctccagagagccctcggtgccggcttcttgtgctgtatcagcaacgtacgagcgatccccctccccagctcatttacccgatgatcccaaggtggcggagaaacagagggaaacccacagtgtggacagacttccttccgccctcactgcgaccgcgtgtaaatcggtgcaggtgaacggagccgccacggaattgcgaaagcccagctacgcagagatttgtcagagaacgagtaaagagcctccttcttccccattgcaaccccaaaaagaacaaaagccaaacactgttggttgtgggaaggaggaaaagaagctggcagagcccgcagagagataccgggagcccccagccctcaagtccacacctggagcccccagagaccagaggcggccggcggggggccggccctcgccctcggccatggggaagcgtctcagccgagagcagagcactccccccaagtctcctcagtgaaaaccgtacgtctgggaggggtcgcagagcgctgtgttaaccacaaacgagacactctcccactcagtgcgagggcgagccgctggttaggagcttgcagtgtctgaggcctgtgggatcctcaagttggttttcttctgtgagttggattctccccctcttgaaaaaaaatcgatttttcaggatttaattaatacaaaccttattttaggttggtgcttaactggaggtgatgcataagtctgatttttttttccaagatagaaaaagcatttatcctaacaaattggtattttttattaagcctccatgtggctctgaatgcaagctatatatagtgagtttttctaaattaagggaactctgcttttttttttttttttttaagtaactggtctgtaagtgcatatctctagaacgtccccgcagatgaatgagggccagtggccttggcagaggcaggtgtggcctcgtagaggcagtgctggccgcgccagggcatcagtgctgatgtgggagctgtgcttccacctaagccgttggtaggggactgtggcatttaagaatgtagagagcgcatcctttttgatctcctgggcggagtgaacctgcaggggccaccccagaaaccttggttctgatgcactgcaagcaagtaaccagcttctcactccagtttcaagtggctattatgtaatataaattcaaagcacattgtgaatagaacctacatgaaaacatacactttgttgcccactgacatgttaccagaagttgtaccatgatgttgttttgacccctgtgagctgatggccccggccctgctctgtgcacatttctgtccgtgttccccagcactctggttggagagagtccacatcttcagctccgtgtggacatctccctgtacctctgcatcagcacatggatttaagagttatgtaatcgtgagagaatggtgtttgtggtttttccccctctttggctggtggaggataaagttcctgctcttttacctccaagacgagggcctcattgattcacttccagaagtgctgcacttctgaagaacaaggatgcactaaagttagcaagtttataataaagttaaatataaattattttgttttaaaatgcctcaaatttttctttattctaagcagcaaacattaaaataagaatatttcctgctaaatgtaaccatacactttattccacaaaatgttatttaacaagactgagggttttttttaagaaaaaattatttccatccaatatttaaagacttgaattttatttaaacttgaaaatgactttgccttaacttttgtataagacagcttagagtccatggagcccggccctgggttggcgtgagtgggtcagagttactcagttactgcgtggatctcctgtcgctagttttactgagtaagcatactgtagtacaagagctagtagtagtttttgtaatataccttaaagatcttcaacagttgatcttttttcagaatgttggaaaatcctgtaaatgcaaatagtcaatactgtattaaatacgtgcacttggagtgtgcttcgcttgtacagttgtaaataatcagaacatatgaaaaaggtaccctacagagaaaattctgatacagattattgatatattataaatgttgctgttgagcgggatgtagataaactaaatgttgtggtttgaatattattttgatttgttgagattttcttttttctcttacatcggtgtgttgaactgattctgcctctttgctgcaaaagggaattggaaagtcttattaaaagcctccagatgttttcatactcttttaaaatgtatgtaaatgcatactaatcatatctaatgtgaaagagttttaaagtatatagagagcaaaaactggcaggatcgtaagtgaaggtgactagtaatctaattaaaatcacctgcagctaagcatgattgaccctgccagaggaaaacatgcctatttgaccatttcctttaaagcagttgccattattcaaatacagagaaatagccacagggctagtgtttttcaaatgcattttaaagaacatggggatttttttttgtagttgtcagttcactgaccaaaaaaaaaaaaaaaatcagaaataattgatctgtgaaacccaaactctcaatactcagaaagctgggaggcaacctcgaggcctgggcctacgagctgcatcttcgctacggaagggccagggcgccatcagccattcccaaaacacaaggcctgcccgtccgccagtgagtccttggtttttaataatgagaagtcctttcccccaaggtgtgagcattgcagcgcagtgtgtgtgtgtggttagagccattcagtgtatccgggcgacgggtagtggtggtgcatgcctgtctgtgtgccccgctggcgagctgtagttgcggcttgcgtgcctcgcggcccactacagggctgcagacaatcgaggcgagggcgctggccgccagcagctcacagcgcgggggtcatgtggtcgctcctcgagggtttcgtttttgttctgcttcattaagactggaatcaagcttacatgtaaactattggtaatttaagtttccttttgtgtcattcagtgtaaaactgtctaatttgaaaaaaaatgtaggttatgaaaataaagatttaggcactgttcaatttttcttttgattttttttaaattaaaatttcttcaataatgaaaattttctaaacatagttttttgtctgttcccataagtgcatgagaaagaaacacgggcctcatatatgattggatcctaaagccttctcacctacgtgggggctggctgtggcacacggggctcaccctttgtgttttagtggttcagagtgagcattaacatcagatgctcatgcggagacagccattactgtgactgccaagatgtactgcaaaaatacatgttcctgtatcaggactttgattttgttaaaatggcactctctccaaagctgtgtccatgaagctgtttggagctaacgttgggtcttcatggtgatggactcatccttaggcagcagtgatgtctgcactaggaagaggctggcgggaggcggggcccctcctgtgccaggcaccgagtggatgggggactgattaacatgttgctgccttcctcctctgtgcattgccttttcatgtcgtcttcccatttttactctttttctgatggaattaatattcttgatctgttaaggctattaatcctttgtcatatatgttacaaatattttctttcaatctaccatttgtcttaactctttatttagaatagtatcttttacggtgtttaattattgtgtagtaaaatctatcaatcttctcct

SEQ ID NO: 343157 - DNA, 2347 bp, Homo sapiens
aagcttgcggccgccgggccccggggttgaggcgaggagcccgcgggcggccggtcgggcggggcggcggcgctgacagcatcctgaggttagcattacacttctcccagtggagcccatgacttctgatcaggacgctaaggttgtggctgaaccgcagacgcagagagtccaggagggcaaggacagcgctcatctgatgaatggtcctatatctcaaaccacttctcagacaagttccatcccacctttgagtcaggtaccagcaactaaggtttcagagctgaaccctaatgcagaagtgtggggggctcctgtgttacatctggaagcaagcagtgctgctgacggtgtgagtgctgcatgggaggaggtggctggccaccacgcagaccgtggcccgcagggatcggatgccaatggtgatggtgaccagggccatgagaatgccgcattgccagacccgcaggagtcggacccagcagacatgaacgctctcgctctgggtccctcagaatatgactctctgcctgaaaatagcgagacaggaggaaatgagtctcaaccagacagccaggaagacccccgagaagtacttaaaaaaacattggaattctgcttatctagggagaaccttgctagtgacatgtatcttatatcacagatggatagtgaccagtatgtgccaatcacaacggtggctaacctcgaccacatcaagaagctcagcactgatgtggacttgattgtggaagtgctaagatctttacctttagtccaagtggatgaaaagggagaaaaagtaaggccaaatcaaaatcgctgcatagtaatattgcgtgaaatatctgaatctacccccgtggaagaagtagaagcactatttaaaggagataatttaccaaaatttataaactgtgaatttgcatataatgataattggtttattacatttgaaacagaagctgatgcacaacaggcttacaaataccttcgagaagaagtcaaaacttttcaaggaaaaccaattaaggcacggataaaagcaaaggcaatagctataaacacatttttgccaaagaatggatttagacccctggacgtgagcctgtatgcccagcagcgctacgcgacgtcgttctacttccctcccatgtacagcccccagcagcagttccccctgtacagcctgatcactccccagacgtggtcagcaacgcacagctatcttgacccacccttggtaactccatttccaaatactggatttataaatgggtttacgtctccagcgttcaagcctgcggcgtctcctctgacttctctcagacagtatcctcctcgaagcaggaatcctagtaaatctcatctgcggcatgcgattcctagtgcagagaggggacctgggttattagaaagtccttcaatatttaacttcactgcagatcgattaattaatggtgtccggagtccacaaacaaggcaagcaggtcaaactagaacacggattcaaaacccttcagcatatgccaagagagaggctgggcctgggcgtgtggagccaggcagtctcgaatcctctcctggtttagggaggggaaggaagaattcctttggctaccggaagaaaagggaggagaagtttacaagcagccagacacagtctccaacgccaccaaagcctccgtcgccaagcttcgagctggggctgtccagcttccctccattacctggagctgccggcaatttgaagacagaggacttgtttgaaaacaggctatctagcttgataataggaccatccaaagaaaggaccctcagtgcagacgcaagcgtgaacacccttcctgtagtggtctccagagagccctcggtgccggcttcttgtgctgtatcagcaacgtacgagcgatccccctccccagctcatttacccgatgatcccaaggtggcggagaaacagagggaaacccacagtgtggacagacttccttccgccctcactgcgaccgcgtgtaaatcggtgcaggtgaacggagccgccacggtacgtacctcgtgcctgccttcctgcacgacagccgcgaggctctggtgtgaacagacgctgcgcactcctgcacctgctcgttttttaatcacatctaatttggtgggtttttatttgcgtctgtctgtgttgtgttttctgtacaaaatacctttaatatttgctaataattttccactaactactctagttctttctcagaccaccatgtagtccttttatttcagtgttggtcaatagaggtttcttgagtagtaacaagaccccagctcctgtttctccatagactttaggatc

SEQ ID NO: 343158 - DNA, 949 bp, Homo sapiens
aagcttgcggccgccgggccccggggttgaggcgaggagcccgcgggcggccggtcgggcggggcggcggcgctgacagcatcctgaggttagcattacacttctcccagtggagcccatgacttctgatcaggacgctaaggttgtggctgaaccgcagacgcagagagtccaggagggcaaggacagcgctcatctgatgaatggtcctatatctcaaaccacttctcagacaagttccatcccacctttgagtcaggtaccagcaactaaggtttcagagctgaaccctaatgcagaagtgtggggggctcctgtgttacatctggaagcaagcagtgctgctgacggtgtgagtgctgcatgggaggaggtggctggccaccacgcagaccgtggcccgcagggatcggatgccaatggtgatggtgaccagggccatgagaatgccgcattgccagacccgcaggagtcggacccagcagacatgaacgctctcgctctgggtccctcagaatatgactctctgcctgaaaatagcgagacaggaggaaatgagtctcaaccagacagccaggaagacccccgagaagtacttaaaaaaacattggaattctgcttatctaggtaaggctggtggtggtttttctagtacctgatatttctagtattgtgcaaatagttaaagtatatacaaatgtgatattttatgaaggagtatctactcatatccatatatatgtatatgaagacgtggaatattgagtaatgacagtcttttgacatttgagcatggaacgtaaccttcatgtctgtggtccccagtggtctcggtggtcactgtctggaatgcgtctaaagtgccccgcccgccctgtgctgccgagtcagacttcctcacactgaagttggagaacaagtgtgccacgttgtttctgaaagcacacca

SEQ ID NO: 343159 - DNA, 161 bp, Homo sapiens
gccacgtgaatgcggggaggccatgttttggaagcccgagggaggatccacactttgtccctgcacatggcccagcctcagacgctagacaaaatgaggggcagagaatggccccttctgcagacgcagtgcatctggcccagcccacaacgagcctctcc

SEQ ID NO: 343160 - DNA, 933 bp, Homo sapiens
atgggagacaatataacatccatcagagagttcctcctactgggatttcccgttggcccaaggattcagatgctcctctttgggctcttctccctgttctacgtcttcaccctgctggggaacgggaccatactggggctcatctcactggactccagactgcacgcccccatgtacttcttcctctcacacctggcggtcgtcgacatcgcctacgcctgcaacacggtgccccggatgctggtgaacctcctgcatccagccaagcccatctcctttgcgggccgcatgatgcagacctttctgttttccacttttgctgtcacagaatgtctcctcctggtggtgatgtcctatgatctgtacgtggccatctgccaccccctccgatatttggccatcatgacctggagagtctgcatcaccctcgcggtgacttcctggaccactggagtccttttatccttgattcatcttgtgttacttctacctttacccttctgtaggccccagaaaatttatcactttttttgtgaaatcttggctgttctcaaacttgcctgtgcagatacccacatcaatgagaacatggtcttggccggagcaatttctgggctggtgggacccttgtccacaattgtagtttcatatatgtgcatcctctgtgctatccttcagatccaatcaagggaagttcagaggaaagccttccgcacctgcttctcccacctctgtgtgattggactcgtttatggcacagccattatcatgtatgttggacccagatatgggaaccccaaggagcagaagaaatatctcctgctgtttcacagcctctttaatcccatgctcaatccccttatctgtagtcttaggaactcagaagtgaagaatactttgaagagagtgctgggagtagaaagggctttatga

SEQ ID NO: 343161 - DNA, 579 bp, Homo sapiens
tatgttgtccaaggtggtcttgaactcctgggctcaagtgatcctcctgcctcagcctcctgagtaactgggactacaggggcccacaagtaattgttaatattctagctagtaacacaatttgcttttttgcagattttttggatgccttttgtcctccatacacattaattgcctctggcattcactgcccatcttttcagtttttacttgtaatctgagtaaataaagtttagggaagtagactaccacctactcctctgtaaaatatgaatcccttagatattgaatgtgttgtgttaagctctttggattgacatatgtagactttataaaccattatattaatctagattatgtgatgatttaagaattattaataaatcagtgaataaaacaaggttctaccaaaagcatagtgatcctgcacaaatgggccttttaaacactttctttaagggcaacttttactccgtgtaccttttgttccagtgtgtttaaactcaccaagaaaagttggtgtgagttgagaaatctcatgtttgttgtctcttaattttctatttcagactatattgc

SEQ ID NO: 343162 - DNA, 267 bp, Homo sapiens
acagacagacagacagacacacacacacacacacacacacacacacacagaggtttatagaagcctcctcatctataaatattaaaacccaagtaggaaggaaaaagtttttttgaaaaaagattatagtagagtttgatgtaattctccaaatggactgatcaaatatataaccctcttgtggaagcatttgtggctcttgcaaaagatgaactttaaaatgagcccagagtagagtttttcagatgttttgtcaggggagaaatg

SEQ ID NO: 343163 - DNA, 476 bp, Homo sapiens
catgccaatacccttcctgccattgcacctgctgctccctttgcccagaaccctctttccacagataatctgcacagctttctccattaggggcttgatgctacctctgtgaggcttctcttagatgtggcagcctcatcacctcctaccctatcctctttacctgctttatttttctccttagctctcctccctatctaacacagtttatgttttattacttccccccaatggaatgtaaccttcacaaagaaagggattttgtttcacttggcatttgttcactgccatatctcctgtacctagaaaagtgtctggcacaaagtagacgctcagtaaatttttgttgaatgaataagttaacagcttcagacatttgagatagcttcaaaaacagactaagataagcaggaaggagggatgtttttgttttgttttttgcccagtggaatgaaataaaagattatccattttcc

SEQ ID NO: 343164 - DNA, 121 bp, Homo sapiens
actaccaataaacccttatttaaggaatgtctgatcccagaagaacatgtgaaatataagaagaaatgataagcaaaagagatgataatcatgtatgtaattctcaacaaaaattgatgat

SEQ ID NO: 343165 - DNA, 286 bp, Homo sapiens
ctgttgtttcaaatctcattatttatcaagaagtgtaaagagccaaccaaggtgattaagggggaaaagacttctgaaccaaatatgtttactcatcactctaaagtatatgggcttatgcagaaatgctaaccctgctacaaatttacactgttcagcaaatactgggtctctatgttttgtttattccaattgtgtcctttagtctctgagtctctgaaagcatggtacaggttgaatgtagccatctgtgatgtcctgtctgatgtatcagagttatcttgac

SEQ ID NO: 343166 - DNA, 1223 bp, Homo sapiens
tttaggggttgtggtttgaggctagcatagttgaccttgagcagataaaatttaagaggttggcagtaggtaaatgcccttcttttgtagggaaatcctttattcctatgtagttacaggggcttctttttacccagagagataaactaatttcaggctagcgttctggctttagctagaattgcaggcatctgggattccagcttctttattccattctctaagcccaaggcccttgctgtggccaccacagttaggggacagagattctggactgtgttgtttacagacaacataggtgggaaatagggacccaggatgtacaaggcctagtcacaagttggggactgcctagggaagaaggagctgatgactatgggggaagctaaccaaggaatcactgttgccatgggagaagggaataactgaatcccctgaaagtttagccctgcttctcccacttcacttgttctcttggtattaagccctcctctccaactctcatccctgactctgcatttcacacccatcctgcctatccccttacaaaatacttcccttgcctttaactctcccatgctcatcttatcatccgttcccatccttagttctacctccctcaccaacctttaatccgcacatcctacctgaatttaccctcatcaaaacctgagctttcccatcattttaaattactctcctaccattttcacccagtcatgtacctacattccacctggtcatctgctgaataccctactcccatcccctgctgtgtgtcaccccctggatctaagcctcttttaatttcttggaccatttgtagatccccttccccattcccagcctgatgcagtcactaacccaaccccatctgcccctagtggctactaatcatatactcataccctttttccccacagcctaaccacatcccgtaaccacagcctcatcctcacattctctgcccaacctgatcctttcccctcttcccaattcgtcgcctaaactcaagctgccccagccgctaaagtggctgctgatgataggaagctgtgggactctaacctgtctaccttagtagttattaggtcctgtcatttctacctccccaaacttgttctgagtgacatcttcctcaatgccattccaactccggcttcattacctttaatttgtactaatacagtgtccttctaactaatctccaaggtactgccaga

SEQ ID NO: 343167 - DNA, 1058 bp, Homo sapiens
tttaggggttgtggtttgaggctagcatagttgaccttgagcagataaaatttaagaggttggcagtaggtaaatgcccttcttttgtagggaaatcctttattcctatgtagttacaggggcttctttttacccagagagataaactaatttcaggctagcgttctggctttagctagaattgcaggcatctgggattccagcttctttattccattctctaagcccaaggcccttgctgtggccaccacagttaggggacagagattctggactgtgttgtttacagacaacataggtgggaaatagggacccaggatgtacaaggcctagtcacaagttggggactgcctagggaagaaggagctgatgactatgggggaagctaaccaaggaatcactgttgccatgggagaagggaataactgaatcccctgaaagtttagccctgcttctcccacttcacttgttctcttggtattaagccctcctctccaactctcatccctgactctgcatttcacacccatcctgcctatccccttacaaaatacttcccttgcctttaactctcccatgctcatcttatcatccgttcccatccttagttctacctccctcaccaacctttaatccgcacatcctacctgaatttaccctcatcaaaacctgagctttcccatcattttaaattactctcctaccattttcacccagtcatgtacctacattccacctggtcatctgctgaataccctactcccatcccctgctgtgtgtcaccccctggatctaagcctcttttaatttcttggaccatttgtagatccccttcccccactccccaacagaaaagaggaaacgagacccaaagaggaaactgggtcttgctgatcccacgcccagccaggccactgaccacacccccacttcactcccagcctgaccctgccactgaccacagcactatcctctactcagcctgacccagccactggctgtaccccatcccccatcccagctccagctttacttagacattgccaatgtcccttcac

SEQ ID NO: 343168 - DNA, 370 bp, Homo sapiens
ctccccaacagaaaagaggaaacgagacccaaagaggaaactgggtcttgctgatcccacgcccagccaggccactgaccacacccccacttcactcccagcctgaccctgccactgaccacagcactatcctctactcagcctgacccagccactggctgtaccccatcccccatcccagctccagctttacttagacattgccaatgtcccttcactttcccacccccaccccagtctgatttagtgactgaccacaggcccagctcttctcaacctcctatagcctgacctggcctctgacctcaccccatcattccctgacttagccaccatccatgtaatcattccccttcccccaacctgatgc

SEQ ID NO: 343169 - DNA, 822 bp, Homo sapiens
tgcctcctgaagttattagcactgcttccctttttatgaacataataacctcagcaattatgggaaaaagcaaaatcaatgcaaataaaccaagcctttttttttaatctttataccttacccttaaaaaaaaatgtcatttgaaggcttaattagatgctttttatttatgtaaatacatatgcccttttccttatacccaatgtttcttactaatgctagtagaattaaccctcaaattagaaatattgaactttttaaatgctttaagtaattaaatgcaaatgcttcgatcagaaataaaaacagtatatactatgcagcaaagttcaaggtaggtactatggtaagataaatgtttctctaaacttgaacttttcacttttggaaattaatagaaagacaaagctcaaaaaaaatttcatgtgttccatttcccacataatttaaagggcatccaacaaatggaagatgaatttatacctttcagtcaactggtttactttggaacatttgctatttatttatttatttatttaggagacagagtctcactctgtcacccgggctggagtgaagtggtgtgatctcagcttattgcaacctttgccccccaggttcaagtgattctcctgcctcagcctcctgagtagctgggattacagatgcctgccaccatgcctggctaatttttgtatttttagtagagacggggtttcactatgttggccaggctagtctcgaactcctgacttcaggtgatctgcccgcctccgcctcccaaagtgctgggattacaaggcttgatccaccgtgcccagc

SEQ ID NO: 343170 - DNA, 1933 bp, Homo sapiens
cgcgtgagaacgtccggggagcgcgcgcgccgccgccgttgccgccgggctgagagaagagcttgcggggtttgcggttgatggccccgactgaagggctggaggcggtgtatgccgctgttcttgctgtcgctcccgacacctccgtccgcttctggtcatgagaggagacagaggcctgaagcaaagacatctgggtcagagaaaaagtatttaagggccatgcaagccaatcgtagccaactgcacagtcctccaggaactggaagcagtgaggatgcctcaacccctcagtgtgtccacacaagattgacaggagagggttcttgccctcattctggagatgttcatatccagataaactccatacctaaagaatgtgcagaaaatgcaagctccagaaatataaggtcaggtgtccatagctgtgcccatggatgtgtacacagtcgcttacggggtcactcccacagtgaagcaaggctgactgatgatactgccgcagaatctggagatcatggtagtagctccttctcagaattccgctatctcttcaagtggctgcaaaaaagtcttccatatattttgattctgagcgtcaaacttgttatgcagcatataacaggaatttctcttggaattgggctgctaacaacttttatgtatgcaaacaaaagcattgtaaatcaggtttttctaagacttaatttttttaaatcctactttggaccatttgagcttctgggaagtattttggattgttggaattacagacttcattctgaaattctttttcatgggcttaaaatgccttattttattggtgccttctttcatcatgccttttaaatctaagggttactggtatatgcttttagaagaattgtgtcaatactaccgaacttttgttcccataccagtttggtttcgctaccttataagctatggggagtttggtaacgtaactagatggagtcttgggatactgctggctttactctacctcatattaaaacttttggaattttttgggcatctgagaactttcagacaggttttacgaatattttttacacaaccaagttatggagtggctgccagcaagagacagtgttcagatgtggatgatatttgttcaatatgtcaagctgaatttcagaagccaattcttctcatctgtcagcatatattttgtgaagagtgcatgaccttatggtttaacagagagaaaacatgtccactctgcagaactgtgatttcagaccatataaacaaatggaaggatggagccacttcatcacaccttcaaatatattaagttgtataaactatcaaggccacaaaatactaatgtcatttggtcataatgactactgataaggcatcagaatggattttcagggctaccagaaaaatgtttccagatggttttagaatgtaggacttatgatccaattcaccaaaagattaaatgaaaccaccctgtgttttaaaatatatataatgttcaacctaatgtatatgcaacatttattctattctaattatttgacaggtaactgcagtgttaaattgtaaatgtgttttctttatgttaccaaaacagcaatttgaaattagaactagtggttttagagaactcaggtattctttcctgacattgttttcagaataaagaatatttttcataatattttaagatacatactatctaaaagtagaattttgttcagcattgacttttataattcccatcctaaaaattcttaatattttcataaaatttgtatttttaaatgaaaattctaaatgttgtattttatcagtaacattttctaagtgaagattaatttactgaggatgatacattatagtattgtattattctctgtagtaagattagtaataagtgaaaataaatgatttaaattca

SEQ ID NO: 343171 - DNA, 325 bp, Homo sapiens
attaaagtaaaacagtttaatgatatttaaaattctggcaaaatcaaagtaacattataaaattgtttatctttcaggaaaggtcctcaaagattcagtgtgcttggttactggtattcttagcaggatcttctgttcttttatattacacctttcattctcagtcactttattacaggtaattagaggtccaaatacacaattacatttttaatgtaatcatatatttcatagcactttgtatcttacttcacatagtacttattgtattcagttcagttcagtttttaactttctcctttcataagcgagagctttttttttt

SEQ ID NO: 343172 - DNA, 2034 bp, Homo sapiens
cgcgtgagaacgtccggggagcgcgcgcgccgccgccgttgccgccgggctgagagaagagcttgcggggtttgcggttgatggccccgactgaagggctggaggcggtgtatgccgctgttcttgctgtcgctcccgacacctccgtccgcttctggtcatgagaggagacagaggcctgaagcaaagacatctgggtcagagaaaaagtatttaagggccatgcaagccaatcgtagccaactgcacagtcctccaggaactggaagcagtgaggatgcctcaacccctcagtgtgtccacacaagattgacaggagagggttcttgccctcattctggagatgttcatatccagataaactccatacctaaagaatgtgcagaaaatgcaagctccagaaatataaggtcaggtgtccatagctgtgcccatggatgtgtacacagtcgcttacggggtcactcccacagtgaagcaaggctgactgatgatactgccgcagaatctggagatcatggtagtagctccttctcagaattccgctatctcttcaagtggctgcaaaaaagtcttccatatattttgattctgagcgtcaaacttgttatgcagcatataacaggaatttctcttggaattgggctgctaacaacttttatgtatgcaaacaaaagcattgtaaatcaggtttttctaagagaaaggtcctcaaagattcagtgtgcttggttactggtattcttagcaggatcttctgttcttttatattacacctttcattctcagtcactttattacagcttaatttttttaaatcctactttggaccatttgagcttctgggaagtattttggattgttggaattacagacttcattctgaaattctttttcatgggcttaaaatgccttattttattggtgccttctttcatcatgccttttaaatctaagggttactggtatatgcttttagaagaattgtgtcaatactaccgaacttttgttcccataccagtttggtttcgctaccttataagctatggggagtttggtaacgtaactagatggagtcttgggatactgctggctttactctacctcatattaaaacttttggaattttttgggcatctgagaactttcagacaggttttacgaatattttttacacaaccaagttatggagtggctgccagcaagagacagtgttcagatgtggatgatatttgttcaatatgtcaagctgaatttcagaagccaattcttctcatctgtcagcatatattttgtgaagagtgcatgaccttatggtttaacagagagaaaacatgtccactctgcagaactgtgatttcagaccatataaacaaatggaaggatggagccacttcatcacaccttcaaatatattaagttgtataaactatcaaggccacaaaatactaatgtcatttggtcataatgactactgataaggcatcagaatggattttcagggctaccagaaaaatgtttccagatggttttagaatgtaggacttatgatccaattcaccaaaagattaaatgaaaccaccctgtgttttaaaatatatataatgttcaacctaatgtatatgcaacatttattctattctaattatttgacaggtaactgcagtgttaaattgtaaatgtgttttctttatgttaccaaaacagcaatttgaaattagaactagtggttttagagaactcaggtattctttcctgacattgttttcagaataaagaatatttttcataatattttaagatacatactatctaaaagtagaattttgttcagcattgacttttataattcccatcctaaaaattcttaatattttcataaaatttgtatttttaaatgaaaattctaaatgttgtattttatcagtaacattttctaagtgaagattaatttactgaggatgatacattatagtattgtattattctctgtagtaagattagtaataagtgaaaataaatgatttaaattca

SEQ ID NO: 343173 - DNA, 2424 bp, Homo sapiens
cgcgtgagaacgtccggggagcgcgcgcgccgccgccgttgccgccgggctgagagaagagcttgcggggtttgcggttgatggccccgactgaagggctggaggcggtgtatgccgctgttcttgctgtcgctcccgacacctccgtccgcttctggtcatgagaggagacagaggcctgaagcaaagacatctgggtcagagaaaaagtatttaagggccatgcaagccaatcgtagccaactgcacagtcctccaggaactggaagcagtgaggatgcctcaacccctcagtgtgtccacacaagattgacaggagagggttcttgccctcattctggagatgttcatatccagataaactccatacctaaagaatgtgcagaaaatgcaagctccagaaatataaggtcaggtgtccatagctgtgcccatggatgtgtacacagtcgcttacggggtcactcccacagtgaagcaaggctgactgatgatactgccgcagaatctggagatcatggtagtagctccttctcagaattccgctatctcttcaagtggctgcaaaaaagtcttccatatattttgattctgagcgtcaaacttgttatgcagcatataacaggaatttctcttggaattgggctgctaacaacttttatgtatgcaaacaaaagcattgtaaatcaggtttttctaagagaaaggtcctcaaagattcagtgtgcttggttactggtattcttagcaggatcttctgttcttttatattacacctttcattctcagtcactttattacagcttaatttttttaaatcctactttggaccatttgagcttctgggaagtattttggattgttggaattacagacttcattctgaaattctttttcatgggcttaaaatgccttattttattggtgccttctttcatcatgccttttaaatctaagggttactggtatatgcttttagaagaattgtgtcaatactaccgaacttttgttcccataccagtttggtttcgctaccttataagctatggggagtttggtaacgtaactagatggagtcttgggatactgctggctttactctacctcatattaaaacttttggaattttttgggcatctgagaactttcagacaggttttacgaatattttttacacaaccaagttatggagtggctgccagcaagagacagtgttcagatgtggatgatatttgttcaatatgtcaagctgaatttcagaagccaattcttctcatctgtcagcatatattttgtgaagagtgcatgaccttatggtttaacagagagaaaacatgtccactctgcagaactgtgatttcagaccatataaacaaatggaaggatggagccacttcatcacaccttcaaatatattaagttgtataaactatcaaggccacaaaatactaatgtcatttggtcataatgactactgataaggcatcagaatggattttcagggctaccagaaaaatgtttccagatggttttagaatgtaggacttatgatccaattcaccaaaagattaaatgaaaccaccctgtgttttaaaatatatataatgttcaacctaatgtatatgcaacatttattctattctaattatttgacaggtaactgcagtgttaaattgtaaatgtgttttctttatgttaccaaaacagcaatttgaaattagaactagtggttttagagaactcaggtattctttcctgacattgttttcagaataaagaatatttttcataatattttaagatacatactatctaaaagtagaattttgttcagcattgacttttataattcccatcctaaaaattcttaatattttcataaaatttgtatttttaaatgaaaattctaaatgttgtattttatcagtaacattttctaagtgaagattaatttactgaggatgatacattatagtattgtattattctctgtagtaagattagtaataagtgaaaataaatgatttaaattcattttgtctctggacgtcataaattcttcctgccatcagctttaatgttcatgatcatgctttttgtatagtaccatggagtatctcgaagtaactattaaaataattcatgtggattataaaaaaaaaaaaaaaaaaatgttgtgggcgccggggacgcgaaaaagtttcaaaccatcctgtgggggggggaccagaggtaaggacactgggcaaaacgtggtgcaagaaaaccggccagatggggtggttcccccaaaaaacccggcgacggggtcgaacatccagggtcggcttctcgtctccacaggtcccatctcacccccccgcgcgcggccaagaaacaaacaacaacaaaaacacaaaacacaagacaaccacaaaaggagaa

SEQ ID NO: 343174 - DNA, 2291 bp, Homo sapiens
cgcgtgagaacgtccggggagcgcgcgcgccgccgccgttgccgccgggctgagagaagagcttgcggggtttgcggttgatggccccgactgaagggctggaggcggtgtatgccgctgttcttgctgtcgctcccgacacctccgtccgcttctggtcatgagaggagacagaggcctgaagcaaagacatctgggtcagagaaaaagtatttaagggccatgcaagccaatcgtagccaactgcacagtcctccaggaactggaagcagtgaggatgcctcaacccctcagtgtgtccacacaagattgacaggagagggttcttgccctcattctggagatgttcatatccagataaactccatacctaaagaatgtgcagaaaatgcaagctccagaaatataaggtcaggtgtccatagctgtgcccatggatgtgtacacagtcgcttacggggtcactcccacagtgaagcaaggctgactgatgatactgccgcagaatctggagatcatggtagtagctccttctcagaattccgctatctcttcaagtggctgcaaaaaagtcttccatatattttgattctgagcgtcaaacttgttatgcagcatataacaggaatttctcttggaattgggctgctaacaacttttatgtatgcaaacaaaagcattgtaaatcaggtttttctaagagaaaggtcctcaaagattcagtgtgcttggttactggtattcttagcaggatcttctgttcttttatattacacctttcattctcagtcactttattacaggctagaaaggtgtcaactatgacaaaccgtgaagactttttccttattctatgaagggaagatctaaaatccaaacaggtttaaaaagtctctttaagcaaaatgatcctccattccattattgtgaactctgacatcctgccaaactcatattttttacatatcaaaataaaatatttgtagcaaattaaaaccctttattaatactttatctttgtatgttgctctgataaattttgatgtttttcttttggtagcttaatttttttaaatcctactttggaccatttgagcttctgggaagtattttggattgttggaattacagacttcattctgaaattctttttcatgggcttaaaatgccttattttattggtgccttctttcatcatgccttttaaatctaagggttactggtatatgcttttagaagaattgtgtcaatactaccgaacttttgttcccataccagtttggtttcgctaccttataagctatggggagtttggtaacgtaactagatggagtcttgggatactgctggctttactctacctcatattaaaacttttggaattttttgggcatctgagaactttcagacaggttttacgaatattttttacacaaccaagttatggagtggctgccagcaagagacagtgttcagatgtggatgatatttgttcaatatgtcaagctgaatttcagaagccaattcttctcatctgtcagcatatattttgtgaagagtgcatgaccttatggtttaacagagagaaaacatgtccactctgcagaactgtgatttcagaccatataaacaaatggaaggatggagccacttcatcacaccttcaaatatattaagttgtataaactatcaaggccacaaaatactaatgtcatttggtcataatgactactgataaggcatcagaatggattttcagggctaccagaaaaatgtttccagatggttttagaatgtaggacttatgatccaattcaccaaaagattaaatgaaaccaccctgtgttttaaaatatatataatgttcaacctaatgtatatgcaacatttattctattctaattatttgacaggtaactgcagtgttaaattgtaaatgtgttttctttatgttaccaaaacagcaatttgaaattagaactagtggttttagagaactcaggtattctttcctgacattgttttcagaataaagaatatttttcataatattttaagatacatactatctaaaagtagaattttgttcagcattgacttttataattcccatcctaaaaattcttaatattttcataaaatttgtatttttaaatgaaaattctaaatgttgtattttatcagtaacattttctaagtgaagattaatttactgaggatgatacattatagtattgtattattctctgtagtaagattagtaataagtgaaaataaatgatttaaattca

SEQ ID NO: 343175 - DNA, 1856 bp, Homo sapiens
cgcgtgagaacgtccggggagcgcgcgcgccgccgccgttgccgccgggctgagagaagagcttgcggggtttgcggttgatggccccgactgaagggctggaggcggtgtatgccgctgttcttgctgtcgctcccgacacctccgtccgcttctggtcatgagaggagacagaggcctgaagcaaagacatctgggtcagagaaaaagtatttaagggccatgcaagccaatcgtagccaactgcacagtcctccaggaactggaagcagtgaggatgcctcaacccctcagtgtgtccacacaagattgacaggagagggttcttgccctcattctggagatgttcatatccagataaactccatacctaaagaatgtgcagaaaatgcaagctccagaaatataaggtcaggtgtccatagctgtgcccatggatgtgtacacagtcgcttacggggtcactcccacagtgaagcaaggctgactgatgatactgccgcagaatctggagatcatggtagtagctccttctcagaattccgctatctcttcaagtggctgcaaaaaagtcttccatatattttgattctgagcgtcaaacttgttatgcagcatataacagcttaatttttttaaatcctactttggaccatttgagcttctgggaagtattttggattgttggaattacagacttcattctgaaattctttttcatgggcttaaaatgccttattttattggtgccttctttcatcatgccttttaaatctaagggttactggtatatgcttttagaagaattgtgtcaatactaccgaacttttgttcccataccagtttggtttcgctaccttataagctatggggagtttggtaacgtaactagatggagtcttgggatactgctggctttactctacctcatattaaaacttttggaattttttgggcatctgagaactttcagacaggttttacgaatattttttacacaaccaagttatggagtggctgccagcaagagacagtgttcagatgtggatgatatttgttcaatatgtcaagctgaatttcagaagccaattcttctcatctgtcagcatatattttgtgaagagtgcatgaccttatggtttaacagagagaaaacatgtccactctgcagaactgtgatttcagaccatataaacaaatggaaggatggagccacttcatcacaccttcaaatatattaagttgtataaactatcaaggccacaaaatactaatgtcatttggtcataatgactactgataaggcatcagaatggattttcagggctaccagaaaaatgtttccagatggttttagaatgtaggacttatgatccaattcaccaaaagattaaatgaaaccaccctgtgttttaaaatatatataatgttcaacctaatgtatatgcaacatttattctattctaattatttgacaggtaactgcagtgttaaattgtaaatgtgttttctttatgttaccaaaacagcaatttgaaattagaactagtggttttagagaactcaggtattctttcctgacattgttttcagaataaagaatatttttcataatattttaagatacatactatctaaaagtagaattttgttcagcattgacttttataattcccatcctaaaaattcttaatattttcataaaatttgtatttttaaatgaaaattctaaatgttgtattttatcagtaacattttctaagtgaagattaatttactgaggatgatacattatagtattgtattattctctgtagtaagattagtaataagtgaaaataaatgatttaaattca

SEQ ID NO: 343176 - DNA, 2041 bp, Homo sapiens
ggtcgatgacgcctttgtgacacaagaccttgcggtgtttgcggttgatggtccctattgactagggctggataccgtggtcgtttgacctggagtgttctgttgacttcgtcacctcacctgaacaaccatccgctgcgggttctgcgtcgatgtagcatggagcacagtagcgccttgagagctaactgacgatttgtgtctagagatactatcgtatttaagggccatgcaagccaatcgtagccaactgcacagtcctccaggaactggaagcagtgaggatgcctcaacccctcagtgtgtccacacaagattgacaggagagggttcttgccctcattctggagatgttcatatccagataaactccatacctaaagaatgtgcagaaaatgcaagctccagaaatataaggtcaggtgtccatagctgtgcccatggatgtgtacacagtcgcttacggggtcactcccacagtgaagcaaggctgactgatgatactgccgcagaatctggagatcatggtagtagctccttctcagaattccgctatctcttcaagtggctgcaaaaaagtcttccatatattttgattctgagcgtcaaacttgttatgcagcatataacaggaatttctcttggaattgggctgctaacaacttttatgtatgcaaacaaaagcattgtaaatcaggtttttctaagagaaaggtcctcaaagattcagtgtgcttggttactggtattcttagcaggatcttctgttcttttatattacacctttcattctcagtcactttattacagcttaatttttttaaatcctactttggaccatttgagcttctgggaagtattttggattgttggaattacagacttcattctgaaattctttttcatgggcttaaaatgccttattttattggtgccttctttcatcatgccttttaaatctaagggttactggtatatgcttttagaagaattgtgtcaatactaccgaacttttgttcccataccagtttggtttcgctaccttataagctatggggagtttggtaacgtaactagatggagtcttgggatactgctggctttactctacctcatattaaaacttttggaattttttgggcatctgagaactttcagacaggttttacgaatattttttacacaaccaagttatggagtggctgccagcaagagacagtgttcagatgtggatgatatttgttcaatatgtcaagctgaatttcagaagccaattcttctcatctgtcagcatatattttgtgaagagtgcatgaccttatggtttaacagagagaaaacatgtccactctgcagaactgtgatttcagaccatataaacaaatggaaggatggagccacttcatcacaccttcaaatatattaagttgtataaactatcaaggccacaaaatactaatgtcatttggtcataatgactactgataaggcatcagaatggattttcagggctaccagaaaaatgtttccagatggttttagaatgtaggacttatgatccaattcaccaaaagattaaatgaaaccaccctgtgttttaaaatatatataatgttcaacctaatgtatatgcaacatttattctattctaattatttgacaggtaactgcagtgttaaattgtaaatgtgttttctttatgttaccaaaacagcaatttgaaattagaactagtggttttagagaactcaggtattctttcctgacattgttttcagaataaagaatatttttcataatattttaagatacatactatctaaaagtagaattttgttcagcattgacttttataattcccatcctaaaaattcttaatattttcataaaatttgtatttttaaatgaaaattctaaatgttgtattttatcagtaacattttctaagtgaagattaatttactgaggatgatacattatagtattgtattattctctgtagtaagattagtaataagtgaaaataaatgatttaaattca

SEQ ID NO: 343177 - DNA, 1719 bp, Homo sapiens
aaaccagcagtgaaatatgagaaatagaaaagtgttgtgttaaaagtctagaaagaaaattattcagggagggaagatggaaaaagagagtgaccttgaaatttagccatacagagggagttgatgatcttgacaagcaattcattgaaaggaagagatggaatcctgattggaattggttaagaaaaacacagcagatgtctggtattgatgagtttttttcatttacaggctagaaaggtgtcaactatgacaaaccgtgaagactttttccttattctatgaagggaagatctaaaatccaaacaggtttaaaaagtctctttaagcaaaatgatcctccattccattattgtgaactctgacatcctgccaaactcatattttttacatatcaaaataaaatatttgtagcaaattaaaaccctttattaatactttatctttgtatgttgctctgataaattttgatgtttttcttttggtagcttaatttttttaaatcctactttggaccatttgagcttctgggaagtattttggattgttggaattacagacttcattctgaaattctttttcatgggcttaaaatgccttattttattggtgccttctttcatcatgccttttaaatctaagggttactggtatatgcttttagaagaattgtgtcaatactaccgaacttttgttcccataccagtttggtttcgctaccttataagctatggggagtttggtaacgtaactagatggagtcttgggatactgctggctttactctacctcatattaaaacttttggaattttttgggcatctgagaactttcagacaggttttacgaatattttttacacaaccaagttatggagtggctgccagcaagagacagtgttcagatgtggatgatatttgttcaatatgtcaagctgaatttcagaagccaattcttctcatctgtcagcatatattttgtgaagagtgcatgaccttatggtttaacagagagaaaacatgtccactctgcagaactgtgatttcagaccatataaacaaatggaaggatggagccacttcatcacaccttcaaatatattaagttgtataaactatcaaggccacaaaatactaatgtcatttggtcataatgactactgataaggcatcagaatggattttcagggctaccagaaaaatgtttccagatggttttagaatgtaggacttatgatccaattcaccaaaagattaaatgaaaccaccctgtgttttaaaatatatataatgttcaacctaatgtatatgcaacatttattctattctaattatttgacaggtaactgcagtgttaaattgtaaatgtgttttctttatgttaccaaaacagcaatttgaaattagaactagtggttttagagaactcaggtattctttcctgacattgttttcagaataaagaatatttttcataatattttaagatacatactatctaaaagtagaattttgttcagcattgacttttataattcccatcctaaaaattcttaatattttcataaaatttgtatttttaaatgaaaattctaaatgttgtattttatcagtaacattttctaagtgaagattaatttactgaggatgatacattatagtattgtattattctctgtagtaagattagtaataagtgaaaataaatgatttaaattca

SEQ ID NO: 343178 - DNA, 1433 bp, Homo sapiens
ggctattttataattggatactagccatgtagaacaatactgacatttgttactggattgtggccctttcctatactttatggcagttactagtaactcaaagaccttaagcagttatcatacttaatcttaaaggtgtcacctaaggatagcttttatggttaaatggatggtacagccagaacactagtggctctaccaatcatactgctctttgtcttcttgaatgtctcatacgttctccattttcacaattgtaaaatgaggggattagtgctcttcaaaatccctttcaggctggacacagtggctcacgcctgtaatcccagaactttgggaggctgaggtgggtggatcacctgaggtcaggagttcaagaccagcctgaccaacatggtgaaaccctgtctctactaaaaataaaaaaactagctgggcatggtggtggtggtcacctgtaatcccggcaacttgggaggctgaggcaggagaatcacttgaaccagtcgggggcggaggttgcagtgagccgagatggtgccattgcactccggcctgggtgacagagcaagacttcagtctccatctcaaaaaaaaaaaaaaagaatccctttcattccctacaatgtgatggatttaaaatgattatcaaatatcaaatctaattcttaattccattacagcatatattttgtgaagagtgcatgaccttatggtttaacagagagaaaacatgtccactctgcagaactgtgatttcagaccatataaacaaatggaaggatggagccacttcatcacaccttcaaatatattaagttgtataaactatcaaggccacaaaatactaatgtcatttggtcataatgactactgataaggcatcagaatggattttcagggctaccagaaaaatgtttccagatggttttagaatgtaggacttatgatccaattcaccaaaagattaaatgaaaccaccctgtgttttaaaatatatataatgttcaacctaatgtatatgcaacatttattctattctaattatttgacaggtaactgcagtgttaaattgtaaatgtgttttctttatgttaccaaaacagcaatttgaaattagaactagtggttttagagaactcaggtattctttcctgacattgttttcagaataaagaatatttttcataatattttaagatacatactatctaaaagtagaattttgttcagcattgacttttataattcccatcctaaaaattcttaatattttcataaaatttgtatttttaaatgaaaattctaaatgttgtattttatcagtaacattttctaagtgaagattaatttactgaggatgatacattatagtattgtattattctctgtagtaagattagtaataagtgaaaataaatgatttaaattca

SEQ ID NO: 343179 - DNA, 318 bp, Homo sapiens
gtaagtactttttatcagttaagaaaaacaccttcacctttcttcactgcaaaaatttttttagttcagcagttttacaagaatggatttcataaatagatgatccttttcttttactttgattattttctagtactttggcacttggggctataataatttaggagttttatctctgtgatcagattcttgaatcacacattgacaaccacctgctaattgttgcagtgcttatatatttgaacttgtctcttgcctcttcaatccactggacatttttaaggcttgtaaacccttaacaatcttatgaaattgtgt

SEQ ID NO: 343180 - DNA, 640 bp, Homo sapiens
gaggttcagtcataatcattatgaagattaattttatagttatttatattattgtataatatactcagtgttctcagtctaatattgtttgtgctatgtagttaagtagtttgggtagctctatttgttttcttcttattttttagggttactggtatatgcttttagaagaattgtgtcaatactaccgaacttttgttcccataccagtttggtttcgctaccttataagctatggggagtttggtaacgtaactagatggagtcttgggatactgctggctttactctacctcatattaaaagtaggtaacattacaaatcttgtcactgcatgattcacattaatgattactgatacatactactgttttcctcttttaacagttttatagtttatcttcatatcactagtttgaagtaatagcaggttctatatttgtttagaaatggagaaacggaaatagactatcttaatccagcggtcctcaggtttcactggagggaaggggagtcgaccttcacatagcgtggattatctaagtagggaaaacaagtggaatagaacatacccatcctcaacagtaacattgtcatacacataattcttaaactagtagagtatcttgtcctgttctct

SEQ ID NO: 343181 - DNA, 911 bp, Homo sapiens
cgcgtgagaacgtccggggagcgcgcgcgccgccgccgttgccgccgggctgagagaagagcttgcggggtttgcggttgatggccccgactgaagggctggaggcggtgtatgccgctgttcttgctgtcgctcccgacacctccgtccgcttctggtcatgagaggagacagaggcctgaagcaaagacatctgggtcagagaaaaagtatttaagggccatgcaagccaatcgtagccaactgcacagtcctccaggaactggaagcagtgaggatgcctcaacccctcagtgtgtccacacaagattgacaggagagggttcttgccctcattctggagatgttcatatccagataaactccatacctaaagaatgtgcagaaaatgcaagctccagaaatataaggtcaggtgtccatagctgtgcccatggatgtgtacacagtcgcttacggggtcactcccacagtgaagcaaggctgactgatgatactgccgcagaatctggagatcatggtagtagctccttctcagaattccgctatctcttcaagtggctgcaaaaaagtcttccatatattttgattctgagcgtcaaacttgttatgcagcatataacaggaatttctcttggaattgggctgctaacaacttttatgtatgcaaacaaaagcattgtaaatcaggtttttctaagagtaagataacaagcaactaaaaaattattaactgtttctctccatagattttagagaaataatttttagagaaataggaaataacttgaaagaaataggaagtgataggatatattgtaacatccacgttatgttaaatttggtatctaaatcctggaataaattatctctcctaatgctgaattccttcacctttccttctttgtaag

SEQ ID NO: 343182 - DNA, 2274 bp, Homo sapiens
cgcgtgagaacgtccggggagcgcgcgcgccgccgccgttgccgccgggctgagagaagagcttgcggggtttgcggttgatggccccgactgaagggctggaggcggtgtatgccgctgttcttgctgtcgctcccgacacctccgtccgcttctggtcatgagaggagacagaggcctgaagcaaagacatctgggtcagagaaaaagtatttaagggccatgcaagccaatcgtagccaactgcacagtcctccaggaactggaagcagtgaggatgcctcaacccctcagtgtgtccacacaagattgacaggagagggttcttgccctcattctggagatgttcatatccagataaactccatacctaaagaatgtgcagaaaatgcaagctccagaaatataaggtcaggtgtccatagctgtgcccatggatgtgtacacagtcgcttacggggtcactcccacagtgaagcaaggctgactgatgatactgccgcagaatctggagatcatggtagtagctccttctcagaattccgctatctcttcaagtggctgcaaaaaagtcttccatatattttgattctgagcgtcaaacttgttatgcagcatataacaggaatttctcttggaattgggctgctaacaacttttatgtatgcaaacaaaagcattgtaaatcaggtttttctaagagaaaggtcctcaaagattcagtgtgcttggttactggtattcttagcaggatcttctgttcttttatattacacctttcattctcagtcactttattacagcttaatttttttaaatcctactttggaccatttgagcttctgggaagtattttggattgttggaattacagacttcattctgaaattctttttcatgggcttaaaatgccttattttattggtgccttctttcatcatgccttttaaatctaagggttactggtatatgcttttagaagaattgtgtcaatactaccgaacttttgttcccataccagtttggtttcgctaccttataagctatggggagtttggtaacgtaactagatggagtcttgggatactgctggctttactctacctcatattaaaacttttggaattttttgggcatctgagaactttcagacaggttttacgaatattttttacacaaccaagttatggagtggctgccagcaagagacagtgttcagatgtggatgatatttgttcaatatgtcaagctgaatttcagaagccaattcttctcatctgtcagcatatattttgtgaagagtgcatgaccttatggtttaacagagagaaaacatgtccactctgcagaactgtgatttcagaccatataaacaaatggaaggatggagccacttcatcacaccttcaaatatattaagttgtataaactatcaaggccacaaaatactaatgtcatttggtcataatgactactgataaggcatcagaatggattttcagggctaccagaaaaatgtttccagatggttttagaatgtaggacttatgatccaattcaccaaaagattaaatgaaaccaccctgtgttttaaaatatatataatgttcaacctaatgtatatgcaacatttattctattctaattatttgacaggtaactgcagtgttaaattgtaaatgtgttttctttatgttaccaaaacagcaatttgaaattagaactagtggttttagagaactcaggtattctttcctgacattgttttcagaataaagaatatttttcataatattttaagatacatactatctaaaagtagaattttgttcagcattgacttttataattcccatcctaaaaattcttaatattttcataaaatttgtatttttaaatgaaaattctaaatgttgtattttatcagtaacattttctaagtgaagattaatttactgaggatgatacattatagtattgtattattctctgtagtaagattagtaataagtgaaaataaatgatttaaattcaaaaaaagaaaagaaacagaacgaccgaccgacagtacgagcgacccgagaacatgacacacagcaaacgaaccaagcgagcacaccaacgcgatcgccacaagcagcggcgagccgcccacgcgcctaaccaccctacagcggggcgggggacctatctaaaccacggggccgcgcccccacgccccgttctacaacaccgggcagcagaggtaagcccaagcgcgcgcccacacgcgac

SEQ ID NO: 343183 - DNA, 2112 bp, Homo sapiens
cgcgtgagaacgtccggggagcgcgcgcgccgccgccgttgccgccgggctgagagaagagcttgcggggtttgcggttgatggccccgactgaagggctggaggcggtgtatgccgctgttcttgctgtcgctcccgacacctccgtccgcttctggtcatgagaggagacagaggcctgaagcaaagacatctgggtcagagaaaaagtatttaagggccatgcaagccaatcgtagccaactgcacagtcctccaggaactggaagcagtgaggatgcctcaacccctcagtgtgtccacacaagattgacaggagagggttcttgccctcattctggagatgttcatatccagataaactccatacctaaagaatgtgcagaaaatgcaagctccagaaatataaggtcaggtgtccatagctgtgcccatggatgtgtacacagtcgcttacggggtcactcccacagtgaagcaaggctgactgatgatactgccgcagaatctggagatcatggtagtagctccttctcagaattccgctatctcttcaagtggctgcaaaaaagtcttccatatattttgattctgagcgtcaaacttgttatgcagcatataacaggaatttctcttggaattgggctgctaacaacttttatgtatgcaaacaaaagcattgtaaatcaggtttttctaagagaaaggtcctcaaagattcagtgtgcttggttactggtattcttagcaggatcttctgttcttttatattacacctttcattctcagtcactttattacaggctagaaaggtgtcaactatgacaaaccgtgaagactttttccttattctatgaagggaagatctaaaatccaaacagcttaatttttttaaatcctactttggaccatttgagcttctgggaagtattttggattgttggaattacagacttcattctgaaattctttttcatgggcttaaaatgccttattttattggtgccttctttcatcatgccttttaaatctaagggttactggtatatgcttttagaagaattgtgtcaatactaccgaacttttgttcccataccagtttggtttcgctaccttataagctatggggagtttggtaacgtaactagatggagtcttgggatactgctggctttactctacctcatattaaaacttttggaattttttgggcatctgagaactttcagacaggttttacgaatattttttacacaaccaagttatggagtggctgccagcaagagacagtgttcagatgtggatgatatttgttcaatatgtcaagctgaatttcagaagccaattcttctcatctgtcagcatatattttgtgaagagtgcatgaccttatggtttaacagagagaaaacatgtccactctgcagaactgtgatttcagaccatataaacaaatggaaggatggagccacttcatcacaccttcaaatatattaagttgtataaactatcaaggccacaaaatactaatgtcatttggtcataatgactactgataaggcatcagaatggattttcagggctaccagaaaaatgtttccagatggttttagaatgtaggacttatgatccaattcaccaaaagattaaatgaaaccaccctgtgttttaaaatatatataatgttcaacctaatgtatatgcaacatttattctattctaattatttgacaggtaactgcagtgttaaattgtaaatgtgttttctttatgttaccaaaacagcaatttgaaattagaactagtggttttagagaactcaggtattctttcctgacattgttttcagaataaagaatatttttcataatattttaagatacatactatctaaaagtagaattttgttcagcattgacttttataattcccatcctaaaaattcttaatattttcataaaatttgtatttttaaatgaaaattctaaatgttgtattttatcagtaacattttctaagtgaagattaatttactgaggatgatacattatagtattgtattattctctgtagtaagattagtaataagtgaaaataaatgatttaaattca

SEQ ID NO: 343184 - DNA, 1446 bp, Homo sapiens
cgcgtgagaacgtccggggagcgcgcgcgccgccgccgttgccgccgggctgagagaagagcttgcggggtttgcggttgatggccccgactgaagggctggaggcggtgtatgccgctgttcttgctgtcgctcccgacacctccgtccgcttctggtcatgagaggagacagaggcctgaagcaaagacatctgggtcagagaaaaagtatttaagggccatgcaagccaatcgtagccaactgcacagtcctccaggaactggaagcagtgaggatgcctcaacccctcagtgtgtccacacaagattgacaggagagggttcttgccctcattctggagatgttcatatccagataaactccatacctaaagaatgtgcagaaaatgcaagctccagaaatataaggtcaggtgtccatagctgtgcccatggatgtgtacacagtcgcttacggggtcactcccacagtgaagcaaggctgactgatgatactgccgcagaatctggagatcatggtagtagctccttctcagaattccgctatctcttcaagtggctgcaaaaaagtcttccatatattttgattctgagcgtcaaacttgttatgcagcatataacaggaatttctcttggaattgggctgctaacaacttttatgtatgcaaacaaaagcattgtaaatcaggtttttctaagagaaaggtcctcaaagattcagtgtgcttggttactggtattcttagcaggatcttctgttcttttatattacacctttcattctcagtcactttattacagcttaatttttttaaatcctactttggaccatttgagcttctgggaagtattttggattgttggaattacagacttcattctgaaattctttttcatgggcttaaaatgccttattttattggtgccttctttcatcatgccttttaaatctaagggttactggtatatgcttttagaagaattgtgtcaatactaccgaacttttgttcccataccagtttggtttcgctaccttataagctatggggagtttggtaacgtaactagatggagtcttgggatactgctggctttactctacctcatattaaaacttttggaattttttgggcatctgagaactttcagacaggttttacgaatattttttacacaaccaagttatggagtggctgccagcaagagacagtgttcagatgtggatgatatttgttcaatatgtcaagctgaatttcagaagccaattcttctcatctgtcagcatatattttgtgaagagtgcatgaccttatggtttaacagagagaaaacatgtccactctgcagaactgtgatttcagaccatataaacaaatggaaggatggagccaactttcaatcaaaaaaacttttccaaaaaatttaattttatttttaaagggtg

SEQ ID NO: 343185 - DNA, 273 bp, Homo sapiens
ctccggctgtgcaaggcaggctgcacgcttgggagccatgtactgcaggaggaaccttctggtaatgataggatagggttggaggataagtaccccggcctcctcattccccagtgggacgactctgcggcatgtctgcgctggctcccagggaacagcaccccagatgcccacactaataacctggtctctcactcatcctgactgggctgccttcccttccctgtctctcttcccctttcttctccctctcctcctgggatcacctcccat

SEQ ID NO: 343186 - DNA, 425 bp, Homo sapiens
aggatgcagcagaagcgacgctgtgtcacttccgaggctgaagctgcagagatttgaggcatctgctctcacccagcttgaagtgcttcctcttggaagccagccaccgtgaaaaaccccgccatgctgtgaggaagcccaagagagctgcatggagagaagggcctgtggaagagccctgaggtgccactcacatgaagtgaacctttgtggaccttccagcccagctaccagcaaaacgcaagcagcgagtgtccccagtcaacgcttctctctataggagacctgtaaatggggtggcggggggagcaggaggaattttctgatctcacacactgttatgagttgaattgtctccccacccaaattcatatgttgaagcccccaccttcagtactttacaaagtaatgtatttggagataat

SEQ ID NO: 343187 - DNA, 129 bp, Homo sapiens
tacacactagatactggcctatatggaatggtcccatttatgtaaaattgtgtatgtgcatgcacagatctgtcttctatcagggtatctggaaaatgttcaacaaaatagtaacaatggttatctgtt

SEQ ID NO: 343188 - DNA, 587 bp, Homo sapiens
gttggagagcaaacttcagaggctacaggctcagggtatccaagtatttgatcctggggagtctgattcagatgacaactgtacagatgtcactggtaagtgtatatcctatttatattttgagctttcaacatggctgtaatgacatgtagagccaactttgaattctgctagatttcttttacttatctatattaggttattgctttaactactgttgcaaatagtgtcgtgtgttctttctgtcagctgctaaaacacctcttctccacaaagtgtatgaattttggggactgaagttccttctaccttgtcactctgccaaccctaacccataacttttactctctagtctaagatatctaccccagctcccaccagcacatctgcattttagccaagggaaagaaggaaggggagaacacgttcctttcccagaaggtacaacctaagatcacttctcaaatcccattagtcagaactataactgggaagactggatagtgtaatcagcagccaggcagacatgtgtccaactaaaatgtagtgttctgttactgaagaaagaagaggagaatggatattgg

SEQ ID NO: 343189 - DNA, 130 bp, Homo sapiens
tggtcagtgtcgctaaaggatgctaaatgccctcacttgtattcaacaaacatgaccttaccctctgtatgacaggataaatgaagggtgctttgtcttgatgtgcagacattaggaaagcttaagtggc

SEQ ID NO: 343190 - DNA, 757 bp, Homo sapiens
cctgccagttttctccattcaagatagtccctttggagatgcgcccctgggtcgaagccactactggccatcccagagccagacctggtgtcccaagaccctgagcccatccaggtctcagagatccaggctcccacaagctcccaaggctctagccacaggtcccaactcccctgagctgtttgaggagtcctggccatccagttcagggaccccctccctgcccagcaccactgagggacagatgtgggcctccccagcacccaccctgattgacagcggggactccgtggtggccaagtatataaacaggttccgccaggctcagcccaccagtcgagaggagcgccagcctgcaggcccaaccccagctgacttttggtggctgcagtctgactctccagaccccagcagtcaaagtgcagcagcaggagccaacaaaccagaaggaagaccccatacagctgtccctactgcggtcaacgtgaccagtgcatcccatgctgtggctccccttcaggaaataaagcagaacctccacacatggaactcatccctgctggacctggagacgctgagcctacagagcagagctgccaggctgctcaaacgcagcaaagcctccatctcctcctcctcctccctcagccccagcgatgccagcacttcctcattccccaccagctctgatggctctctcccttctcggagaccttcatccctgactccagcaagggccttggccccagggcacccg

SEQ ID NO: 343191 - DNA, 411 bp, Homo sapiens
cctgccagttttctccattcaagatagtccctttggagatgcgcccctgggtcgaagccactactggccatcccagagccagacctggtgtcccaaggtatataaacaggttccgccaggctcagcccaccagtcgagaggagcgccagcctgcaggcccaaccccagctgacttttggtggctgcagtctgactctccagaccccagcagtcaaagtgcagcagcaggagccaacaaaccagaaggaagaccccatacagctgtccctactgcggtcaacgtgaccagtgcatcccatgctgtggctccccttcaggaaataaagcaggtgacatccccattcactccctcccttgggtgcctgaactgacaacaccagccctgggcaacaagtgaaattcaatctcaaa

SEQ ID NO: 343192 - DNA, 837 bp, Homo sapiens
cctgccagttttctccattcaagatagtccctttggagatgcgcccctgggtcgaagccactactggccatcccagagccagacctggtgtcccaagaccctgagcccatccaggtctcagagatccaggctcccacaagctcccaaggctctagccacaggtcccaactcccctgagctgtttgaggagtcctggccatccagttcagggaccccctccctgcccagcaccactgagggacagatgtgggcctccccagcacccaccctgattgacagcggggactccgtggtggccaagtatataaacaggttccgccaggctcagcccaccagtcgagaggagcgccagcctgcaggcccaaccccagctgacttttggtggctgcagtctgactctccagaccccagcagtcaaagtgcagcaggtacctctttcagtgccatccactactcccacccctaaacctttgctgatcaatgcccccagcagccactcctcctggccctcatacctcaactggggcttctcagcaggagccaacaaaccagaaggaagaccccatacagctgtccctactgcggtcaacgtgaccagtgcatcccatgctgtggctccccttcaggaaataaagcaggtgacatccccattcactccctcccttgggtgcctgaactgacaacaccagccctaggatagaattagaagatcaggagcagtggctcacacctgtaatcccagcactttgggaggccaaggtgagaggactgcttgaggccaggagttcaagaccagcttgggtgacatggtgagattctgcctctactaaaaaaaaa

SEQ ID NO: 343193 - DNA, 731 bp, Homo sapiens
cctgccagttttctccattcaagatagtccctttggagatgcgcccctgggtcgaagccactactggccatcccagagccagacctggtgtcccaagaccctgagcccatccaggtctcagagatccaggctcccacaagctcccaaggctctagccacaggtcccaactcccctgagctgtttgaggagtcctggccatccagttcagggaccccctccctgcccagcaccactgagggacagatgtgggcctccccagcacccaccctgattgacagcggggactccgtggtggccaagtatataaacaggttccgccaggctcagcccaccagtcgagaggagcgccagcctgcaggcccaaccccagctgacttttggtggctgcagtctgactctccagaccccagcagtcaaagtgcagcagcaggagccaacaaaccagaaggaagaccccatacagctgtccctactgcggtcaacgtgaccagtgcatcccatgctgtggctccccttcaggaaataaagcaggtgacatccccattcactccctcccttgggtgcctgaactgacaacaccagccctaggatagaattagaagatcaggagcagtggctcacacctgtaatcccagcactttgggaggccaaggtgagaggactgcttgaggccaggagttcaagaccagcttgggtgacatggtgagattctgcctctactaaaaaaaaa

SEQ ID NO: 343194 - DNA, 4659 bp, Homo sapiens
tgttctccgctgaggaggagcggggcagaggagggaggcagcgggtgagagttcagagttcagcagcagcagcccgagcccatgattcccatatgccctgtagtttctttcacctatgtgcccagccggctgggggaagatgccaaaatggcgaccggcaactactttggattcacccacagcggggcggcggcggcggcggctgcggcccaatatagccagcagccagcttcgggtgtagcctattctcatccaactacagttgctagctacactgtccatcaggctccagtagctgctcacacagttactgctgcctatgcaccagcagccgccacagttgcagttgccaggcctgctccagtagctgttgcagctgctgcaacagctgctgcttatggaggctaccccactgcacacacagcaactgactatggttatactcagaggcaacaagaagcaccaccaccaccacccccagctactacacaaaactaccaggattcatactcatatgtaaggtccacagctcctgctgtagcttatgatagtaagcaatactaccaacaaccaacagcaactgctgctgctgtagctgccgctgcccaacctcagccttctgttgctgaaacttactatcagacagcccccaaagcaggttacagccaaggtgcaactcagtatactcaagcccagcaaactcgacaagtgacagccataaaaccagccacaccaagtccagctaccactactttctccatctatcctgtatcctccaccgtacagccagtagcagctgcggctactgtggtgccatcctatactcagagtgctacttacagtaccacagcagttacatattctggtacgtcttattcaggttatgaagcagcagtgtattcagctgcatcttcctactatcaacagcagcagcagcaacagaagcaggcagcagcagcagctgctgctgctgctgcaacagctgcctggacagggaccacctttactaaaaaagcaccattccaaaataaacaactgaaaccaaaacagcctcccaaaccaccacagattcactattgtgatgtttgtaagatcagctgtgctggaccacagacttataaagaacatttagaaggacagaaacataaaaaaaaagaagctgcattgaaagcctcacaaaataccagcagcagcaacagttctactcgtgggactcaaaatcagctacgttgtgagctctgcgatgtgtcttgtacaggagcagatgcgtatgctgcccacattcgtggtgctaagcatcagaaagtggttaagttacacacaaaacttggtaaacccattccatcaacagaaccaaatgttgttagccaagctacttcttcaacagctgtatctgcttcaaagccgactgcctctccttcaagcattgcagcaaacaattgtactgtgaatacgtcatcaattgcaacgtcttcaatgaagggtcttacgactacaggaaactcgtctcttaatagcacatctaacactaaagtatcagcagtgcctacaaatatggctgccaagaaaacatctacccccaaaataaattttgttggtggtaataagctgcagtcaacaggaaataaagcagaagacataaaaggaaccgaatgtgttaaaagtactcctgtcacttctgctgtgcagattcctgaagtaaagcaagacacagtgtcagaaccagtcacacctgcatctcttgctgctttacagagtgatgtgcagccagtgggccatgattatgtggaagaggtacgaaatgatgaaggaaaagtaattcggttccattgtaaattatgcgagtgcagctttaatgatcccaatgctaaggagatgcacttaaaagggcgaagacacagacttcaatataaaattcaagaagagaaaatgaggaagcaaatgcagaaggaggagtactggcgaagacgagaagaagaggagcgttggagaatggaaatgagacgttatgaagaggacatgtactggaggagaatggaggaagaacaacatcattgggatgatcgccgccgaatgccagatggaggttatcctcatggtcctccaggcccattaggccttctgggagtccgaccaggcatgcctcctcagcctcaggggcctgcacccttacgtcgtcctgactcatctgatgaccgttatgtaatgacaaaacatgccaccatttatccaactgaagaggagttacaggcagttcagaaaattgtttctattactgaacgtgctttaaaactcgtttcagacagtttgtctgaacatgagaagaacaagaacaaagagggagatgataagaaagagggaggtaaagacagagctttgaaaggagttttgcgagtgggagtattggcaaaaggattacttctccgaggagatagaaatgtcaaccttgttttgctgtgctcagagaaaccttcaaagacattattaagccgtattgcagaaaacctacccaaacagcttgctgttataagccctgagaagtatgacataaaatgtgctgtatctgaagcggcaataattttgaattcatgtgtggaacccaaaatgcaagtcactatcacactgacatctccaattattcgagaagagaacatgagggaaggagatgtaacctcgggtatggtgaaagacccaccggacgtcttggacaggcaaaaatgccttgacgctctggctgctctacgccacgctaagtggttccaggctagagctaatggtctgcagtcctgtgtgattatcatacgcattcttcgagacctctgtcagcgagttccaacttggtctgattttccaagctgggctatggagttactagtagagaaagcaatcagcagtgcttctagccctcagagccctggggatgcactgagaagagtttttgaatgcatttcttcagggattattcttaaaggtagtcctggacttctggatccttgtgaaaaggatccctttgataccttggcaacaatgactgaccagcagcgtgaagacatcacatccagtgcacagtttgcattgagactccttgcattccgccagatacacaaagttctaggcatggatccattaccgcaaatgagccaacgttttaacatccacaacaacaggaaacgaagaagagatagtgatggagttgatggatttgaagctgaggggaaaaaagacaaaaaagattatgataacttttaaaaagtgtctgtaaatcttcagtgttaaaaaaacagatgcccatttgttggctgtttttcattcataataatgtctacattgaaaaatttatcaagaatttaaaggatttcatggaagaaccaagtttttctatgatattaaaaaatgtacagtgttaggtattatttgaatggaaagacacccaaaaaaaaaaatgtgctccgactagggggaaaacagtagttccgattttttcccattatttttattttattttctggttgccctagcttccccccctatttttgtgtcttttattaactagtgcattgtcttattaaatcttcactgtatttaatgcaggatgtgtgcttcagttgctctgtgtattttgatattttaatttagaggttttgtttgctttttgacactagttgtaagttactttgttatagatggtatcctttaccccttcttaatattttacagcagtacgtttttttgtaacgtgagactgcagagtttgtttttctatatgtgaaggattacaacacaaaaagttatcctgccattcgagtgctcagaactgaatgtttctgcagatcttgtggcatttgtctctagtgtgatatataaaggtgtaattaagacagagttctgttaatctaatcaagtttgctgttagttgtgcattagcagtataaaagctaatatatactatatggtcttgcaacagttttaaagcctctgcataattgataataaaaatgcatgacattcttgtttttaatagacttttaaaatcataattttaggtttaacacgtagatctttgtacagttgactttttgacatagcaaggccaaaaataactttctgaatatttttttcttgtgtataagtggaaagggcatttttcacatataagtgggctaaccaatattttcaaaagaacttcatcattgtacaactaacaacagtaactagcccttaattatggtgacagttccttattggtgtgtgtgagattactctagcaactattacagtataacacagatgatcttctccacacaccccatcacccagataatttacagttctgttaacagtgaggttgataaagtattactgataaaaaattatctaaggaaaaaaacagaaaattatttggtgtggccatcttacctgcttatgtctcctacacaaagctaaatattctagcagtgatgtaatgaaaaattacatcttactgttgatatatgtatgctctggtacacagatgtcattttgttgtcacagcactacagtgaaatacacaaaaaatgaaattcatataatgacttaaatgtattatatgttagaattgacaacataaactacttttgctttgaaatgatgtatgcttcagtaaaatcatattcaaattta

SEQ ID NO: 343195 - DNA, 4526 bp, Homo sapiens
ctagttctgttctctggagcagcatggaccagcagccagcttcgggtgtagcctattctcatccaactacagttgctagctacactgtccatcaggctccagtagctgctcacacagttactgctgcctatgcaccagcagccgccacagttgcagttgccaggcctgctccagtagctgttgcagctgctgcaacagctgctgcttatggaggctaccccactgcacacacagcaactgactatggttatactcagaggcaacaagaagcaccaccaccaccacccccagctactacacaaaactaccaggattcatactcatatgtaaggtccacagctcctgctgtagcttatgatagtaagcaatactaccaacaaccaacagcaactgctgctgctgtagctgccgctgcccaacctcagccttctgttgctgaaacttactatcagacagcccccaaagcaggttacagccaaggtgcaactcagtatactcaagcccagcaaactcgacaagtgacagccataaaaccagccacaccaagtccagctaccactactttctccatctatcctgtatcctccaccgtacagccagtagcagctgcggctactgtggtgccatcctatactcagagtgctacttacagtaccacagcagttacatattctggtacgtcttattcaggttatgaagcagcagtgtattcagctgcatcttcctactatcaacagcagcagcagcaacagaagcaggcagcagcagcagctgctgctgctgctgcaacagctgcctggacagggaccacctttactaaaaaagcaccattccaaaataaacaactgaaaccaaaacagcctcccaaaccaccacagattcactattgtgatgtttgtaagatcagctgtgctggaccacagacttataaagaacatttagaaggacagaaacataaaaaaaaagaagctgcattgaaagcctcacaaaataccagcagcagcaacagttctactcgtgggactcaaaatcagctacgttgtgagctctgcgatgtgtcttgtacaggagcagatgcgtatgctgcccacattcgtggtgctaagcatcagaaagtggttaagttacacacaaaacttggtaaacccattccatcaacagaaccaaatgttgttagccaagctacttcttcaacagctgtatctgcttcaaagccgactgcctctccttcaagcattgcagcaaacaattgtactgtgaatacgtcatcaattgcaacgtcttcaatgaagggtcttacgactacaggaaactcgtctcttaatagcacatctaacactaaagtatcagcagtgcctacaaatatggctgccaagaaaacatctacccccaaaataaattttgttggtggtaataagctgcagtcaacaggaaataaagcagaagacataaaaggaaccgaatgtgttaaaagtactcctgtcacttctgctgtgcagattcctgaagtaaagcaagacacagtgtcagaaccagtcacacctgcatctcttgctgctttacagagtgatgtgcagccagtgggccatgattatgtggaagaggtacgaaatgatgaaggaaaagtaattcggttccattgtaaattatgcgagtgcagctttaatgatcccaatgctaaggagatgcacttaaaagggcgaagacacagacttcaatataaaaaaaaagtaaatccagatttgcaagtagaagtaaagcctagtattcgagcaagaaagattcaagaagagaaaatgaggaagcaaatgcagaaggaggagtactggcgaagacgagaagaagaggagcgttggagaatggaaatgagacgttatgaagaggacatgtactggaggagaatggaggaagaacaacatcattgggatgatcgccgccgaatgccagatggaggttatcctcatggtcctccaggcccattaggccttctgggagtccgaccaggcatgcctcctcagcctcaggggcctgcacccttacgtcgtcctgactcatctgatgaccgttatgtaatgacaaaacatgccaccatttatccaactgaagaggagttacaggcagttcagaaaattgtttctattactgaacgtgctttaaaactcgtttcagacagtttgtctgaacatgagaagaacaagaacaaagagggagatgataagaaagagggaggtaaagacagagctttgaaaggagttttgcgagtgggagtattggcaaaaggattacttctccgaggagatagaaatgtcaaccttgttttgctgtgctcagagaaaccttcaaagacattattaagccgtattgcagaaaacctacccaaacagcttgctgttataagccctgagaagtatgacataaaatgtgctgtatctgaagcggcaataattttgaattcatgtgtggaacccaaaatgcaagtcactatcacactgacatctccaattattcgagaagagaacatgagggaaggagatgtaacctcgggtatggtgaaagacccaccggacgtcttggacaggcaaaaatgccttgacgctctggctgctctacgccacgctaagtggttccaggctagagctaatggtctgcagtcctgtgtgattatcatacgcattcttcgagacctctgtcagcgagttccaacttggtctgattttccaagctgggctatggagttactagtagagaaagcaatcagcagtgcttctagccctcagagccctggggatgcactgagaagagtttttgaatgcatttcttcagggattattcttaaaggtagtcctggacttctggatccttgtgaaaaggatccctttgataccttggcaacaatgactgaccagcagcgtgaagacatcacatccagtgcacagtttgcattgagactccttgcattccgccagatacacaaagttctaggcatggatccattaccgcaaatgagccaacgttttaacatccacaacaacaggaaacgaagaagagatagtgatggagttgatggatttgaagctgaggggaaaaaagacaaaaaagattatgataacttttaaaaagtgtctgtaaatcttcagtgttaaaaaaacagatgcccatttgttggctgtttttcattcataataatgtctacattgaaaaatttatcaagaatttaaaggatttcatggaagaaccaagtttttctatgatattaaaaaatgtacagtgttaggtattatttgaatggaaagacacccaaaaaaaaaaatgtgctccgactagggggaaaacagtagttccgattttttcccattatttttattttattttctggttgccctagcttccccccctatttttgtgtcttttattaactagtgcattgtcttattaaatcttcactgtatttaatgcaggatgtgtgcttcagttgctctgtgtattttgatattttaatttagaggttttgtttgctttttgacactagttgtaagttactttgttatagatggtatcctttaccccttcttaatattttacagcagtacgtttttttgtaacgtgagactgcagagtttgtttttctatatgtgaaggattacaacacaaaaagttatcctgccattcgagtgctcagaactgaatgtttctgcagatcttgtggcatttgtctctagtgtgatatataaaggtgtaattaagacagagttctgttaatctaatcaagtttgctgttagttgtgcattagcagtataaaagctaatatatactatatggtcttgcaacagttttaaagcctctgcataattgataataaaaatgcatgacattcttgtttttaatagacttttaaaatcataattttaggtttaacacgtagatctttgtacagttgactttttgacatagcaaggccaaaaataactttctgaatatttttttcttgtgtataagtggaaagggcatttttcacatataagtgggctaaccaatattttcaaaagaacttcatcattgtacaactaacaacagtaactagcccttaattatggtgacagttccttattggtgtgtgtgagattactctagcaactattacagtataacacagatgatcttctccacacaccccatcacccagataatttacagttctgttaacagtgaggttgataaagtattactgataaaaaattatctaaggaaaaaaacagaaaattatttggtgtggccatcttacctgcttatgtctcctacacaaagctaaatattctagcagtgatgtaatgaaaaattacatcttactgttgatatatgtatgctctggtacacagatgtcattttgttgtcacagcactacagtgaaatacacaaaaaatgaaattcatataatgacttaaatgtattatatgttagaattgacaacataaactacttttgctttgaaatgatgtatgcttcagtaaaatcatattcaaattta

SEQ ID NO: 343196 - DNA, 4356 bp, Homo sapiens
tgttctccgctgaggaggagcggggcagaggagggaggcagcgggtgagagttcagagttcagcagcagcagcccgagcccatgattcccatatgccctgtagtttctttcacctatgtgcccagccggctgggggaagatgccaaaatggcgaccggcaactactttggattcacccacagcggggcggcggcggcggcggctgcggcccaatatagccagcagccagcttcgggtgtagcctattctcatccaactacagttgctagctacactgtccatcaggctccagtagctgctcacacagttactgctgcctatgcaccagcagccgccacagttgcagttgccaggcctgctccagtagctgttgcagctgctgcaacagctgctgcttatggaggctaccccactgcacacacagcaactgactatggttatactcagaggcaacaagaagcaccaccaccaccacccccagctactacacaaaactaccaggattcatactcatatgtaaggtccacagctcctgctgtagcttatgatagtaagcaatactaccaacaacagcagcaacagaagcaggcagcagcagcagctgctgctgctgctgcaacagctgcctggacagggaccacctttactaaaaaagcaccattccaaaataaacaactgaaaccaaaacagcctcccaaaccaccacagattcactattgtgatgtttgtaagatcagctgtgctggaccacagacttataaagaacatttagaaggacagaaacataaaaaaaaagaagctgcattgaaagcctcacaaaataccagcagcagcaacagttctactcgtgggactcaaaatcagctacgttgtgagctctgcgatgtgtcttgtacaggagcagatgcgtatgctgcccacattcgtggtgctaagcatcagaaagtggttaagttacacacaaaacttggtaaacccattccatcaacagaaccaaatgttgttagccaagctacttcttcaacagctgtatctgcttcaaagccgactgcctctccttcaagcattgcagcaaacaattgtactgtgaatacgtcatcaattgcaacgtcttcaatgaagggtcttacgactacaggaaactcgtctcttaatagcacatctaacactaaagtatcagcagtgcctacaaatatggctgccaagaaaacatctacccccaaaataaattttgttggtggtaataagctgcagtcaacaggaaataaagcagaagacataaaaggaaccgaatgtgttaaaagtactcctgtcacttctgctgtgcagattcctgaagtaaagcaagacacagtgtcagaaccagtcacacctgcatctcttgctgctttacagagtgatgtgcagccagtgggccatgattatgtggaagaggtacgaaatgatgaaggaaaagtaattcggttccattgtaaattatgcgagtgcagctttaatgatcccaatgctaaggagatgcacttaaaagggcgaagacacagacttcaatataaaaaaaaagtaaatccagatttgcaagtagaagtaaagcctagtattcgagcaagaaagattcaagaagagaaaatgaggaagcaaatgcagaaggaggagtactggcgaagacgagaagaagaggagcgttggagaatggaaatgagacgttatgaagaggacatgtactggaggagaatggaggaagaacaacatcattgggatgatcgccgccgaatgccagatggaggttatcctcatggtcctccaggcccattaggccttctgggagtccgaccaggcatgcctcctcagcctcaggggcctgcacccttacgtcgtcctgactcatctgatgaccgttatgtaatgacaaaacatgccaccatttatccaactgaagaggagttacaggcagttcagaaaattgtttctattactgaacgtgctttaaaactcgtttcagacagtttgtctgaacatgagaagaacaagaacaaagagggagatgataagaaagagggaggtaaagacagagctttgaaaggagttttgcgagtgggagtattggcaaaaggattacttctccgaggagatagaaatgtcaaccttgttttgctgtgctcagagaaaccttcaaagacattattaagccgtattgcagaaaacctacccaaacagcttgctgttataagccctgagaagtatgacataaaatgtgctgtatctgaagcggcaataattttgaattcatgtgtggaacccaaaatgcaagtcactatcacactgacatctccaattattcgagaagagaacatgagggaaggagatgtaacctcgggtatggtgaaagacccaccggacgtcttggacaggcaaaaatgccttgacgctctggctgctctacgccacgctaagtggttccaggctagagctaatggtctgcagtcctgtgtgattatcatacgcattcttcgagacctctgtcagcgagttccaacttggtctgattttccaagctgggctatggagttactagtagagaaagcaatcagcagtgcttctagccctcagagccctggggatgcactgagaagagtttttgaatgcatttcttcagggattattcttaaaggtagtcctggacttctggatccttgtgaaaaggatccctttgataccttggcaacaatgactgaccagcagcgtgaagacatcacatccagtgcacagtttgcattgagactccttgcattccgccagatacacaaagttctaggcatggatccattaccgcaaatgagccaacgttttaacatccacaacaacaggaaacgaagaagagatagtgatggagttgatggatttgaagctgaggggaaaaaagacaaaaaagattatgataacttttaaaaagtgtctgtaaatcttcagtgttaaaaaaacagatgcccatttgttggctgtttttcattcataataatgtctacattgaaaaatttatcaagaatttaaaggatttcatggaagaaccaagtttttctatgatattaaaaaatgtacagtgttaggtattatttgaatggaaagacacccaaaaaaaaaaatgtgctccgactagggggaaaacagtagttccgattttttcccattatttttattttattttctggttgccctagcttccccccctatttttgtgtcttttattaactagtgcattgtcttattaaatcttcactgtatttaatgcaggatgtgtgcttcagttgctctgtgtattttgatattttaatttagaggttttgtttgctttttgacactagttgtaagttactttgttatagatggtatcctttaccccttcttaatattttacagcagtacgtttttttgtaacgtgagactgcagagtttgtttttctatatgtgaaggattacaacacaaaaagttatcctgccattcgagtgctcagaactgaatgtttctgcagatcttgtggcatttgtctctagtgtgatatataaaggtgtaattaagacagagttctgttaatctaatcaagtttgctgttagttgtgcattagcagtataaaagctaatatatactatatggtcttgcaacagttttaaagcctctgcataattgataataaaaatgcatgacattcttgtttttaatagacttttaaaatcataattttaggtttaacacgtagatctttgtacagttgactttttgacatagcaaggccaaaaataactttctgaatatttttttcttgtgtataagtggaaagggcatttttcacatataagtgggctaaccaatattttcaaaagaacttcatcattgtacaactaacaacagtaactagcccttaattatggtgacagttccttattggtgtgtgtgagattactctagcaactattacagtataacacagatgatcttctccacacaccccatcacccagataatttacagttctgttaacagtgaggttgataaagtattactgataaaaaattatctaaggaaaaaaacagaaaattatttggtgtggccatcttacctgcttatgtctcctacacaaagctaaatattctagcagtgatgtaatgaaaaattacatcttactgttgatatatgtatgctctggtacacagatgtcattttgttgtcacagcactacagtgaaatacacaaaaaatgaaattcatataatgacttaaatgtattatatgttagaattgacaacataaactacttttgctttgaaatgatgtatgcttcagtaaaatcatattcaaattta

SEQ ID NO: 343197 - DNA, 5409 bp, Homo sapiens
tgttctccgctgaggaggagcggggcagaggagggaggcagcgggtgagagttcagagttcagcagcagcagcccgagcccatgattcccatatgccctgtagtttctttcacctatgtgcccagccggctgggggaagatgccaaaatggcgaccggcaactactttggattcacccacagcggggcggcggcggcggcggctgcggcccaatatagccagcagccagcttcgggtgtagcctattctcatccaactacagttgctagctacactgtccatcaggctccagtagctgctcacacagttactgctgcctatgcaccagcagccgccacagttgcagttgccaggcctgctccagtagctgttgcagctgctgcaacagctgctgcttatggaggctaccccactgcacacacagcaactgactatggttatactcagaggcaacaagaagcaccaccaccaccacccccagctactacacaaaactaccaggattcatactcatatgtaaggtccacagctcctgctgtagcttatgatagtaagcaatactaccaacaaccaacagcaactgctgctgctgtagctgccgctgcccaacctcagccttctgttgctgaaacttactatcagacagcccccaaagcaggttacagccaaggtgcaactcagtatactcaagcccagcaaactcgacaagtgacagccataaaaccagccacaccaagtccagctaccactactttctccatctatcctgtatcctccaccgtacagccagtagcagctgcggctactgtggtgccatcctatactcagagtgctacttacagtaccacagcagttacatattctggtacgtcttattcaggttatgaagcagcagtgtattcagctgcatcttcctactatcaacagcagcagcagcaacagaagcaggcagcagcagcagctgctgctgctgctgcaacagctgcctggacagggaccacctttactaaaaaagcaccattccaaaataaacaactgaaaccaaaacagcctcccaaaccaccacagattcactattgtgatgtttgtaagatcagctgtgctggaccacagacttataaagaacatttagaaggacagaaacataaaaaaaaagaagctgcattgaaagcctcacaaaataccagcagcagcaacagttctactcgtgggactcaaaatcagctacgttgtgagctctgcgatgtgtcttgtacaggagcagatgcgtatgctgcccacattcgtggtgctaagcatcagaaagtggttaagttacacacaaaacttggtaaacccattccatcaacagaaccaaatgttgttagccaagctacttcttcaacagctgtatctgcttcaaagccgactgcctctccttcaagcattgcagcaaacaattgtactgtgaatacgtcatcaattgcaacgtcttcaatgaagggtcttacgactacaggaaactcgtctcttaatagcacatctaacactaaagtatcagcagtgcctacaaatatggctgccaagaaaacatctacccccaaaataaattttgttggtggtaataagctgcagtcaacaggaaataaagcagaagacataaaaggaaccgaatgtgttaaaagtactcctgtcacttctgctgtgcagattcctgaagtaaagcaagacacagtgtcagaaccagtcacacctgcatctcttgctgctttacagagtgatgtgcagccagtgggccatgattatgtggaagaggtacgaaatgatgaaggaaaagtaattcggttccattgtaaattatgcgagtgcagctttaatgatcccaatgctaaggagatgcacttaaaagggcgaagacacagacttcaatataaaaaaaaagtaaatccagatttgcaagtagaagtaaagcctagtattcgagcaagaaagattcaagaagagaaaatgaggaagcaaatgcagaaggaggagtactggcgaagacgagaagaagaggagcgttggagaatggaaatgagacgttatgaagaggacatgtactggaggagaatggaggaagaacaacatcattgggatgatcgccgccgaatgccagatggaggttatcctcatggtcctccaggcccattaggccttctgggagtccgaccaggcatgcctcctcagcctcaggggcctgcacccttacgtcgtcctgactcatctgatgaccgttatgtaatgacaaaacatgccaccatttatccaactgaagaggagttacaggcagttcagaaaattgtttctattactgaacgtgctttaaaactcgtttcagacagtttgtctgaacatgagaagaacaagaacaaagagggagatgataagaaagagggaggtaaagacagagctttgaaaggagttttgcgagtgggagtattggcaaaaggattacttctccgaggagatagaaatgtcaaccttgttttgctgtgctcagagaaaccttcaaagacattattaagccgtattgcagaaaacctacccaaacagcttgctgttataagccctgagaagtatgacataaaatgtgctgtatctgaagcggcaataattttgaattcatgtgtggaacccaaaatgcaagtcactatcacactgacatctccaattattcgagaagagaacatgagggaaggagatgtaacctcgggtatggtgaaagacccaccggacgtcttggacaggcaaaaatgccttgacgctctggctgctctacgccacgctaagtggttccaggctagagctaatggtctgcagtcctgtgtgattatcatacgcattcttcgagacctctgtcagcgagttccaacttggtctgattttccaagctgggctatggagttactagtagagaaagcaatcagcagtgcttctagccctcagagccctggggatgcactgagaagagtttttgaatgcatttcttcagggattattcttaaaggtagtcctggacttctggatccttgtgaaaaggatccctttgataccttggcaacaatgactgaccagcagcgtgaagacatcacatccagtgcacagtttgcattgagactccttgcattccgccagatacacaaagttctaggcatggatccattaccgcaaatgagccaacgttttaacatccacaacaacaggaaacgaagaagagatagtgatggagttgatggatttgaagctgaggggaaaaaagacaaaaaagattatgataacttttaaaaagtgtctgtaaatcttcagtgttaaaaaaacagatgcccatttgttggctgtttttcattcataataatgtctacattgaaaaatttatcaagaatttaaaggatttcatggaagaaccaagtttttctatgatattaaaaaatgtacagtgttaggtattatttgaatggaaagacacccaaaaaaaaaaatgtgctccgactagggggaaaacagtagttccgattttttcccattatttttattttattttctggttgccctagcttccccccctatttttgtgtcttttattaactagtgcattgtcttattaaatcttcactgtatttaatgcaggatgtgtgcttcagttgctctgtgtattttgatattttaatttagaggttttgtttgctttttgacactagttgtaagttactttgttatagatggtatcctttaccccttcttaatattttacagcagtacgtttttttgtaacgtgagactgcagagtttgtttttctatatgtgaaggattacaacacaaaaagttatcctgccattcgagtgctcagaactgaatgtttctgcagatcttgtggcatttgtctctagtgtgatatataaaggtgtaattaagacagagttctgttaatctaatcaagtttgctgttagttgtgcattagcagtataaaagctaatatatactatatggtcttgcaacagttttaaagcctctgcataattgataataaaaatgcatgacattcttgtttttaatagacttttaaaatcataattttaggtttaacacgtagatctttgtacagttgactttttgacatagcaaggccaaaaataactttctgaatatttttttcttgtgtataagtggaaagggcatttttcacatataagtgggctaaccaatattttcaaaagaacttcatcattgtacaactaacaacagtaactagcccttaattatggtgacagttccttattggtgtgtgtgagattactctagcaactattacagtataacacagatgatcttctccacacaccccatcacccagataatttacagttctgttaacagtgaggttgataaagtattactgataaaaaattatctaaggaaaaaaacagaaaattatttggtgtggccatcttacctgcttatgtctcctacacaaagctaaatattctagcagtgatgtaatgaaaaattacatcttactgttgatatatgtatgctctggtacacagatgtcattttgttgtcacagcactacagtgaaatacacaaaaaatgaaattcatataatgacttaaatgtattatatgttagaattgacaacataaactacttttgctttgaaatgatgtatgcttcagtaaaatcatattcaaatttaaaaaaaaaaaacaaaaaaacaaaaaaagaaacaaaaaaaaaaaaaaaaacaacaaaaaacaaaaaacaacacacacaaaacaaaaacaaaacacacaaagaaaaaaacacaaacacacagaggggggggcggcgcgccctacaaaatcaataccaacagaggagggagccaacaaatcatgagaggagacgagcgcaccaaaatatttgtaagacaagaaggagcgcgccccacaagagagaggaggcacgctaatatcaacaagacagcaacccgacgcgaggcagcggcgacgacaaaaaaacaacagtcgatgtgtgcaagcggagacaaaaagacacctactcagggagaactacatcaccgggagcaaaggaaagaaccaaccaacatacaagatgggctgggggaggggaacaaaaaaacataacgagggcgcaaacaacaaccacaacccaaggcggagagagaaagatgacaagagccacgcaagagagggagcaagcaaaaacaaaaaaacaccccaaacgagagcaggcacaccaccaggcggtcgtagacacacaacaagcagcagaaacaaacaatagacagcgcccgtacgcgaaacaaaaaacgacgaggcgaccatgaggagagatcagatgatacgctccaaaaagcaacaaaatatcacaacacacgacaaaggaa

SEQ ID NO: 343198 - DNA, 4661 bp, Homo sapiens
tgttctccgctgaggaggagcggggcagaggagggaggcagcgggtgagagttcagagttcagcagcagcagcccgagcccatgattcccatatgccctgtagtttctttcacctatgtgcccagccggctgggggaagatgccaaaatggcgaccggcaactactttggattcacccacagcggggcggcggcggcggcggctgcggcccaatatagccagcagccagcttcgggtgtagcctattctcatccaactacagttgctagctacactgtccatcaggctccagtagctgctcacacagttactgctgcctatgcaccagcagccgccacagttgcagttgccaggcctgctccagtagctgttgcagctgctgcaacagctgctgcttatggaggctaccccactgcacacacagcaactgactatggttatactcagaggcaacaagaagcaccaccaccaccacccccagctactacacaaaactaccaggattcatactcatatgtaaggtccacagctcctgctgtagcttatgatagtaagcaatactaccaacaaccaacagcaactgctgctgctgtagctgccgctgcccaacctcagccttctgttgctgaaacttactatcagacagcccccaaagcaggttacagccaaggtgcaactcagtatactcaagcccagcaaactcgacaagtgacagccataaaaccagccacaccaagtccagctaccactactttctccatctatcctgtatcctccaccgtacagccagtagcagctgcggctactgtggtgccatcctatactcagagtgctacttacagtaccacagcagttacatattctggtacgtcttattcaggttatgaagcagcagtgtattcagctgcatcttcctactatcaacagcagcagcagcaacagaagcaggcagcagcagcagctgctgctgctgctgcaacagctgcctggacagggaccacctttactaaaaaagcaccattccaaaataaacaactgaaaccaaaacagcctcccaaaccaccacagattcactattgtgatgtttgtaagatcagctgtgctggaccacagacttataaagaacatttagaaggacagaaacataaaaaaaaagaagctgcattgaaagcctcacaaaataccagcagcagcaacagttctactcgtgggactcaaaatcagctacgttgtgagctctgcgatgtgtcttgtacaggagcagatgcgtatgctgcccacattcgtggtgctaagcatcagaaagtggttaagttacacacaaaacttggtaaacccattccatcaacagaaccaaatgttgttagccaagctacttcttcaacagctgtatctgcttcaaagccgactgcctctccttcaagcattgcagcaaacaattgtactgtgaatacgtcatcaattgcaacgtcttcaatgaagggtcttacgactacaggaaactcgtctcttaatagcacatctaacactaaagtatcagcagtgcctacaaatatggctgccaagaaaacatctacccccaaaataaattttgttggtggtaataagctgcagtcaacaggaaataaagcagaagacataaaaggaaccgaatgtgttaaaagtactcctgtcacttctgctgtgcagattcctgaagtaaagcaagacacagtgtcagaaccagtcacacctgcatctcttgctgctttacagagtgatgtgcagccagtgggccatgattatgtggaagaggtacgaaatgatgaaggaaaagtaattcggttccattgtaaattatgcgagtgcagctttaatgatcccaatgctaaggagatgcacttaaaagggcgaagacacagacttcaatataaaaaaaaagtaaatccagatttgcaagtagaagtaaagcctagtattcgagcaagaaagattcaagaagagaaaatgaggaagcaaatgcagaaggaggagtactggcgaagacgagaagaagaggagcgttggagaatggaaatgagacgttatgaagaggacatgtactggaggagaatggaggaagaacaacatcattgggatgatcgccgccgaatgccagatggaggttatcctcatggtcctccaggcccattaggccttctgggagtccgaccaggcatgcctcctcagcctcaggggcctgcacccttacgtcgtcctgactcatctgatgaccgttatgtaatgacaaaacatgccaccatttatccaactgaagaggagttacaggcagttcagaaaattgtttctattactgaacgtgctttaaaactcgtttcagacagtttgtctgaacatgagaagaacaagaacaaagagggagatgataagaaagagggaggtaaagacagagctttgaaaggagttttgcgagtgggagtattggcaaaaggattacttctccgaggagatagaaatgtcaaccttgttttgctgtgctcagagaaaccttcaaagacattattaagccgtattgcagaaaacctacccaaacagcttgctgttataagccctgagaagtatgacataaaatgtgctgtatctgaagcggcaataattttgaattcatgtgtggaacccaaaatgcaagtcactatcacactgacatctccaattattcgagaagagaacatgagggaaggagatgtaacctcgggtatggtgaaagacccaccggacgtcttggacaggcaaaaatgccttgacgctctggctgctctacgccacgctaagtggttccaggctagagctaatggtctgcagtcctgtgtgattatcatacgcattcttcgagacctctgtcagcgagttccaacttggtctgattttccaagctgggctatggagttactagtagagaaagcaatcagcagtgcttctagccctcagagccctggggatgcactgagaagagtttttgaatgcatttcttcagggattattcttaaaggtagtcctggacttctggatccttgtgaaaaggatccctttgataccttggcaacaatgactgaccagcagcgtgaagacatcacatccagtgcacagtttgcattgagactccttgcattccgccagatacacaaagttctaggcatggatccattaccgcaaatgagccaacgttttaacatccacaacaacaggaaacgaagaagagatagtgatggagttgatggatttgaagctgaggggaaaaaagacaaaaaagattatgataacttttaaaaagtgtctgtaaatcttcagtgttaaaaaaacagatgcccatttgttggctgtttttcattcataataatgtctacattgaaaaatttatcaagaatttaaaggatttcatggaagaaccaagtttttctatgatattaaaaaatgtacagtgttaggtattatttgaatggaaagacacccaaaaaaaaaaatgtgctccgactagggggaacttccccccctatttttgtgtcttttattaactagtgcattgtcttattaaatcttcactgtatttaatgcaggatgtgtgcttcagttgctctgtgtattttgatattttaatttagaggttttgtttgctttttgacactagttgtaagttactttgttatagatggtatcctttaccccttcttaatattttacagcagtacgtttttttgtaacgtgagactgcagagtttgtttttctatatgtgaaggattacaacacaaaaagttatcctgccattcgagtgctcagaactgaatgtttctgcagatcttgtggcatttgtctctagtgtgatatataaaggtgtaattaagacagagttctgttaatctaatcaagtttgctgttagttgtgcattagcagtataaaagctaatatatactatatggtcttgcaacagttttaaagcctctgcataattgataataaaaatgcatgacattcttgtttttaatagacttttaaaatcataattttaggtttaacacgtagatctttgtacagttgactttttgacatagcaaggccaaaaataactttctgaatatttttttcttgtgtataagtggaaagggcatttttcacatataagtgggctaaccaatattttcaaaagaacttcatcattgtacaactaacaacagtaactagcccttaattatggtgacagttccttattggtgtgtgtgagattactctagcaactattacagtataacacagatgatcttctccacacaccccatcacccagataatttacagttctgttaacagtgaggttgataaagtattactgataaaaaattatctaaggaaaaaaacagaaaattatttggtgtggccatcttacctgcttatgtctcctacacaaagctaaatattctagcagtgatgtaatgaaaaattacatcttactgttgatatatgtatgctctggtacacagatgtcattttgttgtcacagcactacagtgaaatacacaaaaaatgaaattcatataatgacttaaatgtattatatgttagaattgacaacataaactacttttgctttgaaatgatgtatgcttcagtaaaatcatattcaaattta

SEQ ID NO: 343199 - DNA, 1789 bp, Homo sapiens
ctcacattttacatgtaatttattcacagagagttaatgtagcatgcgggtccctttatcagttgtgaaagtaattcctttaaatgtttctttcattacacatgcttttttaggttgcatttggagggaggtaaatgtagtaagtattactacttggggtttttcaattaactcaaaattctgactctctttgttgcagtttgcattgagactccttgcattccgccagatacacaaagttctaggcatggatccattaccgcaaatgagccaacgttttaacatccacaacaacaggaaacgaagaagagatagtgatggagttgatggatttgaagctgaggggaaaaaagacaaaaaagattatgataacttttaaaaagtgtctgtaaatcttcagtgttaaaaaaacagatgcccatttgttggctgtttttcattcataataatgtctacattgaaaaatttatcaagaatttaaaggatttcatggaagaaccaagtttttctatgatattaaaaaatgtacagtgttaggtattatttgaatggaaagacacccaaaaaaaaaaatgtgctccgactagggggaaaacagtagttccgattttttcccattatttttattttattttctggttgccctagcttccccccctatttttgtgtcttttattaactagtgcattgtcttattaaatcttcactgtatttaatgcaggatgtgtgcttcagttgctctgtgtattttgatattttaatttagaggttttgtttgctttttgacactagttgtaagttactttgttatagatggtatcctttaccccttcttaatattttacagcagtacgtttttttgtaacgtgagactgcagagtttgtttttctatatgtgaaggattacaacacaaaaagttatcctgccattcgagtgctcagaactgaatgtttctgcagatcttgtggcatttgtctctagtgtgatatataaaggtgtaattaagacagagttctgttaatctaatcaagtttgctgttagttgtgcattagcagtataaaagctaatatatactatatggtcttgcaacagttttaaagcctctgcataattgataataaaaatgcatgacattcttgtttttaatagacttttaaaatcataattttaggtttaacacgtagatctttgtacagttgactttttgacatagcaaggccaaaaataactttctgaatatttttttcttgtgtataagtggaaagggcatttttcacatataagtgggctaaccaatattttcaaaagaacttcatcattgtacaactaacaacagtaactagcccttaattatggtgacagttccttattggtgtgtgtgagattactctagcaactattacagtataacacagatgatcttctccacacaccccatcacccagataatttacagttctgttaacagtgaggttgataaagtattactgataaaaaattatctaaggaaaaaaacagaaaattatttggtgtggccatcttacctgcttatgtctcctacacaaagctaaatattctagcagtgatgtaatgaaaaattacatcttactgttgatatatgtatgctctggtacacagatgtcattttgttgtcacagcactacagtgaaatacacaaaaaatgaaattcatataatgacttaaatgtattatatgttagaattgacaacataaactacttttgctttgaaatgatgtatgcttcagtaaaatcatattcaaattta

SEQ ID NO: 343200 - DNA, 1613 bp, Homo sapiens
cctcagcttcaaatccatcaactccatcactatctcttcttcgtttcctgttgttgtggatgttaaaacgcatggatccattaccgcaaatgagccaacgttttaacatccacaacaacaggaaacgaagaagagatagtgatggagttgatggatttgaagctgaggggaaaaaagacaaaaaagattatgataacttttaaaaagtgtctgtaaatcttcagtgttaaaaaaacagatgcccatttgttggctgtttttcattcataataatgtctacattgaaaaatttatcaagaatttaaaggatttcatggaagaaccaagtttttctatgatattaaaaaatgtacagtgttaggtattatttgaatggaaagacacccaaaaaaaaaaatgtgctccgactagggggaaaacagtagttccgattttttcccattatttttattttattttctggttgccctagcttccccccctatttttgtgtcttttattaactagtgcattgtcttattaaatcttcactgtatttaatgcaggatgtgtgcttcagttgctctgtgtattttgatattttaatttagaggttttgtttgctttttgacactagttgtaagttactttgttatagatggtatcctttaccccttcttaatattttacagcagtacgtttttttgtaacgtgagactgcagagtttgtttttctatatgtgaaggattacaacacaaaaagttatcctgccattcgagtgctcagaactgaatgtttctgcagatcttgtggcatttgtctctagtgtgatatataaaggtgtaattaagacagagttctgttaatctaatcaagtttgctgttagttgtgcattagcagtataaaagctaatatatactatatggtcttgcaacagttttaaagcctctgcataattgataataaaaatgcatgacattcttgtttttaatagacttttaaaatcataattttaggtttaacacgtagatctttgtacagttgactttttgacatagcaaggccaaaaataactttctgaatatttttttcttgtgtataagtggaaagggcatttttcacatataagtgggctaaccaatattttcaaaagaacttcatcattgtacaactaacaacagtaactagcccttaattatggtgacagttccttattggtgtgtgtgagattactctagcaactattacagtataacacagatgatcttctccacacaccccatcacccagataatttacagttctgttaacagtgaggttgataaagtattactgataaaaaattatctaaggaaaaaaacagaaaattatttggtgtggccatcttacctgcttatgtctcctacacaaagctaaatattctagcagtgatgtaatgaaaaattacatcttactgttgatatatgtatgctctggtacacagatgtcattttgttgtcacagcactacagtgaaatacacaaaaaatgaaattcatataatgacttaaatgtattatatgttagaattgacaacataaactacttttgctttgaaatgatgtatgcttcagtaaaatcatattcaaattta

SEQ ID NO: 343201 - DNA, 812 bp, Homo sapiens
gatcggctcggtcctccctatagacatcagacagagttctgttaatctaatcaagtttgctgttagttgtgcattagcagtataaaagctaatatatactatatggtcttgcaacagttttaaagcctctgcataattgataataaaaatgcatgacattcttgtttttaatagacttttaaaatcataattttaggtttaacacgtagatctttgtacagttgactttttgacatagcaaggccaaaaataactttctgaatatttttttcttgtgtataagtggaaagggcatttttcacatataagtgggctaaccaatattttcaaaagaacttcatcattgtacaactaacaacagtaactagcccttaattatggtgacagttccttattggtgtgtgtgagattactctagcaactattacagtataacacagatgatcttctccacacaccccatcacccagataatttacagttctgttaacagtgaggttgataaagtattactgataaaaaattatctaaggaaaaaaacagaaaattatttggtgtggccatcttacctgcttatgtctcctacacaaagctaaatattctagcagtgatgtaatgaaaaattacatcttactgttgatatatgtatgctctggtacacagatgtcattttgttgtcacagcactacagtgaaatacacaaaaaatgaaattcatataatgacttaaatgtattatatgttagaattgacaacataaactacttttgctttgaaatgatgtatgcttcagtaaaatcatattcaaattta

SEQ ID NO: 343202 - DNA, 2095 bp, Homo sapiens
tgttctccgctgaggaggagcggggcagaggagggaggcagcgggtgagagttcagagttcagcagcagcagcccgagcccatgattcccatatgccctgtagtttctttcacctatgtgcccagccggctgggggaagatgccaaaatggcgaccggcaactactttggattcacccacagcggggcggcggcggcggcggctgcggcccaatatagccagcagccagcttcgggtgtagcctattctcatccaactacagttgctagctacactgtccatcaggctccagtagctgctcacacagttactgctgcctatgcaccagcagccgccacagttgcagttgccaggcctgctccagtagctgttgcagctgctgcaacagctgctgcttatggaggctaccccactgcacacacagcaactgactatggttatactcagaggcaacaagaagcaccaccaccaccacccccagctactacacaaaactaccaggattcatactcatatgtaaggtccacagctcctgctgtagcttatgatagtaagcaatactaccaacaaccaacagcaactgctgctgctgtagctgccgctgcccaacctcagccttctgttgctgaaacttactatcagacagcccccaaagcaggttacagccaaggtgcaactcagtatactcaagcccagcaaactcgacaagtgacagccataaaaccagccacaccaagtccagctaccactactttctccatctatcctgtatcctccaccgtacagccagtagcagctgcggctactgtggtgccatcctatactcagagtgctacttacagtaccacagcagttacatattctggtacgtcttattcaggttatgaagcagcagtgtattcagctgcatcttcctactatcaacagcagcagcagcaacagaagcaggcagcagcagcagctgctgctgctgctgcaacagctgcctggacagggaccacctttactaaaaaagcaccattccaaaataaacaactgaaaccaaaacagcctcccaaaccaccacagattcactattgtgatgtttgtaagatcagctgtgctggaccacagacttataaagaacatttagaaggacagaaacataaaaaaaaagaagctgcattgaaagcctcacaaaataccagcagcagcaacagttctactcgtgggactcaaaatcagctacgttgtgagctctgcgatgtgtcttgtacaggagcagatgcgtatgctgcccacattcgtggtgctaagcatcagaaagtggttaagttacacacaaaacttggtaaacccattccatcaacagaaccaaatgttgttagccaagctacttcttcaacagctgtatctgcttcaaagccgactgcctctccttcaagcattgcagcaaacaattgtactgtgaatacgtcatcaattgcaacgtcttcaatgaagggtcttacgactacaggaaactcgtctcttaatagcacatctaacactaaagtatcagcagtgcctacaaatatggctgccaagaaaacatctacccccaaaataaattttgttggtggtaataagctgcagtcaacaggaaataaagcagaagacataaaaggaaccgaatgtgttaaaagtactcctgtcacttctgctgtgcagattcctgaagtaaagcaagacacagtgtcagaaccagtcacacctgcatctcttgctgctttacagagtgatgtgcagccagtgggccatgattatgtggaagaggtacgaaatgatgaaggaaaagtaattcggttccattgtaaattatgcgagtgcagtactggagcaggcctgcaactcaactgtggcggctgctggttgcataggcagcagtaactgtgtgaggcagctactggagcctgatggacagtgtagctagctgtagttggtgagaataggctacacccgaagctgctgctggctatattggccagccgccgccgccgcgcccgctgtgggtgaatccaaagtagttgccggtcgcattttggcatcttcccagccggctgggctcataggtgaa

SEQ ID NO: 343203 - DNA, 525 bp, Homo sapiens
tgttctccgctgaggaggagcggggcagaggagggaggcagcgggtgagagttcagagttcagcagcagcagcccgagcccatgattcccatatgccctgtagtttctttcacctatgtgcccagccggctgggggaagatgccaaaatggcgaccggcaactactttggattcacccacagcggggcggcggcggcggcggctgcggcccaatatagccagcagccagcttcgggtgtagcctattctcatccaactacagttgctagctacactgtccatcaggctccagtagctgctcacacagttactgctgcctatgcaccagcagccgccacagttgcagttgccaggcctgctccagtagctgttgcagctgctgcaacagctgctgcttatggaggctaccccactgcacacacagcaactgactatggttatactcagaggcaacaagaagcaccaccactcctgcctgccccccccccccctcccccccggtaataaaaagcccccccccaaaca

SEQ ID NO: 343204 - DNA, 412 bp, Homo sapiens
cctcaggctgaaattttctgcttttcatgctcttttctctttcatttacttcgcaatgaaagcaaacatggaaaatcagatacatttgggaagaaattttagctaggctgatgttggtggggttttttattgctttttatgtcactattgatgcaagttcttgggctgtatttttcctcatatgcttataatgtcattctttatgtttcagacgttatgaagaggacatgtactggaggagaatggaggaagaacaacatcattgggatgatcgccgccgaatgccagatggaggttatcctcatggtcctccaggcccattaggccttctgggagtccgaccaggcatgcctcctcagcctcaggggcctgcagtgagtgtccacgttggtgatacaaggggtgaaagttt

SEQ ID NO: 343205 - DNA, 4716 bp, Homo sapiens
tgttctccgctgaggaggagcggggcagaggagggaggcagcgggtgagagttcagagttcagcagcagcagcccgagcccatgattcccatatgccctgtagtttctttcacctatgtgcccagccggctgggggaagatgccaaaatggcgaccggcaactactttggattcacccacagcggggcggcggcggcggcggctgcggcccaatatagccagcagccagcttcgggtgtagcctattctcatccaactacagttgctagctacactgtccatcaggctccagtagctgctcacacagttactgctgcctatgcaccagcagccgccacagttgcagttgccaggcctgctccagtagctgttgcagctgctgcaacagctgctgcttatggaggctaccccactgcacacacagcaactgactatggttatactcagaggcaacaagaagcaccaccaccaccacccccagctactacacaaaactaccaggattcatactcatatgtaaggtccacagctcctgctgtagcttatgatagtaagcaatactaccaacaaccaacagcaactgctgctgctgtagctgccgctgcccaacctcagccttctgttgctgaaacttactatcagacagcccccaaagcaggttacagccaaggtgcaactcagtatactcaagcccagcaaactcgacaagtgacagccataaaaccagccacaccaagtccagctaccactactttctccatctatcctgtatcctccaccgtacagccagtagcagctgcggctactgtggtgccatcctatactcagagtgctacttacagtaccacagcagttacatattctggtacgtcttattcaggttatgaagcagcagtgtattcagctgcatcttcctactatcaacagcagcagcagcaacagaagcaggcagcagcagcagctgctgctgctgctgcaacagctgcctggacagggaccacctttactaaaaaagcaccattccaaaataaacaactgaaaccaaaacagcctcccaaaccaccacagattcactattgtgatgtttgtaagatcagctgtgctggaccacagacttataaagaacatttagaaggacagaaacataaaaaaaaagaagctgcattgaaagcctcacaaaataccagcagcagcaacagttctactcgtgggactcaaaatcagctacgttgtgagctctgcgatgtgtcttgtacaggagcagatgcgtatgctgcccacattcgtggtgctaagcatcagaaagtggttaagttacacacaaaacttggtaaacccattccatcaacagaaccaaatgttgttagccaagctacttcttcaacagctgtatctgcttcaaagccgactgcctctccttcaagcattgcagcaaacaattgtactgtgaatacgtcatcaattgcaacgtcttcaatgaagggtcttacgactacaggaaactcgtctcttaatagcacatctaacactaaagtatcagcagtgcctacaaatatggctgccaagaaaacatctacccccaaaataaattttgttggtggtaataagctgcagtcaacaggaaataaagcagaagacataaaaggaaccgaatgtgttaaaagtactcctgtcacttctgctgtgcagattcctgaagtaaagcaagacacagtgtcagaaccagtcacacctgcatctcttgctgctttacagagtgatgtgcagccagtgggccatgattatgtggaagaggtacgaaatgatgaaggaaaagtaattcggttccattgtaaattatgcgagtgcagctttaatgatcccaatgctaaggagatgcacttaaaagggcgaagacacagacttcaatataaaaaaaaagtaaatccagatttgcaagtagaagtaaagcctagtattcgagcaagaaagattcaagaagagaaaatgaggaagcaaatgcagaaggaggagtactggcgaagacgagaagaagaggagcgttggagaatggaaatgagacgttatgaagaggacatgtactggaggagaatggaggaagaacaacatcattgggatgatcgccgccgaatgccagatggaggttatcctcatggtcctccaggcccattaggccttctgggagtccgaccaggcatgcctcctcagcctcaggggcctgcacccttacgtcgtcctgactcatctgatgaccgttatgtaatgacaaaacatgccaccatttatccaactgaagaggagttacaggcagttcagaaaattgtttctattactgaacgtgctttaaaactcgtttcagacagtttgtctgaacatgagaagaacaagaacaaagagggagatgataagaaagagggaggtaaagacagagctttgaaaggagttttgcgagtgggagtattggcaaaaggattacttctccgaggagatagaaatgtcaaccttgttttgctgtgctcagagaaaccttcaaagacattattaagccgtattgcagaaaacctacccaaacagcttgctgttataagccctgagaagtatgacataaaatgtgctgtatctgaagcggcaataattttgaattcatgtgtggaacccaaaatgcaagtcactatcacactgacatctccaattattcgagaagagaacatgagggaaggagatgtaacctcgggtatggtgaaagacccaccggacgtcttggacaggcaaaaatgccttgacgctctggctgctctacgccacgctaagtggttccaggctagagctaatggtctgcagtcctgtgtgattatcatacgcattcttcgagacctctgtcagcgagttccaacttggtctgattttccaagctgggctatggagttactagtagagaaagcaatcagcagtgcttctagccctcagagccctggggatgcactgagaagagtttttgaatgcatttcttcagggattattcttaaaggtagtcctggacttctggatccttgtgaaaaggatccctttgataccttggcaacaatgactgaccagcagcgtgaagacatcacatccagtgcacagtttgcattgagactccttgcattccgccagatacacaaagttctaggcatggatccattaccgcaaatgagccaacgttttaacatccacaacaacaggaaacgaagaagagatagtgatggagttgatggatttgaagctgaggggaaaaaagacaaaaaagattatgataacttttaaaaagtgtctgtaaatcttcagtgttaaaaaaacagatgcccatttgttggctgtttttcattcataataatgtctacattgaaaaatttatcaagaatttaaaggatttcatggaagaaccaagtttttctatgatattaaaaaatgtacagtgttaggtattatttgaatggaaagacacccaaaaaaaaaaatgtgctccgactagggggaaaacagtagttccgattttttcccattatttttattttattttctggttgccctagcttccccccctatttttgtgtcttttattaactagtgcattgtcttattaaatcttcactgtatttaatgcaggatgtgtgcttcagttgctctgtgtattttgatattttaatttagaggttttgtttgctttttgacactagttgtaagttactttgttatagatggtatcctttaccccttcttaatattttacagcagtacgtttttttgtaacgtgagactgcagagtttgtttttctatatgtgaaggattacaacacaaaaagttatcctgccattcgagtgctcagaactgaatgtttctgcagatcttgtggcatttgtctctagtgtgatatataaaggtgtaattaagacagagttctgttaatctaatcaagtttgctgttagttgtgcattagcagtataaaagctaatatatactatatggtcttgcaacagttttaaagcctctgcataattgataataaaaatgcatgacattcttgtttttaatagacttttaaaatcataattttaggtttaacacgtagatctttgtacagttgactttttgacatagcaaggccaaaaataactttctgaatatttttttcttgtgtataagtggaaagggcatttttcacatataagtgggctaaccaatattttcaaaagaacttcatcattgtacaactaacaacagtaactagcccttaattatggtgacagttccttattggtgtgtgtgagattactctagcaactattacagtataacacagatgatcttctccacacaccccatcacccagataatttacagttctgttaacagtgaggttgataaagtattactgataaaaaattatctaaggaaaaaaacagaaaattatttggtgtggccatcttacctgcttatgtctcctacacaaagctaaatattctagcagtgatgtaatgaaaaattacatcttactgttgatatatgtatgctctggtacacagatgtcattttgttgtcacagcactacagtgaaatacacaaaaaatgaaattcatataatgacttaaatgtattatatgttagaattgacaacataaactacttttgctttgaaatgatgtatgcttcagtaaaatcatattcaaattta

SEQ ID NO: 343206 - DNA, 3558 bp, Homo sapiens
ggcacgagggccggaggaggaaggcggcggcgacgacgaggaagacgccgaggcctgggccatggaactggcggacgtgggggcggcagccagctcgcagggagttcatgatcaagtgttgcccacaccaaatgcttcatccagagtcatagtacatgtggatctggattgcttttatgcacaagtagaaatgatctcaaatccagagctaaaagacaaacctttaggggttcaacagaaatatttggtggttacctgcaactatgaagctaggaaacttggagttaagaaacttatgaatgtcagagatgcaaaagaaaagtgtccacagttggtattagttaatggagaagacctgacccgctacagagaaatgtcttataaggttacagaattactggaagaatttagtccagttgttgagagacttggatttgatgaaaattttgtggatctaacagaaatggttgagaagagactacagcagctgcaaagtgatgaactttctgcggtgactgtgtcgggtcatgtatacaataatcagtctataaacctgcttgacgtcttgcacatcagactacttgttggatctcagattgcagcagagatgcgggaagccatgattatgtggaagaggtacgaaatgatgaaggaaaagtaattcggttccattgtaaattatgcgagtgcagctttaatgatcccaatgctaaggagatgcacttaaaagggcgaagacacagacttcaatataaaaaaaaagtaaatccagatttgcaagtagaagtaaagcctagtattcgagcaagaaagattcaagaagagaaaatgaggaagcaaatgcagaaggaggagtactggcgaagacgagaagaagaggagcgttggagaatggaaatgagacgttatgaagaggacatgtactggaggagaatggaggaagaacaacatcattgggatgatcgccgccgaatgccagatggaggttatcctcatggtcctccaggcccattaggccttctgggagtccgaccaggcatgcctcctcagcctcaggggcctgcacccttacgtcgtcctgactcatctgatgaccgttatgtaatgacaaaacatgccaccatttatccaactgaagaggagttacaggcagttcagaaaattgtttctattactgaacgtgctttaaaactcgtttcagacagtttgtctgaacatgagaagaacaagaacaaagagggagatgataagaaagagggaggtaaagacagagctttgaaaggagttttgcgagtgggagtattggcaaaaggattacttctccgaggagatagaaatgtcaaccttgttttgctgtgctcagagaaaccttcaaagacattattaagccgtattgcagaaaacctacccaaacagcttgctgttataagccctgagaagtatgacataaaatgtgctgtatctgaagcggcaataattttgaattcatgtgtggaacccaaaatgcaagtcactatcacactgacatctccaattattcgagaagagaacatgagggaaggagatgtaacctcgggtatggtgaaagacccaccggacgtcttggacaggcaaaaatgccttgacgctctggctgctctacgccacgctaagtggttccaggctagagctaatggtctgcagtcctgtgtgattatcatacgcattcttcgagacctctgtcagcgagttccaacttggtctgattttccaagctgggctatggagttactagtagagaaagcaatcagcagtgcttctagccctcagagccctggggatgcactgagaagagtttttgaatgcatttcttcagggattattcttaaaggtagtcctggacttctggatccttgtgaaaaggatccctttgataccttggcaacaatgactgaccagcagcgtgaagacatcacatccagtgcacagtttgcattgagactccttgcattccgccagatacacaaagttctaggcatggatccattaccgcaaatgagccaacgttttaacatccacaacaacaggaaacgaagaagagatagtgatggagttgatggatttgaagctgaggggaaaaaagacaaaaaagattatgataacttttaaaaagtgtctgtaaatcttcagtgttaaaaaaacagatgcccatttgttggctgtttttcattcataataatgtctacattgaaaaatttatcaagaatttaaaggatttcatggaagaaccaagtttttctatgatattaaaaaatgtacagtgttaggtattatttgaatggaaagacacccaaaaaaaaaaatgtgctccgactagggggaaaacagtagttccgattttttcccattatttttattttattttctggttgccctagcttccccccctatttttgtgtcttttattaactagtgcattgtcttattaaatcttcactgtatttaatgcaggatgtgtgcttcagttgctctgtgtattttgatattttaatttagaggttttgtttgctttttgacactagttgtaagttactttgttatagatggtatcctttaccccttcttaatattttacagcagtacgtttttttgtaacgtgagactgcagagtttgtttttctatatgtgaaggattacaacacaaaaagttatcctgccattcgagtgctcagaactgaatgtttctgcagatcttgtggcatttgtctctagtgtgatatataaaggtgtaattaagacagagttctgttaatctaatcaagtttgctgttagttgtgcattagcagtataaaagctaatatatactatatggtcttgcaacagttttaaagcctctgcataattgataataaaaatgcatgacattcttgtttttaatagacttttaaaatcataattttaggtttaacacgtagatctttgtacagttgactttttgacatagcaaggccaaaaataactttctgaatatttttttcttgtgtataagtggaaagggcatttttcacatataagtgggctaaccaatattttcaaaagaacttcatcattgtacaactaacaacagtaactagcccttaattatggtgacagttccttattggtgtgtgtgagattactctagcaactattacagtataacacagatgatcttctccacacaccccatcacccagataatttacagttctgttaacagtgaggttgataaagtattactgataaaaaattatctaaggaaaaaaacagaaaattatttggtgtggccatcttacctgcttatgtctcctacacaaagctaaatattctagcagtgatgtaatgaaaaattacatcttactgttgatatatgtatgctctggtacacagatgtcattttgttgtcacagcactacagtgaaatacacaaaaaatgaaattcatataatgacttaaatgtattatatgttagaattgacaacataaactacttttgctttgaaatgatgtatgcttcagtaaaatcatattcaaattta

SEQ ID NO: 343207 - DNA, 3401 bp, Homo sapiens
gcatgctaaaattccaacttttcattcccatttctacagtttctatccttttaaaaagtaataggccaggcgcagtggctcatgcctgtaatcccagcactttgggaggccaaggtgggcggatcacaaggagtttgagaccagcctggccaacatggtgaaaccctgtctctactaaaaatacaaaaaacaaattagccggtcgtggtggtgttacatacctttaatcccagctacttgggtggctgaggcgggagaatcgcttgaacccaggaggctgaggttgtagtgagctgagttcaaaccactgcactccagcatgggcgacagagcaagactctgtcctggggaaaaaaaaaatgtaatagacattgccacttctttctaactgtgtacaacttcatcaaataatatgtgggggtttatgaatgatataatcttcaactatgatgattcttgaattttttttccacaccaaggtacgaaatgatgaaggaaaagtaattcggttccattgtaaattatgcgagtgcagctttaatgatcccaatgctaaggagatgcacttaaaagggcgaagacacagacttcaatataaaaaaaaagtaaatccagatttgcaagtagaagtaaagcctagtattcgagcaagaaagattcaagaagagaaaatgaggaagcaaatgcagaaggaggagtactggcgaagacgagaagaagaggagcgttggagaatggaaatgagacgttatgaagaggacatgtactggaggagaatggaggaagaacaacatcattgggatgatcgccgccgaatgccagatggaggttatcctcatggtcctccaggcccattaggccttctgggagtccgaccaggcatgcctcctcagcctcaggggcctgcacccttacgtcgtcctgactcatctgatgaccgttatgtaatgacaaaacatgccaccatttatccaactgaagaggagttacaggcagttcagaaaattgtttctattactgaacgtgctttaaaactcgtttcagacagtttgtctgaacatgagaagaacaagaacaaagagggagatgataagaaagagggaggtaaagacagagctttgaaaggagttttgcgagtgggagtattggcaaaaggattacttctccgaggagatagaaatgtcaaccttgttttgctgtgctcagagaaaccttcaaagacattattaagccgtattgcagaaaacctacccaaacagcttgctgttataagccctgagaagtatgacataaaatgtgctgtatctgaagcggcaataattttgaattcatgtgtggaacccaaaatgcaagtcactatcacactgacatctccaattattcgagaagagaacatgagggaaggagatgtaacctcgggtatggtgaaagacccaccggacgtcttggacaggcaaaaatgccttgacgctctggctgctctacgccacgctaagtggttccaggctagagctaatggtctgcagtcctgtgtgattatcatacgcattcttcgagacctctgtcagcgagttccaacttggtctgattttccaagctgggctatggagttactagtagagaaagcaatcagcagtgcttctagccctcagagccctggggatgcactgagaagagtttttgaatgcatttcttcagggattattcttaaaggtagtcctggacttctggatccttgtgaaaaggatccctttgataccttggcaacaatgactgaccagcagcgtgaagacatcacatccagtgcacagtttgcattgagactccttgcattccgccagatacacaaagttctaggcatggatccattaccgcaaatgagccaacgttttaacatccacaacaacaggaaacgaagaagagatagtgatggagttgatggatttgaagctgaggggaaaaaagacaaaaaagattatgataacttttaaaaagtgtctgtaaatcttcagtgttaaaaaaacagatgcccatttgttggctgtttttcattcataataatgtctacattgaaaaatttatcaagaatttaaaggatttcatggaagaaccaagtttttctatgatattaaaaaatgtacagtgttaggtattatttgaatggaaagacacccaaaaaaaaaaatgtgctccgactagggggaaaacagtagttccgattttttcccattatttttattttattttctggttgccctagcttccccccctatttttgtgtcttttattaactagtgcattgtcttattaaatcttcactgtatttaatgcaggatgtgtgcttcagttgctctgtgtattttgatattttaatttagaggttttgtttgctttttgacactagttgtaagttactttgttatagatggtatcctttaccccttcttaatattttacagcagtacgtttttttgtaacgtgagactgcagagtttgtttttctatatgtgaaggattacaacacaaaaagttatcctgccattcgagtgctcagaactgaatgtttctgcagatcttgtggcatttgtctctagtgtgatatataaaggtgtaattaagacagagttctgttaatctaatcaagtttgctgttagttgtgcattagcagtataaaagctaatatatactatatggtcttgcaacagttttaaagcctctgcataattgataataaaaatgcatgacattcttgtttttaatagacttttaaaatcataattttaggtttaacacgtagatctttgtacagttgactttttgacatagcaaggccaaaaataactttctgaatatttttttcttgtgtataagtggaaagggcatttttcacatataagtgggctaaccaatattttcaaaagaacttcatcattgtacaactaacaacagtaactagcccttaattatggtgacagttccttattggtgtgtgtgagattactctagcaactattacagtataacacagatgatcttctccacacaccccatcacccagataatttacagttctgttaacagtgaggttgataaagtattactgataaaaaattatctaaggaaaaaaacagaaaattatttggtgtggccatcttacctgcttatgtctcctacacaaagctaaatattctagcagtgatgtaatgaaaaattacatcttactgttgatatatgtatgctctggtacacagatgtcattttgttgtcacagcactacagtgaaatacacaaaaaatgaaattcatataatgacttaaatgtattatatgttagaattgacaacataaactacttttgctttgaaatgatgtatgcttcagtaaaatcatattcaaattta

SEQ ID NO: 343208 - DNA, 4618 bp, Homo sapiens
tgttctccgctgaggaggagcggggcagaggagggaggcagcgggtgagagttcagagttcagcagcagcagcccgagcccatgattcccatatgccctgtagtttctttcacctatgtgcccagccggctgggggaagatgccaaaatggcgaccggcaactactttggattcacccacagcggggcggcggcggcggcggctgcggcccaatatagccagcagccagcttcgggtgtagcctattctcatccaactacagttgctagctacactgtccatcaggctccagtagctgctcacacagttactgctgcctatgcaccagcagccgccacagttgcagttgccaggcctgctccagtagctgttgcagctgctgcaacagctgctgcttatggaggctaccccactgcacacacagcaactgactatggttatactcagaggcaacaagaagcaccaccaccaccacccccagctactacacaaaactaccaggattcatactcatatgtaaggtccacagctcctgctgtagcttatgatagtaagcaatactaccaacaaccaacagcaactgctgctgctgtagctgccgctgcccaacctcagccttctgttgctgaaacttactatcagacagcccccaaagcaggttacagccaaggtgcaactcagtatactcaagcccagcaaactcgacaagtgacagccataaaaccagccacaccaagtccagctaccactactttctccatctatcctgtatcctccaccgtacagccagtagcagctgcggctactgtggtgccatcctatactcagagtgctacttacagtaccacagcagttacatattctggtacgtcttattcaggttatgaagcagcagtgtattcagctgcatcttcctactatcaacagcagcagcagcaacagaagcaggcagcagcagcagctgctgctgctgctgcaacagctgcctggacagggaccacctttactaaaaaagcaccattccaaaataaacaactgaaaccaaaacagcctcccaaaccaccacagattcactattgtgatgtttgtaagatcagctgtgctggaccacagacttataaagaacatttagaaggacagaaacataaaaaaaaagaagctgcattgaaagcctcacaaaataccagcagcagcaacagttctactcgtgggactcaaaatcagctacgttgtgagctctgcgatgtgtcttgtacaggagcagatgcgtatgctgcccacattcgtggtgctaagcatcagaaagtggttaagttacacacaaaacttggtaaacccattccatcaacagaaccaaatgttgttagccaagctacttcttcaacagctgtatctgcttcaaagccgactgcctctccttcaagcattgcagcaaacaattgtactgtgaatacgtcatcaattgcaacgtcttcaatgaagggtcttacgactacaggaaactcgtctcttaatagcacatctaacactaaagtatcagcagtgcctacaaatatggctgccaagaaaacatctacccccaaaataaattttgttggtggtaataagctgcagtcaacaggaaataaagcagaagacataaaaggaaccgaatgtgttaaaagtactcctgtcacttctgctgtgcagattcctgaagtaaagcaagacacagtgtcagaaccagtcacacctgcatctcttgctgctttacagagtgatgtgcagccagtgggccatgattatgtggaagaggtacgaaatgatgaaggaaaagtaattcggttccattgtaaattatgcgagtgcagctttaatgatcccaatgctaaggagatgcacttaaaagggcgaagacacagacttcaatataaaaaaaaagtaaatccagatttgcaagtagaagtaaagcctagtattcgagcaagaaagattcaagaagagaaaatgaggaagcaaatgcagaaggaggagtactggcgaagacgagaagaagaggagcgttggagaatggaaatgagacgttatgaagaggacatgtactggaggagaatggaggaagaacaacatcattgggatgatcgccgccgaatgccagatggaggttatcctcatggtcctccaggcccattaggccttctgggagtccgaccaggcatgcctcctcagcctcaggggcctgcacccttacgtcgtcctgactcatctgatgaccgttatgtaatgacaaaacatgccaccatttatccaactgaagaggagttacaggcagttcagaaaattgtttctattactgaacgtgctttaaaactcgtttcagacagtttgtctgaacatgagaagaacaagaacaaagagggagatgataagaaagagggaggtaaagacagagctttgaaaggagttttgcgagtgggagtattggcaaaaggattacttctccgaggagatagaaatgtcaaccttgttttgctgtgctcagagaaaccttcaaagacattattaagccgtattgcagaaaacctacccaaacagcttgctgttataagccctgagaagtatgacataaaatgtgctgtatctgaagcggcaataattttgaattcatgtgtggaacccaaaatgcaagtcactatcacactgacatctccaattattcgagaagagaacatgagggaaggaggctagagctaatggtctgcagtcctgtgtgattatcatacgcattcttcgagacctctgtcagcgagttccaacttggtctgattttccaagctgggctatggagttactagtagagaaagcaatcagcagtgcttctagccctcagagccctggggatgcactgagaagagtttttgaatgcatttcttcagggattattcttaaaggtagtcctggacttctggatccttgtgaaaaggatccctttgataccttggcaacaatgactgaccagcagcgtgaagacatcacatccagtgcacagtttgcattgagactccttgcattccgccagatacacaaagttctaggcatggatccattaccgcaaatgagccaacgttttaacatccacaacaacaggaaacgaagaagagatagtgatggagttgatggatttgaagctgaggggaaaaaagacaaaaaagattatgataacttttaaaaagtgtctgtaaatcttcagtgttaaaaaaacagatgcccatttgttggctgtttttcattcataataatgtctacattgaaaaatttatcaagaatttaaaggatttcatggaagaaccaagtttttctatgatattaaaaaatgtacagtgttaggtattatttgaatggaaagacacccaaaaaaaaaaatgtgctccgactagggggaaaacagtagttccgattttttcccattatttttattttattttctggttgccctagcttccccccctatttttgtgtcttttattaactagtgcattgtcttattaaatcttcactgtatttaatgcaggatgtgtgcttcagttgctctgtgtattttgatattttaatttagaggttttgtttgctttttgacactagttgtaagttactttgttatagatggtatcctttaccccttcttaatattttacagcagtacgtttttttgtaacgtgagactgcagagtttgtttttctatatgtgaaggattacaacacaaaaagttatcctgccattcgagtgctcagaactgaatgtttctgcagatcttgtggcatttgtctctagtgtgatatataaaggtgtaattaagacagagttctgttaatctaatcaagtttgctgttagttgtgcattagcagtataaaagctaatatatactatatggtcttgcaacagttttaaagcctctgcataattgataataaaaatgcatgacattcttgtttttaatagacttttaaaatcataattttaggtttaacacgtagatctttgtacagttgactttttgacatagcaaggccaaaaataactttctgaatatttttttcttgtgtataagtggaaagggcatttttcacatataagtgggctaaccaatattttcaaaagaacttcatcattgtacaactaacaacagtaactagcccttaattatggtgacagttccttattggtgtgtgtgagattactctagcaactattacagtataacacagatgatcttctccacacaccccatcacccagataatttacagttctgttaacagtgaggttgataaagtattactgataaaaaattatctaaggaaaaaaacagaaaattatttggtgtggccatcttacctgcttatgtctcctacacaaagctaaatattctagcagtgatgtaatgaaaaattacatcttactgttgatatatgtatgctctggtacacagatgtcattttgttgtcacagcactacagtgaaatacacaaaaaatgaaattcatataatgacttaaatgtattatatgttagaattgacaacataaactacttttgctttgaaatgatgtatgcttcagtaaaatcatattcaaattta

SEQ ID NO: 343209 - DNA, 4264 bp, Homo sapiens
tgttctccgctgaggaggagcggggcagaggagggaggcagcgggtgagagttcagagttcagcagcagcagcccgagcccatgattcccatatgccctgtagtttctttcacctatgtgcccagccggctgggggaagatgccaaaatggcgaccggcaactactttggattcacccacagcggggcggcggcggcggcggctgcggcccaatatagccagcagccagcttcgggtgtagcctattctcatccaactacagttgctagctacactgtccatcaggctccagtagctgctcacacagttactgctgcctatgcaccagcagccgccacagttgcagttgccaggcctgctccagtagctgttgcagctgctgcaacagctgctgcttatggaggctaccccactgcacacacagcaactgactatggttatactcagaggcaacaagaagcaccaccaccaccacccccagctactacacaaaactaccaggattcatactcatatgtaaggtccacagctcctgctgtagcttatgatagtaagcaatactaccaacaaccaacagcaactgctgctgctgtagctgccgctgcccaacctcagccttctgttgctgaaacttactatcagacagcccccaaagcaggttacagccaaggtgcaactcagtatactcaagcccagcaaactcgacaagtgacagccataaaaccagccacaccaagtccagctaccactactttctccatctatcctgtatcctccaccgtacagccagtagcagctgcggctactgtggtgccatcctatactcagagtgctacttacagtaccacagcagttacatattctggtacgtcttattcaggttatgaagcagcagtgtattcagctgcatcttcctactatcaacagcagcagcagcaacagaagcaggcagcagcagcagctgctgctgctgctgcaacagctgcctggacagggaccacctttactaaaaaagcaccattccaaaataaacaactgaaaccaaaacagcctcccaaaccaccacagattcactattgtgatgtttgtaagatcagctgtgctggaccacagacttataaagaacatttagaaggacagaaacataaaaaaaaagaagctgcattgaaagcctcacaaaataccagcagcagcaacagttctactcgtgggactcaaaatcagctacgttgtgagctctgcgatgtgtcttgtacaggagcagatgcgtatgctgcccacattcgtggtgctaagcatcagaaagtggttaagttacacacaaaacttggtaaacccattccatcaacagaaccaaatgttgttagccaagctacttcttcaacagctgtatctgcttcaaagccgactgcctctccttcaagcattgcagcaaacaattgtactgtgaatacgtcatcaattgcaacgtcttcaatgaagggtcttacgactacaggaaactcgtctcttaatagcacatctaacactaaagtatcagcagtgcctacaaatatggctgccaagaaaacatctacccccaaaataaattttgttggtggtaataagctgcagtcaacaggaaataaagcagaagacataaaaggaaccgaatgtgttaaaagtactcctgtcacttctgctgtgcagattcctgaagtaaagcaagacacagtgtcagaaccagtcacacctgcatctcttgctgctttacagagtgatgtgcagccagtgggccatgattatgtggaagaggtacgaaatgatgaaggaaaagtaattcggttccattgtaaattatgcgagtgcagctttaatgatcccaatgctaaggagatgcacttaaaagggcgaagacacagacttcaatataaaaaaaaagtaaatccagatttgcaagtagaagtaaagcctagtattcgagcaagaaagattcaagaagagaaaatgaggaagcaaatgcagaaggaggagtactggcgaagacgagaagaagaggagcgttggagaatggaaatgagacgttatgaagaggacatgtactggaggagaatggaggaagaacaacatcattgggatgatcgccgccgaatgccagatggaggttatcctcatggtcctccaggcccattaggccttctgggagtccgaccaggcatgcctcctcagcctcaggggcctgcacccttacgtcgtcctgactcatctgatgaccgttatgtaatgacaaaacatgccaccatttatccaactgaagaggagttacaggcagttcagaaaattgtttctattactgaacgtgctttaaaactcgtttcagacagtttgtctgaacatgagaagaacaagaacaaagagggagatgataagaaagagggaggtaaagacagagctttgaaaggagttttgcgagtgggagtattggcaaaaggattacttctccgaggagatagaaatgtcaaccttgttttgctgtgctcagagaaaccttcaaagacattattaagccgtattgcagaaaacctacccaaacagcttgctgttataagccctgagaagtatgacataaaatgtgctgtatctgaagcggcaataattttgaattcatgtgtggaacccaaaatgcaagtcactatcacactgacatctccaattattcgagaagagaacatgagggaaggagatgtaacctcgggtatggtgaaagacccaccggacgtcttggacaggcaaaaatgccttgacgctctggctgctctacgccacgctaagtggttccaggctagagctaatggtctgcagtcctgtgtgattatcatacgcattcttcgagacctctgtcagcgagttccaacttggtctgattttccaagctgggctatggagttactagtagagaaagcaatcagcagtgcttctagccctcagagccctggggatgcactgagaagagtttttgaatgcatttcttcagggattattcttaaaggtagtcctggacttctggatccttgtgaaaaggatccctttgataccttggcaacaatgactgaccagcagcgtgaagacatcacatccagtgcacagtttgcattgagactccttgcattccgccagatacacaaagttctaggcatggatccattaccgcaaatgagccaacgttttaacatccacaacaacaggaaacgaagaagagatagtgatggagttgatggatttgaagctgaggggaaaaaagacaaaaaagattatgataacttttaaaaagtgtctgtaaatcttcagtgttaaaaaaacagatgcccatttgttggctgtttttcattcataataatgtctacattgaaaaatttatcaagaatttaaaggatttcatggaagaaccaagtttttctatgatattaaaaaatgtacagtgttaggtattatttgaatggaaagacacccaaaaaaaaaaatgtgctccgactagggggaaaacagtagttccgattttttcccattatttttattttattttctggttgccctagcttccccccctatttttgtgtcttttattaactagtgcattgtcttattaaatcttcactgtatttaatgcaggatgtgtgcttcagttgctctgtgtattttgatattttaatttagaggttttgtttgctttttgacactagttgtaagttactttgttatagatggtatcctttaccccttcttaatattttacagcagtacgtttttttgtaacgtgagactgcagagtttgtttttctatatgtgaaggattacaacacaaaaagttatcctgccattcgagtgctcagaactgaatgtttctgcagatcttgtggcatttgtctctagtgtgatatataaaggtgtaattaagacagagttctgttaatctaatcaagtttgctgttagttgtgcattagcagtataaaagctaatatatactatatggtcttgcaacagttttaaagcctctgcataattgataataaaaatgcatgacattcttgtttttaatagacttttaaaatcataattttaggtttcacgaagggtgatctgtgtcacccaggctggagtgcagtggcccggtcgcgggttactgcagccttagcctcctgggttcgggtgattctcctgcctcagcctcctgagtagctgtgactacggacacatgccactacacctggcccatcattttattga

SEQ ID NO: 343210 - DNA, 1305 bp, Homo sapiens
tgttctccgctgaggaggagcggggcagaggagggaggcagcgggtgagagttcagagttcagcagcagcagcccgagcccatgattcccatatgccctgtagtttctttcacctatgtgcccagccggctgggggaagatgccaaaatggcgaccggcaactactttggattcacccacagcggggcggcggcggcggcggctgcggcccaatatagccagcagccagcttcgggtgtagcctattctcatccaactacagttgctagctacactgtccatcaggctccagtagctgctcacacagttactgctgcctatgcaccagcagccgccacagttgcagttgccaggcctgctccagtagctgttgcagctgctgcaacagctgctgcttatggaggctaccccactgcacacacagcaactgactatggttatactcagaggcaacaagaagcaccaccaccaccacccccagctactacacaaaactaccaggattcatactcatatgtaaggtccacagctcctgctgtagcttatgatagtaagcaatactaccaacaaccaacagcaactgctgctgctgtagctgccgctgcccaacctcagccttctgttgctgaaacttactatcagacagcccccaaagcaggttacagccaaggtgcaactcagtatactcaagcccagcaaactcgacaagtgacagccataaaaccagccacaccaagtccagctaccactactttctccatctatcctgtatcctccaccgtacagccagtagcagctgcggctactgtggtgccatcctatactcagagtgctacttacagtaccacagcagttacatattctggtacgtcttattcaggttatgaagcagcagtgtattcagctgcatcttcctactatcaacagcagcagcagcaacagaagcaggcagcagcagcagctgctgctgctgctgcaacagctgcctggacagggaccacctttactaaaaaagcaccattccaaaataaacaactgaaaccaaaacagcctcccaaaccaccacagattcactattgtgatgtttgtaagatcagctgtgctggaccacaggtacttacgttgtatgttttaccttgagtcttcagtggttattaagtgtagttggtattctaactcctgagcctactaaaagaggtttacattttttcctgttagcttttagccagtgcattttttaagttacttgtattgtggcatgagaattttcagggaaaaaaaaactgtaaagatgattgtgactgt

SEQ ID NO: 343211 - DNA, 769 bp, Homo sapiens
agcggggtttcgtggttgtatagacatttacccgtggccgtgtacctggagctggcatctgactcaacatttggaggaggcctgtagagctctttacctgtgccgctcgtttaaccatctgttaccaccttgactgttcaaaccccccccttcaagtgtggcttgcctttctgaggtaattttccagagccgttgctttccaagaatctttcatctatttcaaatcctgtccttcctccaaaaaaaatacctaaggaatttataatgaaatacaaacgtggagagataaatcctgtgtcagccttgcaccagtttgcacaaatgcagcgagttcagcttgaccttaaggaaactgtgacaacaggtaatgttatgggaccatattttgccttttgtgctgtggtggatggtattcagtacaagactggactgggacaaaataaaaaggagtctagatccaatgcagcaaaattagctcttgatgagcttctacaactggatgaacctgaaccacgaattttagaaacatcaggtcctcctcctttccctgcagaacctgttgttttatctgaactagcatatgtttcaaaagtacattatgaagggagacatattcaatatgcaaagatttcacagatcgttaaagaaagatttaatcaactaatttctaatcgttcagaatacctgaaatatagcagttcattggctgcttttataattgaaagagctggacaacatgaggttgtagctataggcacaggtgaataca

SEQ ID NO: 343212 - DNA, 856 bp, Homo sapiens
ggccaagccttccccatgggcaccttctcagattgcgattgtggatgaaatgagggattttcttgaaacaaccctcacgcaggtgagaaaatggctagcaacaatcattggtttcagagttcgcaggtccccagctttgcccagatgctgaaaaagaacctgccagttcaaccagcgacaaagacgataactacacccacaggatggtcctcagaaagttacggcctgtccaagatggcatccaaggttacgcaagtaacgggtaattttccagagccgttgctttccaagaatctttcatctatttcaaatcctgtccttcctccaaaaaaaatacctaaggaatttataatgaaatacaaacgtggagagataaatcctgtgtcagccttgcaccagtttgcacaaatgcagcgagttcagcttgaccttaaggaaactgtgacaacaggtaatgttatgggaccatattttgccttttgtgctgtggtggatggtattcagtacaagactggactgggacaaaataaaaaggagtctagatccaatgcagcaaaattagctcttgatgagcttctacaactggatgaacctgaaccacgaattttagaaacatcaggtcctcctcctttccctgcagaacctgttgttttatctgaactagcatatgtttcaaaagtacattatgaagggagacatattcaatatgcaaagatttcacagatcgttaaagaaagatttaatcaactaatttctaatcgttcagaatacctgaaatatagcagttcattggctgcttttataattgaaagagctggacaacatgaggttgtagctataggcacaggtgaataca

SEQ ID NO: 343213 - DNA, 911 bp, Homo sapiens
agtgattggacgaagcagggcgcgggggcgcaagcccgggtcctgcaggggcgacgcgaggcctcttttgaaagatgcggccctgaccctgtgaacctcgcgcagagcggcctgaagcgagaggttgaggctgggaggtgagaaaatggctagcaacaatcattggtttcagagttcgcaggtccccagctttgcccagatgctgaaaaagaacctgccagttcaaccagcgacaaagacgataactacacccacaggatggtcctcagaaagttacggcctgtccaagatggcatccaaggttacgcaagtaacgggtaattttccagagccgttgctttccaagaatctttcatctatttcaaatcctgtccttcctccaaaaaaaatacctaaggaatttataatgaaatacaaacgtggagagataaatcctgtgtcagccttgcaccagtttgcacaaatgcagcgagttcagcttgaccttaaggaaactgtgacaacaggtaatgttatgggaccatattttgccttttgtgctgtggtggatggtattcagtacaagactggactgggacaaaataaaaaggagtctagatccaatgcagcaaaattagctcttgatgagcttctacaactggatgaacctgaaccacgaattttagaaacatcaggtcctcctcctttccctgcagaacctgttgttttatctgaactagcatatgtttcaaaagtacattatgaagggagacatattcaatatgcaaagatttcacagatcgttaaagaaagatttaatcaactaatttctaatcgttcagaatacctgaaatatagcagttcattggctgcttttataattgaaagagctggacaacatgaggttgtagctataggcacaggtgaataca

SEQ ID NO: 343214 - DNA, 840 bp, Homo sapiens
agacgcggagctcggctgcacgacgctggcgcaagcgcgggggcaagagcgccggcctccgagacggtgagaaaatggctagcaacaatcattggtttcagagttcgcaggtccccagctttgcccagatgctgaaaaagaacctgccagttcaaccagcgacaaagacgataactacacccacaggatggtcctcagaaagttacggcctgtccaagatggcatccaaggttacgcaagtaacgggtaattttccagagccgttgctttccaagaatctttcatctatttcaaatcctgtccttcctccaaaaaaaatacctaaggaatttataatgaaatacaaacgtggagagataaatcctgtgtcagccttgcaccagtttgcacaaatgcagcgagttcagcttgaccttaaggaaactgtgacaacaggtaatgttatgggaccatattttgccttttgtgctgtggtggatggtattcagtacaagactggactgggacaaaataaaaaggagtctagatccaatgcagcaaaattagctcttgatgagcttctacaactggatgaacctgaaccacgaattttagaaacatcaggtcctcctcctttccctgcagaacctgttgttttatctgaactagcatatgtttcaaaagtacattatgaagggagacatattcaatatgcaaagatttcacagatcgttaaagaaagatttaatcaactaatttctaatcgttcagaatacctgaaatatagcagttcattggctgcttttataattgaaagagctggacaacatgaggttgtagctataggcacaggtgaataca

SEQ ID NO: 343215 - DNA, 1010 bp, Homo sapiens
agtgattggacgaagcagggcgcgggggcgcaagcccgggtcctgcaggggcgacgcgaggcctcttttgaaagatgcggccctgaccctgtgaacctcgcgcagagcggcctgaagcgagaggttgaggctgggaggtgggagcaacggcggcggcggccgcctgcgagcccccggcctgaggcgcagcagcagctgcccgtcttcccacatagagggcaggaaggacaactttggtgagaaaatggctagcaacaatcattggtttcagagttcgcaggtccccagctttgcccagatgctgaaaaagaacctgccagttcaaccagcgacaaagacgataactacacccacaggatggtcctcagaaagttacggcctgtccaagatggcatccaaggttacgcaagtaacgggtaattttccagagccgttgctttccaagaatctttcatctatttcaaatcctgtccttcctccaaaaaaaatacctaaggaatttataatgaaatacaaacgtggagagataaatcctgtgtcagccttgcaccagtttgcacaaatgcagcgagttcagcttgaccttaaggaaactgtgacaacaggtaatgttatgggaccatattttgccttttgtgctgtggtggatggtattcagtacaagactggactgggacaaaataaaaaggagtctagatccaatgcagcaaaattagctcttgatgagcttctacaactggatgaacctgaaccacgaattttagaaacatcaggtcctcctcctttccctgcagaacctgttgttttatctgaactagcatatgtttcaaaagtacattatgaagggagacatattcaatatgcaaagatttcacagatcgttaaagaaagatttaatcaactaatttctaatcgttcagaatacctgaaatatagcagttcattggctgcttttataattgaaagagctggacaacatgaggttgtagctataggcacaggtgaataca

SEQ ID NO: 343216 - DNA, 269 bp, Homo sapiens
ctgcttcttggtcttttcagttaactttaccacatatcgtctcatgaccggaggaatttacaagagggtataacttagatttatccacatttctcatgaccttccctgtgccacctggagggctgtaagcagggtttgcttagtgtagcaagtcggcaaccttgctgtggcacctagataagggttcaggaatgcagctgcagagtattcggggtaagggtcagctgcactgcgggggcggttcctggggcagctcgtccctaacagta

SEQ ID NO: 343217 - DNA, 595 bp, Homo sapiens
cacacacacacacacacacacacacacacacacacacagagacagagagagacagagagagagttctgcttattctaagtctacatatgtcctctgaacaaacgtggcctcaaatgcaaaactcgcccgtctcgatatccacatttttctccattttgcccacgaatttctctctatcttgtgtgtgctcttaaaaacttgttctgcatattttggtccatgtctgcagctaccattactggaggcagaagtcagatgtatttgttctatattctctcaataaactaaaccatattacatgcatccaacgcaatgccattagccaaaccaaattatataggaagagactgcacaagagacttagcgaattgtctgtagacatgaggttttcctcaatcatatttttggcttgttgtacatgattaaaatgaaactatcttactgctgtttcagaaggagtctgatgagatatacctgctaatatgcctggaatgttattaagatttcagaaataactgcacctgcaaatcaattagcagtggcagagtaattatcagaaacagaatttcatgtacgacaaagaatgcatctgtac

SEQ ID NO: 343218 - DNA, 221 bp, Homo sapiens
tttacatctccgccttactctatcactggggttatagcctcctatgagtatttaggaaaaaaaaaattttaaaaaaaggccttccctacaccaactagaaatctcagaaggagcaactataaacaatacaatagttgtttctttggttagaaatgaagtataaaattccttagttttccaaacttaaacaataaaaaggagcaacaacatcaaagaacaag

SEQ ID NO: 343219 - DNA, 557 bp, Homo sapiens
ttctgatacaggagtgttaaagtgtccaattataatagtacattcatatatttctcattgtagttctatcagtttttgcctcacatattctgatgctttgttgttaggcatatagatattaagaattgttgtatcttcttcgattacttaccctttgtcattacgtcctatttatccctgataacgtacagtgctctgaagtctactattaatatagctaccctcagtttattttggttaatgttagcatgatatatctttctccattcctttacttttaatctttgtgtctttaaacttaaagtgggtttctagttgataacatatagttgggtcttgctttttaattcactctactaatctctgtcttttaattggtatatttaaccacagtgattattgatatagtctggactagtatctatcatatttattacaggtttctgtgtgtggcccctgttctttgttcctatttccgtcttttacactttttctgccttttgtggttttaactgagcacattatatgatttcattttctcccttttcttggcatat

SEQ ID NO: 343220 - DNA, 351 bp, Homo sapiens
ggtatataacagaatacaaatagctaaaaacaaaaatgatgatatggaagataagactgaatacatgtcctgaacatataataaaatgacaaggagggtcaggcgtggtgtctcacacctataatcccaacactttgggaggacaaggcaggtgaatcacctgaggtcaggagttggagaccagcctagccaacatggtgaaaccccgtctctaccaaaaatacaaaaattagccgggcatggtggcaggcgcctgtaatcccagctactcaggaggctgagacaggagaatcacttgaacctggaagaaagaggttgcagtgagccgagatcacgccactgcactccagc

SEQ ID NO: 343221 - DNA, 643 bp, Homo sapiens
tgctgggattacaggcatgagtcactgtgtctggccttaaaaaagcttatactatctggaaagttagatagtagggcttgtctccttatagtgatgctattagttgattaattaactcattagacgatttttgaaaagcagggagaagtggcacagtgtgggtaagtcttaagtggggtgctttgaaaagtaagaaatgtagaatgaggagtggctaaagatggagggatcaggctcaggtgagaggggagccaggggaacactgaggaactaagttaatagacggttttaagactccaaaaataaactttattgttttgcttgtggctctcaactgagagcacaagagatgggaacataataaagcacaaagaaattcagacaaggttcagagctcattcagggatggccaacaacttgatagtgtctctaaaatattacaagaccctggccttaatttgcttggtcaagtcccagatgtgttgccaagacatccagcgagggaggcaagactttgtgttgaatgtggtttccaaaccaaactgccacctgctagaaagaacatgtttttcagaccatttcagttcacatgtttgaatactgcacaatctggtgtgtgtgaatttagtaggaatgctagccc

SEQ ID NO: 343222 - DNA, 1002 bp, Homo sapiens
aaagaacatacacagggataagaaaagtgagagcaaaggcacaaaaggcagcataacatgggaacattaattagactatagcggaaaaagcagtctgactggctcacagggcacaaaggaataggaaaataaaaatagcagtaatcttcagttaagattaaggagatctctgagtatcagtgaagagctctgactcatttaataagcaacaacaatagacattttgaagataaacatgaatactgagaaaactaaagatacttttaaattaacgaaagaagttctaacagtagaaggctgaacaatacatctaggcatggtaagcatttcattaaaatatgagtaatatgtggtaattttttggcgaaaaacaaaaaatgaggtcagaaatagcataccaaatggaagaaactgcaagaaagtgacataaggatagttaagaaactggtaatttcagctttattcaatattatatggatattaagtatctgctatgtgcagccagggtaggtatcatatgcaaacatttttgcttccctattttttataacaggatattaattttgataccatggcatctaatatctaaggcacattgaagttacatttagttataccactatcacagaacatagcacttagggtatttgcctacaacctcacatgtattaacaaataaagcagatgtatggggcagactcccatttttccctcaaaaaagtacttcgaatctgccaaagtacatgaaaaaaaaaacaaattcaggctggatgcggtggttgacacctgtaatccttgggcaacaaggcgaaaccccacccctacaaaaaaatacacaaaattagccaggcgtggtggcctgcgcctgtagttccacctacccgggaggatgggaggtgaaaggatcacctgagcctggggaggttgaggttgcagtgagctgtgacagcgccacttcactctagcctgggtgacagagtgagaacctgccttgaaaaaaac

SEQ ID NO: 343223 - DNA, 1402 bp, Homo sapiens
cagactccatagccagactgcctgggcttgcatcccagcttcacgacttacaagctgtgtgaccatagataagttaccttgcctctctgttgctcagttttatcttctgaaacacagagatgttcagagtgcaacttttcaggatagtggtggagactaagtgagtttacacatataaagtacttagaacagtgcctggcacaaaataaggactacgtaagtgttagttattagtataagcttgcagagcttacattccagtaggtgaggaaataacctaaacaaacaaacaaaaaatattaggcaggtgataagtgccatgaagaaaataaaagagaaaagtgggagagagcgctgctgaggatctgtctcataccaggtggaaagagaatagcttgtgagagtgtatgagtggaatgaagtggtcagatgagagagcgcggcggagatggagagaagcggagaacttgatgcatattttggaggcaaaatcaacaagattggctgatggattaaaagcagaagattttgccatagagaaatctcttgcttttcaatctctccaatttgggaaccaaccaaccaaccagtctaccaaccagccaacgaaccaactactcaaccggtcaactgactcctcccggagacaaagattggagaattgcttgaatctggtacaaagactaaagcaaagtaatactgtatcatgcacagacctcaactctgtgaagacagtccctcatgctgtaggaagtcagccttgaatatctaggcttaggggaggctgagaaaggtcaccactggagaagtaagcggttggggcaggtcaggatccagggctctcaattcttatggagagattttgcttttttaaaacatcagacctgctggtgtttgcactcagttttctttcttataaaaatcaactctattgagatgtactgcccaatcaagatatagaacatttgcatcaccctagaaaacttccttgtgccccaaatcacatcactgatgtgatttctatcactatagctgagttttgtctatcctagaactttgtgtaaattgtccttttcttttgactttatgtagtttttttctcatgtggaagaaaaagaattattgtagttttatggtttttaaaaaatattcaaatcggattcatctgacatttattttggtgtagtgtgtgaaaggcacagatctaatctcatttattttctcccagagagctacctggttgtttcaacatcatttattgacaaatgtatcttttttctcactggtttaaatgccacctttatcatacattaaattcccaagtgtgctcaggtatatttctggaacgtccgttcttttcctttgatgtgttattcatgtctcaatacaatactcttttaat

SEQ ID NO: 343224 - DNA, 976 bp, Homo sapiens
gttctgcagaaacagtggtgagcaacgcagacaagatatctgttgctttagagctgtcattgtggtttgggaagtcagacaagaaatgattttataggttgttgaataggacttttcctctgctcttggaatatctgctgaagccacaaagatagaacaatgagggctaaatattcttgcattctgaagagaagtactagacaccttactaaaggcagaacaggttcaacagcaatcaaactacatccctcaattccagtctacaaatgaaagggattgaagaaagtcactgaagcataacactgctgcatttgtgggcagggctgagatttcccctgagggaactccccaactcaaaccaaatgaagggagctcccagagagaaccagtcatctgcaagaagaggaggctctgtccctataactgtccccccactgatgctgactatgttgctggatgttacaggcacctcggtgcattaaactacagcaagacagttcatgggagaacccaacatatgtctttaggaattgaggacgtacataaatgaagagacttgtgtgcacttcctgtctggagaattctgatcgtggagcctcgctggagtggcctgtgtggcaaggtgagaagtgggcagggtgaggagcggccaacccaccattgttttgcctggcataggtgggacagtcctatgagagacagaggatgcaggggtctccgagaggttggccagagagtaatttgctatggcaactcagggtggaggtcctgtagagaacctcccaaaaacccacatatgtgcccatgaaaaagccagcgcttggcacctgccaaccaagggtacctgtcacataagactttgctacttttcctctaacacctctctcccagccttgacaaagaggagccacagcagaaaagggaggtcaggaaaacagaccacaccccactctcaccactgcaggatctctagcaa

SEQ ID NO: 343225 - DNA, 663 bp, Homo sapiens
ccaagttcaattcttaagacattcctgtcttatttcttctaaaatttcacctttaaaatgatgttttcaaagtatggttgaatgtttaatgtgctcaaacactttttctgcaactagggatgaaataatataatttctttctttaaactctgaatgtgatgaatcatattaattcatgtgattagtattttagtataaaccatctcaggcatataaaatagtataaaagaataccttgtacccactacttagcttaagtgaacatccatgtaccctgtacttaagaaatagaacattacagacctgtctgaagacctcacccctgcatagtcttccctgaatgaattccccattaccattatcctaaattttgttttaacttttctcatttttttcttacaatatacattgatgcattctctagtgatagattactttgaattcccaaaataaacccaactagttcatgatagtacatgtcatattaataatcttcctatcataatgcaaaattcctaaaagaaaaaaattagcaggcttgatccagctttcatcctttctggaatatttggtagtactcaaaacttgaaagaaaaacaccataggatctggtctgtccttccttcctttcttcctcttagtagctttactttcttttttttt

SEQ ID NO: 343226 - DNA, 440 bp, Homo sapiens
ggacaaatgaatctcttcccacgccatgggatttcccttgatttttatattgggagtgaaaagatgaagcatgagactcttcagctgcatctcgaactgcatctaatcccagcacatctctctcaatctttgattaagtctgttcatctaaaagagagacacaggggaaaaatggaaatgggactttggaagaatgaccatccacattcccatcacagcctgagatttcctacctgattgagattttcagtagatggccctaggtctagtttcccactttggacctgctgcccttggctccaatagaggacttccaagtaactaggaagatttcacctctcttttgaaacataatggacaaatgtgtttctttaggatgagaggtgcacctggctagtcaatctttattttcctaaaataaacaggatgaaaactcaaaa

SEQ ID NO: 343227 - DNA, 786 bp, Homo sapiens
gtgatgctgctaaacactgtcagtagttgtctatccccataccttcactcctatttttaaaaagaccatgaaaaaaataccagatccattgattggtttggtctaattatacagatatcggcatatactatctcaagacagctgtgttctttttgtaggaagaatcctggcctagatttgtatcatagctctaccactcattagctccctgaccttggggaagtctcttcatttttctgaatttcatctatgtagataatccttcagaaggttataatgaaaattaaatgaaattctatgagattagggaggggggagggatagcattaggagatatacttaatgtgaatgatgagttaatggatgtagcacaccaacatggcacatgtatacatatgtaacaaacctgcacgttgtgcacatgcaccctagaacttaaagtataatttaaaaaagaaaagaaattctatgagattaataagctatatgatgtaatacatggctcttgtatattcatgaactcttcacttagctctttggcttgtgaatattatgtacatcaaaatttaatttttcatttgatctattttactagactcctgccccatctagtctacctgtccacattattaccacattctagtccatcttgcccattactaccaggctaagctttctagtgtggatatgtcatcatcttattttccttagaattttagcgatctttttatcatttccaagataaacacttgcctaggtgtacagcatccttgtttaccatcatac

SEQ ID NO: 343228 - DNA, 351 bp, Homo sapiens
aagaaatgacactctttttctgagaaactataatgtgtggacataggaactgtctttgtgaagttaagatgaggcccctaatccgttgtgactggtgtccttctaagaagatggccgcataaaggcagagaaacacagggaaaataccatgtgacggtctctgaggacgatgttaaagtgccgcatctacaagacaagaaatgccaaagactgccagcaactaccagggtctaggaagaggcaagaaggactctttctctacaagtttcagagggagtgcagtgctgccaataccttgatttcaagcttgtagctgcccaaactgtaaaacaatacatttctgttgtttta

SEQ ID NO: 343229 - DNA, 299 bp, Homo sapiens
caatcatcattaaacccattttctgaaatgaccacctcatagattcttgggtatgattacactctccattacctacttagggacagcaaataggttttgcattcacttgtactttttcattacaagaaatggagattccaaccccgaatggcctaagcaaaaaggaaatgtattcactcatgtcacacacaccaacaaatgtctagaacaagactatcttcagctatagcttgatttaaagactctgccagccatatacctgtctgtcctgtcacagaaatggctgccacaggtcctgg

SEQ ID NO: 343230 - DNA, 116 bp, Homo sapiens
tgacaattcagaccatattcttagtcttccatgactctgttctttatctcataccccaaatccagtcagatagaaaatctttttgttctgtcttcaaaatatatcctgaatcagac

SEQ ID NO: 343231 - DNA, 482 bp, Homo sapiens
atctagtggtggtggaagggggtggatatattttgcatatgagggggatgtaaattgttgagagcaaagggcagaatgtggtggactgtttgcacagacggtcaccaattcctctcaccctgtattcacatgccattcctccaggatggagtctattttatacaaatgtttataacagccattattcattattcctaatagccataaagtagaaacaacctaaatgcccatcaaccaatgaaaggataactaaaacgtggtatatccacaatggaatattatttggcaataggaaggaataaagtattgatacatgctacaacatagatgaaccctggaaatatcaagctaagtgaaagaagcatgtaacaaaagaccaaatattgtatggttccatttatacaaaatgtccagaacagacaaatctatagagacagagtagattaatggtggggaagaggccgggcgcgatggctcacgcc

SEQ ID NO: 343232 - DNA, 366 bp, Homo sapiens
cctttcataaacggcttatcctgtccaactggtagtttctactgagtagaaatctttaagtgggattacttaaccctagagtatgaatattttaaactttactacaataaatattgcatcatatggctgaatcatcttaacaatcttatcagcaatgtttgagttcctattgtccccaaatggtcaccaaaagttatcatcagacttcatatttgtccaacacatgaatacaaaattatcattttaatttgcagttctctattactgagtttcagtatattttaaatattctactttcagatttccttcagccagacacggtggctcacgactgtaatcccagcactttgggaggctgaggtgggc

SEQ ID NO: 343233 - DNA, 166 bp, Homo sapiens
ggaacccacagggatccacataaatgacaaatccataacattgaaacatgctgtcatcatctctatagatgcctggaactttgacactgaacagtaatgaaagcagagtatttggtaaaatatctggacatagaccaaactgtaatcctgatgctatgtaaaacag

SEQ ID NO: 343234 - DNA, 618 bp, Homo sapiens
gtcaggagttcaagaccagcctggccaatatggcaaaaccccgtttctactaaaaatacgaaaatattagctgagcatggtggcgtgtgcctgtaatcccagctacttaggaggctgaggcatgagaatcgcttgaacctgggaggcagaggttgcagtgagctgagatcacaccactgtactccagcctgggtgacagagcgagagtccacctcaaaaaaaaaaagaaggttaatactcctatatgtaactttttaaaattaactaataaaatgacaaaaagcccaaaggaaaaatacactgaggtaatgacaggcaactcatgaaaaaaaaaaaaaaaaaactcgagttttttttttttttttttcttttaactcatctgtatttgttacaactttaagcagaatgtgactcgagcactacatttccatccacaagactgggtctgagttatttttgaacagctttacgatatgcttaggtaggcttttaactttgctccttcaaacaatacttttctttggaaaacaagccctgtggagagatccttcatcaagtgcttcagttaacctattctagagactagtcatgcagaatggcactacgggaatgaaagtc

SEQ ID NO: 343235 - DNA, 205 bp, Homo sapiens
tatgttgtctatgtctgcaaaaaaatctttccagaattttgatgggaattacattaatggcatttagaaagaattgacatttttactatattgagtcttctaatccatgaacatggaatgtctcttcatttatttagatctatgttttctttcaccatgttagccagggtggtctcaaactcctgacctcgtgattccccctgcg

SEQ ID NO: 343236 - DNA, 647 bp, Homo sapiens
atgggaaaagttgatagtgctgactgtactactctgcctgggtacacacctcttgaaccttcctttgttcaaaatgagtgtggtgtctaataaggagaatgggttttgaagtcagacaaacttaaaatcatgtctgtgatctgagcctttctggctgtgtgaccttcagtttttttacctctctgttagttttcctgtctgtacattgagatttataatagtgaatacatggcagagttgtgttaacttaaataaagtaaattaaactgcctggtttaatagctggcacattttgtgagctccataaatagtagctgtttattgactttatttcttttaaagaccagatgatgactctctccagaacctcttgtgcagctttcaccactaaccccaggtagattgcaccttcatgcctctcctaatggttatacaacttgcccttgcacattgttgtgtactgatttatttaacatctctcttgtacttcctatgagctctttgagtttagtgactgtcttatttatctttgcaacccaagcaattcccacagagcctggcaataacattcaccaacaaatgcttgctggtggattcaatgtgtcgatgggtttgaagactgtgacaaggctacgggaggactctat

SEQ ID NO: 343237 - DNA, 754 bp, Homo sapiens
tgtgaaaaagtcttcagccagagttcatcccttactcttcatcaaagaattcatactggagagaaaccctataaatgtatagagtgtggaaaagccttcagccagagatcaaatcttgttcaacatcagaggattcatactggagaaaaaccctatgaatgtaaggaatgtaggaaagccttcagtcagaatgcacacctagttcaacatctgcgagttcatactggagaaaaaccttacgaatgtaaggtatgtcgaaaagccttcagccagtttgcctaccttgctcaacatcagagagttcacacgggagagaaaccctatgaatgtatcgaatgtgggaaagcatttagcaacagatcatccattgctcaacaccagagagttcatacaggagagaaaccctatgaatgtaatgtctgtgggaaagcatttagccttcgtgcataccttactgtacatcagagaatacatactggagagagaccctatgaatgtaaggaatgtgggaaggcctttagccagaattcacaccttgctcaacatcagagaattcatactggagaaaaaccttataagtgtcaggaatgtaggaaagcattcagccagattgcctaccttgctcagcatcaaagagttcatactggagagaaaccctatgaatgtattgaatgtgggaaggcttttagcaatgactcgtcccttactcaacatcagcgagttcatactggagagaaaccttatgaatgtactg

SEQ ID NO: 343238 - DNA, 254 bp, Homo sapiens
tagctttgcagggtatagtattcttggttgccattttatgtcaatatttggaacatattatcccattctttcctggcctacaaaatttttgtggagaaatctgctgatagtctcatagggattcccttgaatgacaagttgcttttttcttgcatctttcaaaagtttttgactttgacagtttcattgtgatgtgtcttgttgtagacttgtgttcaacctatttgggatcctatgggcttcttcagtctgga

SEQ ID NO: 343239 - DNA, 518 bp, Homo sapiens
aatggagaccctgagaagtcacctttggtgtcacgagcaccttcaggtgaaaggaagtagccttaggctgggaatcccacctctgcacatggcttcctgtgtcacaagggcagacaccctgctgtggacctcaggtgcatgtctgtctaggtgaatatctatctaaataaagctctatgtaaaatgaaggcattcgatttcatggcctctcgggccccttttagttcgaatgatctggtaaatccacctttttttgacagtaacattttctgactctttaaccctgcaaacaatattaaccagccaaggaactggctacccattacatatctcgcccataagcaataacaatcagtattaataataattattagatattcaattgtagctcttaaatgtattccagccccctgatcgttgtaaattagtatgtaattttggagagatgggggtctgtctttgttgcccaggttggtatcaaactcctaggttcaagcgatccacctgcctcagccatc

SEQ ID NO: 343240 - DNA, 376 bp, Homo sapiens
gctgcagtgagctgagattgtgccactgcaccacagcctgggtgacagagcaagattccatctcaggaaaaaaaaaaaaaagtattttcaaatcatctgactcctcctctctcccagtgcaatgactttaggcagcagtccccaacctttttggtaccagggactggtttgtggaagacagtttttccactgacccgggggaaatgattttgagatgattcaaacattacatttattgtgtactttattactatttttaaaaattattattattatttttagagacagagttttgctcttgttgcccaggctggagtgagctgagattgtgccactgcaccacagcctgggtgacagagcaagattccatctcagg

SEQ ID NO: 343241 - DNA, 180 bp, Homo sapiens
aattcctgcttgatgagatggaaggtccaagtcaatagcctcatggtcctcccaagtctgacagtctgctattctacacacctgtccacaggctgcagacatataaaggtaaatgttcaggtattagaaaatattcaaagaattctcaatgttcaaaattctgaaaagcaaatctatgct

SEQ ID NO: 343242 - DNA, 424 bp, Homo sapiens
tgcaggttaaatctggtcatgaggtcttggcttctgaacaagcaactaagaacgaaaacaaataataagagtctttatttaaagtccaatctgtgactccttgtgaaaacttccagcaaagcaaacttaagacagcctatatgcttcacagatgtaatcaggtcaaattaatgacctcattcttattttatgacgaagaatattatcctttttttgacaagaatattcttttgagattatttttggtcaaaagagggtaagtctgtaagaaaataattttgtttcaaatgaaaactatgcatcgtctaaatacagcatatgcttctgggatatcaggttctagccttttattatctttgagttattttacagttttttgtaaattaataggcatgcaaattctatcttgtccagtacagtttca

SEQ ID NO: 343243 - DNA, 1493 bp, Homo sapiens
  misc_feature (1066)..(1066): n is a, c, g, or t
  misc_feature (1093)..(1093): n is a, c, g, or t
  misc_feature (1253)..(1253): n is a, c, g, or t
cgcggttcggcggcggcatccggcctcgcacttccggtggggagattccggcctggagctcccagggccgaggtcactttggtggcagttcatggagaatagcttgaggtgacaagacagcagacacgacgtgggtctctgggactgcctgtgccgttgtgggcagcccctccagagccctgagtcacgcagccttcagaggcacccatggctacgagaagcacagtctctgcctgaggctccagagcggccctttttccccagcagcagaccttgggacctgtgagcgctgcatccaattaaccatgggaagggtcagcaccagccaccagccccttaggtgaggactctgcctggggctctgctgatggttccgaatcatggagctgcagagagctcctccagcctggagacgttcttggtgaaagctgtggtctaactccaccggctcttcctgcacattgtattcaagaggggtgcctgcccccgctgactcaggagctccggtgctgcagccgccacgaatggggaggtgggccctcgatgtggcctttttgtggaaggcggtgttgaccctggggctggtgcttctctactactgcttctccatcggcatcaccttctacaacaagtggctgacaaagagcttccatttccccctcttcatgacgatgctgcacctggccgtgatcttcctcttctccgccctgtccagggcgctggttcagtgctccagccacagggcccgtgtggtgctgagctgggccgactacctcagaagagtggctcccacagctctggcgacggcgcttgacgtgggcttgtccaactggagcttcctgtatgtcaccgtctcgctgtacacaatgaccaaatcctcagctgtcctcttcatcttgatcttctctctgatcttcaagctggaggagctgcgcgcggcactggtcctggtggtcctcctcatcgccgggggtctcttcatgttcacctacaagtccacacagttccacgtggagggcttcgccttggtgctgggggcctcgttcatcggtggcattcgctggancctcacccagatgctcctgcagaaggntgaactcggcctccagaatcccatcgacaccatgttccacctgcagccactcatgttcctggggctcttccctctctttgctgtcttttgaaggtctccattgtccacatctgagaacatcttccgttcccaggaaccggcctgctctgcgggtacttgngagctcttctggggggatgctgctttggttggggctctcgggctccccggtctccagaactcagctcatctttcatgccgggctttaggagctgcttggtcggcgctcgggggcacaatcgctctcgaggtggttcccttgctcgggaatccccagtgccaacgtcagttggccgcttggttcccctgccttcgcgggagatagttgccacgaccccccacctgtgctgcttggtccgtg

SEQ ID NO: 343244 - DNA, 1298 bp, Homo sapiens
  misc_feature (871)..(871): n is a, c, g, or t
  misc_feature (898)..(898): n is a, c, g, or t
  misc_feature (1058)..(1058): n is a, c, g, or t
cgcggttcggcggcggcatccggcctcgcacttccggtggggagattccggcctggagctcccagggccgagcagaccttgggacctgtgagcgctgcatccaattaaccatgggaagggtcagcaccagccaccagccccttaggtgaggactctgcctggggctctgctgatggttccgaatcatggagctgcagagagctcctccagcctggagacgttcttggtgaaagctgtggtctaactccaccggctcttcctgcacattgtattcaagaggggtgcctgcccccgctgactcaggagctccggtgctgcagccgccacgaatggggaggtgggccctcgatgtggcctttttgtggaaggcggtgttgaccctggggctggtgcttctctactactgcttctccatcggcatcaccttctacaacaagtggctgacaaagagcttccatttccccctcttcatgacgatgctgcacctggccgtgatcttcctcttctccgccctgtccagggcgctggttcagtgctccagccacagggcccgtgtggtgctgagctgggccgactacctcagaagagtggctcccacagctctggcgacggcgcttgacgtgggcttgtccaactggagcttcctgtatgtcaccgtctcgctgtacacaatgaccaaatcctcagctgtcctcttcatcttgatcttctctctgatcttcaagctggaggagctgcgcgcggcactggtcctggtggtcctcctcatcgccgggggtctcttcatgttcacctacaagtccacacagttccacgtggagggcttcgccttggtgctgggggcctcgttcatcggtggcattcgctggancctcacccagatgctcctgcagaaggntgaactcggcctccagaatcccatcgacaccatgttccacctgcagccactcatgttcctggggctcttccctctctttgctgtcttttgaaggtctccattgtccacatctgagaacatcttccgttcccaggaaccggcctgctctgcgggtacttgngagctcttctggggggatgctgctttggttggggctctcgggctccccggtctccagaactcagctcatctttcatgccgggctttaggagctgcttggtcggcgctcgggggcacaatcgctctcgaggtggttcccttgctcgggaatccccagtgccaacgtcagttggccgcttggttcccctgccttcgcgggagatagttgccacgaccccccacctgtgctgcttggtccgtg

SEQ ID NO: 343245 - DNA, 221 bp, Homo sapiens
cttggtgtgttggctggttgtctgaaactccattttcatttcactaataacttaaggaatgtactgacgctaataacgtcttgcagccctgttcttttcaaaggtgccaaaatattagtgcttaagtacactgatggtgtgctaaaggcagaatattcacctccctttattccaaggattcatgagaagatagcctaagagttctgtccacatgatgaaac

SEQ ID NO: 343246 - DNA, 5398 bp, Homo sapiens
agcgaaggaggcgggctttggccttttgccctagggagcgagtgcggagcgagtgggagcgagacggccctgagtggaagtgtctggctccccgtagaggcccttctgtacgccccgccgcccatgagctcgttctcacgcgaacagcgccgtcgttaggctggctctgtagcctcggcttaccccgggacaggcccacgcctcgccagggagggggcagcccgtcgaggcgcctccctagtcagcgtcggcgtcgcgctgcgaccctggaagcgggagccgccgcgagcgagaggaggagctccagtggcggcggcggcggcggcagcggcagcgggcagcagctccagcagcgccagcaggcgggatcgaggccgtcaacatggcgagcgcctcgtaccacatttccaatttgctggaaaaaatgacatccagcgacaaggactttaggtttatggctacaaatgatttgatgacggaactgcagaaagattccatcaagttggatgatgatagtgaaaggaaagtagtgaaaatgattttgaagttattggaagataaaaatggagaggtacagaatttagctgtcaaatgtcttggtcctttagtgagtaaagtgaaagaataccaagtagagacaattgtagataccctctgcactaacatgctttctgataaagaacaacttcgagacatttcaagtattggtcttaaaacagtaattggagaacttcctccagcttccagtggctctgcattagctgctaatgtatgtaaaaagattactggacgtcttacaagtgcaatagcaaaacaggaagatgtctctgttcagctagaagccttggatattatggctgatatgttgagcaggcaaggaggacttcttgttaatttccatccttcaattctgacctgtctacttccccagttgaccagccctagacttgcagtgaggaaaagaaccattatcgctcttggccatctggttatgagctgtggaaatatagtttttgtagatcttattgaacatctgttgtcagagttgtccaaaaatgattctatgtcaacaacaagaacctacatacaatgtattgctgctattagtaggcaagctggtcatagaataggtgaataccttgagaagataattcctttggtggtaaaattttgcaatgtagatgatgatgaattaagagagtactgtattcaagcctttgaatcatttgtaagaagatgtcctaaggaagtatatcctcatgtttctaccattataaatatttgtcttaaatatcttacctatgatccaaattataattacgatgatgaagatgaagatgaaaatgcaatggatgctgatggtggtgatgatgatgatcaagggagtgatgatgaatacagtgatgatgatgacatgagttggaaagtgagacgtgcagctgcgaagtgcttggatgctgtagttagcacaaggcatgaaatgcttccagaattctacaagaccgtctctcctgcactaatatccagatttaaagagcgtgaagagaatgtaaaggcagatgtttttcacgcatacctttctcttttgaagcaaactcgtcctgtacaaagttggctatgtgaccctgatgcaatggagcagggagaaacacctttaacaatgcttcagagtcaggttcccaacattgttaaagctcttcacaaacagatgaaagaaaaaagtgtgaagacccgacagtgttgttttaacatgttaactgagctggtaaatgtattacctggggccctaactcaacacattcctgtacttgtaccaggaatcattttctcactgaatgataaatcaagctcatcgaatttgaagatcgatgctttgtcatgtctatacgtaatcctctgtaaccattctcctcaagtcttccatcctcacgttcaggctttggttcctccagtggtggcttgtgttggagacccattttacaaaattacatctgaagcacttcttgttactcaacagcttgtcaaagtaattcgtcctttagatcagccttcctcgtttgatgcaactccttatatcaaagatctatttacctgtaccattaagagattaaaagcagctgacattgatcaggaagtcaaggaaagggctatttcctgtatgggacaaattatttgcaaccttggagacaatttgggttctgacttgcctaatacacttcagattttcttggagagactaaagaatgaaattaccaggttaactacagtaaaggcattgacactgattgctgggtcacctttgaagatagatttgaggcctgttctgggagaaggggttcctatccttgcttcatttcttagaaaaaaccagagagctttgaaactgggtactctttctgcccttgatattctaataaaaaactatagtgacagcttgacagctgccatgattgatgcagttctagatgagctcccacctcttatcagcgaaagtgatatgcatgtttcacaaatggccatcagttttcttaccactttggcaaaagtatatccctcctccctttcaaagataagtggatccattctcaatgaacttattggacttgtgagatcacccttattgcaggggggagctcttagtgccatgctagactttttccaagctctggttgtcactggaacaaataatttaggatacatggatttgttgcgcatgctgactggtccagtttactctcagagcacagctcttactcataagcagtcttattattccattgccaaatgtgtagctgcccttactcgagcatgccctaaagagggaccagctgtagtaggtcagtttattcaagatgtcaagaactcaaggtctacagattccattcgtctcttagctctactttctcttggagaagttgggcatcatattgacttaagtggacagttggaactaaaatctgtaatactagaagctttctcatctcctagtgaagaagtcaaatcagctgcatcctatgcattaggcagcattagtgtgggcaaccttcctgaatatctgccgtttgtcctgcaagaaataactagtcaacccaaaaggcagtatcttttacttcattccttgaaggaaattattagctctgcatcagtggtgggccttaaaccatatgttgaaaacatctgggccttattactaaagcactgtgagtgtgcagaggaaggaaccagaaatgttgttgctgaatgtctaggaaaactcactctaattgatccagaaactctccttccacggcttaaggggtacttgatatcaggctcatcatatgcccgaagctcagtggttacggctgtgaaatttacaatttctgaccatccacaacctattgatccactgttaaagaactgcataggtgatttcctaaaaactttggaagacccagatttgaatgtgagaagagtagccttggtcacatttaattcagcagcacataacaagccatcattaataagggatctattggatactgttcttccacatctttacaatgaaacaaaagttagaaaggagcttataagagaggtagaaatgggtccatttaaacatacggttgatgatggtctggatattagaaaggcagcatttgagtgtatgtacacacttctagacagttgtcttgatagacttgatatctttgaatttctaaatcatgttgaagatggtttgaaggaccattatgatattaagatgctgacatttttaatgttggtgagactgtctaccctttgtccaagtgcagtactgcagaggttggaccgacttgttgagccattacgtgcaacatgtacaactaaggtaaaggcaaactcagtaaagcaggagtttgaaaaacaagatgaattaaagcgatctgccatgagagcagtagcagcactgctaaccattccagaagcagagaagagtccactgatgagtgaattccagtcacagatcagttctaaccctgagctggcggctatctttgaaagtatccagaaagattcatcatctactaacttggaatcaatggacactagttagatgtttgttcaccatggggaccattacatatgaccatacaatgcactgaattgacaggttaatcataagacatggaaagagaagtgtctaaaagcttcaaaatgttccacttttttttccttcatggagactgtttgtttggctttcttccattgttgtttttgtagcatttatttcagaaatgtgtatttccataatccagaggttgtaaaaccactagtgttttagtggttacagcaacatttgaaatggaaactaaaagttaggattttatggagtatggagatagggtccagtatctatttaccctgtaatgtttaggattaaaatgttaaaattttgtgaccatgaatttctttcttttataaattttctcatttaaaaatcaaaaatcttgcaaaacaaaaaccatgtttctttttcttgtataactttttgttttcagcaacataaattgatttttagctggcagacaagaatatccatataagatttgttaaccatttcagagagtttggcaatttttaaaagataataaggtatcatttttaagtatgaaaattaacaatatccctgttgcgcacactaattttgcatgagtaagtttacaaatatgtatcgtctgtaaagcagcatgtgcagattattcataatatagaagttaaaataagtattagtgcaattttcagatatttatttttgcacagaaaacacattatctggagagaaagaaaggagaatttttgagacttgggttttcttaatgccagtgtgaatttgcagatgttttcagaaaatcaagtcacagtaacaatttgccacttttttctattataaatcttcttacttaaattttgaatatttagtttttctcagttacccatttgtgtgtgtgtgattccacttagaaattcttaaaaccagatttttctttcattccgtttggatgtctacattccttatcaaaggatataaatactgtgtatgcttttgaattttatttttaggaaaattctgaagccagctatcacaggtttgttagctaataatagtattttcttttagttgagttaggtttttccccatctcctgtagagcgaatttacatattgtattgggtaagtgttcactacttttcctgattaagggatctgtgctggggaacaaagcttttgcagtaccttatattgtagttaaaattttatttaacatatccttcagtgagctcatttcacactgtagcctcttccttaaaatttgtggtgctcctgtaacagtaagaactaattctgaaataaaagacatctcctaatgctgtgcaaa

SEQ ID NO: 343247 - DNA, 5865 bp, Homo sapiens
agcgaaggaggcgggctttggccttttgccctagggagcgagtgcggagcgagtgggagcgagacggccctgagtggaagtgtctggctccccgtagaggcccttctgtacgccccgccgcccatgagctcgttctcacgcgaacagcgccgtcgttaggctggctctgtagcctcggcttaccccgggacaggcccacgcctcgccagggagggggcagcccgtcgaggcgcctccctagtcagcgtcggcgtcgcgctgcgaccctggaagcgggagccgccgcgagcgagaggaggagctccagtggcggcggcggcggcggcagcggcagcgggcagcagctccagcagcgccagcaggcgggatcgaggccgtcaacatggcgagcgcctcgtaccacatttccaatttgctggaaaaaatgacatccagcgacaaggactttaggtttatggctacaaatgatttgatgacggaactgcagaaagattccatcaagttggatgatgatagtgaaaggaaagtagtgaaaatgattttgaagttattggaagataaaaatggagaggtacagaatttagctgtcaaatgtcttggtcctttagtgagtaaagtgaaagaataccaagtagagacaattgtagataccctctgcactaacatgctttctgataaagaacaacttcgagacatttcaagtattggtcttaaaacagtaattggagaacttcctccagcttccagtggctctgcattagctgctaatgtatgtaaaaagattactggacgtcttacaagtgcaatagcaaaacaggaagatgtctctgttcagctagaagccttggatattatggctgatatgttgagcaggcaaggaggacttcttgttaatttccatccttcaattctgacctgtctacttccccagttgaccagccctagacttgcagtgaggaaaagaaccattatcgctcttggccatctggttatgagctgtggaaatatagtttttgtagatcttattgaacatctgttgtcagagttgtccaaaaatgattctatgtcaacaacaagaacctacatacaatgtattgctgctattagtaggcaagctggtcatagaataggtgaataccttgagaagataattcctttggtggtaaaattttgcaatgtagatgatgatgaattaagagagtactgtattcaagcctttgaatcatttgtaagaagatgtcctaaggaagtatatcctcatgtttctaccattataaatatttgtcttaaatatcttacctatgatccaaattataattacgatgatgaagatgaagatgaaaatgcaatggatgctgatggtggtgatgatgatgatcaagggagtgatgatgaatacagtgatgatgatgacatgagttggaaagtgagacgtgcagctgcgaagtgcttggatgctgtagttagcacaaggcatgaaatgcttccagaattctacaagaccgtctctcctgcactaatatccagatttaaagagcgtgaagagaatgtaaaggcagatgtttttcacgcatacctttctcttttgaagcaaactcgtcctgtacaaagttggctatgtgaccctgatgcaatggagcagggagaaacacctttaacaatgcttcagagtcaggttcccaacattgttaaagctcttcacaaacagatgaaagaaaaaagtgtgaagacccgacagtgttgttttaacatgttaactgagctggtaaatgtattacctggggccctaactcaacacattcctgtacttgtaccaggaatcattttctcactgaatgataaatcaagctcatcgaatttgaagatcgatgctttgtcatgtctatacgtaatcctctgtaaccattctcctcaagtcttccatcctcacgttcaggctttggttcctccagtggtggcttgtgttggagacccattttacaaaattacatctgaagcacttcttgttactcaacagcttgtcaaagtaattcgtcctttagatcagccttcctcgtttgatgcaactccttatatcaaagatctatttacctgtaccattaagagattaaaagcagctgacattgatcaggaagtcaaggaaagggctatttcctgtatgggacaaattatttgcaaccttggagacaatttgggttctgacttgcctaatacacttcagattttcttggagagactaaagaatgaaattaccaggttaactacagtaaaggcattgacactgattgctgggtcacctttgaagatagatttgaggcctgttctgggagaaggggttcctatccttgcttcatttcttagaaaaaaccagagagctttgaaactgggtactctttctgcccttgatattctaataaaaaactatagtgacagcttgacagctgccatgattgatgcagttctagatgagctcccacctcttatcagcgaaagtgatatgcatgtttcacaaatggccatcagttttcttaccactttggcaaaagtatatccctcctccctttcaaagataagtggatccattctcaatgaacttattggacttgtgagatcacccttattgcaggggggagctcttagtgccatgctagactttttccaagctctggttgtcactggaacaaataatttaggatacatggatttgttgcgcatgctgactggtccagtttactctcagagcacagctcttactcataagcagtcttattattccattgccaaatgtgtagctgcccttactcgagcatgccctaaagagggaccagctgtagtaggtcagtttattcaagatgtcaagaactcaaggtctacagattccattcgtctcttagctctactttctcttggagaagttgggcatcatattgacttaagtggacagttggaactaaaatctgtaatactagaagctttctcatctcctagtgaagaagtcaaatcagctgcatcctatgcattaggcagcattagtgtgggcaaccttcctgaatatctgccgtttgtcctgcaagaaataactagtcaacccaaaaggcagtatcttttacttcattccttgaaggaaattattagctctgcatcagtggtgggccttaaaccatatgttgaaaacatctgggccttattactaaagcactgtgagtgtgcagaggaaggaaccagaaatgttgttgctgaatgtctaggaaaactcactctaattgatccagaaactctccttccacggcttaaggggtacttgatatcaggctcatcatatgcccgaagctcagtggttacggctgtgaaatttacaatttctgaccatccacaacctattgatccactgttaaagaactgcataggtgatttcctaaaaactttggaagacccagatttgaatgtgagaagagtagccttggtcacatttaattcagcagcacataacaagccatcattaataagggatctattggatactgttcttccacatctttacaatgaaacaaaagttagaaaggagcttataagagaggtagaaatgggtccatttaaacatacggttgatgatggtctggatattagaaaggcagcatttgagtgtatgtacacacttctagacagttgtcttgatagacttgatatctttgaatttctaaatcatgttgaagatggtttgaaggaccattatgatattaagatgctgacatttttaatgttggtgagactgtctaccctttgtccaagtgcagtactgcagaggttggaccgacttgttgagccattacgtgcaacatgtacaactaaggtaaaggcaaactcagtaaagcaggagtttgaaaaacaagatgaattaaagcgatctgccatgagagcagtagcagcactgctaaccattccagaagcagagaagagtccactgatgagtgaattccagtcacagatcagttctaaccctgagctggcggctatctttgaaagtatccagaaagattcatcatctactaacttggaatcaatggacactagttagatgtttgttcaccatggggaccattacatatgaccatacaatgcactgaattgacaggttaatcataagacatggaaagagaagtgtctaaaagcttcaaaatgttccacttttttttccttcatggagactgtttgtttggctttcttccattgttgtttttgtagcatttatttcagaaatgtgtatttccataatccagaggttgtaaaaccactagtgttttagtggttacagcaacatttgaaatggaaactaaaagttaggattttatggagtatggagatagggtccagtatctatttaccctgtaatgtttaggattaaaatgttaaaattttgtgaccatgaatttctttcttttataaattttctcatttaaaaatcaaaaatcttgcaaaacaaaaaccatgtttctttttcttgtataactttttgttttcagcaacataaattgatttttagctggcagacaagaatatccatataagatttgttaaccatttcagagagtttggcaatttttaaaagataataaggtatcatttttaagtatgaaaattaacaatatccctgttgcgcacactaattttgcatgagtaagtttacaaatatgtatcgtctgtaaagcagcatgtgcagattattcataatatagaagttaaaataagtattagtgcaattttcagatatttatttttgcacagaaaacacattatctggagagaaagaaaggagaatttttgagacttgggttttcttaatgccagtgtgaatttgcagatgttttcagaaaatcaagtcacagtaacaatttgccacttttttctattataaatcttcttacttaaattttgaatatttagtttttctcagttacccatttgtgtgtgtgtgattccacttagaaattcttaaaaccagatttttctttcattccgtttggatgtctacattccttatcaaaggatataaatactgtgtatgcttttgaattttatttttaggaaaattctgaagccagctatcacaggtttgttagctaataatagtattttcttttagttgagttaggtttttccccatctcctgtagagcgaatttacatattgtattgggtaagtgttcactacttttcctgattaagggatctgtgctggggaacaaagcttttgcagtaccttatattgtagttaaaattttatttaacatatccttcagtgagctcatttcacactgtagcctcttccttaaaatttgtggtgctcctgtaacagtaagaactaattctgaaataaaagacatctcctaatgctgtgcaaacatagtttacatgtattgaaggaggcagttgttaaattgagtgaccaatttaagcaatcagatatttgaaaactgcaccctttagttttgaaactgtgaattagaaacacttttcctgctgtattactacctgctttaacatccaaatatacagtgattttaaatgataacatactgtggttattagattaacagcttgattttgaatgttcagatgataatgcagaagacatcacttctagtaaggattttgactagtgcattgatgttgaagttggtgccatttcaaaatgtggcaggtgataatcttttaccataatttgcataaaactgtaatagaagtttattttgagatgttagtatattatgtactatgcatttctgtggtatagatgttgtggatatatttaagtatttggttacatggttttacaataaattacaatactgcaggctctaggactgaa

SEQ ID NO: 343248 - DNA, 3425 bp, Homo sapiens
agtagctgtcttgagtacctataaatccggcaatcgcagtcagccgtagtagatactgatgtgcaacaagcaatgaacctacatacaatgtattgctgctattagtaggcaagctggtcatagaataggtgaataccttgagaagataattcctttggtggtaaaattttgcaatgtagatgatgatgaattaagagagtactgtattcaagcctttgaatcatttgtaagaagatgtcctaaggaagtatatcctcatgtttctaccattataaatatttgtcttaaatatcttacctatgatccaaattataattacgatgatgaagatgaagatgaaaatgcaatggatgctgatggtggtgatgatgatgatcaagggagtgatgatgaatacagtgatgatgatgacatgagttggaaagtgagacgtgcagctgcgaagtgcttggatgctgtagttagcacaaggcatgaaatgcttccagaattctacaagaccgtctctcctgcactaatatccagatttaaagagcgtgaagagaatgtaaaggcagatgtttttcacgcatacctttctcttttgaagcaaactcgtcctgtacaaagttggctatgtgaccctgatgcaatggagcagggagaaacacctttaacaatgcttcagagtcaggttcccaacattgttaaagctcttcacaaacagatgaaagaaaaaagtgtgaagacccgacagtgttgttttaacatgttaactgagctggtaaatgtattacctggggccctaactcaacacattcctgtacttgtaccaggaatcattttctcactgaatgataaatcaagctcatcgaatttgaagatcgatgctttgtcatgtctatacgtaatcctctgtaaccattctcctcaagtcttccatcctcacgttcaggctttggttcctccagtggtggcttgtgttggagacccattttacaaaattacatctgaagcacttcttgttactcaacagcttgtcaaagtaattcgtcctttagatcagccttcctcgtttgatgcaactccttatatcaaagatctatttacctgtaccattaagagattaaaagcagctgacattgatcaggaagtcaaggaaagggctatttcctgtatgggacaaattatttgcaaccttggagacaatttgggttctgacttgcctaatacacttcagattttcttggagagactaaagaatgaaattaccaggttaactacagtaaaggcattgacactgattgctgggtcacctttgaagatagatttgaggcctgttctgggagaaggggttcctatccttgcttcatttcttagaaaaaaccagagagctttgaaactgggtactctttctgcccttgatattctaataaaaaactatagtgacagcttgacagctgccatgattgatgcagttctagatgagctcccacctcttatcagcgaaagtgatatgcatgtttcacaaatggccatcagttttcttaccactttggcaaaagtatatccctcctccctttcaaagataagtggatccattctcaatgaacttattggacttgtgagatcacccttattgcaggggggagctcttagtgccatgctagactttttccaagctctggttgtcactggaacaaataatttaggatacatggatttgttgcgcatgctgactggtccagtttactctcagagcacagctcttactcataagcagtcttattattccattgccaaatgtgtagctgcccttactcgagcatgccctaaagagggaccagctgtagtaggtcagtttattcaagatgtcaagaactcaaggtctacagattccattcgtctcttagctctactttctcttggagaagttgggcatcatattgacttaagtggacagttggaactaaaatctgtaatactagaagctttctcatctcctagtgaagaagtcaaatcagctgcatcctatgcattaggcagcattagtgtgggcaaccttcctgaatatctgccgtttgtcctgcaagaaataactagtcaacccaaaaggcagtatcttttacttcattccttgaaggaaattattagctctgcatcagtggtgggccttaaaccatatgttgaaaacatctgggccttattactaaagcactgtgagtgtgcagaggaaggaaccagaaatgttgttgctgaatgtctaggaaaactcactctaattgatccagaaactctccttccacggcttaaggggtacttgatatcaggctcatcatatgcccgaagctcagtggttacggctgtgaaatttacaatttctgaccatccacaacctattgatccactgttaaagaactgcataggtgatttcctaaaaactttggaagacccagatttgaatgtgagaagagtagccttggtcacatttaattcagcagcacataacaagccatcattaataagggatctattggatactgttcttccacatctttacaatgaaacaaaagttagaaaggagcttataagagaggtagaaatgggtccatttaaacatacggttgatgatggtctggatattagaaaggcagcatttgagtgtatgtacacacttctagacagttgtcttgatagacttgatatctttgaatttctaaatcatgttgaagatggtttgaaggaccattatgatattaagatgctgacatttttaatgttggtgagactgtctaccctttgtccaagtgcagtactgcagaggttggaccgacttgttgagccattacgtgcaacatgtacaactaaggtaaaggcaaactcagtaaagcaggagtttgaaaaacaagatgaattaaagcgatctgccatgagagcagtagcagcactgctaaccattccagaagcagagaagagtccactgatgagtgaattccagtcacagatcagttctaaccctgagctggcggctatctttgaaagtatccagaaagattcatcatctactaacttggaatcaatggacactagttagatgtttgttcaccatggggaccattacatatgaccatacaatgcactgaattgacaggttaatcataagacatggaaagagaagtgtctaaaagcttcaaaatgttccacttttttttccttcatggagactgtttgtttggctttcttccattgttgtttttgtagcatttatttcagaaatgtgtatttccataatccagaggttgtaaaaccactagtgttttagtggttacagcaacatttgaaatggaaactaaaagttaggattttatggagtatggagatagggtccagtatctatttaccctgtaatgtttaggattaaaatgttaaaattttgtgaccatgaa

SEQ ID NO: 343249 - DNA, 6702 bp, Homo sapiens
agcgaaggaggcgggctttggccttttgccctagggagcgagtgcggagcgagtgggagcgagacggccctgagtggaagtgtctggctccccgtagaggcccttctgtacgccccgccgcccatgagctcgttctcacgcgaacagcgccgtcgttaggctggctctgtagcctcggcttaccccgggacaggcccacgcctcgccagggagggggcagcccgtcgaggcgcctccctagtcagcgtcggcgtcgcgctgcgaccctggaagcgggagccgccgcgagcgagaggaggagctccagtggcggcggcggcggcggcagcggcagcgggcagcagctccagcagcgccagcaggcgggatcgaggccgtcaacatggcgagcgcctcgtaccacatttccaatttgctggaaaaaatgacatccagcgacaaggactttaggtttatggctacaaatgatttgatgacggaactgcagaaagattccatcaagttggatgatgatagtgaaaggaaagtagtgaaaatgattttgaagttattggaagataaaaatggagaggtacagaatttagctgtcaaatgtcttggtcctttagtgagtaaagtgaaagaataccaagtagagacaattgtagataccctctgcactaacatgctttctgataaagaacaacttcgagacatttcaagtattggtcttaaaacagtaattggagaacttcctccagcttccagtggctctgcattagctgctaatgtatgtaaaaagattactggacgtcttacaagtgcaatagcaaaacaggaagatgtctctgttcagctagaagccttggatattatggctgatatgttgagcaggcaaggaggacttcttgttaatttccatccttcaattctgacctgtctacttccccagttgaccagccctagacttgcagtgaggaaaagaaccattatcgctcttggccatctggttatgagctgtggaaatatagtttttgtagatcttattgaacatctgttgtcagagttgtccaaaaatgattctatgtcaacaacaagaacctacatacaatgtattgctgctattagtaggcaagctggtcatagaataggtgaataccttgagaagataattcctttggtggtaaaattttgcaatgtagatgatgatgaattaagagagtactgtattcaagcctttgaatcatttgtaagaagatgtcctaaggaagtatatcctcatgtttctaccattataaatatttgtcttaaatatcttacctatgatccaaattataattacgatgatgaagatgaagatgaaaatgcaatggatgctgatggtggtgatgatgatgatcaagggagtgatgatgaatacagtgatgatgatgacatgagttggaaagtgagacgtgcagctgcgaagtgcttggatgctgtagttagcacaaggcatgaaatgcttccagaattctacaagaccgtctctcctgcactaatatccagatttaaagagcgtgaagagaatgtaaaggcagatgtttttcacgcatacctttctcttttgaagcaaactcgtcctgtacaaagttggctatgtgaccctgatgcaatggagcagggagaaacacctttaacaatgcttcagagtcaggttcccaacattgttaaagctcttcacaaacagatgaaagaaaaaagtgtgaagacccgacagtgttgttttaacatgttaactgagctggtaaatgtattacctggggccctaactcaacacattcctgtacttgtaccaggaatcattttctcactgaatgataaatcaagctcatcgaatttgaagatcgatgctttgtcatgtctatacgtaatcctctgtaaccattctcctcaagtcttccatcctcacgttcaggctttggttcctccagtggtggcttgtgttggagacccattttacaaaattacatctgaagcacttcttgttactcaacagcttgtcaaagtaattcgtcctttagatcagccttcctcgtttgatgcaactccttatatcaaagatctatttacctgtaccattaagagattaaaagcagctgacattgatcaggaagtcaaggaaagggctatttcctgtatgggacaaattatttgcaaccttggagacaatttgggttctgacttgcctaatacacttcagattttcttggagagactaaagaatgaaattaccaggttaactacagtaaaggcattgacactgattgctgggtcacctttgaagatagatttgaggcctgttctgggagaaggggttcctatccttgcttcatttcttagaaaaaaccagagagctttgaaactgggtactctttctgcccttgatattctaataaaaaactatagtgacagcttgacagctgccatgattgatgcagttctagatgagctcccacctcttatcagcgaaagtgatatgcatgtttcacaaatggccatcagttttcttaccactttggcaaaagtatatccctcctccctttcaaagataagtggatccattctcaatgaacttattggacttgtgagatcacccttattgcaggggggagctcttagtgccatgctagactttttccaagctctggttgtcactggaacaaataatttaggatacatggatttgttgcgcatgctgactggtccagtttactctcagagcacagctcttactcataagcagtcttattattccattgccaaatgtgtagctgcccttactcgagcatgccctaaagagggaccagctgtagtaggtcagtttattcaagatgtcaagaactcaaggtctacagattccattcgtctcttagctctactttctcttggagaagttgggcatcatattgacttaagtggacagttggaactaaaatctgtaatactagaagctttctcatctcctagtgaagaagtcaaatcagctgcatcctatgcattaggcagcattagtgtgggcaaccttcctgaatatctgccgtttgtcctgcaagaaataactagtcaacccaaaaggcagtatcttttacttcattccttgaaggaaattattagctctgcatcagtggtgggccttaaaccatatgttgaaaacatctgggccttattactaaagcactgtgagtgtgcagaggaaggaaccagaaatgttgttgctgaatgtctaggaaaactcactctaattgatccagaaactctccttccacggcttaaggggtacttgatatcaggctcatcatatgcccgaagctcagtggttacggctgtgaaatttacaatttctgaccatccacaacctattgatccactgttaaagaactgcataggtgatttcctaaaaactttggaagacccagatttgaatgtgagaagagtagccttggtcacatttaattcagcagcacataacaagccatcattaataagggatctattggatactgttcttccacatctttacaatgaaacaaaagttagaaaggagcttataagagaggtagaaatgggtccatttaaacatacggttgatgatggtctggatattagaaaggcagcatttgagtgtatgtacacacttctagacagttgtcttgatagacttgatatctttgaatttctaaatcatgttgaagatggtttgaaggaccattatgatattaagatgctgacatttttaatgttggtgagactgtctaccctttgtccaagtgcagtactgcagaggttggaccgacttgttgagccattacgtgcaacatgtacaactaaggtaaaggcaaactcagtaaagcaggagtttgaaaaacaagatgaattaaagcgatctgccatgagagcagtagcagcactgctaaccattccagaagcagagaagagtccactgatgagtgaattccagtcacagatcagttctaaccctgagctggcggctatctttgaaagtatccagaaagattcatcatctactaacttggaatcaatggacactagttagatgtttgttcaccatggggaccattacatatgaccatacaatgcactgaattgacaggttaatcataagacatggaaagagaagtgtctaaaagcttcaaaatgttccacttttttttccttcatggagactgtttgtttggctttcttccattgttgtttttgtagcatttatttcagaaatgtgtatttccataatccagaggttgtaaaaccactagtgttttagtggttacagcaacatttgaaatggaaactaaaagttaggattttatggagtatggagatagggtccagtatctatttaccctgtaatgtttaggattaaaatgttaaaattttgtgaccatgaatttctttcttttataaattttctcatttaaaaatcaaaaatcttgcaaaacaaaaaccatgtttctttttcttgtataactttttgttttcagcaacataaattgatttttagctggcagacaagaatatccatataagatttgttaaccatttcagagagtttggcaatttttaaaagataataaggtatcatttttaagtatgaaaattaacaatatccctgttgcgcacactaattttgcatgagtaagtttacaaatatgtatcgtctgtaaagcagcatgtgcagattattcataatatagaagttaaaataagtattagtgcaattttcagatatttatttttgcacagaaaacacattatctggagagaaagaaaggagaatttttgagacttgggttttcttaatgccagtgtgaatttgcagatgttttcagaaaatcaagtcacagtaacaatttgccacttttttctattataaatcttcttacttaaattttgaatatttagtttttctcagttacccatttgtgtgtgtgtgattccacttagaaattcttaaaaccagatttttctttcattccgtttggatgtctacattccttatcaaaggatataaatactgtgtatgcttttgaattttatttttaggaaaattctgaagccagctatcacaggtttgttagctaataatagtattttcttttagttgagttaggtttttccccatctcctgtagagcgaatttacatattgtattgggtaagtgttcactacttttcctgattaagggatctgtgctggggaacaaagcttttgcagtaccttatattgtagttaaaattttatttaacatatccttcagtgagctcatttcacactgtagcctcttccttaaaatttgtggtgctcctgtaacagtaagaactaattctgaaataaaagacatctcctaatgctgtgcaaacatagtttacatgtattgaaggaggcagttgttaaattgagtgaccaatttaagcaatcagatatttgaaaactgcaccctttagttttgaaactgtgaattagaaacacttttcctgctgtattactacctgctttaacatccaaatatacagtgattttaaatgataacatactgtggttattagattaacagcttgattttgaatgttcagatgataatgcagaagacatcacttctagtaaggattttgactagtgcattgatgttgaagttggtgccatttcaaaatgtggcaggtgataatcttttaccataatttgcataaaactgtaatagaagtttattttgagatgttagtatattatgtactatgcatttctgtggtatagatgttgtggatatatttaagtatttggttacatggttttacaataaattacaatactgcaggctctaggactgaacaggagactgacatgcatatgttgtgtgaatgtcttagttgggtaaagttaaatccaaatacttcaactggctttttcttcagtttgtttgtttttaactttcaagatgcatgttttgttttgttttgctttgtttttgtctcttaagccaattcatttttctaacagttgaaattcttttagtactaaagaaatagatactgctcttttatggctttagtgtttatatacctgtttatatgcatacattaacaaaattagtaacagcagtgcttagaatttcaatgctgtgtcatactgatgattaactccatactcctagtggtgatgtggtccagatactggaatggaagtggcaggatgtggagtccagacatagtctaccactcatgctacttactagtaatattaaggtgttaaacttaggaatttgtcacatgtaggttcctgaggagatctaaaagttaatacaaaaccaagctgtttactgattttcatgagaacatttaagttagtttaggtctacctgatttattttaaaagaaggcagagggctggacgcagtggcttacgcctgtaatcccagcactttgggaggccgaggcgggcggatcacgaggtcaggagatcgagactatcctggctaacactgtgaaaacccatctctactgaaaatacaaaaaattagctgggcgtggtggcagacgcctgtagtcctagctgctacagctgaggcaggagaatggcgtgaacccaggaggcggagctggcagtgagccgagatcacgccactgcactctggcctgggcaacagagcgagagtctgtctcaaaaaaa

SEQ ID NO: 343250 - DNA, 5453 bp, Homo sapiens
  misc_feature (5428)..(5430): n is a, c, g, or t
agcgaaggaggcgggctttggccttttgccctagggagcgagtgcggagcgagtgggagcgagacggccctgagtggaagtgtctggctccccgtagaggcccttctgtacgccccgccgcccatgagctcgttctcacgcgaacagcgccgtcgttaggctggctctgtagcctcggcttaccccgggacaggcccacgcctcgccagggagggggcagcccgtcgaggcgcctccctagtcagcgtcggcgtcgcgctgcgaccctggaagcgggagccgccgcgagcgagaggaggagctccagtggcggcggcggcggcggcagcggcagcgggcagcagctccagcagcgccagcaggcgggatcgaggccgtcaacatggcgagcgcctcgtaccacatttccaatttgctggaaaaaatgacatccagcgacaaggactttaggtttatggctacaaatgatttgatgacggaactgcagaaagattccatcaagttggatgatgatagtgaaaggaaagtagtgaaaatgattttgaagttattggaagataaaaatggagaggtacagaatttagctgtcaaatgtcttggtcctttagtgagtaaagtgaaagaataccaagtagagacaattgtagataccctctgcactaacatgctttctgataaagaacaacttcgagacatttcaagtattggtcttaaaacagtaattggagaacttcctccagcttccagtggctctgcattagctgctaatgtatgtaaaaagattactggacgtcttacaagtgcaatagcaaaacaggaagatgtctctgttcagctagaagccttggatattatggctgatatgttgagcaggcaaggaggacttcttgttaatttccatccttcaattctgacctgtctacttccccagttgaccagccctagacttgcagtgaggaaaagaaccattatcgctcttggccatctggttatgagctgtggaaatatagtttttgtagatcttattgaacatctgttgtcagagttgtccaaaaatgattctatgtcaacaacaagaacctacatacaatgtattgctgctattagtaggcaagctggtcatagaataggtgaataccttgagaagataattcctttggtggtaaaattttgcaatgtagatgatgatgaattaagagagtactgtattcaagcctttgaatcatttgtaagaagatgtcctaaggaagtatatcctcatgtttctaccattataaatatttgtcttaaatatcttacctatgatccaaattataattacgatgatgaagatgaagatgaaaatgcaatggatgctgatggtggtgatgatgatgatcaagggagtgatgatgaatacagtgatgatgatgacatgagttggaaagtgagacgtgcagctgcgaagtgcttggatgctgtagttagcacaaggcatgaaatgcttccagaattctacaagaccgtctctcctgcactaatatccagatttaaagagcgtgaagagaatgtaaaggcagatgtttttcacgcatacctttctcttttgaagcaaactcgtcctgtacaaagttggctatgtgaccctgatgcaatggagcagggagaaacacctttaacaatgcttcagagtcaggttcccaacattgttaaagctcttcacaaacagatgaaagaaaaaagtgtgaagacccgacagtgttgttttaacatgttaactgagctggtaaatgtattacctggggccctaactcaacacattcctgtacttgtaccaggaatcattttctcactgaatgataaatcaagctcatcgaatttgaagatcgatgctttgtcatgtctatacgtaatcctctgtaaccattctcctcaagtcttccatcctcacgttcaggctttggttcctccagtggtggcttgtgttggagacccattttacaaaattacatctgaagcacttcttgttactcaacagcttgtcaaagtaattcgtcctttagatcagccttcctcgtttgatgcaactccttatatcaaagatctatttacctgtaccattaagagattaaaagcagctgacattgatcaggaagtcaaggaaagggctatttcctgtatgggacaaattatttgcaaccttggagacaatttgggttctgacttgcctaatacacttcagattttcttggagagactaaagaatgaaattaccaggttaactacagtaaaggcattgacactgattgctgggtcacctttgaagatagatttgaggcctgttctgggagaaggggttcctatccttgcttcatttcttagaaaaaaccagagagctttgaaactgggtactctttctgcccttgatattctaataaaaaactatagtgacagcttgacagctgccatgattgatgcagttctagatgagctcccacctcttatcagcgaaagtgatatgcatgtttcacaaatggccatcagttttcttaccactttggcaaaagtatatccctcctccctttcaaagataagtggatccattctcaatgaacttattggacttgtgagatcacccttattgcaggggggagctcttagtgccatgctagactttttccaagctctggttgtcactggaacaaataatttaggatacatggatttgttgcgcatgctgactggtccagtttactctcagagcacagctcttactcataagcagtcttattattccattgccaaatgtgtagctgcccttactcgagcatgccctaaagagggaccagctgtagtaggtcagtttattcaagatgtcaagaactcaaggtctacagattccattcgtctcttagctctactttctcttggagaagttgggcatcatattgacttaagtggacagttggaactaaaatctgtaatactagaagctttctcatctcctagtgaagaagtcaaatcagctgcatcctatgcattaggcagcattagtgtgggcaaccttcctgaatatctgccgtttgtcctgcaagaaataactagtcaacccaaaaggcagtatcttttacttcattccttgaaggaaattattagctctgcatcagtggtgggccttaaaccatatgttgaaaacatctgggccttattactaaagcactgtgagtgtgcagaggaaggaaccagaaatgttgttgctgaatgtctaggaaaactcactctaattgatccagaaactctccttccacggcttaaggggtacttgatatcaggctcatcatatgcccgaagctcagtggttacggctgtgaaatttacaatttctgaccatccacaacctattgatccactgttaaagaactgcataggtgatttcctaaaaactttggaagacccagatttgaatgtgagaagagtagccttggtcacatttaattcagcagcacataacaagccatcattaataagggatctattggatactgttcttccacatctttacaatgaaacaaaagttagaaaggagcttataagagaggtagaaatgggtccatttaaacatacggttgatgatggtctggatattagaaaggcagcatttgagtgtatgtacacacttctagacagttgtcttgatagacttgatatctttgaatttctaaatcatgttgaagatggtttgaaggaccattatgatattaagatgctgacatttttaatgttggtgagactgtctaccctttgtccaagtgcagtactgcagaggttggaccgacttgttgagccattacgtgcaacatgtacaactaaggtaaaggcaaactcagtaaagcaggagtttgaaaaacaagatgaattaaagcgatctgccatgagagcagtagcagcactgctaaccattccagaagcagagaagagtccactgatgagtgaattccagtcacagatcagttctaaccctgagctggcggctatctttgaaagtatccagaaagattcatcatctactaacttggaatcaatggacactagttagatgtttgttcaccatggggaccattacatatgaccatacaatgcactgaattgacaggttaatcataagacatggaaagagaagtgtctaaaagcttcaaaatgttccacttttttttccttcatggagactgtttgtttggctttcttccattgttgtttttgtagcatttatttcagaaatgtgtatttccataatccagaggttgtaaaaccactagtgttttagtggttacagcaacatttgaaatggaaactaaaagttaggattttatggagtatggagatagggtccagtatctatttaccctgtaatgtttaggattaaaatgttaaaattttgtgaccatgaatttctttcttttataaattttctcatttaaaaatcaaaaatcttgcaaaacaaaaaccatgtttctttttcttgtataactttttgttttcagcaacataaattgatttttagctggcagacaagaatatccatataagatttgttaaccatttcagagagtttggcaatttttaaaagataataaggtatcatttttaagtatgaaaattaacaatatccctgttgcgcacactaattttgcatgagtaagtttacaaatatgtatcgtctgtaaagcagcatgtgcagattattcataatatagaagttaaaataagtattagtgcaattttcagatatttatttttgcacagaaaacacattatctggagagaaagaaaggagaatttttgagacttgggttttcttaatgccagtgtgaatttgcagatgttttcagaaaatcaagtcacagtaacaatttgccacttttttctattataaatcttcttacttaaattttgaatatttagtttttctcagttacccatttgtgtgtgtgtgattccacttagaaattcttaaaaccagatttttctttcattccgtttggatgtctacattccttatcaaaggatataaatactgtgtatgcttttgaattttatttttaggaaaattctgaagccagctatcacaggtttgttagctaataatagtattttcttttagttgagttaggtttttccccatctcctgtagagcgaatttacatattgtattgggtaagtgttcactacttttcctgattaagggatctgtgctggggaacaaagcttttgcagtaccttatattgtagttaaaattttatttaacatatccttcagtgagctcatttcacactgtagcctcttccttaaaatttgtggtgctcctgtaacagtaagaactaattctgaaataaaagacatctcctaatgctgtgcaaaaaaaaaaaaaaaaaaaaaaaaaaaaaaaannnaaaaaaaaaaaaaaaaaaaaaaa

SEQ ID NO: 343251 - DNA, 6603 bp, Homo sapiens
agcgaaggaggcgggctttggccttttgccctagggagcgagtgcggagcgagtgggagcgagacggccctgagtggaagtgtctggctccccgtagaggcccttctgtacgccccgccgcccatgagctcgttctcacgcgaacagcgccgtcgttaggctggctctgtagcctcggcttaccccgggacaggcccacgcctcgccagggagggggcagcccgtcgaggcgcctccctagtcagcgtcggcgtcgcgctgcgaccctggaagcgggagccgccgcgagcgagaggaggagctccagtggcggcggcggcggcggcagcggcagcgggcagcagctccagcagcgccagcaggcgggatcgaggccgtcaacatggcgagcgcctcgtaccacatttccaatttgctggaaaaaatgacatccagcgacaaggactttaggtttatggctacaaatgatttgatgacggaactgcagaaagattccatcaagttggatgatgatagtgaaaggaaagtagtgaaaatgattttgaagttattggaagataaaaatggagaggtacagaatttagctgtcaaatgtcttggtcctttagtgagtaaagtgaaagaataccaagtagagacaattgtagataccctctgcactaacatgctttctgataaagaacaacttcgagacatttcaagtattggtcttaaaacagtaattggagaacttcctccagcttccagtggctctgcattagctgctaatgtatgtaaaaagattactggacgtcttacaagtgcaatagcaaaacaggaagatgtctctgttcagctagaagccttggatattatggctgatatgttgagcaggcaaggaggacttcttgttaatttccatccttcaattctgacctgtctacttccccagttgaccagccctagacttgcagtgaggaaaagaaccattatcgctcttggccatctggttatgagctgtggaaatatagtttttgtagatcttattgaacatctgttgtcagagttgtccaaaaatgattctatgtcaacaacaagaacctacatacaatgtattgctgctattagtaggcaagctggtcatagaataggtgaataccttgagaagataattcctttggtggtaaaattttgcaatgtagatgatgatgaattaagagagtactgtattcaagcctttgaatcatttgtaagaagatgtcctaaggaagtatatcctcatgtttctaccattataaatatttgtcttaaatatcttacctatgatccaaattataattacgatgatgaagatgaagatgaaaatgcaatggatgctgatggtggtgatgatgatgatcaagggagtgatgatgaatacagtgatgatgatgacatgagttggaaagtgagacgtgcagctgcgaagtgcttggatgctgtagttagcacaaggcatgaaatgcttccagaattctacaagaccgtctctcctgcactaatatccagatttaaagagcgtgaagagaatgtaaaggcagatgtttttcacgcatacctttctcttttgaagcaaactcgtcctgtacaaagttggctatgtgaccctgatgcaatggagcagggagaaacacctttaacaatgcttcagagtcaggttcccaacattgttaaagctcttcacaaacagatgaaagaaaaaagtgtgaagacccgacagtgttgttttaacatgttaactgagctggtaaatgtattacctggggccctaactcaacacattcctgtacttgtaccaggaatcattttctcactgaatgataaatcaagctcatcgaatttgaagatcgatgctttgtcatgtctatacgtaatcctctgtaaccattctcctcaagtcttccatcctcacgttcaggctttggttcctccagtggtggcttgtgttggagacccattttacaaaattacatctgaagcacttcttgttactcaacagcttgtcaaagtaattcgtcctttagatcagccttcctcgtttgatgcaactccttatatcaaagatctatttacctgtaccattaagagattaaaagcagctgacattgatcaggaagtcaaggaaagggctatttcctgtatgggacaaattatttgcaaccttggagacaatttgggttctgacttgcctaatacacttcagattttcttggagagactaaagaatgaaattaccaggttaactacagtaaaggcattgacactgattgctgggtcacctttgaagatagatttgaggcctgttctgggagaaggggttcctatccttgcttcatttcttagaaaaaaccagagagctttgaaactgggtactctttctgcccttgatattctaataaaaaactatagtgacagcttgacagctgccatgattgatgcagttctagatgagctcccacctcttatcagcgaaagtgatatgcatgtttcacaaatggccatcagttttcttaccactttggcaaaagtatatccctcctccctttcaaagataagtggatccattctcaatgaacttattggacttgtgagatcacccttattgcaggggggagctcttagtgccatgctagactttttccaagctctggttgtcactggaacaaataatttaggatacatggatttgttgcgcatgctgactggtccagtttactctcagagcacagctcttactcataagcagtcttattattccattgccaaatgtgtagctgcccttactcgagcatgccctaaagagggaccagctgtagtaggtcagtttattcaagatgtcaagaactcaaggtctacagattccattcgtctcttagctctactttctcttggagaagttgggcatcatattgacttaagtggacagttggaactaaaatctgtaatactagaagctttctcatctcctagtgaagaagtcaaatcagctgcatcctatgcattaggcagcattagtgtgggcaaccttcctgaatatctgccgtttgtcctgcaagaaataactagtcaacccaaaaggcagtatcttttacttcattccttgaaggaaattattagctctgcatcagtggtgggccttaaaccatatgttgaaaacatctgggccttattactaaagcactgtgagtgtgcagaggaaggaaccagaaatgttgttgctgaatgtctaggaaaactcactctaattgatccagaaactctccttccacggcttaaggggtacttgatatcaggctcatcatatgcccgaagctcagtggttacggctgtgaaatttacaatttctgaccatccacaacctattgatccactgttaaagaactgcataggtgatttcctaaaaactttggaagacccagatttgaatgtgagaagagtagccttggtcacatttaattcagcagcacataacaagccatcattaataagggatctattggatactgttcttccacatctttacaatgaaacaaaagttagaaaggagcttataagagaggtagaaatgggtccatttaaacatacggttgatgatggtctggatattagaaaggcagcatttgagatgctgacatttttaatgttggtgagactgtctaccctttgtccaagtgcagtactgcagaggttggaccgacttgttgagccattacgtgcaacatgtacaactaaggtaaaggcaaactcagtaaagcaggagtttgaaaaacaagatgaattaaagcgatctgccatgagagcagtagcagcactgctaaccattccagaagcagagaagagtccactgatgagtgaattccagtcacagatcagttctaaccctgagctggcggctatctttgaaagtatccagaaagattcatcatctactaacttggaatcaatggacactagttagatgtttgttcaccatggggaccattacatatgaccatacaatgcactgaattgacaggttaatcataagacatggaaagagaagtgtctaaaagcttcaaaatgttccacttttttttccttcatggagactgtttgtttggctttcttccattgttgtttttgtagcatttatttcagaaatgtgtatttccataatccagaggttgtaaaaccactagtgttttagtggttacagcaacatttgaaatggaaactaaaagttaggattttatggagtatggagatagggtccagtatctatttaccctgtaatgtttaggattaaaatgttaaaattttgtgaccatgaatttctttcttttataaattttctcatttaaaaatcaaaaatcttgcaaaacaaaaaccatgtttctttttcttgtataactttttgttttcagcaacataaattgatttttagctggcagacaagaatatccatataagatttgttaaccatttcagagagtttggcaatttttaaaagataataaggtatcatttttaagtatgaaaattaacaatatccctgttgcgcacactaattttgcatgagtaagtttacaaatatgtatcgtctgtaaagcagcatgtgcagattattcataatatagaagttaaaataagtattagtgcaattttcagatatttatttttgcacagaaaacacattatctggagagaaagaaaggagaatttttgagacttgggttttcttaatgccagtgtgaatttgcagatgttttcagaaaatcaagtcacagtaacaatttgccacttttttctattataaatcttcttacttaaattttgaatatttagtttttctcagttacccatttgtgtgtgtgtgattccacttagaaattcttaaaaccagatttttctttcattccgtttggatgtctacattccttatcaaaggatataaatactgtgtatgcttttgaattttatttttaggaaaattctgaagccagctatcacaggtttgttagctaataatagtattttcttttagttgagttaggtttttccccatctcctgtagagcgaatttacatattgtattgggtaagtgttcactacttttcctgattaagggatctgtgctggggaacaaagcttttgcagtaccttatattgtagttaaaattttatttaacatatccttcagtgagctcatttcacactgtagcctcttccttaaaatttgtggtgctcctgtaacagtaagaactaattctgaaataaaagacatctcctaatgctgtgcaaacatagtttacatgtattgaaggaggcagttgttaaattgagtgaccaatttaagcaatcagatatttgaaaactgcaccctttagttttgaaactgtgaattagaaacacttttcctgctgtattactacctgctttaacatccaaatatacagtgattttaaatgataacatactgtggttattagattaacagcttgattttgaatgttcagatgataatgcagaagacatcacttctagtaaggattttgactagtgcattgatgttgaagttggtgccatttcaaaatgtggcaggtgataatcttttaccataatttgcataaaactgtaatagaagtttattttgagatgttagtatattatgtactatgcatttctgtggtatagatgttgtggatatatttaagtatttggttacatggttttacaataaattacaatactgcaggctctaggactgaacaggagactgacatgcatatgttgtgtgaatgtcttagttgggtaaagttaaatccaaatacttcaactggctttttcttcagtttgtttgtttttaactttcaagatgcatgttttgttttgttttgctttgtttttgtctcttaagccaattcatttttctaacagttgaaattcttttagtactaaagaaatagatactgctcttttatggctttagtgtttatatacctgtttatatgcatacattaacaaaattagtaacagcagtgcttagaatttcaatgctgtgtcatactgatgattaactccatactcctagtggtgatgtggtccagatactggaatggaagtggcaggatgtggagtccagacatagtctaccactcatgctacttactagtaatattaaggtgttaaacttaggaatttgtcacatgtaggttcctgaggagatctaaaagttaatacaaaaccaagctgtttactgattttcatgagaacatttaagttagtttaggtctacctgatttattttaaaagaaggcagagggctggacgcagtggcttacgcctgtaatcccagcactttgggaggccgaggcgggcggatcacgaggtcaggagatcgagactatcctggctaacactgtgaaaacccatctctactgaaaatacaaaaaattagctgggcgtggtggcagacgcctgtagtcctagctgctacagctgaggcaggagaatggcgtgaacccaggaggcggagctggcagtgagccgagatcacgccactgcactctggcctgggcaacagagcgagagtctgtctcaaaaaaa

SEQ ID NO: 343252 - DNA, 6802 bp, Homo sapiens
agcgaaggaggcgggctttggccttttgccctagggagcgagtgcggagcgagtgggagcgagacggccctgagtggaagtgtctggctccccgtagaggcccttctgtacgccccgccgcccatgagctcgttctcacgcgaacagcgccgtcgttaggctggctctgtagcctcggcttaccccgggacaggcccacgcctcgccagggagggggcagcccgtcgaggcgcctccctagtcagcgtcggcgtcgcgctgcgaccctggaagcgggagccgccgcgagcgagaggaggagctccagtggcggcggcggcggcggcagcggcagcgggcagcagctccagcagcgccagcaggcgggatcgaggccgtcaacatggcgagcgcctcgtaccacatttccaatttgctggaaaaaatgacatccagcgacaaggactttaggtttatggctacaaatgatttgatgacggaactgcagaaagattccatcaagttggatgatgatagtgaaaggaaagtagtgaaaatgattttgaagttattggaagataaaaatggagaggtacagaatttagctgtcaaatgtcttggtcctttagtgagtaaagtgaaagaataccaagtagagacaattgtagataccctctgcactaacatgctttctgataaagaacaacttcgagacatttcaagtattggtcttaaaacagtaattggagaacttcctccagcttccagtggctctgcattagctgctaatgtatgtaaaaagattactggacgtcttacaagtgcaatagcaaaacaggaagatgtctctgttcagctagaagccttggatattatggctgatatgttgagcaggcaaggaggacttcttgttaatttccatccttcaattctgacctgtctacttccccagttgaccagccctagacttgcagtgaggaaaagaaccattatcgctcttggccatctggttatgagctgtggaaatatagtttttgtagatcttattgaacatctgttgtcagagttgtccaaaaatgattctatgtcaacaacaagaacctacatacaatgtattgctgctattagtaggcaagctggtcatagaataggtgaataccttgagaagataattcctttggtggtaaaattttgcaatgtagatgatgatgaattaagagagtactgtattcaagcctttgaatcatttgtaagaagatgtcctaaggaagtatatcctcatgtttctaccattataaatatttgtcttaaatatcttacctatgatccaaattataattacgatgatgaagatgaagatgaaaatgcaatggatgctgatggtggtgatgatgatgatcaagggagtgatgatgaatacagtgatgatgatgacatgagttggaaagtgagacgtgcagctgcgaagtgcttggatgctgtagttagcacaaggcatgaaatgcttccagaattctacaagaccgtctctcctgcactaatatccagatttaaagagcgtgaagagaatgtaaaggcagatgtttttcacgcatacctttctcttttgaagcaaactcgtcctgtacaaagttggctatgtgaccctgatgcaatggagcagggagaaacacctttaacaatgcttcagagtcaggttcccaacattgttaaagctcttcacaaacagatgaaagaaaaaagtgtgaagacccgacagtgttgttttaacatgttaactgagctggtaaatgtattacctggggccctaactcaacacattcctgtacttgtaccaggaatcattttctcactgaatgataaatcaagctcatcgaatttgaagatcgatgctttgtcatgtctatacgtaatcctctgtaaccattctcctcaagtcttccatcctcacgttcaggctttggttcctccagtggtggcttgtgttggagacccattttacaaaattacatctgaagcacttcttgttactcaacagcttgtcaaagctcatcatatgcccgaagctcagtggttacggctgtgaaatttacaatttctgaccatccacaacctattgatccactgttaaagaactgcataggtgatttcctaaaaactttggaagacccagatttgaatgtgagaagagtagccttggtcacatttaattcagcagcacataacaagccatcattaataagggatctattggatactgttcttccacatctttacaatgaaacaaaagttagaaaggagcttataagagaggtagaaatgggtccatttaaacatacggttgatgatggtctggatattagaaaggcagcatttgagtgtatgtacacacttctagacagttgtcttgatagacttgatatctttgaatttctaaatcatgttgaagatggtttgaaggaccattatgatattaaggtaagatgtttgtgcctatttatacaatgttttagaagaagactttgctagagcaactttcacccttgtaatttactcatgtgtctgagaaaaatcaggttgtctgtgaagattttgataagcatattgtaaactataaagtgcaaaagtaataggcagtgtaacaccagttgacgtgtaagaaagatccagagccctttttattggaggaggaagtggcagtggatgcaaaatgctgtgtgcccacttgcttagtgaatagtccctagatcctttccctcaaaaaagtcccgacagattttgctgtttaaagtataaatctgtaactttttggcctgtcttaacattggaccatagttgctacccatggagggttttcttagcattgtcttgattaagtctcctgagctacctttggggctagtctgaattgtaactgtatcatttacctgaatgaggaatttttgtttttcaatataatatactgtgtttaatatcaagaattttgttataggacatggaacttttcagatatacaaaacaatctgtagaagctacttgagagaaatcatactgcgtcttatgtttggataatgaattttgcatataagtgttctttgttttcctgtgtgttcgtctccatttaaaatgtgaacagtaaaagggtgatttgaaaaatgaaaaatatatgcattgtgtctttttcatctactcttccatttagggcttttggccaagcaggacaaaagtggtaactcagcagtaattgagccatactacccgaactcctactcttaggtttccatgtgtggtagtgacctgagcctctcaaagttcaatgaagagggcctccccaccaagaagtaaaaggatgtgcttgtttaattctatgagtttatagtccaagagaaaaaggtttatggggtttatgggttatcaggttttacatggattaatctgaataactggtcaactctgttatgatagtggaaacttattatgaaattgtgttccagttcagtaattttctagttctatgattctcaattctggtgcacatgagctttaaaaaataaaaataaaaaaaataatgtgtgccatattctgacaggttcagtaaaactctctggggatggggcttgaagaatgggtatgtttctaaagctctctggatgattctaatgtgcaaccaagattgaaaaccactttctagtccttatatgctgttgagacaaatctgtctgattctgattgggcagattacattaaaaggaaggtttactttgcatgctagttattttcctttaaaggatttgtcagaatttagtattttgtttttagaaaatgatgtcaaatctaaattctgtcttttttattcctaatagatgctgacatttttaatgttggtgagactgtctaccctttgtccaagtgcagtactgcagaggttggaccgacttgttgagccattacgtgcaacatgtacaactaaggtaaaggcaaactcagtaaagcaggagtttgaaaaacaagatgaattaaagcgatctgccatgagagcagtagcagcactgctaaccattccagaagcagagaagagtccactgatgagtgaattccagtcacagatcagttctaaccctgagctggcggctatctttgaaagtatccagaaagattcatcatctactaacttggaatcaatggacactagttagatgtttgttcaccatggggaccattacatatgaccatacaatgcactgaattgacaggttaatcataagacatggaaagagaagtgtctaaaagcttcaaaatgttccacttttttttccttcatggagactgtttgtttggctttcttccattgttgtttttgtagcatttatttcagaaatgtgtatttccataatccagaggttgtaaaaccactagtgttttagtggttacagcaacatttgaaatggaaactaaaagttaggattttatggagtatggagatagggtccagtatctatttaccctgtaatgtttaggattaaaatgttaaaattttgtgaccatgaatttctttcttttataaattttctcatttaaaaatcaaaaatcttgcaaaacaaaaaccatgtttctttttcttgtataactttttgttttcagcaacataaattgatttttagctggcagacaagaatatccatataagatttgttaaccatttcagagagtttggcaatttttaaaagataataaggtatcatttttaagtatgaaaattaacaatatccctgttgcgcacactaattttgcatgagtaagtttacaaatatgtatcgtctgtaaagcagcatgtgcagattattcataatatagaagttaaaataagtattagtgcaattttcagatatttatttttgcacagaaaacacattatctggagagaaagaaaggagaatttttgagacttgggttttcttaatgccagtgtgaatttgcagatgttttcagaaaatcaagtcacagtaacaatttgccacttttttctattataaatcttcttacttaaattttgaatatttagtttttctcagttacccatttgtgtgtgtgtgattccacttagaaattcttaaaaccagatttttctttcattccgtttggatgtctacattccttatcaaaggatataaatactgtgtatgcttttgaattttatttttaggaaaattctgaagccagctatcacaggtttgttagctaataatagtattttcttttagttgagttaggtttttccccatctcctgtagagcgaatttacatattgtattgggtaagtgttcactacttttcctgattaagggatctgtgctggggaacaaagcttttgcagtaccttatattgtagttaaaattttatttaacatatccttcagtgagctcatttcacactgtagcctcttccttaaaatttgtggtgctcctgtaacagtaagaactaattctgaaataaaagacatctcctaatgctgtgcaaacatagtttacatgtattgaaggaggcagttgttaaattgagtgaccaatttaagcaatcagatatttgaaaactgcaccctttagttttgaaactgtgaattagaaacacttttcctgctgtattactacctgctttaacatccaaatatacagtgattttaaatgataacatactgtggttattagattaacagcttgattttgaatgttcagatgataatgcagaagacatcacttctagtaaggattttgactagtgcattgatgttgaagttggtgccatttcaaaatgtggcaggtgataatcttttaccataatttgcataaaactgtaatagaagtttattttgagatgttagtatattatgtactatgcatttctgtggtatagatgttgtggatatatttaagtatttggttacatggttttacaataaattacaatactgcaggctctaggactgaacaggagactgacatgcatatgttgtgtgaatgtcttagttgggtaaagttaaatccaaatacttcaactggctttttcttcagtttgtttgtttttaactttcaagatgcatgttttgttttgttttgctttgtttttgtctcttaagccaattcatttttctaacagttgaaattcttttagtactaaagaaatagatactgctcttttatggctttagtgtttatatacctgtttatatgcatacattaacaaaattagtaacagcagtgcttagaatttcaatgctgtgtcatactgatgattaactccatactcctagtggtgatgtggtccagatactggaatggaagtggcaggatgtggagtccagacatagtctaccactcatgctacttactagtaatattaaggtgttaaacttaggaatttgtcacatgtaggttcctgaggagatctaaaagttaatacaaaaccaagctgtttactgattttcatgagaacatttaagttagtttaggtctacctgatttattttaaaagaaggcagagggctggacgcagtggcttacgcctgtaatcccagcactttgggaggccgaggcgggcggatcacgaggtcaggagatcgagactatcctggctaacactgtgaaaacccatctctactgaaaatacaaaaaattagctgggcgtggtggcagacgcctgtagtcctagctgctacagctgaggcaggagaatggcgtgaacccaggaggcggagctggcagtgagccgagatcacgccactgcactctggcctgggcaacagagcgagagtctgtctcaaaaaaa

SEQ ID NO: 343253 - DNA, 4426 bp, Homo sapiens
agcgaaggaggcgggctttggccttttgccctagggagcgagtgcggagcgagtgggagcgagacggccctgagtggaagtgtctggctccccgtagaggcccttctgtacgccccgccgcccatgagctcgttctcacgcgaacagcgccgtcgttaggctggctctgtagcctcggcttaccccgggacaggcccacgcctcgccagggagggggcagcccgtcgaggcgcctccctagtcagcgtcggcgtcgcgctgcgaccctggaagcgggagccgccgcgagcgagaggaggagctccagtggcggcggcggcggcggcagcggcagcgggcagcagctccagcagcgccagcaggcgggatcgaggccgtcaacatggcgagcgcctcgtaccacatttccaatttgctggaaaaaatgacatccagcgacaaggactttaggtttatggctacaaatgatttgatgacggaactgcagaaagattccatcaagttggatgatgatagtgaaaggaaagtagtgaaaatgattttgaagttattggaagataaaaatggagaggtacagaatttagctgtcaaatgtcttggtcctttagtgagtaaagtgaaagaataccaagtagagacaattgtagataccctctgcactaacatgctttctgataaagaacaacttcgagacatttcaagtattggtcttaaaacagtaattggagaacttcctccagcttccagtggctctgcattagctgctaatgtatgtaaaaagattactggacgtcttacaagtgcaatagcaaaacaggaagatgtctctgttcagctagaagccttggatattatggctgatatgttgagcaggcaaggaggacttcttgttaatttccatccttcaattctgacctgtctacttccccagttgaccagccctagacttgcagtgaggaaaagaaccattatcgctcttggccatctggttatgagctgtggaaatatagtttttgtagatcttattgaacatctgttgtcagagttgtccaaaaatgattctatgtcaacaacaagaacctacatacaatgtattgctgctattagtaggcaagctggtcatagaataggtgaataccttgagaagataattcctttggtggtaaaattttgcaatgtagatgatgatgaattaagagagtactgtattcaagcctttgaatcatttgtaagaagatgtcctaaggaagtatatcctcatgtttctaccattataaatatttgtcttaaatatcttacctatgatccaaattataattacgatgatgaagatgaagatgaaaatgcaatggatgctgatggtggtgatgatgatgatcaagggagtgatgatgaatacagtgatgatgatgacatgagttggaaagtgagacgtgcagctgcgaagtgcttggatgctgtagttagcacaaggcatgaaatgcttccagaattctacaagaccgtctctcctgcactaatatccagatttaaagagcgtgaagagaatgtaaaggcagatgtttttcacgcatacctttctcttttgaagcaaactcgtcctgtacaaagttggctatgtgaccctgatgcaatggagcagggagaaacacctttaacaatgcttcagagtcaggttcccaacattgttaaagctcttcacaaacagatgaaagaaaaaagtgtgaagacccgacagtgttgttttaacatgttaactgagctggtaaatgtattacctggggccctaactcaacacattcctgtacttgtaccaggaatcattttctcactgaatgataaatcaagctcatcgaatttgaagatcgatgctttgtcatgtctatacgtaatcctctgtaaccattctcctcaagtcttccatcctcacgttcaggctttggttcctccagtggtggcttgtgttggagacccattttacaaaattacatctgaagcacttcttgttactcaacagcttgtcaaagtaattcgtcctttagatcagccttcctcgtttgatgcaactccttatatcaaagatctatttacctgtaccattaagagattaaaagcagctgacattgatcaggaagtcaaggaaagggctatttcctgtatgggacaaattatttgcaaccttggagacaatttgggttctgacttgcctaatacacttcagattttcttggagagactaaagaatgaaattaccaggttaactacagtaaaggcattgacactgattgctgggtcacctttgaagatagatttgaggcctgttctgggagaaggggttcctatccttgcttcatttcttagaaaaaaccagagagctttgaaactgggtactctttctgcccttgatattctaataaaaaactatagtgacagcttgacagctgccatgattgatgcagttctagatgagctcccacctcttatcagcgaaagtgatatgcatgtttcacaaatggccatcagttttcttaccactttggcaaaagtatatccctcctccctttcaaagataagtggatccattctcaatgaacttattggacttgtgagatcacccttattgcaggggggagctcttagtgccatgctagactttttccaagctctggttgtcactggaacaaataatttaggatacatggatttgttgcgcatgctgactggtccagtttactctcagagcacagctcttactcataagcagtcttattattccattgccaaatgtgtagctgcccttactcgagcatgccctaaagagggaccagctgtagtaggtcagtttattcaagatgtcaagaactcaaggtctacagattccattcgtctcttagctctactttctcttggagaagttgggcatcatattgacttaagtggacagttggaactaaaatctgtaatactagaagctttctcatctcctagtgaagaagtcaaatcagctgcatcctatgcattaggcagcattagtgtgggcaaccttcctgaatatctgccgtttgtcctgcaagaaataactagtcaacccaaaaggcagtatcttttacttcattccttgaaggaaattattagctctgcatcagtggtgggccttaaaccatatgttgaaaacatctgggccttattactaaagcactgtgagtgtgcagaggaaggaaccagaaatgttgttgctgaatgtctaggaaaactcactctaattgatccagaaactctccttccacggcttaaggggtacttgatatcaggctcatcatatgcccgaagctcagtggttacggctgtgaaatttacaatttctgaccatccacaacctattgatccactgttaaagaactgcataggtgatttcctaaaaactttggaagacccagatttgaatgtgagaagagtagccttggtcacatttaattcagcagcacataacaagccatcattaataagggatctattggatactgttcttccacatctttacaatgaaacaaaagttagaaaggagcttataagagaggtagaaatgggtccatttaaacatacggttgatgatggtctggatattagaaaggcagcatttgagtgtatgtacacacttctagacagttgtcttgatagacttgatatctttgaatttctaaatcatgttgaagatggtttgaaggaccattatgatattaagatgctgacatttttaatgttggtgagactgtctaccctttgtccaagtgcagtactgcagaggttggaccgacttgttgagccattacgtgcaacatgtacaactaaggtaaaggcaaactcagtaaagcaggagtttgaaaaacaagatgaattaaagcgatctgccatgagagcagtagcagcactgctaaccattccagaagcagagaagagtccactgatgagtgaattccagtcacagatcagttctaaccctgagctggcggctatctttgaaagtatccagaaagattcatcatctactaacttggaatcaatggacactagttagatgtttgttcaccatggggaccattacatatgaccatacaatgcactgaattgacaggttaatcataagacatggaaagagaagtgtctaaaagcttcaaaatgttccacttttttttccttcatggagactgtttgtttggctttcttccattgttgtttttgtagcatttatttcagaaatgtgtatttccataatccagaggttgtaaaaccactagtgttttagtggttctagtcacctttgcaatgctaactctactgactgtcctagaaatccgtgtcgccttaatccaagcctacgttttcacacttctagtaagcctctacctgcacgacaacacataaaaaa

SEQ ID NO: 343254 - DNA, 3122 bp, Homo sapiens
tagatacacacaaccagacacgaatcccactaacctacggctaggtacgaggcccgggtcgagtgtatgtacacacttctagacagttgtcttgatagacttgatatctttgaatttctaaatcatgttgaagatggtttgaaggaccattatgatattaagatgctgacatttttaatgttggtgagactgtctaccctttgtccaagtgcagtactgcagaggttggaccgacttgttgagccattacgtgcaacatgtacaactaaggtaaaggcaaactcagtaaagcaggagtttgaaaaacaagatgaattaaagcgatctgccatgagagcagtagcagcactgctaaccattccagaagcagagaagagtccactgatgagtgaattccagtcacagatcagttctaaccctgagctggcggctatctttgaaagtatccagaaagattcatcatctactaacttggaatcaatggacactagttagatgtttgttcaccatggggaccattacatatgaccatacaatgcactgaattgacaggttaatcataagacatggaaagagaagtgtctaaaagcttcaaaatgttccacttttttttccttcatggagactgtttgtttggctttcttccattgttgtttttgtagcatttatttcagaaatgtgtatttccataatccagaggttgtaaaaccactagtgttttagtggttacagcaacatttgaaatggaaactaaaagttaggattttatggagtatggagatagggtccagtatctatttaccctgtaatgtttaggattaaaatgttaaaattttgtgaccatgaatttctttcttttataaattttctcatttaaaaatcaaaaatcttgcaaaacaaaaaccatgtttctttttcttgtataactttttgttttcagcaacataaattgatttttagctggcagacaagaatatccatataagatttgttaaccatttcagagagtttggcaatttttaaaagataataaggtatcatttttaagtatgaaaattaacaatatccctgttgcgcacactaattttgcatgagtaagtttacaaatatgtatcgtctgtaaagcagcatgtgcagattattcataatatagaagttaaaataagtattagtgcaattttcagatatttatttttgcacagaaaacacattatctggagagaaagaaaggagaatttttgagacttgggttttcttaatgccagtgtgaatttgcagatgttttcagaaaatcaagtcacagtaacaatttgccacttttttctattataaatcttcttacttaaattttgaatatttagtttttctcagttacccatttgtgtgtgtgtgattccacttagaaattcttaaaaccagatttttctttcattccgtttggatgtctacattccttatcaaaggatataaatactgtgtatgcttttgaattttatttttaggaaaattctgaagccagctatcacaggtttgttagctaataatagtattttcttttagttgagttaggtttttccccatctcctgtagagcgaatttacatattgtattgggtaagtgttcactacttttcctgattaagggatctgtgctggggaacaaagcttttgcagtaccttatattgtagttaaaattttatttaacatatccttcagtgagctcatttcacactgtagcctcttccttaaaatttgtggtgctcctgtaacagtaagaactaattctgaaataaaagacatctcctaatgctgtgcaaacatagtttacatgtattgaaggaggcagttgttaaattgagtgaccaatttaagcaatcagatatttgaaaactgcaccctttagttttgaaactgtgaattagaaacacttttcctgctgtattactacctgctttaacatccaaatatacagtgattttaaatgataacatactgtggttattagattaacagcttgattttgaatgttcagatgataatgcagaagacatcacttctagtaaggattttgactagtgcattgatgttgaagttggtgccatttcaaaatgtggcaggtgataatcttttaccataatttgcataaaactgtaatagaagtttattttgagatgttagtatattatgtactatgcatttctgtggtatagatgttgtggatatatttaagtatttggttacatggttttacaataaattacaatactgcaggctctaggactgaacaggagactgacatgcatatgttgtgtgaatgtcttagttgggtaaagttaaatccaaatacttcaactggctttttcttcagtttgtttgtttttaactttcaagatgcatgttttgttttgttttgctttgtttttgtctcttaagccaattcatttttctaacagttgaaattcttttagtactaaagaaatagatactgctcttttatggctttagtgtttatatacctgtttatatgcatacattaacaaaattagtaacagcagtgcttagaatttcaatgctgtgtcatactgatgattaactccatactcctagtggtgatgtggtccagatactggaatggaagtggcaggatgtggagtccagacatagtctaccactcatgctacttactagtaatattaaggtgttaaacttaggaatttgtcacatgtaggttcctgaggagatctaaaagttaatacaaaaccaagctgtttactgattttcatgagaacatttaagttagtttaggtctacctgatttattttaaaagaaggcagagggctggacgcagtggcttacgcctgtaatcccagcactttgggaggccgaggcgggcggatcacgaggtcaggagatcgagactatcctggctaacactgtgaaaacccatctctactgaaaatacaaaaaattagctgggcgtggtggcagacgcctgtagtcctagctgctacagctgaggcaggagaatggcgtgaacccaggaggcggagctggcagtgagccgagatcacgccactgcactctggcctgggcaacagagcgagagtctgtctcaaaaaaa

SEQ ID NO: 343255 - DNA, 2477 bp, Homo sapiens
agcgaaggaggcgggctttggccttttgccctagggagcgagtgcggagcgagtgggagcgagacggccctgagtggaagtgtctggctccccgtagaggcccttctgtacgccccgccgcccatgagctcgttctcacgcgaacagcgccgtcgttaggctggctctgtagcctcggcttaccccgggacaggcccacgcctcgccagggagggggcagcccgtcgaggcgcctccctagtcagcgtcggcgtcgcgctgcgaccctggaagcgggagccgccgcgagcgagaggaggagctccagtggcggcggcggcggcggcagcggcagcgggcagcagctccagcagcgccagcaggcgggatcgaggccgtcaacatggcgagcgcctcgtaccacatttccaatttgctggaaaaaatgacatccagcgacaaggactttaggtttatggctacaaatgatttgatgacggaactgcagaaagattccatcaagttggatgatgatagtgaaaggaaagtagtgaaaatgattttgaagttattggaagataaaaatggagaggtacagaatttagctgtcaaatgtcttggtcctttagtgagtaaagtgaaagaataccaagtagagacaattgtagataccctctgcactaacatgctttctgataaagaacaacttcgagacatttcaagtattggtcttaaaacagtaattggagaacttcctccagcttccagtggctctgcattagctgctaatgtatgtaaaaagattactggacgtcttacaagtgcaatagcaaaacaggaagatgtctctgttcagctagaagccttggatattatggctgatatgttgagcaggcaaggaggacttcttgttaatttccatccttcaattctgacctgtctacttccccagttgaccagccctagacttgcagtgaggaaaagaaccattatcgctcttggccatctggttatgagctgtggaaatatagtttttgtagatcttattgaacatctgttgtcagagttgtccaaaaatgattctatgtcaacaacaagaacctacatacaatgtattgctgctattagtaggcaagctggtcatagaataggtgaataccttgagaagataattcctttggtggtaaaattttgcaatgtagatgatgatgaattaagagagtactgtattcaagcctttgaatcatttgtaagaagatgtcctaaggaagtatatcctcatgtttctaccattataaatatttgtcttaaatatcttacctatgatccaaattataattacgatgatgaagatgaagatgaaaatgcaatggatgctgatggtggtgatgatgatgatcaagggagtgatgatgaatacagtgatgatgatgacatgagttggaaagtgagacgtgcagctgcgaagtgcttggatgctgtagttagcacaaggcatgaaatgcttccagaattctacaagaccgtctctcctgcactaatatccagatttaaagagcgtgaagagaatgtaaaggcagatgtttttcacgcatacctttctcttttgaagcaaactcgtcctgtacaaagttggctatgtgaccctgatgcaatggagcagggagaaacacctttaacaatgcttcagagtcaggttcccaacattgttaaagctcttcacaaacagatgaaagaaaaaagtgtgaagacccgacagtgttgttttaacatgttaactgagctggtaaatgtattacctggggccctaactcaacacattcctgtacttgtaccaggaatcattttctcactgaatgataaatcaagctcatcgaatttgaagatcgatgctttgtcatgtctatacgtaatcctctgtaaccattctcctcaagtcttccatcctcacgttcaggctttggttcctccagtggtggcttgtgttggagacccattttacaaaattacatctgaagcacttcttgttactcaacagcttgtcaaagtaattcgtcctttagatcagccttcctcgtttgatgcaactccttatatcaaagatctatttacctgtaccattaagagattaaaagcagctgacattgatcaggaagtcaaggaaagggctatttcctgtatgggacaaattatttgcaaccttggagacaatttgggttctgacttgcctaatacacttcagattttcttggagagactaaagaatgaaattaccaggttaactacagtaaaggcattgacactgattgctgggtcacctttgaagatagatttgaggcctgttctgggagaaggggttcctatccttgcttcatttcttagaaaaaaccagagagctttgaaaccagaacagtgctgcatttacttgccttgcatattctgacagacctgaatagtggccacttccgcctcccggttaatgggatccttcataaatt

SEQ ID NO: 343256 - DNA, 2078 bp, Homo sapiens
agcgaaggaggcgggctttggccttttgccctagggagcgagtgcggagcgagtgggagcgagacggccctgagtggaagtgtctggctccccgtagaggcccttctgtacgccccgccgcccatgagctcgttctcacgcgaacagcgccgtcgttaggctggctctgtagcctcggcttaccccgggacaggcccacgcctcgccagggagggggcagcccgtcgaggcgcctccctagtcagcgtcggcgtcgcgctgcgaccctggaagcgggagccgccgcgagcgagaggaggagctccagtggcggcggcggcggcggcagcggcagcgggcagcagctccagcagcgccagcaggcgggatcgaggccgtcaacatggcgagcgcctcgtaccacatttccaatttgctggaaaaaatgacatccagcgacaaggactttaggtttatggctacaaatgatttgatgacggaactgcagaaagattccatcaagttggatgatgatagtgaaaggaaagtagtgaaaatgattttgaagttattggaagataaaaatggagaggtacagaatttagctgtcaaatgtcttggtcctttagtgagtaaagtgaaagaataccaagtagagacaattgtagataccctctgcactaacatgctttctgataaagaacaacttcgagacatttcaagtattggtcttaaaacagtaattggagaacttcctccagcttccagtggtaagcaagagcacatttttcttcctatttctttttgtgtggaggtatttctccccacccttttttccccttctggccaaggagggagggaggtggctgtccttacagatgttcataggaatccctttggacaattaagaaaattaaagcgtgaagccttattttccttagaaataaatgttaaatgaatattttgattgaacttgtatgtaatatgaatttcagtgaaggatttttatatgttggagcaagattttatactgtgtgtaccatgactgcagactagagttatgccaacctatgcagtgagggaagagataaccaaaatattgcatcctgattagttcactgtttccagtattaattttactttgcgtcagtatttgctatgtaaaatgtaacaccattcagacatagctgtggaatagttcagtttactagtagctttaattaaagctgagccttttacagctacttggtaattaaacaaatttaaaactatgattaatgtatttgttaactaattagcttttggcctttgatagaaatgtgtaggtaatataaattttagaattggtcttgactactaaactattgctaaaattattaggctaaaagtttttgtctcatctgcaaaaggtgagattatcacctatttcatgggaagatttagattggtaataatgtagtctgggggccgggcgaggtggctcacgcctataatcccagcactttgggaggccaaggcaggtggatcacctgaggtcgggagttcaagaccagcctgaccaacatggagaaaccccatctctactaaaaatacaaaattagccgggcgtggtggtgcatgcctgtaatcccagctacttgggaggctgaggcaggagaatcactttaactcaggaggcggaggttgtggtgagccgagatggtgccattgcattccagcctagggaacaagagtgaaactccgtgtcaaaaaaaaataaaaaaacaaaaaaataaataatgtagcctgggtatgttatttccactcatgtacttgaatcattcactgtgctagttttcatgctaaaggctgcatacgtaaactagtctaaacatcaatcatatgggaggtcttactgttccttctagtttgtagatgggagaactgaaattcagagagattaggttaattcacccaaagttgggtgagtaattgggtaaagattcaaatccattttcttttaatccaaaaaggatgctttcttcaatgtatcataccagtgttattttacctttattaaatagttacttatttcaataaaacatttcaccaactcagaa

SEQ ID NO: 343257 - DNA, 1446 bp, Homo sapiens
agcgaaggaggcgggctttggccttttgccctagggagcgagtgcggagcgagtgggagcgagacggccctgagtggaagtgtctggctccccgtagaggcccttctgtacgccccgccgcccatgagctcgttctcacgcgaacagcgccgtcgttaggctggctctgtagcctcggcttaccccgggacaggcccacgcctcgccagggagggggcagcccgtcgaggcgcctccctagtcagcgtcggcgtcgcgctgcgaccctggaagcgggagccgccgcgagcgagaggaggagctccagtggcggcggcggcggcggcagcggcagcgggcagcagctccagcagcgccagcaggcgggatcgaggccgtcaacatggcgagcgcctcgtaccacatttccaatttgctggaaaaaatgacatccagcgacaaggactttaggtgaggccgagatccgaccctcaccccacctcggggttctcgcagccgcggccctggccgtcacgcaggccttgccccaccccttcggctgtagccggtagcttctctgccccgaagtctccatgcccaccggtccgctggcctcccgatccctgcggagcccctgttcctctcccctctttgcaaccgcaaccccctccccccattctttctcctaggcagttgcccgccgcggtctctaggccccgtttgcttgtctcagcgcccccacatccttccctgccccaccaggaggcgattcttgcgtctcaggtagcgcgaaggggctaaaccacccaccattgtggagaagggagttgctctaggccgggagaccgggcgccgggcctattcgcttgccatcctgcggcgctaggccgccgtgctcgctggggcccaagctgctgcccactcggggacccggcagcctcctctctgcccgcaggtgcgcgtgggccttgctgcattcaggtggaatgatgaacttttgcgctcttggctgatacatagttcttttgtggattattaattttcgtgaaggtgggaagaagggggaggggagccaggatggaggaaacttcgctcatagggttttcccgccagcatcactgtcagttcctcttgtcaggtaaaaccaacttaggaactcggggtttcagtctcatgtcctcatatccaaaatcactgccaaaggggtggattgctggatcttaatcatagcagacggatcttcaaaaggaagagatgtttaatacggacctggtgaatatgaagctttattacagcagttctgttcaggagatcggtactgttggttccaaagtgttgtaatatgcatagtgaagatttgttatatttttacaggttatctttgtttttatttttccttgcacgcttcggtgattgttgcattctttcccgcctcccatctcttcacaaataagttctcaatctaaa

SEQ ID NO: 343258 - DNA, 1191 bp, Homo sapiens
agcgaaggaggcgggctttggccttttgccctagggagcgagtgcggagcgagtgggagcgagacggccctgagtggaagtgtctggctccccgtagaggcccttctgtacgccccgccgcccatgagctcgttctcacgcgaacagcgccgtcgttaggctggctctgtagcctcggcttaccccgggacaggcccacgcctcgccagggagggggcagcccgtcgaggcgcctccctagtcagcgtcggcgtcgcgctgcgaccctggaagcgggagccgccgcgagcgagaggaggagctccagtggcggcggcggcggcggcagcggcagcgggcagcagctccagcagcgccagcaggcgggatcgaggccgtcaacatggcgagcgcctcgtaccacatttccaatttgctggaaaaaatgacatccagcgacaaggactttaggtttatggctcaacaatgcatttgcatgcacggacactgcagcaaagcattccatcaagttggcatgcatgcatccgtgcacaaggcacaagtcagtgcacacacatgcatctcttgcacagttccattgcgcacagcatcaacacacatgcgcagcaggtaccagcacatttcaagcatagtcaacacatagtccttgcgtcccctttcgaatgcagttccacaggtgcaccacgcacatcacccacagctcacccagcacaacatatagttgacgcaagtcagccccataccatcggccctgccttcaacagcgactggggccgtttctcgacctcgtcacttcaccacgccacagccgaaaaactctcattcggccacgaaaacgagtttttaccaacaagcttgactctgaggggtagcatttcagacactaagcaagggaccacactttcggggcaagccacaactttacccatacacaaggacagctattcagcacagcgatggcggcccattcagtcggaccaccatctcaacgaccgtttggcccatcacacctggcatcaaatggcttacaccactatacggcactttcaccgcttgagacacccggattcccttacacaacccagcagggtcggccacaaatatcagccctgaaacaaccaaatggcggtaaacgcacttggctccgttccctaggctaccccaaggccttcagtaacaacccccatttgg

SEQ ID NO: 343259 - DNA, 670 bp, Homo sapiens
gaagataattcctttggtggtaaaattttgcaatgtagatgatgatgaattaagagagtactgtattcaagcctttgaatcatttgtaagaaggtaagtttttaagatctctattttttacaaaaagtttttccttaagagtagaatcataaggtctacattaggtgtgtgaggagaagcggccttttggatttcagatataacagacaatacagtatttgaaactaatgtcatcttgctattataaaatgtggtcatcacatttattttgaaaattttccttgtcattgttaggactttatttaaagaattttggaaaggtatttataattattttgggtttactttagaagggaagaaatgccagtgtaataatgtagtctgtactgaaagcccagcaggataaattattcgtcagaaataagtagtgaattgccttttcaacaatttcttaggtcacatccattttgctaggtcagtgattctcaatttggaaactgattctaatatattttttaaaagcttagtaaaagttgtgtatttgtgtactagaaggcaatacaagataagtaacattatttttcctcttgactaatgcagtagcatggtgtcttgagaccttactggttgttttctgcatttatcccttgacactcctggttttgagaag

SEQ ID NO: 343260 - DNA, 4427 bp, Homo sapiens
agcgaaggaggcgggctttggccttttgccctagggagcgagtgcggagcgagtgggagcgagacggccctgagtggaagtgtctggctccccgtagaggcccttctgtacgccccgccgcccatgagctcgttctcacgcgaacagcgccgtcgttaggctggctctgtagcctcggcttaccccgggacaggcccacgcctcgccagggagggggcagcccgtcgaggcgcctccctagtcagcgtcggcgtcgcgctgcgaccctggaagcgggagccgccgcgagcgagaggaggagctccagtggcggcggcggcggcggcagcggcagcgggcagcagctccagcagcgccagcaggcgggatcgaggccgtcaacatggcgagcgcctcgtaccacatttccaatttgctggaaaaaatgacatccagcgacaaggactttaggtttatggctacaaatgatttgatgacggaactgcagaaagattccatcaagttggatgatgatagtgaaaggaaagtagtgaaaatgattttgaagttattggaagataaaaatggagaggtacagaatttagctgtcaaatgtcttggtcctttagtgagtaaagtgaaagaataccaagtagagacaattgtagataccctctgcactaacatgctttctgataaagaacaacttcgagacatttcaagtattggtcttaaaacagtaattggagaacttcctccagcttccagtggctctgcattagctgctaatgtatgtaaaaagattactggacgtcttacaagtgcaatagcaaaacaggaagatgtctctgttcagctagaagccttggatattatggctgatatgttgagcaggcaaggaggacttcttgttaatttccatccttcaattctgacctgtctacttccccagttgaccagccctagacttgcagtgaggaaaagaaccattatcgctcttggccatctggttatgagctgtggaaatatagtttttgtagatcttattgaacatctgttgtcagagttgtccaaaaatgattctatgtcaacaacaagaacctacatacaatgtattgctgctattagtaggcaagctggtcatagaataggtgaataccttgagaagataattcctttggtggtaaaattttgcaatgtagatgatgatgaattaagagagtactgtattcaagcctttgaatcatttgtaagaagatgtcctaaggaagtatatcctcatgtttctaccattataaatatttgtcttaaatatcttacctatgatccaaattataattacgatgatgaagatgaagatgaaaatgcaatggatgctgatggtggtgatgatgatgatcaagggagtgatgatgaatacagtgatgatgatgacatgagttggaaagtgagacgtgcagctgcgaagtgcttggatgctgtagttagcacaaggcatgaaatgcttccagaattctacaagaccgtctctcctgcactaatatccagatttaaagagcgtgaagagaatgtaaaggcagatgtttttcacgcatacctttctcttttgaagcaaactcgtcctgtacaaagttggctatgtgaccctgatgcaatggagcagggagaaacacctttaacaatgcttcagagtcaggttcccaacattgttaaagctcttcacaaacagatgaaagaaaaaagtgtgaagacccgacagtgttgttttaacatgttaactgagctggtaaatgtattacctggggccctaactcaacacattcctgtacttgtaccaggaatcattttctcactgaatgataaatcaagctcatcgaatttgaagatcgatgctttgtcatgtctatacgtaatcctctgtaaccattctcctcaagtcttccatcctcacgttcaggctttggttcctccagtggtggcttgtgttggagacccattttacaaaattacatctgaagcacttcttgttactcaacagcttgtcaaagtaattcgtcctttagatcagccttcctcgtttgatgcaactccttatatcaaagatctatttacctgtaccattaagagattaaaagcagctgacattgatcaggaagtcaaggaaagggctatttcctgtatgggacaaattatttgcaaccttggagacaatttgggttctgacttgcctaatacacttcagattttcttggagagactaaagaatgaaattaccaggttaactacagtaaaggcattgacactgattgctgggtcacctttgaagatagatttgaggcctgttctgggagaaggggttcctatccttgcttcatttcttagaaaaaaccagagagctttgaaactgggtactctttctgcccttgatattctaataaaaaactatagtgacagcttgacagctgccatgattgatgcagttctagatgagctcccacctcttatcagcgaaagtgatatgcatgtttcacaaatggccatcagttttcttaccactttggcaaaagtatatccctcctccctttcaaagataagtggatccattctcaatgaacttattggacttgtgagatcacccttattgcaggggggagctcttagtgccatgctagactttttccaagctctggttgtcactggaacaaataatttaggatacatggatttgttgcgcatgctgactggtccagtttactctcagagcacagctcttactcataagcagtcttattattccattgccaaatgtgtagctgcccttactcgagcatgccctaaagagggaccagctgtagtaggtcagtttattcaagatgtcaagaactcaaggtctacagattccattcgtctcttagctctactttctcttggagaagttgggcatcatattgacttaagtggacagttggaactaaaatctgtaatactagaagctttctcatctcctagtgaagaagtcaaatcagctgcatcctatgcattaggcagcattagtgtgggcaaccttcctgaatatctgccgtttgtcctgcaagaaataactagtcaacccaaaaggcagtatcttttacttcattccttgaaggaaattattagctctgcatcagtggtgggccttaaaccatatgttgaaaacatctgggccttattactaaagcactgtgagtgtgcagaggaaggaaccagaaatgttgttgctgaatgtctaggaaaactcactctaattgatccagaaactctccttccacggcttaaggggtacttgatatcaggctcatcatatgcccgaagctcagtggttacggctgtgaaatttacaatttctgaccatccacaacctattgatccactgttaaagaactgcataggtgatttcctaaaaactttggaagacccagatttgaatgtgagaagagtagccttggtcacatttaattcagcagcacataacaagccatcattaataagggatctattggatactgttcttccacatctttacaatgaaacaaaagttagaaaggagcttataagagaggtagaaatgggtccatttaaacatacggttgatgatggtctggatattagaaaggcagcatttgagtgtatgtacacacttctagacagttgtcttgatagacttgatatctttgaatttctaaatcatgttgaagatggtttgaaggaccattatgatattaagatgctgacatttttaatgttggtgagactgtctaccctttgtccaagtgcagtactgcagaggttggaccgacttgttgagccattacgtgcaacatgtacaactaaggtaaaggcaaactcagtaaagcaggagtttgaaaaacaagatgaattaaagcgatctgccatgagagcagtagcagcactgctaaccattccagaagcagagaagagtccactgatgagtgaattccagtcacagatcagttctaaccctgagctggcggctatctttgaaagtatccagaaagattcatcatctactaacttggaatcaatggacactagttagatgtttgttcaccatggggaccattacatatgaccatacaatgcactgaattgacaggttaatcataagacatggaaagagaagtgtctaaaagcttcaaaatgttccacttttttttccttcatggagactgtttgtttggctttcttccattgttgtttttgtagcatttatttcagaaatgtgtatttccataatccagaggttgtaaaaccactagtgttttagtggttacagcaacatttgaaatggaaactaaaagttaggattttatggagtatggagatagggtccagtatctatttaccctgtaatgtttaggattaaaatgttaaaattttgtgaccatgaa

SEQ ID NO: 343261 - DNA, 3469 bp, Homo sapiens
ccccagtcggttctaccattataaatatttgtcttaaatatcttacctatgatccaaattataattacgatgatgaagatgaagatgaaaatgcaatgggattctatgtcaacaacaagaacctacatacaatgtattgctgctattagtaggcaagctggtcatagaataggtgaataccttgagaagataattcctttggtggtaaaattttgcaatgtagatgatgatgaattaagagagtactgtattcaagcctttgaatcatttgtaagaagatgtcctaaggaagtatatcctcatgtttctaccattataaatatttgtcttaaatatcttacctatgatccaaattataattacgatgatgaagatgaagatgaaaatgcaatggatgctgatggtggtgatgatgatgatcaagggagtgatgatgaatacagtgatgatgatgacatgagttggaaagtgagacgtgcagctgcgaagtgcttggatgctgtagttagcacaaggcatgaaatgcttccagaattctacaagaccgtctctcctgcactaatatccagatttaaagagcgtgaagagaatgtaaaggcagatgtttttcacgcatacctttctcttttgaagcaaactcgtcctgtacaaagttggctatgtgaccctgatgcaatggagcagggagaaacacctttaacaatgcttcagagtcaggttcccaacattgttaaagctcttcacaaacagatgaaagaaaaaagtgtgaagacccgacagtgttgttttaacatgttaactgagctggtaaatgtattacctggggccctaactcaacacattcctgtacttgtaccaggaatcattttctcactgaatgataaatcaagctcatcgaatttgaagatcgatgctttgtcatgtctatacgtaatcctctgtaaccattctcctcaagtcttccatcctcacgttcaggctttggttcctccagtggtggcttgtgttggagacccattttacaaaattacatctgaagcacttcttgttactcaacagcttgtcaaagtaattcgtcctttagatcagccttcctcgtttgatgcaactccttatatcaaagatctatttacctgtaccattaagagattaaaagcagctgacattgatcaggaagtcaaggaaagggctatttcctgtatgggacaaattatttgcaaccttggagacaatttgggttctgacttgcctaatacacttcagattttcttggagagactaaagaatgaaattaccaggttaactacagtaaaggcattgacactgattgctgggtcacctttgaagatagatttgaggcctgttctgggagaaggggttcctatccttgcttcatttcttagaaaaaaccagagagctttgaaactgggtactctttctgcccttgatattctaataaaaaactatagtgacagcttgacagctgccatgattgatgcagttctagatgagctcccacctcttatcagcgaaagtgatatgcatgtttcacaaatggccatcagttttcttaccactttggcaaaagtatatccctcctccctttcaaagataagtggatccattctcaatgaacttattggacttgtgagatcacccttattgcaggggggagctcttagtgccatgctagactttttccaagctctggttgtcactggaacaaataatttaggatacatggatttgttgcgcatgctgactggtccagtttactctcagagcacagctcttactcataagcagtcttattattccattgccaaatgtgtagctgcccttactcgagcatgccctaaagagggaccagctgtagtaggtcagtttattcaagatgtcaagaactcaaggtctacagattccattcgtctcttagctctactttctcttggagaagttgggcatcatattgacttaagtggacagttggaactaaaatctgtaatactagaagctttctcatctcctagtgaagaagtcaaatcagctgcatcctatgcattaggcagcattagtgtgggcaaccttcctgaatatctgccgtttgtcctgcaagaaataactagtcaacccaaaaggcagtatcttttacttcattccttgaaggaaattattagctctgcatcagtggtgggccttaaaccatatgttgaaaacatctgggccttattactaaagcactgtgagtgtgcagaggaaggaaccagaaatgttgttgctgaatgtctaggaaaactcactctaattgatccagaaactctccttccacggcttaaggggtacttgatatcaggctcatcatatgcccgaagctcagtggttacggctgtgaaatttacaatttctgaccatccacaacctattgatccactgttaaagaactgcataggtgatttcctaaaaactttggaagacccagatttgaatgtgagaagagtagccttggtcacatttaattcagcagcacataacaagccatcattaataagggatctattggatactgttcttccacatctttacaatgaaacaaaagttagaaaggagcttataagagaggtagaaatgggtccatttaaacatacggttgatgatggtctggatattagaaaggcagcatttgagtgtatgtacacacttctagacagttgtcttgatagacttgatatctttgaatttctaaatcatgttgaagatggtttgaaggaccattatgatattaagatgctgacatttttaatgttggtgagactgtctaccctttgtccaagtgcagtactgcagaggttggaccgacttgttgagccattacgtgcaacatgtacaactaaggtaaaggcaaactcagtaaagcaggagtttgaaaaacaagatgaattaaagcgatctgccatgagagcagtagcagcactgctaaccattccagaagcagagaagagtccactgatgagtgaattccagtcacagatcagttctaaccctgagctggcggctatctttgaaagtatccagaaagattcatcatctactaacttggaatcaatggacactagttagatgtttgttcaccatggggaccattacatatgaccatacaatgcactgaattgacaggttaatcataagacatggaaagagaagtgtctaaaagcttcaaaatgttccacttttttttccttcatggagactgtttgtttggctttcttccattgttgtttttgtagcatttatttcagaaatgtgtatttccataatccagaggttgtaaaaccactagtgttttagtggttacagcaacatttgaaatggaaactaaaagttaggattttatggagtatggagatagggtccagtatctatttaccctgtaatgtttaggattaaaatgttaaaattttgtgaccatgaa

SEQ ID NO: 343262 - DNA, 5905 bp, Homo sapiens
agcgaaggaggcgggctttggccttttgccctagggagcgagtgcggagcgagtgggagcgagacggccctgagtggaagtgtctggctccccgtagaggcccttctgtacgccccgccgcccatgagctcgttctcacgcgaacagcgccgtcgttaggctggctctgtagcctcggcttaccccgggacaggcccacgcctcgccagggagggggcagcccgtcgaggcgcctccctagtcagcgtcggcgtcgcgctgcgaccctggaagcgggagccgccgcgagcgagaggaggagctccagtggcggcggcggcggcggcagcggcagcgggcagcagctccagcagcgccagcaggcgggatcgaggccgtcaacatggcgagcgcctcgtaccacatttccaatttgctggaaaaaatgacatccagcgacaaggactttaggtttatggctacaaatgatttgatgacggaactgcagaaagattccatcaagttggatgatgatagtgaaaggaaagtagtgaaaatgattttgaagttattggaagataaaaatggagaggtacagaatttagctgtcaaatgtcttggtcctttagtgagtaaagtgaaagaataccaagtagagacaattgtagataccctctgcactaacatgctttctgataaagaacaacttcgagacatttcaagtattggtcttaaaacagtaattggagaacttcctccagcttccagtggctctgcattagctgctaatgtatgtaaaaagattactggacgtcttacaagtgcaatagcaaaacaggaagatgtctctgttcagctagaagccttggatattatggctgatatgttgagcaggcaaggaggacttcttgttaatttccatccttcaattctgacctgtctacttccccagttgaccagccctagacttgcagtgaggaaaagaaccattatcgctcttggccatctggttatgagctgtggaaatatagtttttgtagatcttattgaacatctgttgtcagagttgtccaaaaatgattctatgtcaacaacaagaacctacatacaatgtattgctgctattagtaggcaagctggtcatagaataggtgaataccttgagaagataattcctttggtggtaaaattttgcaatgtagatgatgatgaattaagagagtactgtattcaagcctttgaatcatttgtaagaagatgtcctaaggaagtatatcctcatgtttctaccattataaatatttgtcttaaatatcttacctatgatccaaattataattacgatgatgaagatgaagatgaaaatgcaatggatgctgatggtggtgatgatgatgatcaagggagtgatgatgaatacagtgatgatgatgacatgagttggaaagtgagacgtgcagctgcgaagtgcttggatgctgtagttagcacaaggcatgaaatgcttccagaattctacaagaccgtctctcctgcactaatatccagatttaaagagcgtgaagagaatgtaaaggcagatgtttttcacgcatacctttctcttttgaagcaaactcgtcctgtacaaagttggctatgtgaccctgatgcaatggagcagggagaaacacctttaacaatgcttcagagtcaggttcccaacattgttaaagctcttcacaaacagatgaaagaaaaaagtgtgaagacccgacagtgttgttttaacatgttaactgagctggtaaatgtattacctggggccctaactcaacacattcctgtacttgtaccaggaatcattttctcactgaatgataaatcaagctcatcgaatttgaagatcgatgctttgtcatgtctatacgtaatcctctgtaaccattctcctcaagtcttccatcctcacgttcaggctttggttcctccagtggtggcttgtgttggagacccattttacaaaattacatctgaagcacttcttgttactcaacagcttgtcaaagtaattcgtcctttagatcagccttcctcgtttgatgcaactccttatatcaaagatctatttacctgtaccattaagagattaaaagcagctgacattgatcaggaagtcaaggaaagggctatttcctgtatgggacaaattatttgcaaccttggagacaatttgggttctgacttgcctaatacacttcagattttcttggagagactaaagaatgaaattaccaggttaactacagtaaaggcattgacactgattgctgggtcacctttgaagatagatttgaggcctgttctgggagaaggggttcctatccttgcttcatttcttagaaaaaaccagagagctttgaaactgggtactctttctgcccttgatattctaataaaaaactatagtgacagcttgacagctgccatgattgatgcagttctagatgagctcccacctcttatcagcgaaagtgatatgcatgtttcacaaatggccatcagttttcttaccactttggcaaaagtatatccctcctccctttcaaagataagtggatccattctcaatgaacttattggacttgtgagatcacccttattgcaggggggagctcttagtgccatgctagactttttccaagctctggttgtcactggaacaaataatttaggatacatggatttgttgcgcatgctgactggtccagtttactctcagagcacagctcttactcataagcagtcttattattccattgccaaatgtgtagctgcccttactcgagcatgccctaaagagggaccagctgtagtaggtcagtttattcaagatgtcaagaactcaaggtctacagattccattcgtctcttagctctactttctcttggagaagttgggcatcatattgacttaagtggacagttggaactaaaatctgtaatactagaagctttctcatctcctagtgaagaagtcaaatcagctgcatcctatgcattaggcagcattagtgtgggcaaccttcctgaatatctgccgtttgtcctgcaagaaataactagtcaacccaaaaggcagtatcttttacttcattccttgaaggaaattattagctctgcatcagtggtgggccttaaaccatatgttgaaaacatctgggccttattactaaagcactgtgagtgtgcagaggaaggaaccagaaatgttgttgctgaatgtctaggaaaactcactctaattgatccagaaactctccttccacggcttaaggggtacttgatatcaggctcatcatatgcccgaagctcagtggttacggctgtgaaatttacaatttctgaccatccacaacctattgatccactgttaaagaactgcataggtgatttcctaaaaactttggaagacccagatttgaatgtgagaagagtagccttggtcacatttaattcagcagcacataacaagccatcattaataagggatctattggatactgttcttccacatctttacaatgaaacaaaagttagaaaggagcttataagagaggtagaaatgggtccatttaaacatacggttgatgatggtctggatattagaaaggcagcatttgagtgtatgtacacacttctagacagttgtcttgatagacttgatatctttgaatttctaaatcatgttgaagatggtttgaaggaccattatgatattaagatgctgacatttttaatgttggtgagactgtctaccctttgtccaagtgcagtactgcagaggttggaccgacttgttgagccattacgtgcaacatgtacaactaaggtaaaggcaaactcagtaaagcaggagtttgaaaaacaagatgaattaaagcgatctgccatgagagcagtagcagcactgctaaccattccagaagcagagaagagtccactgatgagtgaattccagtcacagatcagttctaaccctgagctggcggctatctttgaaagtatccagaaagattcatcatctactaacttggaatcaatggacactagttagatgtttgttcaccatggggaccattacatatgaccatacaatgcactgaattgacaggttaatcataagacatggaaagagaagtgtctaaaagcttcaaaatgttccacttttttttccttcatggagactgtttgtttggctttcttccattgttgtttttgtagcatttatttcagaaatgtgtatttccataatccagaggttgtaaaaccactagtgttttagtggttacagcaacatttgaaatggaaactaaaagttaggattttatggagtatggagatagggtccagtatctatttaccctgtaatgtttaggattaaaatgttaaaattttgtgaccatgaatttctttcttttataaattttctcatttaaaaatcaaaaatcttgcaaaacaaaaaccatgtttctttttcttgtataactttttgttttcagcaacataaattgatttttagctggcagacaagaatatccatataagatttgttaaccatttcagagagtttggcaatttttaaaagataataaggtatcatttttaagtatgaaaattaacaatatccctgttgcgcacactaattttgcatgagtaagtttacaaatatgtatcgtctgtaaagcagcatgtgcagattattcataatatagaagttaaaataagtattagtgcaattttcagatatttatttttgcacagaaaacacattatctggagagaaagaaaggagaatttttgagacttgggttttcttaatgccagtgtgaatttgcagatgttttcagaaaatcaagtcacagtaacaatttgccacttttttctattataaatcttcttacttaaattttgaatatttagtttttctcagttacccatttgtgtgtgtgtgattccacttagaaattcttaaaaccagatttttctttcattccgtttggatgtctacattccttatcaaaggatataaatactgtgtatgcttttgaattttatttttaggaaaattctgaagccagctatcacaggtttgttagctaataatagtattttcttttagttgagttaggtttttccccatctcctgtagagcgaatttacatattgtattgggtaagtgttcactacttttcctgattaagggatctgtgctggggaacaaagcttttgcagtaccttatattgtagttaaaattttatttaacatatccttcagtgagctcatttcacactgtagcctcttccttaaaatttgtggtgctcctgtaacagtaagaactaattctgaaataaaagacatctcctaatgctgtgcaaacatagtttacatgtattgaaggaggcagttgttaaattgagtgaccaatttaagcaatcagatatttgaaaactgcaccctttagttttgaaactgtgaattagaaacacttttcctgctgtattactacctgctttaacatccaaatatacagtgattttaaatgataacatactgtggttattagattaacagcttgattttgaatgttcagatgataatgcagaagacatcacttctagtaaggattttgactagtgcattgatgttgaagttggtgccatttcaaaatgtggcaggtgataatcttttaccataatttgcataaaactgtaatagaagtttattttgagatgttagtatattatgtactatgcatttctgtggtatagatgttgtggatatatttaagtatttggttacatggttttacaataaattacaatactgcaggctctaggactgaaaaaaaaaaaagtcgacgcggccgcgaatttagtagtagta

SEQ ID NO: 343263 - DNA, 8087 bp, Homo sapiens
agcgaaggaggcgggctttggccttttgccctagggagcgagtgcggagcgagtgggagcgagacggccctgagtggaagtgtctggctccccgtagaggcccttctgtacgccccgccgcccatgagctcgttctcacgcgaacagcgccgtcgttaggctggctctgtagcctcggcttaccccgggacaggcccacgcctcgccagggagggggcagcccgtcgaggcgcctccctagtcagcgtcggcgtcgcgctgcgaccctggaagcgggagccgccgcgagcgagaggaggagctccagtggcggcggcggcggcggcagcggcagcgggcagcagctccagcagcgccagcaggcgggatcgaggccgtcaacatggcgagcgcctcgtaccacatttccaatttgctggaaaaaatgacatccagcgacaaggactttaggtttatggctacaaatgatttgatgacggaactgcagaaagattccatcaagttggatgatgatagtgaaaggaaagtagtgaaaatgattttgaagttattggaagataaaaatggagaggtacagaatttagctgtcaaatgtcttggtcctttagtgagtaaagtgaaagaataccaagtagagacaattgtagataccctctgcactaacatgctttctgataaagaacaacttcgagacatttcaagtattggtcttaaaacagtaattggagaacttcctccagcttccagtggctctgcattagctgctaatgtatgtaaaaagattactggacgtcttacaagtgcaatagcaaaacaggaagatgtctctgttcagctagaagccttggatattatggctgatatgttgagcaggcaaggaggacttcttgttaatttccatccttcaattctgacctgtctacttccccagttgaccagccctagacttgcagtgaggaaaagaaccattatcgctcttggccatctggttatgagctgtggaaatatagtttttgtagatcttattgaacatctgttgtcagagttgtccaaaaatgattctatgtcaacaacaagaacctacatacaatgtattgctgctattagtaggcaagctggtcatagaataggtgaataccttgagaagataattcctttggtggtaaaattttgcaatgtagatgatgatgaattaagagagtactgtattcaagcctttgaatcatttgtaagaagatgtcctaaggaagtatatcctcatgtttctaccattataaatatttgtcttaaatatcttacctatgatccaaattataattacgatgatgaagatgaagatgaaaatgcaatggatgctgatggtggtgatgatgatgatcaagggagtgatgatgaatacagtgatgatgatgacatgagttggaaagtgagacgtgcagctgcgaagtgcttggatgctgtagttagcacaaggcatgaaatgcttccagaattctacaagaccgtctctcctgcactaatatccagatttaaagagcgtgaagagaatgtaaaggcagatgtttttcacgcatacctttctcttttgaagcaaactcgtcctgtacaaagttggctatgtgaccctgatgcaatggagcagggagaaacacctttaacaatgcttcagagtcaggttcccaacattgttaaagctcttcacaaacagatgaaagaaaaaagtgtgaagacccgacagtgttgttttaacatgttaactgagctggtaaatgtattacctggggccctaactcaacacattcctgtacttgtaccaggaatcattttctcactgaatgataaatcaagctcatcgaatttgaagatcgatgctttgtcatgtctatacgtaatcctctgtaaccattctcctcaagtcttccatcctcacgttcaggctttggttcctccagtggtggcttgtgttggagacccattttacaaaattacatctgaagcacttcttgttactcaacagcttgtcaaagtaattcgtcctttagatcagccttcctcgtttgatgcaactccttatatcaaagatctatttacctgtaccattaagagattaaaagcagctgacattgatcaggaagtcaaggaaagggctatttcctgtatgggacaaattatttgcaaccttggagacaatttgggttctgacttgcctaatacacttcagattttcttggagagactaaagaatgaaattaccaggttaactacagtaaaggcattgacactgattgctgggtcacctttgaagatagatttgaggcctgttctgggagaaggggttcctatccttgcttcatttcttagaaaaaaccagagagctttgaaactgggtactctttctgcccttgatattctaataaaaaactatagtgacagcttgacagctgccatgattgatgcagttctagatgagctcccacctcttatcagcgaaagtgatatgcatgtttcacaaatggccatcagttttcttaccactttggcaaaagtatatccctcctccctttcaaagataagtggatccattctcaatgaacttattggacttgtgagatcacccttattgcaggggggagctcttagtgccatgctagactttttccaagctctggttgtcactggaacaaataatttaggatacatggatttgttgcgcatgctgactggtccagtttactctcagagcacagctcttactcataagcagtcttattattccattgccaaatgtgtagctgcccttactcgagcatgccctaaagagggaccagctgtagtaggtcagtttattcaagatgtcaagaactcaaggtctacagattccattcgtctcttagctctactttctcttggagaagttgggcatcatattgacttaagtggacagttggaactaaaatctgtaatactagaagctttctcatctcctagtgaagaagtcaaatcagctgcatcctatgcattaggcagcattagtgtgggcaaccttcctgaatatctgccgtttgtcctgcaagaaataactagtcaacccaaaaggcagtatcttttacttcattccttgaaggaaattattagctctgcatcagtggtgggccttaaaccatatgttgaaaacatctgggccttattactaaagcactgtgagtgtgcagaggaaggaaccagaaatgttgttgctgaatgtctaggaaaactcactctaattgatccagaaactctccttccacggcttaaggggtacttgatatcaggctcatcatatgcccgaagctcagtggttacggctgtgaaatttacaatttctgaccatccacaacctattgatccactgttaaagaactgcataggtgatttcctaaaaactttggaagacccagatttgaatgtgagaagagtagccttggtcacatttaattcagcagcacataacaagccatcattaataagggatctattggatactgttcttccacatctttacaatgaaacaaaagttagaaaggagcttataagagaggtagaaatgggtccatttaaacatacggttgatgatggtctggatattagaaaggcagcatttgagtgtatgtacacacttctagacagttgtcttgatagacttgatatctttgaatttctaaatcatgttgaagatggtttgaaggaccattatgatattaaggtaagatgtttgtgcctatttatacaatgttttagaagaagactttgctagagcaactttcacccttgtaatttactcatgtgtctgagaaaaatcaggttgtctgtgaagattttgataagcatattgtaaactataaagtgcaaaagtaataggcagtgtaacaccagttgacgtgtaagaaagatccagagccctttttattggaggaggaagtggcagtggatgcaaaatgctgtgtgcccacttgcttagtgaatagtccctagatcctttccctcaaaaaagtcccgacagattttgctgtttaaagtataaatctgtaactttttggcctgtcttaacattggaccatagttgctacccatggagggttttcttagcattgtcttgattaagtctcctgagctacctttggggctagtctgaattgtaactgtatcatttacctgaatgaggaatttttgtttttcaatataatatactgtgtttaatatcaagaattttgttataggacatggaacttttcagatatacaaaacaatctgtagaagctacttgagagaaatcatactgcgtcttatgtttggataatgaattttgcatataagtgttctttgttttcctgtgtgttcgtctccatttaaaatgtgaacagtaaaagggtgatttgaaaaatgaaaaatatatgcattgtgtctttttcatctactcttccatttagggcttttggccaagcaggacaaaagtggtaactcagcagtaattgagccatactacccgaactcctactcttaggtttccatgtgtggtagtgacctgagcctctcaaagttcaatgaagagggcctccccaccaagaagtaaaaggatgtgcttgtttaattctatgagtttatagtccaagagaaaaaggtttatggggtttatgggttatcaggttttacatggattaatctgaataactggtcaactctgttatgatagtggaaacttattatgaaattgtgttccagttcagtaattttctagttctatgattctcaattctggtgcacatgagctttaaaaaataaaaataaaaaaaataatgtgtgccatattctgacaggttcagtaaaactctctggggatggggcttgaagaatgggtatgtttctaaagctctctggatgattctaatgtgcaaccaagattgaaaaccactttctagtccttatatgctgttgagacaaatctgtctgattctgattgggcagattacattaaaaggaaggtttactttgcatgctagttattttcctttaaaggatttgtcagaatttagtattttgtttttagaaaatgatgtcaaatctaaattctgtcttttttattcctaatagatgctgacatttttaatgttggtgagactgtctaccctttgtccaagtgcagtactgcagaggttggaccgacttgttgagccattacgtgcaacatgtacaactaaggtaaaggcaaactcagtaaagcaggagtttgaaaaacaagatgaattaaagcgatctgccatgagagcagtagcagcactgctaaccattccagaagcagagaagagtccactgatgagtgaattccagtcacagatcagttctaaccctgagctggcggctatctttgaaagtatccagaaagattcatcatctactaacttggaatcaatggacactagttagatgtttgttcaccatggggaccattacatatgaccatacaatgcactgaattgacaggttaatcataagacatggaaagagaagtgtctaaaagcttcaaaatgttccacttttttttccttcatggagactgtttgtttggctttcttccattgttgtttttgtagcatttatttcagaaatgtgtatttccataatccagaggttgtaaaaccactagtgttttagtggttacagcaacatttgaaatggaaactaaaagttaggattttatggagtatggagatagggtccagtatctatttaccctgtaatgtttaggattaaaatgttaaaattttgtgaccatgaatttctttcttttataaattttctcatttaaaaatcaaaaatcttgcaaaacaaaaaccatgtttctttttcttgtataactttttgttttcagcaacataaattgatttttagctggcagacaagaatatccatataagatttgttaaccatttcagagagtttggcaatttttaaaagataataaggtatcatttttaagtatgaaaattaacaatatccctgttgcgcacactaattttgcatgagtaagtttacaaatatgtatcgtctgtaaagcagcatgtgcagattattcataatatagaagttaaaataagtattagtgcaattttcagatatttatttttgcacagaaaacacattatctggagagaaagaaaggagaatttttgagacttgggttttcttaatgccagtgtgaatttgcagatgttttcagaaaatcaagtcacagtaacaatttgccacttttttctattataaatcttcttacttaaattttgaatatttagtttttctcagttacccatttgtgtgtgtgtgattccacttagaaattcttaaaaccagatttttctttcattccgtttggatgtctacattccttatcaaaggatataaatactgtgtatgcttttgaattttatttttaggaaaattctgaagccagctatcacaggtttgttagctaataatagtattttcttttagttgagttaggtttttccccatctcctgtagagcgaatttacatattgtattgggtaagtgttcactacttttcctgattaagggatctgtgctggggaacaaagcttttgcagtaccttatattgtagttaaaattttatttaacatatccttcagtgagctcatttcacactgtagcctcttccttaaaatttgtggtgctcctgtaacagtaagaactaattctgaaataaaagacatctcctaatgctgtgcaaacatagtttacatgtattgaaggaggcagttgttaaattgagtgaccaatttaagcaatcagatatttgaaaactgcaccctttagttttgaaactgtgaattagaaacacttttcctgctgtattactacctgctttaacatccaaatatacagtgattttaaatgataacatactgtggttattagattaacagcttgattttgaatgttcagatgataatgcagaagacatcacttctagtaaggattttgactagtgcattgatgttgaagttggtgccatttcaaaatgtggcaggtgataatcttttaccataatttgcataaaactgtaatagaagtttattttgagatgttagtatattatgtactatgcatttctgtggtatagatgttgtggatatatttaagtatttggttacatggttttacaataaattacaatactgcaggctctaggactgaacaggagactgacatgcatatgttgtgtgaatgtcttagttgggtaaagttaaatccaaatacttcaactggctttttcttcagtttgtttgtttttaactttcaagatgcatgttttgttttgttttgctttgtttttgtctcttaagccaattcatttttctaacagttgaaattcttttagtactaaagaaatagatactgctcttttatggctttagtgtttatatacctgtttatatgcatacattaacaaaattagtaacagcagtgcttagaatttcaatgctgtgtcatactgatgattaactccatactcctagtggtgatgtggtccagatactggaatggaagtggcaggatgtggagtccagacatagtctaccactcatgctacttactagtaatattaaggtgttaaacttaggaatttgtcacatgtaggttcctgaggagatctaaaagttaatacaaaaccaagctgtttactgattttcatgagaacatttaagttagtttaggtctacctgatttattttaaaagaaggcagagggctggacgcagtggcttacgcctgtaatcccagcactttgggaggccgaggcgggcggatcacgaggtcaggagatcgagactatcctggctaacactgtgaaaacccatctctactgaaaatacaaaaaattagctgggcgtggtggcagacgcctgtagtcctagctgctacagctgaggcaggagaatggcgtgaacccaggaggcggagctggcagtgagccgagatcacgccactgcactctggcctgggcaacagagcgagagtctgtctcaaaaaaa

SEQ ID NO: 343264 - DNA, 4479 bp, Homo sapiens
agcgaaggaggcgggctttggccttttgccctagggagcgagtgcggagcgagtgggagcgagacggccctgagtggaagtgtctggctccccgtagaggcccttctgtacgccccgccgcccatgagctcgttctcacgcgaacagcgccgtcgttaggctggctctgtagcctcggcttaccccgggacaggcccacgcctcgccagggagggggcagcccgtcgaggcgcctccctagtcagcgtcggcgtcgcgctgcgaccctggaagcgggagccgccgcgagcgagaggaggagctccagtggcggcggcggcggcggcagcggcagcgggcagcagctccagcagcgccagcaggcgggatcgaggccgtcaacatggcgagcgcctcgtaccacatttccaatttgctggaaaaaatgacatccagcgacaaggactttaggtttatggctacaaatgatttgatgacggaactgcagaaagattccatcaagttggatgatgatagtgaaaggaaagtagtgaaaatgattttgaagttattggaagataaaaatggagaggtacagaatttagctgtcaaatgtcttggtcctttagtgagtaaagtgaaagaataccaagtagagacaattgtagataccctctgcactaacatgctttctgataaagaacaacttcgagacatttcaagtattggtcttaaaacagtaattggagaacttcctccagcttccagtggctctgcattagctgctaatgtatgtaaaaagattactggacgtcttacaagtgcaatagcaaaacaggaagatgtctctgttcagctagaagccttggatattatggctgatatgttgagcaggcaaggaggacttcttgttaatttccatccttcaattctgacctgtctacttccccagttgaccagccctagacttgcagtgaggaaaagaaccattatcgctcttggccatctggttatgagctgtggaaatatagtttttgtagatcttattgaacatctgttgtcagagttgtccaaaaatgattctatgtcaacaacaagaacctacatacaatgtattgctgctattagtaggcaagctggtcatagaataggtgaataccttgagaagataattcctttggtggtaaaattttgcaatgtagatgatgatgaattaagagagtactgtattcaagcctttgaatcatttgtaagaagatgtcctaaggaagtatatcctcatgtttctaccattataaatatttgtcttaaatatcttacctatgatccaaattataattacgatgatgaagatgaagatgaaaatgcaatggatgctgatggtggtgatgatgatgatcaagggagtgatgatgaatacagtgatgatgatgacatgagttggaaagtgagacgtgcagctgcgaagtgcttggatgctgtagttagcacaaggcatgaaatgcttccagaattctacaagaccgtctctcctgcactaatatccagatttaaagagcgtgaagagaatgtaaaggcagatgtttttcacgcatacctttctcttttgaagcaaactcgtcctgtacaaagttggctatgtgaccctgatgcaatggagcagggagaaacacctttaacaatgcttcagagtcaggttcccaacattgttaaagctcttcacaaacagatgaaagaaaaaagtgtgaagacccgacagtgttgttttaacatgttaactgagctggtaaatgtattacctggggccctaactcaacacattcctgtacttgtaccaggaatcattttctcactgaatgataaatcaagctcatcgaatttgaagatcgatgctttgtcatgtctatacgtaatcctctgtaaccattctcctcaagtcttccatcctcacgttcaggctttggttcctccagtggtggcttgtgttggagacccattttacaaaattacatctgaagcacttcttgttactcaacagcttgtcaaagtaattcgtcctttagatcagccttcctcgtttgatgcaactccttatatcaaagatctatttacctgtaccattaagagattaaaagcagctgacattgatcaggaagtcaaggaaagggctatttcctgtatgggacaaattatttgcaaccttggagacaatttgggttctgacttgcctaatacacttcagattttcttggagagactaaagaatgaaattaccaggttaactacagtaaaggcattgacactgattgctgggtcacctttgaagatagatttgaggcctgttctgggagaaggggttcctatccttgcttcatttcttagaaaaaaccagagagctttgaaactgggtactctttctgcccttgatattctaataaaaaactatagtgacagcttgacagctgccatgattgatgcagttctagatgagctcccacctcttatcagcgaaagtgatatgcatgtttcacaaatggccatcagttttcttaccactttggcaaaagtatatccctcctccctttcaaagataagtggatccattctcaatgaacttattggacttgtgagatcacccttattgcaggggggagctcttagtgccatgctagactttttccaagctctggttgtcactggaacaaataatttaggatacatggatttgttgcgcatgctgactggtccagtttactctcagagcacagctcttactcataagcagtcttattattccattgccaaatgtgtagctgcccttactcgagcatgccctaaagagggaccagctgtagtaggtcagtttattcaagatgtcaagaactcaaggtctacagattccattcgtctcttagctctactttctcttggagaagttgggcatcatattgacttaagtggacagttggaactaaaatctgtaatactagaagctttctcatctcctagtgaagaagtcaaatcagctgcatcctatgcattaggcagcattagtgtgggcaaccttcctgaatatctgccgtttgtcctgcaagaaataactagtcaacccaaaaggcagtatcttttacttcattccttgaaggaaattattagctctgcatcagtggtgggccttaaaccatatgttgaaaacatctgggccttattactaaagcactgtgagtgtgcagaggaaggaaccagaaatgttgttgctgaatgtctaggaaaactcactctaattgatccagaaactctccttccacggcttaaggggtacttgatatcaggctcatcatatgcccgaagctcagtggttacggctgtgaaatttacaatttctgaccatccacaacctattgatccactgttaaagaactgcataggtgatttcctaaaaactttggaagacccagatttgaatgtgagaagagtagccttggtcacatttaattcagcagcacataacaagccatcattaataagggatctattggatactgttcttccacatctttacaatgaaacaaaagttagaaaggagcttataagagaggtagaaatgggtccatttaaacatacggttgatgatggtctggatattagaaaggcagcatttgagtgtatgtacacacttctagacagttgtcttgatagacttgatatctttgaatttctaaatcatgttgaagatggtttgaaggaccattatgatattaagatgctgacatttttaatgttggtgagactgtctaccctttgtccaagtgcagtactgcagaggttggaccgacttgttgagccattacgtgcaacatgtacaactaaggtaaaggcaaactcagtaaagcaggagtttgaaaaacaagatgaattaaagcgatctgccatgagagcagtagcagcactgctaaccattccagaagcagagaagagtccactgatgagtgaattccagtcacagatcagttctaaccctgagctggcggctatctttgaaagtatccagaaagattcatcatctactaacttggaatcaatggacactagttagatgtttgttcaccatggggaccattacatatgaccatacaatgcactgaattgacaggttaatcataagacatggaaagagaagtgtctaaaagcttcaaaatgttccacttttttttccttcatggagactgtttgtttggctttcttccattgttgtttttgtagcatttatttcagaaatgtgtatttccataatccagaggttgtaaaaccactagtgttttagtggttacagcaacatttgaaatggaaactaaaagttaggattttatggagtatggagatagggtccagtatctatttaccctgtaatgtttaggattaaaatgttaaaattttgtgaccatgaatttctttcttttataaattttctcatttaaaaatcaaaaatcttgcaaaaca

SEQ ID NO: 343265 - DNA, 4350 bp, Homo sapiens
  misc_feature (23)..(23): n is a, c, g, or t
  misc_feature (25)..(25): n is a, c, g, or t
  misc_feature (32)..(32): n is a, c, g, or t
gcactgatgtcatgagtgcgagncngggttgntgggtactctttctgcccttgatattctaataaaaaactatagtgacagcttgacagctgccatgattgatgcagttctagatgagctcccacctcttatcagcgaaagtgatatgcatgtttcacaaatggccatcagttttcttaccactttggcaaaagtatatccctcctccctttcaaagataagtggatccattctcaatgaacttattggacttgtgagatcacccttattgcaggggggagctcttagtgccatgctagactttttccaagctctggttgtcactggaacaaataatttaggatacatggatttgttgcgcatgctgactggtccagtttactctcagagcacagctcttactcataagcagtcttattattccattgccaaatgtgtagctgcccttactcgagcatgccctaaagagggaccagctgtagtaggtcagtttattcaagatgtcaagaactcaaggtctacagattccattcgtctcttagctctactttctcttggagaagttgggcatcatattgacttaagtggacagttggaactaaaatctgtaatactagaagctttctcatctcctagtgaagaagtcaaatcagctgcatcctatgcattaggcagcattagtgtgggcaaccttcctgaatatctgccgtttgtcctgcaagaaataactagtcaacccaaaaggcagtatcttttacttcattccttgaaggaaattattagctctgcatcagtggtgggccttaaaccatatgttgaaaacatctgggccttattactaaagcactgtgagtgtgcagaggaaggaaccagaaatgttgttgctgaatgtctaggaaaactcactctaattgatccagaaactctccttccacggcttaaggggtacttgatatcaggctcatcatatgcccgaagctcagtggttacggctgtgaaatttacaatttctgaccatccacaacctattgatccactgttaaagaactgcataggtgatttcctaaaaactttggaagacccagatttgaatgtgagaagagtagccttggtcacatttaattcagcagcacataacaagccatcattaataagggatctattggatactgttcttccacatctttacaatgaaacaaaagttagaaaggagcttataagagaggtagaaatgggtccatttaaacatacggttgatgatggtctggatattagaaaggcagcatttgagtgtatgtacacacttctagacagttgtcttgatagacttgatatctttgaatttctaaatcatgttgaagatggtttgaaggaccattatgatattaagatgctgacatttttaatgttggtgagactgtctaccctttgtccaagtgcagtactgcagaggttggaccgacttgttgagccattacgtgcaacatgtacaactaaggtaaaggcaaactcagtaaagcaggagtttgaaaaacaagatgaattaaagcgatctgccatgagagcagtagcagcactgctaaccattccagaagcagagaagagtccactgatgagtgaattccagtcacagatcagttctaaccctgagctggcggctatctttgaaagtatccagaaagattcatcatctactaacttggaatcaatggacactagttagatgtttgttcaccatggggaccattacatatgaccatacaatgcactgaattgacaggttaatcataagacatggaaagagaagtgtctaaaagcttcaaaatgttccacttttttttccttcatggagactgtttgtttggctttcttccattgttgtttttgtagcatttatttcagaaatgtgtatttccataatccagaggttgtaaaaccactagtgttttagtggttacagcaacatttgaaatggaaactaaaagttaggattttatggagtatggagatagggtccagtatctatttaccctgtaatgtttaggattaaaatgttaaaattttgtgaccatgaatttctttcttttataaattttctcatttaaaaatcaaaaatcttgcaaaacaaaaaccatgtttctttttcttgtataactttttgttttcagcaacataaattgatttttagctggcagacaagaatatccatataagatttgttaaccatttcagagagtttggcaatttttaaaagataataaggtatcatttttaagtatgaaaattaacaatatccctgttgcgcacactaattttgcatgagtaagtttacaaatatgtatcgtctgtaaagcagcatgtgcagattattcataatatagaagttaaaataagtattagtgcaattttcagatatttatttttgcacagaaaacacattatctggagagaaagaaaggagaatttttgagacttgggttttcttaatgccagtgtgaatttgcagatgttttcagaaaatcaagtcacagtaacaatttgccacttttttctattataaatcttcttacttaaattttgaatatttagtttttctcagttacccatttgtgtgtgtgtgattccacttagaaattcttaaaaccagatttttctttcattccgtttggatgtctacattccttatcaaaggatataaatactgtgtatgcttttgaattttatttttaggaaaattctgaagccagctatcacaggtttgttagctaataatagtattttcttttagttgagttaggtttttccccatctcctgtagagcgaatttacatattgtattgggtaagtgttcactacttttcctgattaagggatctgtgctggggaacaaagcttttgcagtaccttatattgtagttaaaattttatttaacatatccttcagtgagctcatttcacactgtagcctcttccttaaaatttgtggtgctcctgtaacagtaagaactaattctgaaataaaagacatctcctaatgctgtgcaaacatagtttacatgtattgaaggaggcagttgttaaattgagtgaccaatttaagcaatcagatatttgaaaactgcaccctttagttttgaaactgtgaattagaaacacttttcctgctgtattactacctgctttaacatccaaatatacagtgattttaaatgataacatactgtggttattagattaacagcttgattttgaatgttcagatgataatgcagaagacatcacttctagtaaggattttgactagtgcattgatgttgaagttggtgccatttcaaaatgtggcaggtgataatcttttaccataatttgcataaaactgtaatagaagtttattttgagatgttagtatattatgtactatgcatttctgtggtatagatgttgtggatatatttaagtatttggttacatggttttacaataaattacaatactgcaggctctaggactgaacaggagactgacatgcatatgttgtgtgaatgtcttagttgggtaaagttaaatccaaatacttcaactggctttttcttcagtttgtttgtttttaactttcaagatgcatgttttgttttgttttgctttgtttttgtctcttaagccaattcatttttctaacagttgaaattcttttagtactaaagaaatagatactgctcttttatggctttagtgtttatatacctgtttatatgcatacattaacaaaattagtaacagcagtgcttagaatttcaatgctgtgtcatactgatgattaactccatactcctagtggtgatgtggtccagatactggaatggaagtggcaggatgtggagtccagacatagtctaccactcatgctacttactagtaatattaaggtgttaaacttaggaatttgtcacatgtaggttcctgaggagatctaaaagttaatacaaaaccaagctgtttactgattttcatgagaacatttaagttagtttaggtctacctgatttattttaaaagaaggcagagggctggacgcagtggcttacgcctgtaatcccagcactttgggaggccgaggcgggcggatcacgaggtcaggagatcgagactatcctggctaacactgtgaaaacccatctctactgaaaatacaaaaaattagctgggcgtggtggcagacgcctgtagtcctagctgctacagctgaggcaggagaatggcgtgaacccaggaggcggagctggcagtgagccgagatcacgccactgcactctggcctgggcaacagagcgagagtctgtctcaaaaaaa

SEQ ID NO: 343266 - DNA, 4482 bp, Homo sapiens
  misc_feature (4457)..(4459): n is a, c, g, or t
agcgaaggaggcgggctttggccttttgccctagggagcgagtgcggagcgagtgggagcgagacggccctgagtggaagtgtctggctccccgtagaggcccttctgtacgccccgccgcccatgagctcgttctcacgcgaacagcgccgtcgttaggctggctctgtagcctcggcttaccccgggacaggcccacgcctcgccagggagggggcagcccgtcgaggcgcctccctagtcagcgtcggcgtcgcgctgcgaccctggaagcgggagccgccgcgagcgagaggaggagctccagtggcggcggcggcggcggcagcggcagcgggcagcagctccagcagcgccagcaggcgggatcgaggccgtcaacatggcgagcgcctcgtaccacatttccaatttgctggaaaaaatgacatccagcgacaaggactttaggtttatggctacaaatgatttgatgacggaactgcagaaagattccatcaagttggatgatgatagtgaaaggaaagtagtgaaaatgattttgaagttattggaagataaaaatggagaggtacagaatttagctgtcaaatgtcttggtcctttagtgagtaaagtgaaagaataccaagtagagacaattgtagataccctctgcactaacatgctttctgataaagaacaacttcgagacatttcaagtattggtcttaaaacagtaattggagaacttcctccagcttccagtggctctgcattagctgctaatgtatgtaaaaagattactggacgtcttacaagtgcaatagcaaaacaggaagatgtctctgttcagctagaagccttggatattatggctgatatgttgagcaggcaaggaggacttcttgttaatttccatccttcaattctgacctgtctacttccccagttgaccagccctagacttgcagtgaggaaaagaaccattatcgctcttggccatctggttatgagctgtggaaatatagtttttgtagatcttattgaacatctgttgtcagagttgtccaaaaatgattctatgtcaacaacaagaacctacatacaatgtattgctgctattagtaggcaagctggtcatagaataggtgaataccttgagaagataattcctttggtggtaaaattttgcaatgtagatgatgatgaattaagagagtactgtattcaagcctttgaatcatttgtaagaagatgtcctaaggaagtatatcctcatgtttctaccattataaatatttgtcttaaatatcttacctatgatccaaattataattacgatgatgaagatgaagatgaaaatgcaatggatgctgatggtggtgatgatgatgatcaagggagtgatgatgaatacagtgatgatgatgacatgagttggaaagtgagacgtgcagctgcgaagtgcttggatgctgtagttagcacaaggcatgaaatgcttccagaattctacaagaccgtctctcctgcactaatatccagatttaaagagcgtgaagagaatgtaaaggcagatgtttttcacgcatacctttctcttttgaagcaaactcgtcctgtacaaagttggctatgtgaccctgatgcaatggagcagggagaaacacctttaacaatgcttcagagtcaggttcccaacattgttaaagctcttcacaaacagatgaaagaaaaaagtgtgaagacccgacagtgttgttttaacatgttaactgagctggtaaatgtattacctggggccctaactcaacacattcctgtacttgtaccaggaatcattttctcactgaatgataaatcaagctcatcgaatttgaagatcgatgctttgtcatgtctatacgtaatcctctgtaaccattctcctcaagtcttccatcctcacgttcaggctttggttcctccagtggtggcttgtgttggagacccattttacaaaattacatctgaagcacttcttgttactcaacagcttgtcaaagtaattcgtcctttagatcagccttcctcgtttgatgcaactccttatatcaaagatctatttacctgtaccattaagagattaaaagcagctgacattgatcaggaagtcaaggaaagggctatttcctgtatgggacaaattatttgcaaccttggagacaatttgggttctgacttgcctaatacacttcagattttcttggagagactaaagaatgaaattaccaggttaactacagtaaaggcattgacactgattgctgggtcacctttgaagatagatttgaggcctgttctgggagaaggggttcctatccttgcttcatttcttagaaaaaaccagagagctttgaaactgggtactctttctgcccttgatattctaataaaaaactatagtgacagcttgacagctgccatgattgatgcagttctagatgagctcccacctcttatcagcgaaagtgatatgcatgtttcacaaatggccatcagttttcttaccactttggcaaaagtatatccctcctccctttcaaagataagtggatccattctcaatgaacttattggacttgtgagatcacccttattgcaggggggagctcttagtgccatgctagactttttccaagctctggttgtcactggaacaaataatttaggatacatggatttgttgcgcatgctgactggtccagtttactctcagagcacagctcttactcataagcagtcttattattccattgccaaatgtgtagctgcccttactcgagcatgccctaaagagggaccagctgtagtaggtcagtttattcaagatgtcaagaactcaaggtctacagattccattcgtctcttagctctactttctcttggagaagttgggcatcatattgacttaagtggacagttggaactaaaatctgtaatactagaagctttctcatctcctagtgaagaagtcaaatcagctgcatcctatgcattaggcagcattagtgtgggcaaccttcctgaatatctgccgtttgtcctgcaagaaataactagtcaacccaaaaggcagtatcttttacttcattccttgaaggaaattattagctctgcatcagtggtgggccttaaaccatatgttgaaaacatctgggccttattactaaagcactgtgagtgtgcagaggaaggaaccagaaatgttgttgctgaatgtctaggaaaactcactctaattgatccagaaactctccttccacggcttaaggggtacttgatatcaggctcatcatatgcccgaagctcagtggttacggctgtgaaatttacaatttctgaccatccacaacctattgatccactgttaaagaactgcataggtgatttcctaaaaactttggaagacccagatttgaatgtgagaagagtagccttggtcacatttaattcagcagcacataacaagccatcattaataagggatctattggatactgttcttccacatctttacaatgaaacaaaagttagaaaggagcttataagagaggtagaaatgggtccatttaaacatacggttgatgatggtctggatattagaaaggcagcatttgagtgtatgtacacacttctagacagttgtcttgatagacttgatatctttgaatttctaaatcatgttgaagatggtttgaaggaccattatgatattaagatgctgacatttttaatgttggtgagactgtctaccctttgtccaagtgcagtactgcagaggttggaccgacttgttgagccattacgtgcaacatgtacaactaaggtaaaggcaaactcagtaaagcaggagtttgaaaaacaagatgaattaaagcgatctgccatgagagcagtagcagcactgctaaccattccagaagcagagaagagtccactgatgagtgaattccagtcacagatcagttctaaccctgagctggcggctatctttgaaagtatccagaaagattcatcatctactaacttggaatcaatggacactagttagatgtttgttcaccatggggaccattacatatgaccatacaatgcactgaattgacaggttaatcataagacatggaaagagaagtgtctaaaagcttcaaaatgttccacttttttttccttcatggagactgtttgtttggctttcttccattgttgtttttgtagcatttatttcagaaatgtgtatttccataatccagaggttgtaaaaccactagtgttttagtggttacagcaacatttgaaatggaaactaaaagttaggattttatggagtatggagatagggtccagtatctatttaccctgtaatgtttaggattaaaatgttaaaattttgtgaccatgaaaaaaaaaaaaaaaaaaaaaaaaaaaaaaannnaaaaaaaaaaaaaaaaaaaaaaa

SEQ ID NO: 343267 - DNA, 3983 bp, Homo sapiens
ctgcccttactcgagcatgccctaaagagggaccagtcatggttttaaacgtatggtcagtttattcaatagactgatcaaggtaactcaaaggatcatacagagtttgccaaaatatccgggtccctcgtgtaagggccatgccctaagccgtgtatccatacctgggggaccgaaaccggttctagcgcgacctcagtaacttctggggacttaagtggacagttggaactaaaatctgtaatactagaagctttctcatctcctagtgaagaagtcaaatcagctgcatcctatgcattaggcagcattagtgtgggcaaccttcctgaatatctgccgtttgtcctgcaagaaataactagtcaacccaaaaggcagtatcttttacttcattccttgaaggaaattattagctctgcatcagtggtgggccttaaaccatatgttgaaaacatctgggccttattactaaagcactgtgagtgtgcagaggaaggaaccagaaatgttgttgctgaatgtctaggaaaactcactctaattgatccagaaactctccttccacggcttaaggggtacttgatatcaggctcatcatatgcccgaagctcagtggttacggctgtgaaatttacaatttctgaccatccacaacctattgatccactgttaaagaactgcataggtgatttcctaaaaactttggaagacccagatttgaatgtgagaagagtagccttggtcacatttaattcagcagcacataacaagccatcattaataagggatctattggatactgttcttccacatctttacaatgaaacaaaagttagaaaggagcttataagagaggtagaaatgggtccatttaaacatacggttgatgatggtctggatattagaaaggcagcatttgagtgtatgtacacacttctagacagttgtcttgatagacttgatatctttgaatttctaaatcatgttgaagatggtttgaaggaccattatgatattaagatgctgacatttttaatgttggtgagactgtctaccctttgtccaagtgcagtactgcagaggttggaccgacttgttgagccattacgtgcaacatgtacaactaaggtaaaggcaaactcagtaaagcaggagtttgaaaaacaagatgaattaaagcgatctgccatgagagcagtagcagcactgctaaccattccagaagcagagaagagtccactgatgagtgaattccagtcacagatcagttctaaccctgagctggcggctatctttgaaagtatccagaaagattcatcatctactaacttggaatcaatggacactagttagatgtttgttcaccatggggaccattacatatgaccatacaatgcactgaattgacaggttaatcataagacatggaaagagaagtgtctaaaagcttcaaaatgttccacttttttttccttcatggagactgtttgtttggctttcttccattgttgtttttgtagcatttatttcagaaatgtgtatttccataatccagaggttgtaaaaccactagtgttttagtggttacagcaacatttgaaatggaaactaaaagttaggattttatggagtatggagatagggtccagtatctatttaccctgtaatgtttaggattaaaatgttaaaattttgtgaccatgaatttctttcttttataaattttctcatttaaaaatcaaaaatcttgcaaaacaaaaaccatgtttctttttcttgtataactttttgttttcagcaacataaattgatttttagctggcagacaagaatatccatataagatttgttaaccatttcagagagtttggcaatttttaaaagataataaggtatcatttttaagtatgaaaattaacaatatccctgttgcgcacactaattttgcatgagtaagtttacaaatatgtatcgtctgtaaagcagcatgtgcagattattcataatatagaagttaaaataagtattagtgcaattttcagatatttatttttgcacagaaaacacattatctggagagaaagaaaggagaatttttgagacttgggttttcttaatgccagtgtgaatttgcagatgttttcagaaaatcaagtcacagtaacaatttgccacttttttctattataaatcttcttacttaaattttgaatatttagtttttctcagttacccatttgtgtgtgtgtgattccacttagaaattcttaaaaccagatttttctttcattccgtttggatgtctacattccttatcaaaggatataaatactgtgtatgcttttgaattttatttttaggaaaattctgaagccagctatcacaggtttgttagctaataatagtattttcttttagttgagttaggtttttccccatctcctgtagagcgaatttacatattgtattgggtaagtgttcactacttttcctgattaagggatctgtgctggggaacaaagcttttgcagtaccttatattgtagttaaaattttatttaacatatccttcagtgagctcatttcacactgtagcctcttccttaaaatttgtggtgctcctgtaacagtaagaactaattctgaaataaaagacatctcctaatgctgtgcaaacatagtttacatgtattgaaggaggcagttgttaaattgagtgaccaatttaagcaatcagatatttgaaaactgcaccctttagttttgaaactgtgaattagaaacacttttcctgctgtattactacctgctttaacatccaaatatacagtgattttaaatgataacatactgtggttattagattaacagcttgattttgaatgttcagatgataatgcagaagacatcacttctagtaaggattttgactagtgcattgatgttgaagttggtgccatttcaaaatgtggcaggtgataatcttttaccataatttgcataaaactgtaatagaagtttattttgagatgttagtatattatgtactatgcatttctgtggtatagatgttgtggatatatttaagtatttggttacatggttttacaataaattacaatactgcaggctctaggactgaacaggagactgacatgcatatgttgtgtgaatgtcttagttgggtaaagttaaatccaaatacttcaactggctttttcttcagtttgtttgtttttaactttcaagatgcatgttttgttttgttttgctttgtttttgtctcttaagccaattcatttttctaacagttgaaattcttttagtactaaagaaatagatactgctcttttatggctttagtgtttatatacctgtttatatgcatacattaacaaaattagtaacagcagtgcttagaatttcaatgctgtgtcatactgatgattaactccatactcctagtggtgatgtggtccagatactggaatggaagtggcaggatgtggagtccagacatagtctaccactcatgctacttactagtaatattaaggtgttaaacttaggaatttgtcacatgtaggttcctgaggagatctaaaagttaatacaaaaccaagctgtttactgattttcatgagaacatttaagttagtttaggtctacctgatttattttaaaagaaggcagagggctggacgcagtggcttacgcctgtaatcccagcactttgggaggccgaggcgggcggatcacgaggtcaggagatcgagactatcctggctaacactgtgaaaacccatctctactgaaaatacaaaaaattagctgggcgtggtggcagacgcctgtagtcctagctgctacagctgaggcaggagaatggcgtgaacccaggaggcggagctggcagtgagccgagatcacgccactgcactctggcctgggcaacagagcgagagtctgtctcaaaaaaa

SEQ ID NO: 343268 - DNA, 3185 bp, Homo sapiens
  misc_feature (48)..(49): n is a, c, g, or t
  misc_feature (56)..(56): n is a, c, g, or t
tcgtctagaggatcccatgagcagcatattataggtgaggtctctttnncacttantcaggtaaggttgagacaaatctgtctgattctgattgggcagattacattaaaaggaaggtttactttgcatgctagttattttcctttaaaggatttgtcagaatttagtattttgtttttagaaaatgatgtcaaatctaaattctgtcttttttattcctaatagatgctgacatttttaatgttggtgagactgtctaccctttgtccaagtgcagtactgcagaggttggaccgacttgttgagccattacgtgcaacatgtacaactaaggtaaaggcaaactcagtaaagcaggagtttgaaaaacaagatgaattaaagcgatctgccatgagagcagtagcagcactgctaaccattccagaagcagagaagagtccactgatgagtgaattccagtcacagatcagttctaaccctgagctggcggctatctttgaaagtatccagaaagattcatcatctactaacttggaatcaatggacactagttagatgtttgttcaccatggggaccattacatatgaccatacaatgcactgaattgacaggttaatcataagacatggaaagagaagtgtctaaaagcttcaaaatgttccacttttttttccttcatggagactgtttgtttggctttcttccattgttgtttttgtagcatttatttcagaaatgtgtatttccataatccagaggttgtaaaaccactagtgttttagtggttacagcaacatttgaaatggaaactaaaagttaggattttatggagtatggagatagggtccagtatctatttaccctgtaatgtttaggattaaaatgttaaaattttgtgaccatgaatttctttcttttataaattttctcatttaaaaatcaaaaatcttgcaaaacaaaaaccatgtttctttttcttgtataactttttgttttcagcaacataaattgatttttagctggcagacaagaatatccatataagatttgttaaccatttcagagagtttggcaatttttaaaagataataaggtatcatttttaagtatgaaaattaacaatatccctgttgcgcacactaattttgcatgagtaagtttacaaatatgtatcgtctgtaaagcagcatgtgcagattattcataatatagaagttaaaataagtattagtgcaattttcagatatttatttttgcacagaaaacacattatctggagagaaagaaaggagaatttttgagacttgggttttcttaatgccagtgtgaatttgcagatgttttcagaaaatcaagtcacagtaacaatttgccacttttttctattataaatcttcttacttaaattttgaatatttagtttttctcagttacccatttgtgtgtgtgtgattccacttagaaattcttaaaaccagatttttctttcattccgtttggatgtctacattccttatcaaaggatataaatactgtgtatgcttttgaattttatttttaggaaaattctgaagccagctatcacaggtttgttagctaataatagtattttcttttagttgagttaggtttttccccatctcctgtagagcgaatttacatattgtattgggtaagtgttcactacttttcctgattaagggatctgtgctggggaacaaagcttttgcagtaccttatattgtagttaaaattttatttaacatatccttcagtgagctcatttcacactgtagcctcttccttaaaatttgtggtgctcctgtaacagtaagaactaattctgaaataaaagacatctcctaatgctgtgcaaacatagtttacatgtattgaaggaggcagttgttaaattgagtgaccaatttaagcaatcagatatttgaaaactgcaccctttagttttgaaactgtgaattagaaacacttttcctgctgtattactacctgctttaacatccaaatatacagtgattttaaatgataacatactgtggttattagattaacagcttgattttgaatgttcagatgataatgcagaagacatcacttctagtaaggattttgactagtgcattgatgttgaagttggtgccatttcaaaatgtggcaggtgataatcttttaccataatttgcataaaactgtaatagaagtttattttgagatgttagtatattatgtactatgcatttctgtggtatagatgttgtggatatatttaagtatttggttacatggttttacaataaattacaatactgcaggctctaggactgaacaggagactgacatgcatatgttgtgtgaatgtcttagttgggtaaagttaaatccaaatacttcaactggctttttcttcagtttgtttgtttttaactttcaagatgcatgttttgttttgttttgctttgtttttgtctcttaagccaattcatttttctaacagttgaaattcttttagtactaaagaaatagatactgctcttttatggctttagtgtttatatacctgtttatatgcatacattaacaaaattagtaacagcagtgcttagaatttcaatgctgtgtcatactgatgattaactccatactcctagtggtgatgtggtccagatactggaatggaagtggcaggatgtggagtccagacatagtctaccactcatgctacttactagtaatattaaggtgttaaacttaggaatttgtcacatgtaggttcctgaggagatctaaaagttaatacaaaaccaagctgtttactgattttcatgagaacatttaagttagtttaggtctacctgatttattttaaaagaaggcagagggctggacgcagtggcttacgcctgtaatcccagcactttgggaggccgaggcgggcggatcacgaggtcaggagatcgagactatcctggctaacactgtgaaaacccatctctactgaaaatacaaaaaattagctgggcgtggtggcagacgcctgtagtcctagctgctacagctgaggcaggagaatggcgtgaacccaggaggcggagctggcagtgagccgagatcacgccactgcactctggcctgggcaacagagcgagagtctgtctcaaaaaaa

SEQ ID NO: 343269 - DNA, 1452 bp, Homo sapiens
agcgaaggaggcgggctttggccttttgccctagggagcgagtgcggagcgagtgggagcgagacggccctgagtggaagtgtctggctccccgtagaggcccttctgtacgccccgccgcccatgagctcgttctcacgcgaacagcgccgtcgttaggctggctctgtagcctcggcttaccccgggacaggcccacgcctcgccagggagggggcagcccgtcgaggcgcctccctagtcagcgtcggcgtcgcgctgcgaccctggaagcgggagccgccgcgagcgagaggaggagctccagtggcggcggcggcggcggcagcggcagcgggcagcagctccagcagcgccagcaggcgggatcgaggccgtcaacatggcgagcgcctcgtaccacatttccaatttgctggaaaaaatgacatccagcgacaaggactttaggtgaggccgagatccgaccctcaccccacctcggggttctcgcagccgcggccctggccgtcacgcaggccttgccccaccccttcggctgtagccggtagcttctctgccccgaagtctccatgcccaccggtccgctggcctcccgatccctgcggagcccctgttcctctcccctctttgcaaccgcaaccccctccccccattctttctcctaggcagttgcccgccgcggtctctaggccccgtttgcttgtctcagcgcccccacatccttccctgccccaccaggaggcgattcttgcgtctcaggtagcgcgaaggggctaaaccacccaccattgtggagaagggagttgctctaggccgggagaccgggcgccgggcctattcgcttgccatcctgcggcgctaggccgccgtgctcgctggggcccaagctgctgcccactcggggacccggcagcctcctctctgcccgcaggtgcgcgtgggccttgctgcattcaggtggaatgatgaacttttgcgctcttggctgatacatagttcttttgtggattattaattttcgtgaaggtgggaagaagggggaggggagccaggatggaggaaacttcgctcatagggttttcccgccagcatcactgtcagttcctcttgtcaggtaaaaccaacttaggaactcggggtttcagtctcatgtcctcatatccaaaatcactgccaaaggggtggattgctggatcttaatcatagcagacggatcttcaaaaggaagagatgtttaatacggacctggtgaatatgaagctttattacagcagttctgttcaggagatcggtactgttggttccaaagtgttgtaatatgcatagtgaagatttgttatatttttacaggttatctttgtttttatttttccttgcacgcttcggtgatttggcttgcagttgattaaagccgcgcgggccattcttcttccactacattaagtctag

SEQ ID NO: 343270 - DNA, 855 bp, Homo sapiens
gtccctttcacaatgcatcggaattatgagagctacaattgaagatgagatttgggtggggacacaggcaaaccatatcagaccccaagatctcttttcagctctataggctgatccctgtgacttgcatcttgcagaagaaaacaatggcttttcagtgccttttttgtaaataatatggctgcatagtcagagaatatgggagacagtgtctcctttattttgaagacataattgtggtttggtggaaagagctctggactaagagacagaaggcctaggttttacttttagcttcaataccatgtggccatgtgaccggaggaaggttgactcttctgaacttcagttcctctacctgagaaacaagaagcttggactggactggctctaggctcttgtcagctctgacatctgggcaaggatgccaggtgcctcacctactgctccagatgtcccaggagaggtttccatgcaggatttcaacttgctgaaagcacgtgcgtctttcctaatgaatgactgggattccttcacaggtgaaaatctctaaacctctgggaaagtctgtaatgtcacagcaaactcatcttctttgtatgataaaaccgaggtctttcctctggttgatgataaggggagacagagttcttgtcatagtacttgaactaggggacaagcaaaagggccacataggaaaggcttttggttgttgcttaataaaagcaacaataaggttttggaaaggctttaattcatcgctcatgtagaaggtagccgggcctgaatttctagaagatccaaagctgggagcaagtcacatggctgcacggagaactaccatggccaccctgg

SEQ ID NO: 343271 - DNA, 290 bp, Homo sapiens
aagctcccaacaagagctagagaaataagcaaacaagatgtaaattaatcatctgttggcaaaagaggaaagaaataggagctgagggtgtatgagagcaaaaatccaggtattttaaatagttggttaaaggaggtgaccacaaataagaaagggagtaaaatcaaatttaaaaaatatatgcaagctcacttcaagctcatgtatttgcaaaatcccaagaaatagcgagtagcacacaaaccagtcctgtggttcagcaatcaggaatgtggtgatcttgttggagc

SEQ ID NO: 343272 - DNA, 1533 bp, Homo sapiens
tggaactaaaaagtcgtatattattatcccacagattttagctatttcaccttgatggagtgatgaatgattcacattagaacagatgattcacagacttcacaaggcagaaattttagcgcctgtcaaatcagagaaatggtccaggataaaaagggaaagaggacacagttaggtcctgttaatgcaggggtttggctaatgcttactttcttctgtttgtttatgtgtctatccacactcttcaggtataagtctacctacctatcgatcgagcaggtatttgttaagcagtttctgagtgctagccctggagatatttgcatctgaggggtaaataaataacatccctctcttccttttcaggttcctgaaccaactgagaaagagagatgcttaagatcaaatgtgaaccttaatactaagaaggctaattgaaaaactgatttcagttctacaactaaatgggcttactaacacttctctggcaacagatagacatttccaccttgtcattgacatagatgggcagcaatactcacctctttggcagagggagaatcataccccacagtgaaataatgaatcggctattgcccatttctgtggcctgattgatgagggagagaaaagatcaataagaggctgagttgatcatgtttagtttcctctctgaaatccacaatttggtagaggtagacatagagacagattataaatgattgcttcctctcttgggtgataaagtggaaattatcttctctctgtaagaacataagaagtgggggaaaattgtccagggaaaagtcctggaagtgtgaattattgtaacaatgagtagtttgatgtccttggagcataggatgtggcctgggaagagacccatgcattaatatcattattaattccatgcattaatatcattattaattctatgcattaatgttattaattccatgaatgtggcaggtatttttttaacatttattgtaggctcagctgtctactgggtgttctgagaaaatacaaggaagctatagtaatgcagtgtatacatacattctttcctgcatattaggaacctatagtctaattggggatgtaagctttcacgcatgaaaagacaggtaaatgtagaagacaatttcttatgagtttcagtgagtcatgcagacagtactggaggagttcacaggtggaaggggatgcagggaatgagagttatggagaggaactaggagatcaggaaagtctttctgggggagtgaagatttgactggactttaaaaaatggaacatgcatggaccatttgagggatggtgaagaaatcaccccaactggaataaatgtgttgggtagtgggagatgagtctaggaaggtggtttggagttatattttgaaggatcttgttgggtgaagtaaggatccatggacttgctctttgcaccccgactatgttccttcaccctttatcgcctcgatccgatgtctcttaacccgtccctacagctctacttcttcattctcccgg

SEQ ID NO: 343273 - DNA, 1987 bp, Homo sapiens
agtgggaggtgctgagccgcctgatttattccggtcccagaggagaaggcgccagaaccccgcggggtctgagcagcccagcgtgcccattccagcgcccgcgtccccgcagcatgccgcgcccccgcctgctggccgcgctgtgcggcgcgctgctctgcgcccccagcctcctcgtcgccctggatatctgttccaaaaacccctgccacaacggtggtttatgcgaggagatttcccaagaagtgcgaggagatgtcttcccctcgtacacctgcacgtgccttaagggctacgcgggcaaccactgtgagacgaaatgtgtcgagccactgggcatggagaatgggaacattgccaactcacagatcgccgcctcatctgtgcgtgtgaccttcttgggtttgcagcattgggtcccggagctggcccgcctgaaccgcgcaggcatggtcaatgcctggacacccagcagcaatgacgataacccctggatccaggtgaacctgctgcggaggatgtgggtaacaggtgtggtgacgcagggtgccagccgcttggccagtcatgagtacctgaaggccttcaaggtggcctacagccttaatggacacgaattcgatttcatccatgatgttaataaaaaacacaaggagtttgtgggtaactggaacaaaaacgcggtgcatgtcaacctgtttgagacccctgtggaggctcagtacgtgagattgtaccccacgagctgccacacggcctgcactctgcgctttgagctactgggctgtgagctgaacggatgcgccaatcccctgggcctgaagaataacagcatccctgacaagcagatcacggcctccagcagctacaagacctggggcttgcatctcttcagctggaacccctcctatgcacggctggacaagcagggcaacttcaacgcctgggttgcggggagctacggtaacgatcagtggctgcaggtggacctgggctcctcgaaggaggtgacaggcatcatcacccagggggcccgtaactttggctctgtccagtttgtggcatcctacaaggttgcctacagtaatgacagtgcgaactggactgagtaccaggaccccaggactggcagcagtaagatcttccctggcaactgggacaaccactcccacaagaagaacttgtttgagacgcccatcctggctcgctatgtgcgcatcctgcctgtagcctggcacaaccgcatcgccctgcgcctggagctgctgggctgttagtggccacctgccacccccaggtcttcctgctttccatgggcccgctgcctcttggcttctcagcccctttaaatcaccatagggctggggactggggaaggggagggtgttcagaggcagcaccaccacacagtcacccctccctccctctttcccaccctccacctctcacgggccctgccccagcccctaagccccgtcccctaacccccagtcctcactgtcctgttttcttaggcactgagggatctgagtaggtctgggatggacaggaaagggcaaagtagggcgtgtggtttccctgcccctgtccggaccgccgatcccaggtgcgtgtgtctctgtctctcctagcccctctctcacacatcacattcccatggtggcctcaagaaaggcccggaagcgccaggctggagataacagcctcttgcccgtcggccctgcgtcggccctggggtaccatgtggccacaactgctgtggccccctgtccccaagacacttccccttgtctccctggttgcctctcttgccccttgtcctgaagcccagcgacacagaagggggtggggcgggtctatggggagaaagggagcgaggtcagaggagggcatgggttggcagggtgggcgtttggggccctctatgctggcttttcaccccagaggacacaggcagcttccaaaatatatttatcttcttcacggg

SEQ ID NO: 343274 - DNA, 1831 bp, Homo sapiens
agtgggaggtgctgagccgcctgatttattccggtcccagaggagaaggcgccagaaccccgcggggtctgagcagcccagcgtgcccattccagcgcccgcgtccccgcagcatgccgcgcccccgcctgctggccgcgctgtgcggcgcgctgctctgcgcccccagcctcctcgtcgccctggatatctgttccaaaaacccctgccacaacggtggtttatgcgaggagatttcccaagaagtgcgaggagatgtcttcccctcgtacacctgcacgtgccttaagggctacgcgggcaaccactgtgagacgaaatgtgtcgagccactgggcatggagaatgggaacattgccaactcacagatcgccgcctcatctgtgcgtgtgaccttcttgggtttgcagcattgggtcccggagctggcccgcctgaaccgcgcaggcatggtcaatgcctggacacccagcagcaatgacgataacccctggatccaggtgaacctgctgcggaggatgtgggtaacaggtgtggtgacgcagggtgccagccgcttggccagtcatgagtacctgaaggccttcaaggtggcctacagccttaatggacacgaattcgatttcatccatgatgttaataaaaaacacaaggagtttgtgggtaactggaacaaaaacgcggtgcatgtcaacctgtttgagacccctgtggaggctcagtacgtgagattgtaccccacgagctgccacacggcctgcactctgcgctttgagctactgggctgtgagctgaacggatgcgccaatcccctgggcctgaagaataacagcatccctgacaagcagatcacggcctccagcagctacaagacctggggcttgcatctcttcagctggaacccctcctatgcacggctggacaagcagggcaacttcaacgcctgggttgcggggagctacggtaacgatcagtggctgcagatcttccctggcaactgggacaaccactcccacaagaagaacttgtttgagacgcccatcctggctcgctatgtgcgcatcctgcctgtagcctggcacaaccgcatcgccctgcgcctggagctgctgggctgttagtggccacctgccacccccaggtcttcctgctttccatgggcccgctgcctcttggcttctcagcccctttaaatcaccatagggctggggactggggaaggggagggtgttcagaggcagcaccaccacacagtcacccctccctccctctttcccaccctccacctctcacgggccctgccccagcccctaagccccgtcccctaacccccagtcctcactgtcctgttttcttaggcactgagggatctgagtaggtctgggatggacaggaaagggcaaagtagggcgtgtggtttccctgcccctgtccggaccgccgatcccaggtgcgtgtgtctctgtctctcctagcccctctctcacacatcacattcccatggtggcctcaagaaaggcccggaagcgccaggctggagataacagcctcttgcccgtcggccctgcgtcggccctggggtaccatgtggccacaactgctgtggccccctgtccccaagacacttccccttgtctccctggttgcctctcttgccccttgtcctgaagcccagcgacacagaagggggtggggcgggtctatggggagaaagggagcgaggtcagaggagggcatgggttggcagggtgggcgtttggggccctctatgctggcttttcaccccagaggacacaggcagcttccaaaatatatttatcttcttcacggg

SEQ ID NO: 343275 - DNA, 672 bp, Homo sapiens
  misc_feature (93)..(93): n is a, c, g, or t
  misc_feature (99)..(99): n is a, c, g, or t
  misc_feature (119)..(119): n is a, c, g, or t
tctatttccatctcatacacccttcacctcaatcatattcttttacagcctctcctttatactccctatcttctctacattttctctactccnaagccnctcctctttctttttctctnatcttctacttttaagggccctgccccagcccctaagccccgtcccctaacccccagtcctcactgtcctgttttcttaggcactgagggatctgagtaggtctgggatggacaggaaagggcaaagtagggcgtgtggtttccctgcccctgtccggaccgccgatcccaggtgcgtgtgtctctgtctctcctagcccctctctcacacatcacattcccatggtggcctcaagaaaggcccggaagcgccaggctggagataacagcctcttgcccgtcggccctgcgtcggccctggggtaccatgtggccacaactgctgtggccccctgtccccaagacacttccccttgtctccctggttgcctctcttgccccttgtcctgaagcccagcgacacagaagggggtggggcgggtctatggggagaaagggagcgaggtcagaggagggcatgggttggcagggtgggcgtttggggccctctatgctggcttttcaccccagaggacacaggcagcttccaaaatatatttatcttcttcacggg

SEQ ID NO: 343276 - DNA, 963 bp, Homo sapiens
ggagcctctctttgagggggaaggtggtggttccctggtgcatcaccatcaggagatgatggtaccatcagcaggcattgtcaacacaccctggaggcaaatgtcttgagtggtgagagtacaggtgggcagtgatataacttagctggctcccagtactcttgagtggtgagagtattggagggcagtgatataacttagctggctcccagagggcagggggctctccagtcccaccgtccactcctgcctccctcaattccccagagggatagacacttgtggagtgaggattcttccaggtgggagacacccccatcattctcttgggagttgtatctcttgcccatccccaactgttctatccatatgcaggtgcagatacaagtgcaaggcagcccggcacattcctgagtgtttggggcagggctgagtgaaacaaaggccagcttcccgggccagccctcacaggcctgtgtgacagcatccccagaacatttgagtgtgcgaaggccctctgggagacactaagtcagggggcttctggggaatggaaatagagatgttcctgtgccccaggagttgtctgatttctctaactgccagctgctggagggcagggatgttgtcctgttcatcactgggtcgtcactaggcaggccttcatcatctagctgggatgtgtagctggtagaggtgacgtcatagtgtgacattaggagtttgtatgtgacttgagcatgatgcttaatgtctttcagttttctcatctatagaatgggcttactaatttctacttcatttagtgtttttttttcttttttttttggtggcaggttaaatgactgaagtaagcactgaataaacaatgtggttgttattaaagtagatagtgactgtgccatgggacggatgggaggccgaggcgatgggggcagtgctgtgagtccagaagaggaagaa

SEQ ID NO: 343277 - DNA, 883 bp, Homo sapiens
ggagcctctctttgagggggaaggtggtggttccctggtgcatcaccatcaggagatgatggtaccatcagcaggcattgtcaacacaccctggaggcaaatgtcttgagtggtgagagtacaggtgggcagtgatataacttagctggctcccagtactcttgagtggtgagagtattggagggcagtgatataacttagctggctcccagagggcagggggctctccagtcccaccgtccactcctgcctccctcaattccccagagggatagacacttgtggagtgaggattcttccaggtgggagacacccccatcattctcttgggagttgtatctcttgcccatccccaactgttctatccatatgcaggtgcagatacaagtgcaaggcagcccggcacattcctgagtgtttggggcagggctgagtgaaacaaaggccagcttcccgggccagccctcacaggcctgtgtgacagcatccccagaacatttgagtgtgcgaaggccctctgggagacactaagtcagggggcttctggggaatggaaatagagatgttcctgtgccccaggagttgtctgatttctctaactgccagctgctggagggcagggatgttgtcctgttcatcactgggtcgtcactaggcaggccttcatcatctagctgggatgtgtagctggtagaggtgacgtcatagtgtgacattaggagtttgtatgtgacttgagcatgatgcttaatgtctttcagttttctcatctatagaatgggcttactaatttctacttcatttagtgtttttttttcttttttttttggtggcaggttaaatgactgaagtaagcactgaataaacaatgtggttgttatta

SEQ ID NO: 343278 - DNA, 460 bp, Homo sapiens
tgtgtgggtggggctgaggtctgggggtacctgggattccacaagggattcctctttgcagacatatggtgtctttggtaaattaattatttaattcgatggatgtttattaagatattgattaagcccctcctgggtgcttggctctagggaatgattccttgacctcatgtaatttgcattgtagcaaggaaggcagacttgaggcgaggagcagatgacagagagcagtaacagctctgaagaaaagctagaggctgatgagatgaccatgacttggggtgaggggagagagcaagacaaggactgctctgtcgggaaggcctttgactgggggcctgaatgatggagagccagccacatgaaaaacttaaaaacagcactgcaaaaagagcactgcaggcaaggaattggttaaatgactgaagtaagcactgaataaacaatgtggttgttatta

SEQ ID NO: 343279 - DNA, 704 bp, Homo sapiens
cgaaccccttccacctgggagattctaggactctagtatggataagtcttgtctggataactttgtcctggccatctccctgccaactccagttggctggacagttcattggatttttgcgctcccaattgtccgtgcctggtcacataagggaagggccggggagtcggtgcaatggacgcaggccgtaagtggggcccgggaggggacccagaggcttcgaggagcttggaagagggctgcctgctgatgggagtctcctgactccctccctcccgcggccttggccggctgctgtatcttccccggtcctcctccgcctcccaggaggcctccggaggccagctgggccccttgcaggctggacttgcggatgccccgtgccattcaccgtggagcgctgggagggagtcagggccaggactctttaggtggcccctccatcattttctcatagaaatgggattgactgaagcaaggtaggtaacagctgagccccagccctatgtcctgtgatctgcctgaccctcggggctagagcttccagagtgctccaagctcccaggaacttgggagctcctggccctccccggccaccatgaaagacagctggatcttcttagcccctttctactcttccctgtaccccccaactgcactccagcctgggtgacagagcgagactgtgtctcaaacaaacaaac

SEQ ID NO: 343280 - DNA, 2532 bp, Homo sapiens
  misc_feature (2054)..(2055): n is a, c, g, or t
  misc_feature (2057)..(2057): n is a, c, g, or t
agtgggaggtgctgagccgcctgatttattccggtcccagaggagaaggcgccagaaccccgcggggtctgagcagcccagcgtgcccattccagcgcccgcgtccccgcagcatgccgcgcccccgcctgctggccgcgctgtgcggcgcgctgctctgcgcccccagcctcctcgtcgccctggatatctgttccaaaaacccctgccacaacggtggtttatgcgaggagatttcccaagaagtgcgaggagatgtcttcccctcgtacacctgcacgtgccttaagggctacgcgggcaaccactgtgagacgaaatgtgtcgagccactgggcatggagaatgggaacattgccaactcacagatcgccgcctcatctgtgcgtgtgaccttcttgggtttgcagcattgggtcccggagctggcccgcctgaaccgcgcaggcatggtcaatgcctggacacccagcagcaatgacgataacccctggatccaggtgaacctgctgcggaggatgtgggtaacaggtgtggtgacgcagggtgccagccgcttggccagtcatgagtacctgaaggccttcaaggtggcctacagccttaatggacacgaattcgatttcatccatgatgttaataaaaaacacaaggagtttgtgggtaactggaacaaaaacgcggtgcatgtcaacctgtttgagacccctgtggaggctcagtacgtgagattgtaccccacgagctgccacacggcctgcactctgcgctttgagctactgggctgtgagctgaacggatgcgccaatcccctgggcctgaagaataacagcatccctgacaagcagatcacggcctccagcagctacaagacctggggcttgcatctcttcagctggaacccctcctatgcacggctggacaagcagggcaacttcaacgcctgggttgcggggagctacggtaacgatcagtggctgcaggtggacctgggctcctcgaaggaggtgacaggcatcatcacccagggggcccgtaactttggctctgtccagtttgtggcatcctacaaggttgcctacagtaatgacagtgcgaactggactgagtaccaggaccccaggactggcagcagtaagatcttccctggcaactgggacaaccactcccacaagaagaacttgtttgagacgcccatcctggctcgctatgtgcgcatcctgcctgtagcctggcacaaccgcatcgccctgcgcctggagctgctgggctgttagtggccacctgccacccccaggtcttcctgctttccatgggcccgctgcctcttggcttctcagcccctttaaatcaccatagggctggggactggggaaggggagggtgttcagaggcagcaccaccacacagtcacccctccctccctctttcccaccctccacctctcacgggccctgccccagcccctaagccccgtcccctaacccccagtcctcactgtcctgttttcttaggcactgagggatctgagtaggtctgggatggacaggaaagggcaaagtagggcgtgtggtttccctgcccctgtccggaccgccgatcccaggtgcgtgtgtctctgtctctcctagcccctctctcacacatcacattcccatggtggcctcaagaaaggcccggaagcgccaggctggagataacagcctcttgcccgtcggccctgcgtcggccctggggtaccatgtggccacaactgctgtggccccctgtccccaagacacttccccttgtctccctggttgcctctcttgccccttgtcctgaagcccagcgacacagaagggggtggggcgggtctatggggagaaagggagcgaggtcagaggagggcatgggttggcagggtgggcgtttggggccctctatgctggcttttcaccccagaggacacaggcagcttccaaaatatatttatcttcttcacggggaaaaaaaaaaaaaaagaaaaaaaaaaaaaaaaaaaaaaaaaaaaaaaaaaaaaaaaaaaaaaaagnngngggcggcgcgccgccccaaaacccccccccccgcccccccccccccccccccccccccttttttgtaaagggggccccccaaaggggcggcgcataataaaacagcgacgcggcgagcgcggggcgcgcgggttaaaaaacacgcgcgatcagtggaggagaacaacaggcgggaccacgggggggactccttcgggggagaaaagacacacccaactgcgcggggggggaggagaaccacaaggtggggagcacaaacacccacagggaggattattataacgggcctccgagggggaaaaatatattagaagtgttccgaggggtgtataatcagggtggtgtaaacacaaccgcgcgacattatatcggcgggcgagtaaaagaaaagattggggctcacccgcaggaatgatattgttgagcagaatctttattttccggggggtgctttgttgtttataaaacgggggtg

SEQ ID NO: 343281 - DNA, 1763 bp, Homo sapiens
agtgggaggtgctgagccgcctgatttattccggtcccagaggagaaggcgccagaaccccgcggggtctgagcagcccagcgtgcccattccagcgcccgcgtccccgcagcatgccgcgcccccgcctgctggccgcgctgtgcggcgcgctgctctgcgcccccagcctcctcgtcgccctggatatctgttccaaaaacccctgccacaacggtggtttatgcgaggagatttcccaagaagtgcgaggagatgtcttcccctcgtacacctgcacgtgccttaagggctacgcgggcaaccactgtgagacgaaatgtgtcgagccactgggcatggagaatgggaacattgccaactcacagatcgccgcctcatctgtgcgtgtgaccttcttgggtttgcagcattgggtcccggagctggcccgcctgaaccgcgcaggcatggtcaatgcctggacacccagcagcaatgacgataacccctggatccaggtgaacctgctgcggaggatgtgggtaacaggtgtggtgacgcagggtgccagccgcttggccagtcatgagtacctgaaggccttcaaggtggcctacagccttaatggacacgaattcgatttcatccatgatgttaataaaaaacacaaggagtttgtgggtaactggaacaaaaacgcggtgcatgtcaacctgtttgagacccctgtggaggctcagtacgtgagattgtaccccacgagctgccacacggcctgcactctgcgctttgagctactgggctgtgagctgaacggatgcgccaatcccctgggcctgaagaataacagcatccctgacaagcagatcacggcctccagcagctacaagacctggggcttgcatctcttcagctggaacccctcctatgcacggctggacaagcagggcaacttcaacgcctgggttgcggggagctacggtaacgatcagtggctgcaggtggacctgggctcctcgaaggaggtgacaggcatcatcacccagggggcccgtaactttggctctgtccagtttgtggcatcctacaaggttgcctacagtaatgacagtgcgaactggactgagtaccaggaccccaggactggcagcagtaagatcttccctggcaactgggacaaccactcccacaagaagaacttgtttgagacgcccatcctggctcgctatgtgcgcatcctgcctgtagcctggcacaaccgcatcgccctgcgcctggagctgctgggctgttagtggccacctgccagcactgagggatctgagtaggtctgggatggacaggaaagggcaaagtagggcgtgtggtttccctgcccctgtccggaccgccgatcccaggtgcgtgtgtctctgtctctcctagcccctctctcacacatcacattcccatggtggcctcaagaaaggcccggaagcgccaggctggagataacagcctcttgcccgtcggccctgcgtcggccctggggtaccatgtggccacaactgctgtggccccctgtccccaagacacttccccttgtctccctggttgcctctcttgccccttgtcctgaagcccagcgacacagaagggggtggggcgggtctatggggagaaagggagcgaggtcagaggagggcatgggttggcagggtgggcgtttggggccctctatgctggcttttcaccccagaggacacaggcagcttccaaaatatatttatcttcttcacggg

SEQ ID NO: 343282 - DNA, 1854 bp, Homo sapiens
agtgggaggtgctgagccgcctgatttattccggtcccagaggagaaggcgccagaaccccgcggggtctgagcagcccagcgtgcccattccagcgcccgcgtccccgcagcatgccgcgcccccgcctgctggccgcgctgtgcggcgcgctgctctgcgcccccagcctcctcgtcgccctggatatctgttccaaaaacccctgccacaacggtggtttatgcgaggagatttcccaagaagtgcgaggagatgtcttcccctcgtacacctgcacgtgccttaagggctacgcgggcaaccactgtgagacgaaatgtgtcgagccactgggcatggagaatgggaacattgccaactcacagatcgccgcctcatctgtgcgtgtgaccttcttgggtttgcagcattgggtcccggagctggcccgcctgaaccgcgcaggcatggtcaatgcctggacacccagcagcaatgacgataacccctggatccaggtgaacctgctgcggaggatgtgggtaacaggtgtggtgacgcagggtgccagccgcttggccagtcatgagtacctgaaggccttcaaggtggcctacagccttaatggacacgaattcgatttcatccatgatgttaataaaaaacacaaggagtttgtgggtaactggaacaaaaacgcggtgcatgtcaacctgtttgagacccctgtggaggctcagtacgtgagattgtaccccacgagctgccacacggcctgcactctgcgctttgagctactgggctgtgagctgaacggatgcgccaatcccctgggcctgaagaataacagcatccctgacaagcagatcacggcctccagcagctacaagacctggggcttgcatctcttcagctggaacccctcctatgcacggctggacaagcagggcaacttcaacgcctgggttgcggggagctacggtaacgatcagtggctgcaggtggacctgggctcctcgaaggaggtgacaggcatcatcacccagggggcccgtaactttggctctgtccagtttgtggcatcctacaaggttgcctacagtaatgacagtgcgaactggactgagtaccaggaccccaggactggcagcagtaagatcttccctggcaactgggacaaccactcccacaagaagaacttgtttgagacgcccatcctggctcgctatgtgcgcatcctgcctgtagcctggcacaaccgcatcgccctgcgcctggagctgctgggctgttagtggccacctgccacccccaggtcttcctgctttccatgggcccgctgcctcttggcttctcagcccctttaaatcaccatagggctggggactggggaaggggagggtgttcagaggcagcaccaccacacagtcacccctccctccctctttcccaccctccacctctcacgggccctgccccagcccctaagccccgtcccctaacccccagtcctcactgtcctgttttcttaggcactgagggatctgagtaggtctgggatggacaggaaagggcaaagtagggcgtgtggtttccctgcccctcctgcgtcggccctggggtaccatgtggccacaactgctgtggccccctgtccccaagacacttccccttgtctccctggttgcctctcttgccccttgtcctgaagcccagcgacacagaagggggtggggcgggtctatggggagaaagggagcgaggtcagaggagggcatgggttggcagggtgggcgtttggggccctctatgctggcttttcaccccagaggacacaggcagcttccaaaatatatttatcttcttcacggg

SEQ ID NO: 343283 - DNA, 1701 bp, Homo sapiens
agtgggaggtgctgagccgcctgatttattccggtcccagaggagaaggcgccagaaccccgcggggtctgagcagcccagcgtgcccattccagcgcccgcgtccccgcagcatgccgcgcccccgcctgctggccgcgctgtgcggcgcgctgctctgcgcccccagcctcctcgtcgccctggatatctgttccaaaaacccctgccacaacggtggtttatgcgaggagatttcccaagaagtgcgaggagatgtcttcccctcgtacacctgcacgtgccttaagggctacgcgggcaaccactgtgagacgaaatgtgtcgagccactgggcatggagaatgggaacattgccaactcacagatcgccgcctcatctgtgcgtgtgaccttcttgggtttgcagcattgggtcccggagctggcccgcctgaaccgcgcaggcatggtcaatgcctggacacccagcagcaatgacgataacccctggatccaggtgaacctgctgcggaggatgtgggtaacaggtgtggtgacgcagggtgccagccgcttggccagtcatgagtacctgaaggccttcaaggtggcctacagccttaatggacacgaattcgatttcatccatgatgttaataaaaaacacaaggagtttgtgggtaactggaacaaaaacgcggtgcatgtcaacctgtttgagacccctgtggaggctcagtacgtgagattgtaccccacgagctgccacacggcctgcactctgcgctttgagctactgggctgtgagctgaacggatgcgccaatcccctgggcctgaagaataacagcatccctgacaagcagatcacggcctccagcagctacaagacctggggcttgcatctcttcagctggaacccctcctatgcacggctggacaagcagggcaacttcaacgcctgggttgcggggagctacggtaacgatcagtggctgcaggtggacctgggctcctcgaaggaggtgacaggcatcatcacccagggggcccgtaactttggctctgtccagtttgtggcatcctacaaggttgcctacagtaatgacagtgcgaactggactgagtaccaggaccccaggactggcagcagtaagatcttccctggcaactgggacaaccactcccacaagaagaacttgtttgagacgcccatcctggctcgctatgtgcgcatcctgcctgtagcctggcacaaccgcatcgccctgcgcctggagctgctgggctgttagtggccacctgccacccccaggtcttcctgctttccatgggcccgctgcctcttggcttctcagcccctttaaatcaccatagggctggggactggggaaggggagggtgttcagaggcagcaccaccacacagtcacccctccctccctctttcccaccctccacctctcacgggccctgccccagcccctaagccccgtcccctgtccccaagacacttccccttgtctccctggttgcctctcttgccccttgtcctgaagcccagcgacacagaagggggtggggcgggtctatggggagaaagggagcgaggtcagaggagggcatgggttggcagggtgggcgtttggggccctctatgctggcttttcaccccagaggacacaggcagcttccaaaatatatttatcttcttcacggg

SEQ ID NO: 343284 - DNA, 1430 bp, Homo sapiens
agtgggaggtgctgagccgcctgatttattccggtcccagaggagaaggcgccagaaccccgcggggtctgagcagcccagcgtgcccattccagcgcccgcgtccccgcagcatgccgcgcccccgcctgctggccgcgctgtgcggcgcgctgctctgcgcccccagcctcctcgtcgccctggatatctgttccaaaaacccctgccacaacggtggtttatgcgaggagatttcccaagaagtgcgaggagatgtcttcccctcgtacacctgcacgtgccttaagggctacgcgggcaaccactgtgagacgaaatgtgtcgagccactgggcatggagaatgggaacattgccaactcacagatcgccgcctcatctgtgcgtgtgaccttcttgggtttgcagcattgggtcccggagctggcccgcctgaaccgcgcaggcatggtcaatgcctggacacccagcagcaatgacgataacccctggatccaggtgaacctgctgcggaggatgtgggtaacaggtgtggtgacgcagggtgccagccgcttggccagtcatgagtacctgaaggccttcaaggtggcctacagccttaatggacacgaattcgatttcatccatgatgttaataaaaaacacaaggagtttgtgggtaactggaacaaaaacgcggtgcatgtcaacctgtttgagacccctgtggaggctcagtacgtgagattgtaccccacgagctgccacacggcctgcactctgcgctttgagctactgggctgtgagctgaacggatgcgccaatcccctgggcctgaagaataacagcatccctgacaagcagatcacggcctccagcagctacaagacctggggcttgcatctcttcagctggaacccctcctatgcacggctggacaagcagggcaacttcaacgcctgggttgcggggagctacggtaacgatcagtggctgcaggtggacctgggctcctcgaaggaggtgacaggcatcatcacccagggggcccgtaactttggctctgtccagtttgtggcatcctacaaggttgcctacagtaatgacagtgcgaactggactgagtaccaggaccccaggactggcagcagtaagatcttccctggcaactgggacaaccactcccacaagaagaacttgtttgagacgcccatcctggctcgctatgtgcgcatcctgcctgtagcctggcacaaccgcatcgccctgcgcctggagctgctgggctgttagtggccacctgccacccccaggtcttcctgctttccatgggcccgctgcctcttggcttctcagcccctttaaatcaccatagggctggggactggggaaggggagggtgttcagaggcggcagcttccaaaatatatttatcttcttcacggg

SEQ ID NO: 343285 - DNA, 1761 bp, Homo sapiens
agtgggaggtgctgagccgcctgatttattccggtcccagaggagaaggcgccagaaccccgcggggtctgagcagcccagcgtgcccattccagcgcccgcgtccccgcagcatgccgcgcccccgcctgctggccgcgctgtgcggcgcgctgctctgcgcccccagcctcctcgtcgccctggatatctgttccaaaaacccctgccacaacggtggtttatgcgaggagatttcccaagaagtgcgaggagatgtcttcccctcgtacacctgcacgtgccttaagggctacgcgggcaaccactgtgagacgaaatgtgtcgagccactgggcatggagaatgggaacattgccaactcacagatcgccgcctcatctgtgcgtgtgaccttcttgggtttgcagcattgggtcccggagctggcccgcctgaaccgcgcaggcatggtcaatgcctggacacccagcagcaatgacgataacccctggatccaggtgaacctgctgcggaggatgtgggtaacaggtgtggtgacgcagggtgccagccgcttggccagtcatgagtacctgaaggccttcaaggtggcctacagccttaatggacacgaattcgatttcatccatgatgttaataaaaaacacaaggagtttgtgggtaactggaacaaaaacgcggtgcatgtcaacctgtttgagacccctgtggaggctcagtacgtgagattgtaccccacgagctgccacacggcctgcactctgcgctttgagctactgggctgtgagctgaacgcaagacctggggcttgcatctcttcagctggaacccctcctatgcacggctggacaagcagggcaacttcaacgcctgggttgcggggagctacggtaacgatcagtggctgcagatcttccctggcaactgggacaaccactcccacaagaagaacttgtttgagacgcccatcctggctcgctatgtgcgcatcctgcctgtagcctggcacaaccgcatcgccctgcgcctggagctgctgggctgttagtggccacctgccacccccaggtcttcctgctttccatgggcccgctgcctcttggcttctcagcccctttaaatcaccatagggctggggactggggaaggggagggtgttcagaggcagcaccaccacacagtcacccctccctccctctttcccaccctccacctctcacgggccctgccccagcccctaagccccgtcccctaacccccagtcctcactgtcctgttttcttaggcactgagggatctgagtaggtctgggatggacaggaaagggcaaagtagggcgtgtggtttccctgcccctgtccggaccgccgatcccaggtgcgtgtgtctctgtctctcctagcccctctctcacacatcacattcccatggtggcctcaagaaaggcccggaagcgccaggctggagataacagcctcttgcccgtcggccctgcgtcggccctggggtaccatgtggccacaactgctgtggccccctgtccccaagacacttccccttgtctccctggttgcctctcttgccccttgtcctgaagcccagcgacacagaagggggtggggcgggtctatggggagaaagggagcgaggtcagaggagggcatgggttggcagggtgggcgtttggggccctctatgctggcttttcaccccagaggacacaggcagcttccaaaatatatttatcttcttcacggg

SEQ ID NO: 343286 - DNA, 1008 bp, Homo sapiens
agtgggaggtgctgagccgcctgatttattccggtcccagaggagaaggcgccagaaccccgcggggtctgagcagcccagcgtgcccattccagcgcccgcgtccccgcagcatgccgcgcccccgcctgctggccgcgctgtgcggcgcgctgctctgcgcccccagcctcctcgtcgccctggatatctgttccaaaaacccctgccacaacggtggtttatgcgaggagatttcccaagaagtgcgaggagatgtcttcccctcgtacacctgcacgtgccttaagggctacgcgggcaaccactgtgagacgaaatgtgtcgagccactgggcatggagaatgggaacattgccaactcacagatcgccgcctcatctgtgcgtgtgaccttcttgggtttgcagcattgggtcccggagctggcccgcctgaaccgcgcaggcatggtcaatgcctggacacccagcagcaatgacgataacccctggatccaggtgaacctgctgcggaggatgtgggtaacaggtgtggtgacgcagggtgccagccgcttggccagtcatgagtacctgaaggccttcaaggtggcctacagccttaatggacacgaattcgatttcatccatgatgttaataaaaaacacaaggagtttgtgggtaactggaacaaaaacgcggtgcatgtcaacctgtttgagacccctgtggaggctcagtacgtgagattgtaccccacgagctgccacacggcctgcactctgcgctttgagctactgggctgtgagctgaacggatgcgccaatcccctgggcctgaagaataacagcatccctgacaagcagatcacggcctccagcagctacccccaggtcttcctgctttccatgggcccgctgcctcttggcttctcagcccctttaaatcaccatagggctggggactggggaaggggagggtgttcagaggcggcagcttccaaaatatatttatcttcttcacggg

SEQ ID NO: 343287 - DNA, 829 bp, Homo sapiens
agtgggaggtgctgagccgcctgatttattccggtcccagaggagaaggcgccagaaccccgcggggtctgagcagcccagcgtgcccattccagcgcccgcgtccccgcagcatgccgcgcccccgcctgctggccgcgctgtgcggcgcgctgctctgcgcccccagcctcctcgtcgccctggatatctgttccaaaaacccctgccacaacggtggtttatgcgaggagatttcccaagaagtgcgaggagatgtcttcccctcgtacacctgcacgtgccttaagggctacgcgggcaaccactgtgagacgaaatgtgtcgagccactgggcatggagaatgggaacattgccaactcacagatcgccgcctcatctgtgcgtgtgaccttcttgggtttgcagcattgggtcccggagctggcccgcctgaaccgcgcaggcatggtcaatgcctggacacccagcagcaatgacgataacccctggatccaggtgaacctgctgcggaggatgtgggtaacaggtgtggtgacgcagggtgccagccgcttggccagtcatgagtacctgaaggccttcaaggtggcctacagccttaatggacacgaattcgatttcatccatgatgttaataaaaaacacaaggagtttgtgggtaactggaacaaaaacgcggtgcatgtcaacctgtttgagacccctgtggaggctcagtacgtgagattgtaccccacgagctgccacacggcctgcactctgcgctttgagctactgggctgtgagctgaacggtaaattgcctcaagtaagcactgataacat

SEQ ID NO: 343288 - DNA, 1195 bp, Homo sapiens
  misc_feature (93)..(93): n is a, c, g, or t
  misc_feature (99)..(99): n is a, c, g, or t
  misc_feature (119)..(119): n is a, c, g, or t
  misc_feature (717)..(718): n is a, c, g, or t
  misc_feature (720)..(720): n is a, c, g, or t
tctatttccatctcatacacccttcacctcaatcatattcttttacagcctctcctttatactccctatcttctctacattttctctactccnaagccnctcctctttctttttctctnatcttctacttttaagggccctgccccagcccctaagccccgtcccctaacccccagtcctcactgtcctgttttcttaggcactgagggatctgagtaggtctgggatggacaggaaagggcaaagtagggcgtgtggtttccctgcccctgtccggaccgccgatcccaggtgcgtgtgtctctgtctctcctagcccctctctcacacatcacattcccatggtggcctcaagaaaggcccggaagcgccaggctggagataacagcctcttgcccgtcggccctgcgtcggccctggggtaccatgtggccacaactgctgtggccccctgtccccaagacacttccccttgtctccctggttgcctctcttgccccttgtcctgaagcccagcgacacagaagggggtggggcgggtctatggggagaaagggagcgaggtcagaggagggcatgggttggcagggtgggcgtttggggccctctatgctggcttttcaccccagaggacacaggcagcttccaaaatatatttatcttcttcacgggaaaaaaaaaaaaaaaaaaaaaaaaaaaaaaaaaaaaaaaaaaagnngngggcggcgcgccgccccaaaacccccccccccgcccccccccccccccccccccccccttttttgtaaagggggccccccaaaggggcggcgcataataaaacagcgacgcggcgagcgcggggcgcgcgggttaaaaaacacgcgcgatcagtggaggagaacaacaggcgggaccacgggggggactccttcgggggagaaaagacacacccaactgcgcggggggggaggagaaccacaaggtggggagcacaaacacccacagggaggattattataacgggcctccgagggggaaaaatatattagaagtgttccgaggggtgtataatcagggtggtgtaaacacaaccgcgcgacattatatcggcgggcgagtaaaagaaaagattggggctcacccgcaggaatgatattgttgagcagaatctttattttccggggggtgctttgttgtttataaaacgggggtg

SEQ ID NO: 343289 - DNA, 478 bp, Homo sapiens
ctgagacagagccttgctctgtcacccaggctggagtgcagtggcgccatctcggctcaccgcaacctccgcctcccaggttcaagcggttcttctgactcagcctccctagtagctgggattacaggcagccaccatcatgcccagctaattttttgtatttttagtagagacggggtttcaccatgttggtcaggctggtctcgaactcctgacctcaggtgatccacctgcctcaagtctctcccaaagtgttgggattataggcatgagacaccatgtccggccttatgcccattttatagccaaagaaactgaggctcacccaagtagtttttttcaaaactagaattcatgcctcagtgtgtctgcctcttttcaccttactggagatggtccaagcagagaaaatgtggttggtttcttctgtaggtggacctgggctcctcgaaggaggtgacaggcatcatcacccagg

SEQ ID NO: 343290 - DNA, 501 bp, Homo sapiens
catgaaaaacttaaaaacagcactgcaaaaagagcactgcaggcaaggaattggtaaatgcaaaggccctggggcatgttgaagggtggaaggaaggccagtggagctggagccaagagatggaggggcagcttggtgggtgaagagccccagggacccgcagtgtcatcacctaggagcttcttagaaatgcagactgaggccgggtgcggtggctcacgcctgtaatcccagcactttgggaggccgaggcgagcggatcacctgaggtcaggagatcaagaccagcttggccaacatggcgaagccccgtctctactaaaaaaatacaaaaattagccaggcgtggtggcaggtgcctgtaatcccagctactagggaggctgaggcaggataattgcctgaacccggtcagaaggtggaggttgcagtgagccgagatcatgccactgcactccagcctgggtgacagagcgagactgtgtctcaaacaaacaaaca

SEQ ID NO: 343291 - DNA, 479 bp, Homo sapiens
tcttaggcactgagggatctgagtaggtctgggatggacaggaaagggcaaagtagggcgtgtggtttccctgcccctgtccggaccgccgatcccaggtgcgtgtgtctctgtctctcctagcccctctctcacacatcacattcccatggtggcctcaagaaaggcccggaagcgccaggctggagataacagcctcttgcccgtcggccctgcgtcggccctggggtaccatgtggccacaactgctgtggccccctgtccccaagacacttccccttgtctccctggttgcctctcttgccccttgtcctgaagcccagcgacacagaagggggtggggcgggtctatggggagaaagggagcgaggtcagaggagggcatgggttggcagggtgggcgtttggggccctctatgctggcttttcaccccagaggacacaggcagcttccaaaatatatttatcttcttcacggg

SEQ ID NO: 343292 - DNA, 3837 bp, Homo sapiens
agtgggaggtgctgagccgcctgatttattccggtcccagaggagaaggcgccagaaccccgcggggtctgagcagcccagcgtgcccattccagcgcccgcgtccccgcagcatgccgcgcccccgcctgctggccgcgctgtgcggcgcgctgctctgcgcccccagcctcctcgtcgccctggatatctgttccaaaaacccctgccacaacggtggtttatgcgaggagatttcccaagaagtgcgaggagatgtcttcccctcgtacacctgcacgtgccttaagggctacgcgggcaaccactgtgagacgaaatgtgtcgagccactgggcatggagaatgggaacattgccaactcacagatcgccgcctcatctgtgcgtgtgaccttcttgggtttgcagcattgggtcccggagctggcccgcctgaaccgcgcaggcatggtcaatgcctggacacccagcagcaatgacgataacccctggatccaggtgaacctgctgcggaggatgtgggtaacaggtgtggtgacgcagggtgccagccgcttggccagtcatgagtacctgaaggccttcaaggtggcctacagccttaatggacacgaattcgatttcatccatgatgttaataaaaaacacaaggagtttgtgggtaactggaacaaaaacgcggtgcatgtcaacctgtttgagacccctgtggaggctcagtacgtgagattgtaccccacgagctgccacacggcctgcactctgcgctttgagctactgggctgtgagctgaacggatgcgccaatcccctgggcctgaagaataacagcatccctgacaagcagatcacggcctccagcagctacaagacctggggcttgcatctcttcagctggaacccctcctatgcacggctggacaagcagggcaacttcaacgcctgggttgcggggagctacggtaacgatcagtggctgcaggtggacctgggctcctcgaaggaggtgacaggcatcatcacccagggggcccgtaactttggctctgtccagtttgtggcatcctacaaggttgcctacagtaatgacagtgcgaactggactgagtaccaggaccccaggactggcagcagtaagatcttccctggcaactgggacaaccactcccacaagaagaacttgtttgagacgcccatcctggctcgctatgtgcgcatcctgcctgtagcctggcacaaccgcatcgccctgcgcctggagctgctgggctgttagtggccacctgccacccccaggtcttcctgctttccatgggcccgctgcctcttggcttctcagcccctttaaatcaccatagggctggggactggggaaggggagggtgttcagaggcagcaccaccacacagtcacccctccctccctctttcccaccctccacctctcacgggccctgccccagcccctaagccccgtcccctaacccccagtcctcactgtcctgttttcttaggcactgagggatctgagtaggtctgggatggacaggaaagggcaaagtagggcgtgtggtttccctgcccctgtccggaccgccgatcccaggtgcgtgtgtctctgtctctcctagcccctctctcacacatcacattcccatggtggcctcaagaaaggcccggaagcgccaggctggagataacagcctcttgcccgtcggccctgcgtcggccctggggtaccatgtggccacaactgctgtggccccctgtccccaagacacttccccttgtctccctggttgcctctcttgccccttgtcctgaagcccagcgacacagaagggggtggggcgggtctatggggagaaagggagcgaggtcagaggagggcatgggttggcagggtgggcgtttggggccctctatgctggcttttcaccccagaggacacaggcagcttccaaaatatatttatcttcttcacggggaaaaaaaaaaaaaaagaaaaaaaaaaaaaaaaaaaaaaaaaaaaggggggggggcgcgcgcgcaagaagaaccactccccgagaggggcgcccaccctaatgacgcacgcaccacacggagatctgatcgagggacaaaaggggggccaccaaaagaggagcggctgcagatattaatacactaggacagcggagcagggacgcgcagtttatcaagaacacgcactgcaccgcgcattgagagcgaggcaaaacacgcgcgcggcgacacccacgcgcggagaccacctgcgtggagagagagaagagagacacccctgatcctcgggcggggggggagggggagccacccacacgagggggggcgaacaagcaaagcccaagaaggagaacagatagatattatagaccgcccccacagagacggggcgggccaccaaaccatcaaacagacgaccatcttctcgcgaagaggcgaggcgaggaccaagcgcagcgggcgggcgcggcccagacaccacagccacacgagccgcccgagccaaaatccaccatgccccgcggcgccgcatcacccccgaccagcatgcagacagaaaataccaattctagccgctcgacgcgcccacacaacgcagcaagcgaacccgcacccacaagtcgagacctaatcactgccaacacaaccaacacacaaatacttctgatgttacatacgcacaccacgacgggggggggagggaccaacagaagagagtggcacatataactaacaaacccccaagcgcgccagacactcaccaacgacatacgatgaggatgacagcgaccgcaagacacacaggagcgacacgcggaacgaacaagccacctgaccaccaacactgcatgaacagtgctaacactcagagcgacatcacacgcagtcacaccagcaacagagccaacacacacccagcaaccagacaagcaggaaccaccacagcgacaaccacacgcatagccacgtcgagatcgaaccaacgagccgctgactcacccaccacctcgcctgacgacagatccagacgaacgacacaacgcgatgagcgcacgaacacagacgcaacccagacgcaccgaagagcgaatactgacacagccagagaatcacacgacctccacaagccggacgcgaggcgactaagccacacacgaacgacaaccgtaaaccagcgaccgccgccgccgaccgatacacaccgaacctgcgacacacgaaagataacacgtcaccacgcgcaacgagcacagacggctcgcaacacaacgagacagcgcgacagccgacggcgcaacagcgcccgcgacacaggcccgcacgacgcgaccgacgccacacgccagcgcagcccgagcacgcggaccgtccacgctccacacaccacaccaccggccccgcgcacccagcagtacaccacgacgaggccagccgcagccacacaccaccgctcgattcgcctcgcgccactcggacagcgtacgggatgtacctcctcgcaccacccgccaccgacgcgcccgcaacccgcgccacaaccacacaccacccgcacccgcgagacagagtgcccccaacacacgcgcacgtgcacgccaactgcgcgacgtaggcgggaggggccccggcactgcggcgcgccggcagcgcgcaggaccgcgagggcacgcctgcacggcgcagaaggaggcgaaggcatgacaccagcgacgcggccgaccggggcggccaagagagcgtcgggggcgagggcagcgaggtcgacgacgagacggcggggtcagacgaggtccgaggcgcgaagcacgc

SEQ ID NO: 343293 - DNA, 2510 bp, Homo sapiens
  misc_feature (2032)..(2033): n is a, c, g, or t
  misc_feature (2035)..(2035): n is a, c, g, or t
agtgggaggtgctgagccgcctgatttattccggtcccagaggagaaggcgccagaaccccgcggggtctgagcagcccagcgtgcccattccagcgcccgcgtccccgcagcatgccgcgcccccgcctgctggccgcgctgtgcggcgcgctgctctgcgcccccagcctcctcgtcgccctggatatctgttccaaaaacccctgccacaacggtggtttatgcgaggagatttcccaagaagtgcgaggagatgtcttcccctcgtacacctgcacgtgccttaagggctacgcgggcaaccactgtgagacgaaatgtgtcgagccactgggcatggagaatgggaacattgccaactcacagatcgccgcctcatctgtgcgtgtgaccttcttgggtttgcagcattgggtcccggagctggcccgcctgaaccgcgcaggcatggtcaatgcctggacacccagcagcaatgacgataacccctggatccaggtgaacctgctgcggaggatgtgggtaacaggtgtggtgacgcagggtgccagccgcttggccagtcatgagtacctgaaggccttcaaggtggcctacagccttaatggacacgaattcgatttcatccatgatgttaataaaaaacacaaggagtttgtgggtaactggaacaaaaacgcggtgcatgtcaacctgtttgagacccctgtggaggctcagtacgtgagattgtaccccacgagctgccacacggcctgcactctgcgctttgagctactgggctgtgagctgaacggatgcgccaatcccctgggcctgaagaataacagcatccctgacaagcagatcacggcctccagcagctacaagacctggggcttgcatctcttcagctggaacccctcctatgcacggctggacaagcagggcaacttcaacgcctgggttgcggggagctacggtaacgatcagtggctgcaggtggacctgggctcctcgaaggaggtgacaggcatcatcacccagggggcccgtaactttggctctgtccagtttgtggcatcctacaaggttgcctacagtaatgacagtgcgaactggactgagtaccaggaccccaggactggcagcagtaagatcttccctggcaactgggacaaccactcccacaagaagaacttgtttgagacgcccatcctggctcgctatgtgcgcatcctgcctgtagcctggcacaaccgcatcgccctgcgcctggagctgctgggctgttagtggccacctgccacccccaggtcttcctgctttccatgggcccgctgcctcttggcttctcagcccctttaaatcaccatagggctggggactggggaaggggagggtgttcagaggcagcaccaccacacagtcacccctccctccctctttcccaccctccacctctcacgggccctgccccagcccctaagccccgtcccctaacccccagtcctcactgtcctgttttcttaggcactgagggatctgagtaggtctgggatggacaggaaagggcaaagtagggcgtgtggtttccctgcccctgtccggaccgccgatcccaggtgcgtgtgtctctgtctctcctagcccctctctcacacatcacattcccatggtggcctcaagaaaggcccggaagcgccaggctggagataacagcctcttgcccgtcggccctgcgtcggccctggggtaccatgtggccacaactgctgtggccccctgtccccaagacacttccccttgtctccctggttgcctctcttgccccttgtcctgaagcccagcgacacagaagggggtggggcgggtctatggggagaaagggagcgaggtcagaggagggcatgggttggcagggtgggcgtttggggccctctatgctggcttttcaccccagaggacacaggcagcttccaaaatatatttatcttcttcacgggaaaaaaaaaaaaaaaaaaaaaaaaaaaaaaaaaaaaaaaaaaagnngngggcggcgcgccgccccaaaacccccccccccgcccccccccccccccccccccccccttttttgtaaagggggccccccaaaggggcggcgcataataaaacagcgacgcggcgagcgcggggcgcgcgggttaaaaaacacgcgcgatcagtggaggagaacaacaggcgggaccacgggggggactccttcgggggagaaaagacacacccaactgcgcggggggggaggagaaccacaaggtggggagcacaaacacccacagggaggattattataacgggcctccgagggggaaaaatatattagaagtgttccgaggggtgtataatcagggtggtgtaaacacaaccgcgcgacattatatcggcgggcgagtaaaagaaaagattggggctcacccgcaggaatgatattgttgagcagaatctttattttccggggggtgctttgttgtttataaaacgggggtg

SEQ ID NO: 343294 - DNA, 1882 bp, Homo sapiens
agtgggaggtgctgagccgcctgatttattccggtcccagaggagaaggcgccagaaccccgcggggtctgagcagcccagcgtgcccattccagcgcccgcgtccccgcagcatgccgcgcccccgcctgctggccgcgctgtgcggcgcgctgctctgcgcccccagcctcctcgtcgccctggatatctgttccaaaaacccctgccacaacggtggtttatgcgaggagatttcccaagaagtgcgaggagatgtcttcccctcgtacacctgcacgtgccttaagggctacgcgggcaaccactgtgagacgaaatgtgtcgagccactgggcatggagaatgggaacattgccaactcacagatcgccgcctcatctgtgcgtgtgaccttcttgggtttgcagcattgggtcccggagctggcccgcctgaaccgcgcaggcatggtcaatgcctggacacccagcagcaatgacgataacccctggatccaggtgaacctgctgcggaggatgtgggtaacaggtgtggtgacgcagggtgccagccgcttggccagtcatgagtacctgaaggccttcaaggtggcctacagccttaatggacacgaattcgatttcatccatgatgttaataaaaaacacaaggagtttgtgggtaactggaacaaaaacgcggtgcatgtcaacctgtttgagacccctgtggaggctcagtacgtgagattgtaccccacgagctgccacacggcctgcactctgcgctttgagctactgggctgtgagctgaacggatgcgccaatcccctgggcctgaagaataacagcatccctgacaagcagatcacggcctccagcagctacaagacctggggcttgcatctcttcagctggaacccctcctatgcacggctggacaagcagggcaacttcaacgcctgggttgcggggagctacggtaacgatcagtggctgcaggtggacctgggctcctcgaaggaggtgacaggcatcatcacccagggggcccgtaactttggctctgtccagtttgtggcatcctacaaggttgcctacagtaatgacagtgcgaactggactgagtaccaggaccccaggactggcagcagtaagatcttccctggcaactgggacaaccactcccacaagaagaacttgtttgagacgcccatcctggctcgctatgtgcgcatcctgcctgtagcctggcacaaccgcatcgccctgcgcctggagctgctgggctgttagtggccacctgccacccccaggtcttcctgctttccatgggcccgctgcctcttggcttctcagcccctttaaatcaccatagggctggggactggggaaggggagggtgttcagaggcagcaccaccacacagtcacccctccctccctctttcccaccctccacctctcacgggccctgccccagcccctaagccccgtccccgtccggaccgccgatcccaggtgcgtgtgtctctgtctctcctagcccctctctcacacatcacattcccatggtggcctcaagaaaggcccggaagcgccaggctggagataacagcctcttgcccgtcggccctgcgtcggccctggggtaccatgtggccacaactgctgtggccccctgtccccaagacacttccccttgtctccctggttgcctctcttgccccttgtcctgaagcccagcgacacagaagggggtggggcgggtctatggggagaaagggagcgaggtcagaggagggcatgggttggcagggtgggcgtttggggccctctatgctggcttttcaccccagaggacacaggcagcttccaaaatatatttatcttcttcacggg

SEQ ID NO: 343295 - DNA, 1479 bp, Homo sapiens
agtgggaggtgctgagccgcctgatttattccggtcccagaggagaaggcgccagaaccccgcggggtctgagcagcccagcgtgcccattccagcgcccgcgtccccgcagcatgccgcgcccccgcctgctggccgcgctgtgcggcgcgctgctctgcgcccccagcctcctcgtcgccctggatatctgttccaaaaacccctgccacaacggtggtttatgcgaggagatttcccaagaagtgcgaggagatgtcttcccctcgtacacctgcacgtgccttaagggctacgcgggcaaccactgtgagacgaaatgtgtcgagccactgggcatggagaatgggaacattgccaactcacagatcgccgcctcatctgtgcgtgtgaccttcttgggtttgcagcattgggtcccggagctggcccgcctgaaccgcgcaggcatggtcaatgcctggacacccagcagcaatgacgataacccctggatccaggtgaacctgctgcggaggatgtgggtaacaggtgtggtgacgcagggtgccagccgcttggccagtcatgagtacctgaaggccttcaaggtggcctacagccttaatggacacgaattcgatttcatccatgatgttaataaaaaacacaaggagtttgtgggtaactggaacaaaaacgcggtgcatgtcaacctgtttgagacccctgtggaggctcagtacgtgagattgtaccccacgagctgccacacggcctgcactctgcgctttgagctactgggctgtgagctgaacggatgcgccaatcccctgggcctgaagaataacagcatccctgacaagcagatcacggcctccagcagctacaagacctggggcttgcatctcttcagctggaacccctcctatgcacggctggacaagcagggcaacttcaacgcctgggttgcggggagctacggtaacgatcagtggctgcaggtggacctgggctcctcgaaggaggtgacaggcatcatcacccagggggcccgtaactttggctctgtccagtttgtggcatcctacaaggttgcctacagtaatgacagtgcgaactggactgagtaccaggaccccaggactggcagcagtaagatcttccctggcaactgggacaaccactcccacaagaagaacttgtttgagacgcccatcctggctcgctatgtgcgcatcctgcctgtagcctggcacaaccgcatcgccctgcgcctggagctgctgggctgttagtggccacctgccacccccaggtcttcctgctttccatgggcccgctgcctcttggcttctcagcccctttaaatcaccatagggctggggactggggaaggggagggtgttcagaggcggtgggcgtttggggccctctatgctggcttttcaccccagaggacacaggcagcttccaaaatatatttatcttcttcacggg

SEQ ID NO: 343296 - DNA, 1855 bp, Homo sapiens
agtgggaggtgctgagccgcctgatttattccggtcccagaggagaaggcgccagaaccccgcggggtctgagcagcccagcgtgcccattccagcgcccgcgtccccgcagcatgccgcgcccccgcctgctggccgcgctgtgcggcgcgctgctctgcgcccccagcctcctcgtcgccctggaatgtgtcgagccactgggcatggagaatgggaacattgccaactcacagatcgccgcctcatctgtgcgtgtgaccttcttgggtttgcagcattgggtcccggagctggcccgcctgaaccgcgcaggcatggtcaatgcctggacacccagcagcaatgacgataacccctggatccaggtgaacctgctgcggaggatgtgggtaacaggtgtggtgacgcagggtgccagccgcttggccagtcatgagtacctgaaggccttcaaggtggcctacagccttaatggacacgaattcgatttcatccatgatgttaataaaaaacacaaggagtttgtgggtaactggaacaaaaacgcggtgcatgtcaacctgtttgagacccctgtggaggctcagtacgtgagattgtaccccacgagctgccacacggcctgcactctgcgctttgagctactgggctgtgagctgaacggatgcgccaatcccctgggcctgaagaataacagcatccctgacaagcagatcacggcctccagcagctacaagacctggggcttgcatctcttcagctggaacccctcctatgcacggctggacaagcagggcaacttcaacgcctgggttgcggggagctacggtaacgatcagtggctgcaggtggacctgggctcctcgaaggaggtgacaggcatcatcacccagggggcccgtaactttggctctgtccagtttgtggcatcctacaaggttgcctacagtaatgacagtgcgaactggactgagtaccaggaccccaggactggcagcagtaagatcttccctggcaactgggacaaccactcccacaagaagaacttgtttgagacgcccatcctggctcgctatgtgcgcatcctgcctgtagcctggcacaaccgcatcgccctgcgcctggagctgctgggctgttagtggccacctgccacccccaggtcttcctgctttccatgggcccgctgcctcttggcttctcagcccctttaaatcaccatagggctggggactggggaaggggagggtgttcagaggcagcaccaccacacagtcacccctccctccctctttcccaccctccacctctcacgggccctgccccagcccctaagccccgtcccctaacccccagtcctcactgtcctgttttcttaggcactgagggatctgagtaggtctgggatggacaggaaagggcaaagtagggcgtgtggtttccctgcccctgtccggaccgccgatcccaggtgcgtgtgtctctgtctctcctagcccctctctcacacatcacattcccatggtggcctcaagaaaggcccggaagcgccaggctggagataacagcctcttgcccgtcggccctgcgtcggccctggggtaccatgtggccacaactgctgtggccccctgtccccaagacacttccccttgtctccctggttgcctctcttgccccttgtcctgaagcccagcgacacagaagggggtggggcgggtctatggggagaaagggagcgaggtcagaggagggcatgggttggcagggtgggcgtttggggccctctatgctggcttttcaccccagaggacacaggcagcttccaaaatatatttatcttcttcacggg

SEQ ID NO: 343297 - DNA, 1151 bp, Homo sapiens
tttttcccgtgaagaagataaatatattttggaagctgcctgtgtcctctggggtgaaaagccagcatagcgagccaggatacaggcaggatgcgcacatagcgagcctgggttgcggggagctacggtaacgatcagtggctgcaggtggacctgggctcctcgaaggaggtgacaggcatcatcacccagggggcccgtaactttggctctgtccagtttgtggcatcctacaaggttgcctacagtaatgacagtgcgaactggactgagtaccaggaccccaggactggcagcagtaagatcttccctggcaactgggacaaccactcccacaagaagaacttgtttgagacgcccatcctggctcgctatgtgcgcatcctgcctgtagcctggcacaaccgcatcgccctgcgcctggagctgctgggctgttagtggccacctgccacccccaggtcttcctgctttccatgggcccgctgcctcttggcttctcagcccctttaaatcaccatagggctggggactggggaaggggagggtgttcagaggcagcaccaccacacagtcacccctccctccctctttcccaccctccacctctcacgggccctgccccagcccctaagccccgtcccctaacccccagtcctcactgtcctgttttcttaggcactgagggatctgagtaggtctgggatggacaggaaagggcaaagtagggcgtgtggtttccctgcccctgtccggaccgccgatcccaggtgcgtgtgtctctgtctctcctagcccctctctcacacatcacattcccatggtggcctcaagaaaggcccggaagcgccaggctggagataacagcctcttgcccgtcggccctgcgtcggccctggggtaccatgtggccacaactgctgtggccccctgtccccaagacacttccccttgtctccctggttgcctctcttgccccttgtcctgaagcccagcgacacagaagggggtggggcgggtctatggggagaaagggagcgaggtcagaggagggcatgggttggcagggtgggcgtttggggccctctatgctggcttttcaccccagaggacacaggcagcttccaaaatatatttatcttcttcacggg

SEQ ID NO: 343298 - DNA, 851 bp, Homo sapiens
agtgggaggtgctgagccgcctgatttattccggtcccagaggagaaggcgccagaaccccgcggggtctgagcagcccagcgtgcccattccagcgcccgcgtccccgcagcatgccgcgcccccgcctgctggccgcgctgtgcggcgcgctgctctgcgcccccagcctcctcgtcgccctggatatctgttccaaaaacccctgccacaacggtggtttatgcgaggagatttcccaagaagtgcgaggagatgtcttcccctcgtacacctgcacgtgccttaagggctacgcgggcaaccactgtgagacgaaatgtgtcgagccactgggcatggagaatgggaacattgccaactcacagatcgccgcctcatctgtgcgtgtgaccttcttgggtttgcagcattgggtcccggagctggcccgcctgaaccgcgcaggcatggtcaatgcctggacacccagcagcaatgacgataacccctggatccaggtgaacctgctgcggaggatgtgggtaacaggtgtggtgacgcagggtgccagccgcttggccagtcatgagtacctgaaggccttcaaggtggcctacagccttaatggacacgaattcgatttcatccatgatgttaataaaaaacacaaggagtttgtgggtaactggaacaaaaacgcggtgcatgtcaacctgtttgagacccctgtggaggctcagtacgtgagattgtaccccacgagctgccacacggcctgcactctgcgctttgagctactgggctgtgagctgaacgatgcgcccatccctgggcccgaaggtctaccctccagggatcctctagatccg

SEQ ID NO: 343299 - DNA, 505 bp, Homo sapiens
agtgggaggtgctgagccgcctgatttattccggtcccagaggagaaggcgccagaaccccgcggggtctgagcagcccagcgtgcccattccagcgcccgcgtccccgcagcatgccgcgcccccgcctgctggccgcgctgtgcggcgcgctgctctgcgcccccagcctcctcgtcgccctggtgggatttctgcatttcagccagagggacctgtctgcagctaccagatgctccccaccctgggagagctcagcggcatgtctgcacatgggccttttcagccttcttcatcccgcaattggaactgactttcccactcccatctcacacttgagaatctctgtttcttgtttcttgttttttattttatttttattttttctcccccctggtggacaatggtgaggagggtgaaggaaggttaaaagccactgctctacgggatgaaaaactaaacttgtcattcttcagatccctcccagtctggccccagcctaccc

SEQ ID NO: 343300 - DNA, 371 bp, Homo sapiens
taaccaagagccctgctaataggctatgtccacaaacataggccacaatgcaataattatcatatcaactccaggaatttactgatacttgggtttaaccctcaaatcaccagaaagccatagggttatactgaattttaaccgtgaaactggtagaattcagaataaaaacgaattcttccctcaatgtgacatgatacctaaaggtaccctgggtagggcgtggtggctcatgcctgtaatcccagcactttgggaggccgaggtgggtggatcacctgaggtcgggagttcaagaccagcctgaccaacacagagaaaccccatctctgctaaaaatacaaaaaaaaaattagccgggcatgctggtg

SEQ ID NO: 343301 - DNA, 638 bp, Homo sapiens
aatctccctggggtgccctccccaggcagcaatgccaggatgcctgtgtccacctccctccaccaggatggcagccaggagcggccggtgagcctgacctctaccacctcctcgtcgggctcctcctgtgacagtcgcagtgccatggaggagcccagcagctccgaggctcccgccaagaatggggcaggctccctgagaagccggcatctgcccaacagcaacaacaactccagcagctggttgaacgtgaaggggcccctctccccgttcaacagccgggcagcggcagggcctgcacaccacaagctcagctacctgggccgagtggtgcgggagatcgtggagacagagcgcatgtacgtacaggacctgcgcagcatcgtggaggactacctcttgaagatcattgacacacccgggctgctgaagccagaacaggtcagcgccctctttgggaacatagaaaatatctacgcgctgaacagagccaagagtttgatatctacactcagtattgcaacaattaccccaactccgtggccgccctgacggaatgcatgcgggacaagcagcaggccaagttctttcgggaccggcaggagctgctacagcactcgctgcccttgggctcctac

SEQ ID NO: 343302 - DNA, 2156 bp, Homo sapiens
ggaagcaccgccgggagccccctccaggcctctggacagggggagcagccgcctggaccgaagctacagctatagctacagcaatggcccaggcccattctacaataaagggctcatctctgaagaggagctcggggccagtgtggcttccctgagcagtgagaacccatatgccaccatccgggacctgcccagcttgccagggggcccccgggagagcagctacatggagatgaaaggccctccctcaggatctccccccaggcagcctcctcagttctgggacagccagaggcggcggcaaccccagccacagagagacagtggcacctacgagcagcccagccccctgatccatgaccgagactctgtgggctcccagccccctctgcctccgggcctaccccccggccactatgactcacccaagaacagccacatccctggacattatgacttgcctccagtacggcatcccccatcacctccacttcgacgccaggaccgttgaggagccaggatggtatggcagaggccagcacacctggctgttgctgctcaaggctggggacagagcctagtgtacccctgccaggagcagggagtggaccggcaggctgtgaacatgaacaacacttaacagagcaagtgatgggagccttgttcctgggttctaccatgggagacgctgatcagcaggatgcctggctccctttcccaacccactgctcccaaggcctccagggccctgtgtacataaactggtgggttggaagttgctgggtaactctgatttcagacatgcgtgtggggtaccttttctgtgcatgctcagcctgggctctgtgcgtgtgtgtgtttctgtgattttagaagggtaccaggcacaggttctgtcctagggcacttaccatttagtagggagatggaaccaacccaattaactctagcaatagcctcctaactggcctcctccattgattcagtgaaccttccaatgcatggctcataatttcaaaatacaggctggttagttactccctacctgaaagccttcataggtgcctctttgctcttctgccagtatcaaaacttttgaaggccttaaaggccctgctttgcctggcccatctgtctctccagcctcaccttgaactgtgttcctgtcactgcacgccagtcacaccggcctctaggtcctcctgtaggccactcttctttctggcacagggacctgcacacctggagtgcccttcctcccccactcgcctgttcacccctgcttttcctttacacctcctcctcagggaagtgcccaccctccgtacatctttcacagccctgattgcagctgtgttcactcaccaggtacctgcagaaggcctacagggtgccaggcacttctttaatgtgttctttctttatgtgattatttgattaatctctgcctcccccactagactgtaagctccctgaaggcaagaatcctgtgcttatgctcaatattagctctcccttggcacagagtaggcactcaacaaatgctccccaaaaggctgagtggctgactgaattaagtaccagtgacatgcagtaactgctaagatagatgagccatctgtatgctctgacagttacagactgaataagttggagacttccctaaagggtggcatttccccagggtaacaacgcagagctcaggtgtgggaaggtgccaggggcaggggtgcagaggggctgaggctgaggggggtgcagaggctggagaaaggataacaggagagagtatacaggcatgccttgatttattgcacttcacaggtagcagaatttttaaagaaattgaaggttttgggacatatatgtgacagcaataggttaagaaaagcaaagcagagaaattgaagatttgtgtcaacactgctttaagcaaatctgttggcaccatttttccaatagcatgtgcccattttgggtctctacattgcattttggtaattgcttgcaatatttcaagcattttcattgttattatatgtgttatagtgatctgtgatcagtgatctttgatatattattgtaattgtttcggggcgccatgaaccgcacccatataacacggtaaacttaatcagcaaacgttgtgtgtgttc

SEQ ID NO: 343303 - DNA, 1305 bp, Homo sapiens
ggaagcaccgccgggagccccctccaggcctctggacagggggagcagccgcctggaccgaagctacagctatagctacagcaatggcccaggcccattctacaataaagggctcatctctgaagaggagctcggggccagtgtggcttccctgagcagtgagaacccatatgccaccatccgggacctgcccagcttgccagggggcccccgggagagcagctacatggagatgaaaggccctccctcaggatctccccccaggcagcctcctcagttctgggacagccagaggcggcggcaaccccagccacagagagacagtggcacctacgagcagcccagccccctgatccatgaccgagactctgtgggctcccagccccctctgcctccgggcctaccccccggccactatgactcacccaagaacagccacatccctggacattatgacttgcctccagtacggcatcccccatcacctccacttcgacgccaggaccgttgaggagccaggatggtatggcagaggccagcacacctggctgttgctgctcaaggctggggacagagcctagtgtacccctgccaggagcagggagtggaccggcaggctgtgaacatgaacaacacttaacagagcaagtgatgggagccttgttcctgggttctaccatgggagacgctgatcagcaggatgcctggctccctttcccaacccactgctcccaaggcctccagggccctgtgtacataaactggtgggttggaagttgctgggtaactctgatttcagacatgcgtgtggggtaccttttctgtgcatgctcagcctgggctctgtgcgtgtgtgtgtttctgtgattttagaagggtaccaggcacaggttctgtcctagggcacttaccatttagtagggagatggaaccaacccaattaactctagcaatagcctcctaactggcctcctccattgattcagtgaaccttccaatgcatggctcataatttcaaaatacaggctggttagttactccctacctgaaagccttcataggtgcctctttgctcttctgccagtatcaaaacttttgaaggccttaaaggccctgctttgcctggcccatctgtctctccagcctcaccttgaactgtgttcctgtcactgcacgccagtcacaccggcctctaggtcctcctgtaggccactcttctttctgcgctcagagtcaaatggtctcctcgagtgctcttgcaatccccactaggctttattctatactcaacaatcagaaagaaat

SEQ ID NO: 343304 - DNA, 143 bp, Homo sapiens
aatcccagcactttgggaggctgagatgggaggatctcttgagtccaggagttcaagatcagtccacagcctgggcaacatgataagatccctgtctctacaaaagaaagaaagaaaaaagaaagttaaaaaacttatctggg

SEQ ID NO: 343305 - DNA, 608 bp, Homo sapiens
agaccatccttgttgacggagtcagtgaggaatttcggcttgttgacctgcttcctagcacccactatactgccaccatgtatgccaccaatggacctctcaccagtggcaccatcagcaccaacttttctactctcctggaccctccggcaaacctgacagccagtgaagtcaccagacaaagtgccctgatctcctggcagcctcccagggcagagattgaaaattatgtcttgacctacaaatccaccgatggaagccgcaaggagctgattgtggatgcagaagacacctggattcgactggagggcctgttggagaacacagactacacggtgctcctgcaggcagcacaggacaccacgtggagcagcatcacctccaccgctttcaccacagcccctaccaggaaacctctcactaacaaggtaaccgcaggaaccagcagtacaactccctgatccacccggaccaattaaatgcaccaagtaaagacatcaggttctggctgggtgcggtgactcacacctataatcccagcacttcgggggcctagatgggcagattacctgaggtcaggagtttgagaccagcctgtccaacatgat

SEQ ID NO: 343306 - DNA, 223 bp, Homo sapiens
actaatatactagtttttttctttcacttttttactattcatttttctttgcttttttgttttttcattgttctcgttttagaagtttgatcatgatactccctctttctttcttccctttgttaatttggaaggtccactgttgttttacattctgctagcagttactgctcctttcccaacactcataatcaaaagcatattcgtctctcacgaggtcagg

SEQ ID NO: 343307 - DNA, 550 bp, Homo sapiens
ccatgtttgctgcaatcacagtattcctgaggttagttcccttctcacatattctaaatgcaaggtgttactgatagggtgatgacaacaagaatctgtccattaaactgacagtgttagatgtttccaggttagtaggcttctttcagcaattagtgtgtatgtgtggggtaaggaaggtgctatgagatacatttcttaggcaatagagagcttcaattaagtagccaaattacagttgatgttattgtgtaactattttggcagtatgtatcagaatccattcatgctctttgacccagaaatgctactgtagcggtcctgctattgccatatcaattaaggataactgggagtgggaagccatataagccaagatgttcatagagacattatcaaaggtatataacagaaaaaaacacctcattctttaacagctggtaagtggtgttttagctcttagaatgttgtccttaaacaattgttatgaagtctgactgtctcacaccttgcatttagaatatgtgagaagggaactaacctcaggaat

SEQ ID NO: 343308 - DNA, 780 bp, Homo sapiens
gcctagcagcaacagaatctttaatgagcaagtagaaacagccagaagtgaagtggtgttggtactagggaaaggttagaaggagtcagatttgaaacacgaatgcatgttttactagccgtgtgactttcaatttggcacctcacctttccaagcctcagcttcttttcgtgtaaactgaggatagtccctccctagtggagtttctcttggtattaaatgtatgaagtgcctgacatgtaggtcccttgctagtataggaggtgctggaaatgaagtatgtgtctttacgaggtgttactgatagggtgatgacaacaagaatctgtccattaaactgacagtgttagatgtttccaggttagtaggcttctttcagcaattagtgtgtatgtgtggggtaaggaaggtgctatgagatacatttcttaggcaatagagagcttcaattaagtagccaaattacagttgatgttattgtgtaactattttggcagtatgtatcagaatccattcatgctctttgacccagaaatgctactgtagcggtcctgctattgccatatcaattaaggataactgggagtgggaagccatataagccaagatgttcatagagacattatcaaaggtatataacagaaaaaaacacctcattctttaacagctggtaagtggtgttttagctcttagaatgttgtccttaaacaattgttatgaagtctgactgtctcacaccttgcatttagaatatgtgagaagggaactaacctcaggaat

SEQ ID NO: 343309 - DNA, 438 bp, Homo sapiens
atcatactgtaagatgaggaaatggtagatgagcagaaaaaggtggctgaggcagaatagggcagctaagatgattaacaagttctggcttgagtgaatgaatagataaatggtggaatcattcaatgacagaatgtggaagagtggtgacaaggctagttttaggtacttgtggaatatccaggtgaataaatccaatagtcaattagaagatggcagagagaaagagcaaaagaaaaaagatttgcatataacctgcattaagtggtattgaaagttctcactatgttaagtgctaggaacataacaaagaacaaatcacagcctcatacaaggaagcttatagaagatgactgtaaaacatcaattacagaactttgagtggtaatgatgtgtcaaggtaggttcatcaattgtagcaaatgaaccactctggtg

SEQ ID NO: 343310 - DNA, 262 bp, Homo sapiens
ccaatcaacatccaaccatggacctgctctgtttctgtcaataatttgttgtttctggtctgcaataccaaaacatagttatcatgcaggttaccttcaaaattttcatgtcatccaccccatattgaaattatcaccaaacttactatttctccattcaaaatgcctcctgaattagccttttcttcttcagtcatccatcactcaacttaaagtcttcatcctcttaagtctagaggactatcagagtttggatcaattt

SEQ ID NO: 343311 - DNA, 499 bp, Homo sapiens
ccttgggcaacagagcgagactctgtctcaaaaaaaaaaaaaatttaaaatgacaagttaaaaagtgataggtaaggatgatatatttctgtgactacccagattagaaaaagaactaatagctatttttccatatatatttatatataaataattttataatgtgtgtattatatatcatcaaaatatattttataatattgtgtatgttattgtatatattatcttttatatataaacataaaatttacatacacaaattttattaaaatataaatatattcattgtgtatataaaatatagctattatatacagtatacaatttaatagctattacaatatgcaatattacatatactgtacaatttatattgtatatatgtataaataaaagacatacacatatatatatatcatgtgttacttaatgattgggtagtcacagaccgatccgagtagggccagatatacggatccctggggtgggtagtcacaga

SEQ ID NO: 343312 - DNA, 645 bp, Homo sapiens
gagccgttcatgtcagagactcactctctgctcagcgaggacttggccgcctcacttggagtcttggtcctcgctgagcagagagggagccgttcatgtcagagactcactgccagaaaagccttacccattttggttttcactattgagaccgcaactgcttgcactgatcattttggttcatgagcagttggtgattttagttggtctggtgttcgggctaagaatattttattgtggacttaattacaaccactgcactgtaatgattcaatgctgtattatgatattgctgtaaacaaaattcattcttatattgtcacttattctttgcctgattcagaagttaaataggagctttggaatcattattcatgacccctctgcaaatgtgtcagtctccaaagagagtatctccccccaaattttgtgtagcttcttttgttatggaaaatggtggacaaaaaaagaaactgtgataactggggcgttgttttttaaaataaactccagcacagggatgctgtgcatgcctgagttgattccgaagtgcatatgtctgtaaggatttggagtgcctgcagtgttttatgtgtgggaagtaagggtgagtctcatattcttctattaaatttgccacaagaa

SEQ ID NO: 343313 - DNA, 1268 bp, Homo sapiens
ccacctcctacctgccgggcgggacgagcaacatgattggtggaatcgagtaattactgatcagtattgtccaatcacggagggcagtttagagccggcccaatgagggcctccagggggcgggtcggactgccgcgggccggggagcgctctgggtggccagctgtgggcccgggccgtcgtgggctccggcttgcgtgcggagatgagcgggtccctcggccgagctgcggcggctctgctccgctgggggcgcggcgcgggcggcggtggcctttggggtccgggcgtgcgggcggcgggctcgggcgcgggcggcggcggctcggcggagcagttggacgcgctggtgaagaaggacaaggtggtggtcttcctcaaggggacgccggagcagccccagtgcggcttcagcaacgccgtggtgcagatcctgcggctgcacggcgtccgcgattacgcggcctacaacgtgctggacgacccggagctccgacaaggcattaaagactattccaactggcccaccatcccgcaagtgtacctcaatggcgagtttgtagggggctgtgacattcttctgcagatgcaccagaatggggacttggtggaagaactgaaaaagctggggatccactccgcccttttagatgaaaagaaagaccaagactccaagtgagggcggccaagtcctcgctgagcagagagggagccgttcatgtcagagactcactgccagaaaagccttacccattttggttttcactattgagaccgcaactgcttgcactgatcattttggttcatgagcagttggtgattttagttggtctggtgttcgggctaagaatattttattgtggacttaattacaaccactgcactgtaatgattcaatgctgtattatgatattgctgtaaacaaaattcattcttatattgtcacttattctttgcctgattcagaagttaaataggagctttggaatcattattcatgacccctctgcaaatgtgtcagtctccaaagagagtatctccccccaaattttgtgtagcttcttttgttatggaaaatggtggacaaaaaaagaaactgtgataactggggcgttgttttttaaaataaactccagcacagggatgctgtgcatgcctgagttgattccgaagtgcatatgtctgtaaggatttggagtgcctgcagtgttttatgtgtgggaagtaagggtgagtctcatattcttctattaaatttgccacaagaa

SEQ ID NO: 343314 - DNA, 2370 bp, Homo sapiens
ccttctcaaggattactcttaatctttaatggcagctgcattctcaacttaatacaacgttcaacaaataaaaaagacaactgcttctgagcccaatattatacattaggtaaggaacacgatactcctcattactgttctgtctcaggatataagtttgcaaattcttctcctgatctcagtcaacataaaagcagaattacagtttagagtgggcaatgagaaaggtggaatcaaaatagacacagggaaggccataaagagttcgcaagcataaatgcctgatagcaaaaacgatcacagaagattccaaaaccacaatcctgcacaaaggccatctcaatcttacacaaaaaatacttctgcaatgcctgccgagcacctgcctgtccaacctgggactggtgtcacctttgttactgatccttgtagtcaaaaataattatctcaaaacaattatgtaaccctcctcatttttcctttaaagacctttgtcttcctctatctcccaggatacacacagttaactatcgcatgcattttctcattgcagtgctctattcctgaataaatgccattttcttttagagagcctctctctgttcgttatttaagttgacagcaacaaacagtttaggtttttggcaacaaatcaccaatatttacttaaaaacaaacaaaacacttacaacacaggtaggaacaacagtttattttggaaagagtttaatatattctctattgttaagtgcaccagatgctggacttctgaaacaacaattatgcttctgcataatagctttttctacatatttctgttcatgttgcttgttcctctgatttacctggaatcaatgaatctgaaaaacaaaaagattctttaagcacctggtaaatttcaggtcccacattagaaaatgagcaatcatcaataatattgatgggggtgaaaatatgacattgagactttcgggtaatgtgccgagtttactttcatagtttactaggctcaggtttcatgccgaaggattatttgaaagactcactcactgacatgattttctgattttaaattcgaacactctcaaagcataaacagatcacctccagcaacattgtaaaaaaatactcaaagtttaaaaaaaaaaaagtaacttgtggcagtacttagtgttcaacagaaaacactccatctgctaaacaatatctcgactgcaaagcttctcttactgttggcggatagataatgacatagcccagtcattatcaccgtggcaacagcgaccagaaactatcagaggaaaattgcacatggaacagctggctctcgagcaggcatgcctcagcttcctctggagtatgctttttctgcaagtctggtgtgctcgagggtaccaccaaccctgtgcggctccaagactacagattatgtagcaagtccactggtcctgctcttccggatttattcttcccgccaataggagcacttaccacgttccaagcatcgtcctaggcactgaggatacagcagtgaataaaactgagtgctgggtaggaagtcaataaccaagctagtaaataactgtatattgtcaagcactggcattaaagactattccaactggcccaccatcccgcaagtgtacctcaatggcgagtttgtagggggctgtgacattcttctgcagatgcaccagaatggggacttggtggaagaactgaaaaagctggggatccactccgcccttttagatgaaaagaaagaccaagactccaagtgagggcggccaagtcctcgctgagcagagagggagccgttcatgtcagagactcactgccagaaaagccttacccattttggttttcactattgagaccgcaactgcttgcactgatcattttggttcatgagcagttggtgattttagttggtctggtgttcgggctaagaatattttattgtggacttaattacaaccactgcactgtaatgattcaatgctgtattatgatattgctgtaaacaaaattcattcttatattgtcacttattctttgcctgattcagaagttaaataggagctttggaatcattattcatgacccctctgcaaatgtgtcagtctccaaagagagtatctccccccaaattttgtgtagcttcttttgttatggaaaatggtggacaaaaaaagaaactgtgataactggggcgttgttttttaaaataaactccagcacagggatgctgtgcatgcctgagttgattccgaagtgcatatgtctgtaaggatttggagtgcctgcagtgttttatgtgtgggaagtaagggtgagtctcatattcttctattaaatttgccacaagaa

SEQ ID NO: 343315 - DNA, 1739 bp, Homo sapiens
ccttctcaaggattactcttaatctttaatggcagctgcattctcaacttaatacaacgttcaacaaataaaaaagacaactgcttctgagcccaatattatacattaggtaaggaacacgatactcctcattactgttctgtctcaggatataagtttgcaaattcttctcctgatctcagtcaacataaaagcagaattacagtttagagtgggcaatgagaaaggtggaatcaaaatagacacagggaaggccataaagagttcgcaagcataaatgcctgatagcaaaaacgatcacagaagattccaaaaccacaatcctgcacaaaggccatctcaatcttacacaaaaaatacttctgcaatgcctgccgagcacctgcctgtccaacctgggactggtgtcacctttgttactgatccttgtagtcaaaaataattatctcaaaacaattatgtaaccctcctcatttttcctttaaagacctttgtcttcctctatctcccaggatacacacagttaactatcgcatgcattttctcattgcagtgctctattcctgaataaatgccattttcttttagagagcctctctctgttcgttatttaagttgacagcaacaaacagtttaggtttttggcaacaaatcaccaatatttacttaaaaacaaacaaaacacttacaacacaggtaggaacaacagtttattttggaaagagtttaatatattctctattgttaagtgcaccagatgctggacttctgaaacaacaattatgcttctgcataatagctttttctacatatttctgttcatgttgcttgttcctctgatttacctggaatcaatgaatcacgttccaagcatcgtcctaggcactgaggatacagcagtgaataaaactgagtgctgggtaggaagtcaataaccaagctagtaaataactgtatattgtcaagcactggcattaaagactattccaactggcccaccatcccgcaagtgtacctcaatggcgagtttgtagggggctgtgacattcttctgcagatgcaccagaatggggacttggtggaagaactgaaaaagctggggatccactccgcccttttagatgaaaagaaagaccaagactccaagtgagggcggccaagtcctcgctgagcagagagggagccgttcatgtcagagactcactgccagaaaagccttacccattttggttttcactattgagaccgcaactgcttgcactgatcattttggttcatgagcagttggtgattttagttggtctggtgttcgggctaagaatattttattgtggacttaattacaaccactgcactgtaatgattcaatgctgtattatgatattgctgtaaacaaaattcattcttatattgtcacttattctttgcctgattcagaagttaaataggagctttggaatcattattcatgacccctctgcaaatgtgtcagtctccaaagagagtatctccccccaaattttgtgtagcttcttttgttatggaaaatggtggacaaaaaaagaaactgtgataactggggcgttgttttttaaaataaactccagcacagggatgctgtgcatgcctgagttgattccgaagtgcatatgtctgtaaggatttggagtgcctgcagtgttttatgtgtgggaagtaagggtgagtctcatattcttctattaaatttgccacaagaa

SEQ ID NO: 343316 - DNA, 1285 bp, Homo sapiens
ccacctcctacctgccgggcgggacgagcaacatgattggtggaatcgagtaattactgatcagtattgtccaatcacggagggcagtttagagccggcccaatgagggcctccagggggcgggtcggactgccgcgggccggggagcgctctgggtggccagctgtgggcccgggccgtcgtgggctccggcttgcgtgcggagatgagcgggtccctcggccgagctgcggcggctctgctccgctgggggcgcggcgcgggcggcggtggcctttggggtccgggcgtgcgggcggcgggctcgggcgcgggcggcggcggctcggcggagcagttggacgcgctggtgaagaaggacaaggtggtggtcttcctcaaggggacgccggagcagccccagtgcggcttcagcaacgccgtggtgcagatcctgcggctgcacggcgtccgcgattacgcggcctacaacgtgctggacgacccggagctccgacaaggcattaaagactattccaactggcccaccatcccgcaagtgtacctcaatggcgagtttgtagggggctgtgacattcttctgcagatgcaccagaatggggacttggtggaagaactgaaaaagctggggatccactccgcccttttagatgaaaagaaagaccaagactccaagtgagggcggccaagtcctcgctgagcagagagggagccgttcatgtcagagactcactgccagaaaagccttacccattttggttttcactattgagaccgcaactgcttgcactgatcattttggttcatgagcagttggtgattttagttggtctggtgttcgggctaagaatattttattgtggacttaattacaaccactgcactgtaatgattcaatgctgtattatgatattgctgtaaacaaaattcattcttatattgtcacttattctttgcctgattcagaagttaaataggagctttggaatcattattcatgacccctctgcaaatgtgtcagtctccaaagagagtatctccccccaaattttgtgtagcttcttttgttatggaaaatggtggacaaaaaaagaaactgtgataactggggcgttgttttttaaaataaactgcacccagcccagactgactttttttaaagtgggactaccagaggccgggtgcggtggatcagtttggcaggccggggtgggaggattgcttgagtccgggagtttaagaccagtctgagcgacatagtgaaaccccatttcattaaaaaaaa

SEQ ID NO: 343317 - DNA, 2670 bp, Homo sapiens
ccttctcaaggattactcttaatctttaatggcagctgcattctcaacttaatacaacgttcaacaaataaaaaagacaactgcttctgagcccaatattatacattaggtaaggaacacgatactcctcattactgttctgtctcaggatataagtttgcaaattcttctcctgatctcagtcaacataaaagcagaattacagtttagagtgggcaatgagaaaggtggaatcaaaatagacacagggaaggccataaagagttcgcaagcataaatgcctgatagcaaaaacgatcacagaagattccaaaaccacaatcctgcacaaaggccatctcaatcttacacaaaaaatacttctgcaatgcctgccgagcacctgcctgtccaacctgggactggtgtcacctttgttactgatccttgtagtcaaaaataattatctcaaaacaattatgtaaccctcctcatttttcctttaaagacctttgtcttcctctatctcccaggatacacacagttaactatcgcatgcattttctcattgcagtgctctattcctgaataaatgccattttcttttagagagcctctctctgttcgttatttaagttgacagcaacaaacagtttaggtttttggcaacaaatcaccaatatttacttaaaaacaaacaaaacacttacaacacaggtaggaacaacagtttattttggaaagagtttaatatattctctattgttaagtgcaccagatgctggacttctgaaacaacaattatgcttctgcataatagctttttctacatatttctgttcatgttgcttgttcctctgatttacctggaatcaatgaatctgaaaaacaaaaagattctttaagcacctggtaaatttcaggtcccacattagaaaatgagcaatcatcaataatattgatgggggtgaaaatatgacattgagactttcgggtaatgtgccgagtttactttcatagtttactaggctcaggtttcatgccgaaggattatttgaaagactcactcactgacatgattttctgattttaaattcgaacactctcaaagcataaacagatcacctccagcaacattgtaaaaaaatactcaaagtttaaaaaaaaaaaagtaacttgtggcagtacttagtgttcaacagaaaacactccatctgctaaacaatatctcgactgcaaagcttctcttactgttggcggatagataatgacatagcccagtcattatcaccgtggcaacagcgaccagaaactatcagaggaaaattgcacatggaacagctggctctcgagcaggcatgcctcagcttcctctggagtatgctttttctgcaagtctggtgtgctcgagggtaccaccaaccctgtgcggctccaagactacagattatgtagcaagtccactggtcctgctcttccggatttattcttcccgccaataggagcacttaccacgttccaagcatcgtcctaggcactgaggatacagcagtgaataaaactgagtgctgggtaggaagtcaataaccaagctagtaaataactgtatattgtcaagcactggtaagtacaagggagagcagagcaagcaatgggcctgatgaggcttgctttgtctcctctgcactcccacactgctttgtatctgcttctcatttctcacgatgggtccaagctttgggcaccaggtctccctggacattccgcgctggcactgcgcctagcacccagcggctgctcaggaaacgtttgtcgaacgaacgaattcacttcttagttccccattcaacaaacctttcctgatcctaggcccaacaggttaaaaggctggagggccaacgaggctggaaactcagaggcggccgggggcggtggctcacgcctgtaatcccagcactttaagaggccgaggcaggaggatcccttgaagccaggagttcgagaccagcctgggcaaaaaagtgagacatcgaccccccgcccccgccgccaattccgtctctacaaaaaggaagaaaaaaaaaaaaacccagaggaaatcacacaggcaaaagcgctttacaaattttaaaaatgaaaactgttctagagaaataatcgcgcgccggaggcggaagccccagagcctcagctcccacgtggcggcggagccagggaaagtccaggagccaaggctacggcccgagcgctggaaccccggtcaggctccggctccccgccacgacgaactgcatgcggccgcggcgctccggaggcgcccggggacgctcacctaagctgggagaggcggatacccgcccggcctagccccgctacctcccaagagaccaacacgacaagcgcgcgcccaccgcattgccatggcaattcaaccgccgctgacaccggaaccggaaacttcatcaggaggtgaccccttcccggcgttccgcggaacgggcgagtcccgcgcctctcccagttgtctcggcgtagtccagctggcctcattggctcacaggaggaaagtcgtcttccctcttgttttgcctctcgttgccctgcaagcgtgaccctgatggacatccagtctctccaattaactaacaaagcggttgccgacgaccaatagtaaggcagtaggatgaggct

SEQ ID NO: 343318 - DNA, 2039 bp, Homo sapiens
ccttctcaaggattactcttaatctttaatggcagctgcattctcaacttaatacaacgttcaacaaataaaaaagacaactgcttctgagcccaatattatacattaggtaaggaacacgatactcctcattactgttctgtctcaggatataagtttgcaaattcttctcctgatctcagtcaacataaaagcagaattacagtttagagtgggcaatgagaaaggtggaatcaaaatagacacagggaaggccataaagagttcgcaagcataaatgcctgatagcaaaaacgatcacagaagattccaaaaccacaatcctgcacaaaggccatctcaatcttacacaaaaaatacttctgcaatgcctgccgagcacctgcctgtccaacctgggactggtgtcacctttgttactgatccttgtagtcaaaaataattatctcaaaacaattatgtaaccctcctcatttttcctttaaagacctttgtcttcctctatctcccaggatacacacagttaactatcgcatgcattttctcattgcagtgctctattcctgaataaatgccattttcttttagagagcctctctctgttcgttatttaagttgacagcaacaaacagtttaggtttttggcaacaaatcaccaatatttacttaaaaacaaacaaaacacttacaacacaggtaggaacaacagtttattttggaaagagtttaatatattctctattgttaagtgcaccagatgctggacttctgaaacaacaattatgcttctgcataatagctttttctacatatttctgttcatgttgcttgttcctctgatttacctggaatcaatgaatcacgttccaagcatcgtcctaggcactgaggatacagcagtgaataaaactgagtgctgggtaggaagtcaataaccaagctagtaaataactgtatattgtcaagcactggtaagtacaagggagagcagagcaagcaatgggcctgatgaggcttgctttgtctcctctgcactcccacactgctttgtatctgcttctcatttctcacgatgggtccaagctttgggcaccaggtctccctggacattccgcgctggcactgcgcctagcacccagcggctgctcaggaaacgtttgtcgaacgaacgaattcacttcttagttccccattcaacaaacctttcctgatcctaggcccaacaggttaaaaggctggagggccaacgaggctggaaactcagaggcggccgggggcggtggctcacgcctgtaatcccagcactttaagaggccgaggcaggaggatcccttgaagccaggagttcgagaccagcctgggcaaaaaagtgagacatcgaccccccgcccccgccgccaattccgtctctacaaaaaggaagaaaaaaaaaaaaacccagaggaaatcacacaggcaaaagcgctttacaaattttaaaaatgaaaactgttctagagaaataatcgcgcgccggaggcggaagccccagagcctcagctcccacgtggcggcggagccagggaaagtccaggagccaaggctacggcccgagcgctggaaccccggtcaggctccggctccccgccacgacgaactgcatgcggccgcggcgctccggaggcgcccggggacgctcacctaagctgggagaggcggatacccgcccggcctagccccgctacctcccaagagaccaacacgacaagcgcgcgcccaccgcattgccatggcaattcaaccgccgctgacaccggaaccggaaacttcatcaggaggtgaccccttcccggcgttccgcggaacgggcgagtcccgcgcctctcccagttgtctcggcgtagtccagctggcctcattggctcacaggaggaaagtcgtcttccctcttgttttgcctctcgttgccctgcaagcgtgaccctgatggacatccagtctctccaattaactaacaaagcggttgccgacgaccaatagtaaggcagtaggatgaggct

SEQ ID NO: 343319 - DNA, 1697 bp, Homo sapiens
ccttctcaaggattactcttaatctttaatggcagctgcattctcaacttaatacaacgttcaacaaataaaaaagacaactgcttctgagcccaatattatacattaggtaaggaacacgatactcctcattactgttctgtctcaggatataagtttgcaaattcttctcctgatctcagtcaacataaaagcagaattacagtttagagtgggcaatgagaaaggtggaatcaaaatagacacagggaaggccataaagagttcgcaagcataaatgcctgatagcaaaaacgatcacagaagattccaaaaccacaatcctgcacaaaggccatctcaatcttacacaaaaaatacttctgcaatgcctgccgagcacctgcctgtccaacctgggactggtgtcacctttgttactgatccttgtagtcaaaaataattatctcaaaacaattatgtaaccctcctcatttttcctttaaagacctttgtcttcctctatctcccaggatacacacagttaactatcgcatgcattttctcattgcagtgctctattcctgaataaatgccattttcttttagagagcctctctctgttcgttatttaagttgacagcaacaaacagtttaggtttttggcaacaaatcaccaatatttacttaaaaacaaacaaaacacttacaacacaggtaggaacaacagtttattttggaaagagtttaatatattctctattgttaagtgcaccagatgctggacttctgaaacaacaattatgcttctgcataatagctttttctacatatttctgttcatgttgcttgttcctctgatttacctggaatcaatgaatctttcctgatcctaggcccaacaggttaaaaggctggagggccaacgaggctggaaactcagaggcggccgggggcggtggctcacgcctgtaatcccagcactttaagaggccgaggcaggaggatcccttgaagccaggagttcgagaccagcctgggcaaaaaagtgagacatcgaccccccgcccccgccgccaattccgtctctacaaaaaggaagaaaaaaaaaaaaacccagaggaaatcacacaggcaaaagcgctttacaaattttaaaaatgaaaactgttctagagaaataatcgcgcgccggaggcggaagccccagagcctcagctcccacgtggcggcggagccagggaaagtccaggagccaaggctacggcccgagcgctggaaccccggtcaggctccggctccccgccacgacgaactgcatgcggccgcggcgctccggaggcgcccggggacgctcacctaagctgggagaggcggatacccgcccggcctagccccgctacctcccaagagaccaacacgacaagcgcgcgcccaccgcattgccatggcaattcaaccgccgctgacaccggaaccggaaacttcatcaggaggtgaccccttcccggcgttccgcggaacgggcgagtcccgcgcctctcccagttgtctcggcgtagtccagctggcctcattggctcacaggaggaaagtcgtcttccctcttgttttgcctctcgttgccctgcaagcgtgaccctgatggacatccagtctctccaattaactaacaaagcggttgccgacgaccaatagtaaggcagtaggatgaggct

SEQ ID NO: 343320 - DNA, 1219 bp, Homo sapiens
ccttctcaaggattactcttaatctttaatggcagctgcattctcaacttaatacaacgttcaacaaataaaaaagacaactgcttctgagcccaatattatacattaggtaaggaacacgatactcctcattactgttctgtctcaggatataagtttgcaaattcttctcctgatctcagtcaacataaaagcagaattacagtttagagtgggcaatgagaaaggtggaatcaaaatagacacagggaaggccataaagagttcgcaagcataaatgcctgatagcaaaaacgatcacagaagattccaaaaccacaatcctgcacaaaggccatctcaatcttacacaaaaaatacttctgcaatgcctgccgagcacctgcctgtccaacctgggactggtgtcacctttgttactgatccttgtagtcaaaaataattatctcaaaacaattatgtaaccctcctcatttttcctttaaagacctttgtcttcctctatctcccaggatacacacagttaactatcgcatgcattttctcattgcagtgctctattcctgaataaatgccattttcttttagagagcctctctctgttcgttatttaagttgacagcaacaaacagtttaggtttttggcaacaaatcaccaatatttacttaaaaacaaacaaaacacttacaacacaggtaggaacaacagtttattttggaaagagtttaatatattctctattgttaagtgcaccagatgctggacttctgaaacaacaattatgcttctgcataatagctttttctacatatttctgttcatgttgcttgttcctctgatttacctggaatcaatgaatctaagctgggagaggcggatacccgcccggcctagccccgctacctcccaagagaccaacacgacaagcgcgcgcccaccgcattgccatggcaattcaaccgccgctgacaccggaaccggaaacttcatcaggaggtgaccccttcccggcgttccgcggaacgggcgagtcccgcgcctctcccagttgtctcggcgtagtccagctggcctcattggctcacaggaggaaagtcgtcttccctcttgttttgcctctcgttgccctgcaagcgtgaccctgatggacatccagtctctccaattaactaacaaagcggttgccgacgaccaatagtaaggcagtaggatgaggct

SEQ ID NO: 343321 - DNA, 385 bp, Homo sapiens
agctataccaccctataccaccctataccaccctataccacccgataccactgactataccaccctataccaccctataccaccctataccaccataccactctataccaccgtgatacccctctgcaaatgtgtcagtctccaaagagagtatctccccccaaattttgtgtagcttcttttgttatggaaaatggtggacaaaaaaagaaactgtgataactggggcgttgttttttaaaataaactccagcacagggatgctgtgcatgcctgagttgattccgaagtgcatatgtctgtaaggatttggagtgcctgcagtgttttatgtgtgggaagtaagggtgagtctcatattcttctattaaatttgccacaagaa

SEQ ID NO: 343322 - DNA, 1140 bp, Homo sapiens
ccttctcaaggattactcttaatctttaatggcagctgcattctcaacttaatacaacgttcaacaaataaaaaagacaactgcttctgagcccaatattatacattaggtaaggaacacgatactcctcattactgttctgtctcaggatataagtttgcaaattcttctcctgatctcagtcaacataaaagcagaattacagtttagagtgggcaatgagaaaggtggaatcaaaatagacacagggaaggccataaagagttcgcaagcataaatgcctgatagcaaaaacgatcacagaagattccaaaaccacaatcctgcacaaaggccatctcaatcttacacaaaaaatacttctgcaatgcctgccgagcacctgcctgtccaacctgggactggtgtcacctttgttactgatccttgtagtcaaaaataattatctcaaaacaattatgtaaccctcctcatttttcctttaaagacctttgtcttcctctatctcccaggatacacacagttaactatcgcatgcattttctcattgcagtgctctattcctgaataaatgccattttcttttagagagcctctctctgttcgttatttaagttgacagcaacaaacagtttaggtttttggcaacaaatcaccaatatttacttaaaaacaaacaaaacacttacaacacaggtaggaacaacagtttattttggaaagagtttaatatattctctattgttaagtgcaccagatgctggacttctgaaacaacaattatgcttctgcataatagctttttctacatatttctgttcatgttgcttgttcctctgatttacctggaatcaatgaatcgcattgccatggcaattcaaccgccgctgacaccggaaccggaaacttcatcaggaggtgaccccttcccggcgttccgcggaacgggcgagtcccgcgcctctcccagttgtctcggcgtagtccagctggcctcattggctcacaggaggaaagtcgtcttccctcttgttttgcctctcgttgccctgcaagcgtgaccctgatggacatccagtctctccaattaactaacaaagcggttgccgacgaccaatagtaaggcagtaggatgaggct

SEQ ID NO: 343323 - DNA, 1322 bp, Homo sapiens
ccacctcctacctgccgggcgggacgagcaacatgattggtggaatcgagtaattactgatcagtattgtccaatcacggagggcagtttagagccggcccaatgagggcctccagggggcgggtcggactgccgcgggccggggagcgctctgggtggccagctgtgggcccgggccgtcgtgggctccggcttgcgtgcggagatgagcgggtccctcggccgagctgcggcggctctgctccgctgggggcgcggcgcgggcggcggtggcctttggggtccgggcgtgcgggcggcgggctcgggcgcgggcggcggcggctcggcggagcagttggacgcgctggtgaagaaggacaaggtggtggtcttcctcaaggggacgccggagcagccccagtgcggcttcagcaacgccgtggtgcagatcctgcggctgcacggcgtccgcgattacgcggcctacaacgtgctggacgacccggagctccgacaaggcattaaagactattccaactggcccaccatcccgcaagtgtacctcaatggcgagtttgtagggggctgtgacattcttctgcagatgcaccagaatggggacttggtggaagaactgaaaaagctggggatccactccgcccttttagatgaaaagaaagaccaagactccaagtgagggcggccaagtcctcgctgagcagagagggagccgttcatgtcagagactcactgccagaaaagccttacccattttggttttcactattgagaccgcaactgcttgcactgatcattttggttcatgagcagttggtgattttagttggtctggtgttcgggctaagaatattttattgtggacttaattacaaccactgcactgtaatgattcaatgctgtattatgatattgctgtaaacaaaattcattcttatattgtcacttattctttgcctgattcagaagttaaataggagctttggaatcattattcatgacccctctgcaaatgtgtcagtctccaaagagagtatctccccccaaattttgtgtagcttcttttgttatggaaaatggtggacaaaaaaagaaactgtgataactggggcgttgttttttaaaataaactccagcacagggatgctgtgcatgctgaaaaaaaaaaaaaaaaaaaaaaggggggggtaagattactccggggcgatttcggtcccgttttgaaagggcccaaggggcgtaaagaagagggggcggggaaacggggggaagacggttgtggggccttgggggatggggacacagagggaaataggtgtgtc

SEQ ID NO: 343324 - DNA, 1810 bp, Homo sapiens
gaatgttaagagtaatcttttatgtcttaagattgaagccacatttctttcttaccattttgttacagtcatcatccttgtggctcagaattgaacagagtagttgcacagctgcgctgtcacagagtgtccctcatctcatgtgtgtcctcagagccatttgcacacaggactgatcacatgcatgctggttggtttcttggctgctgtgagcgcttaagagcagagcgggtctcactcccccacccctcagccctggacagggaccttgctgagctctgggccttcattagactcaccagtcacttcgggttctgcacagagcctcatcatccactccacagagagcccatcacagtggctggatagatgggaactgacaacccatagctgtgggacagggatttttccctgggtaaaagtaattgttaaaaattaaaaaaaaaaaaaactcaacaactcatcatctcgaggagaagtgactgacggcctgcaccaacttagacggtcacagtcatgaaaagtgcacaggtgggattgcccgagttggccatgaattaccgtgatggatccatttggaaatgaagttggttgtgacatttcttcaagttttgtttcgcttgaagcttgactggtagatggagaattttggccttatgtatcttatgtgacttgcattacccagtccagtcctctgccattaatctaaggtccgcaatgtatcaggtattttactgagaatcttgcttacctaattctcacaaaaaaaaaaaccttgggagatgagggtggaaacaggatgagaggtcaggtgacttgtctgagggctgacggtttgtaattggaagagtcagggcctaaccactggtctctttgacacaaaaactcatgctcttagtggcaagcacagtgttctcaagattgggggaagccagggagggacagtgggttgtctgctactagtgggtcaaaattacatatttagtcatgaatggttcagcttttaccatttaaataacaaataaatgttctttctccataggcattaaagactattccaactggcccaccatcccgcaagtgtacctcaatggcgagtttgtagggggctgtgacattcttctgcagatgcaccagaatggggacttggtggaagaactgaaaaagctggggatccactccgcccttttagatgaaaagaaagaccaagactccaagtgagggcggccaagtcctcgctgagcagagagggagccgttcatgtcagagactcactgccagaaaagccttacccattttggttttcactattgagaccgcaactgcttgcactgatcattttggttcatgagcagttggtgattttagttggtctggtgttcgggctaagaatattttattgtggacttaattacaaccactgcactgtaatgattcaatgctgtattatgatattgctgtaaacaaaattcattcttatattgtcacttattctttgcctgattcagaagttaaataggagctttggaatcattattcatgacccctctgcaaatgtgtcagtctccaaagagagtatctccccccaaattttgtgtagcttcttttgttatggaaaatggtggacaaaaaaagaaactgtgataactggggcgttgttttttaaaataaactccagcacagggatgctgtgcatgcctgagttgattccgaagtgcatatgtctgtaaggatttggagtgcctgcagtgttttatgtgtgggaagtaagggtgagtctcatattcttctattaaatttgccacaagaa

SEQ ID NO: 343325 - DNA, 517 bp, Homo sapiens
tttcacctcaggtgccatttctgtttccatctctgatcagttagtagtggctgttcagagtggagtagcagccccccattgccgtgtatttgcaatctctgcacaaacggaactctcttttcctgggggagttgcagaagccatgcaaaggttatgatggcttgagtgaggttatacatctagttagtggcttctaagctgaaatgtctttattggctttcatttatagtattgccctatagaattcctgatataaatcaccttattctgtcaatcaaaaattgcatttaaatggtatctgatttttggataatgtgcctccacttaaactgatcatgtggtgggtcatgcttttcctatgagatgaaagtaaagaaggagaaataatggggtagttggatttattttattaacctgtatgcctgcacaggtgggatgctagctgaaagaagtagagtagtgacatactgacagtttaagttttcagtgttgacttgagtcaatgtatgtaagtatg

SEQ ID NO: 343326 - DNA, 239 bp, Homo sapiens
agaagggggtgtaggtactccaggggaaaggcctctccagcagattagcttgttcacgtgatactagagtcccaaaagggcaatagtggaagctctaaagcttcttgcagcttaggcttggactgaataaataacagcagtaacacaacagcaatggtaatagtaataatgaaaacaactcttctaaaaaatttgaggaaagtctcttgtctattgaatataaaaaatatttaccatta

SEQ ID NO: 343327 - DNA, 307 bp, Homo sapiens
actatcttcctcaatatgcctcaacattcataatgaggaattacacgtgaacactgaactctcttctgaacttctgcttaatgtggaaaactgaagagcaattcagaaaagatcaagcacatgtttctacgatgccaaacagctggatggaaatatgaaaactctataaataatctacattttgctaaatagccagacattgagtgttgaagctaaaacctcagttcttttattgctttatgatcattcttcaaatgacacagaaggcctgaagtgctcttgcgaatatttttcttcattatggctc

SEQ ID NO: 343328 - DNA, 315 bp, Homo sapiens
agctgtactgagagaagctgggtttggggtactcaagaactctgctgtttctacattttttttttgaacctaaaattccttcaaaacagttaaaacaaaagacagttatgctaccctcagcttgaatgccttacagttgtaggatatgataaatttctcttcatagattttagcctgtaaattgttaagtacaatgagttctgagatcctctccaaagaaccagtgtatcagtatgttcagctcccctgttctttgttcttcattttaaagtttaaattcctagttctttatttctccttgcccccagtttcagt

SEQ ID NO: 343329 - DNA, 353 bp, Homo sapiens
acagaagggcttaacaaaatgagggcttttattttctcacataaaacatctgaaagcaatccagcctttcagcctggcacacaggcttcatagtgcatttggggcttagcctctttctgtttggctgtctttagtaggtggctttattcttcatgagaacaagatagctgttccactttcaggcacaaagtctgaagcagatggcagcagccaataaaatttgtgctagtgaagtctgccctttaataagctctgctagaaaactttgccacttagctaaccagccacaaaagagtttgggaagctaggcacttttctgccccaaacaaaattgggggttgccttactgtaag

SEQ ID NO: 343330 - DNA, 718 bp, Homo sapiens
tagcactttgggaggccaaggtgggaggatcactggagctcaggagtttgagaccagcttgggcaacgtagtgagacttcatctctattaaaaaaaaaatgaaaagaaaaaattttaaagtccatatataactttaaaatcacatagagatatttatcaattagtatgtctttagagtaaggagaaaattgccttgcaagggcttaaacgataagggtggcttgtgccatccacgttaaggtctcctaggcgggctgcagataggagcccttctgcttggccactctccactgtggctttgccctggggcagcgccccctcttggtctcacttgtctagacttacacaagaggatggccaggtggaaccgggatcactcttcctgtgccacgcatgtcttctaagcccatcaccacgaacttctgaaatcagctgcctaaggtcatttcaagccgatatgttttccctaaacagttcttgttcaaataaagagatggagaggaggacttactacctgagtagctttgaggattgaaacataaggcaccaacctgtcttctaaaatcactttttgggccaggcgtggtggctcatgcctgtaatcccagcactttgggaggccgaagcaggcagatcacttgaggccaggagttcaagagcagcctggccaacatggcgaaaccctatctttactaaaaataccaaaaaattggctggg

SEQ ID NO: 343331 - DNA, 875 bp, Homo sapiens
ccgccgcccaagatgccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaggtaaagaacttgccactaaactgggttaaatgtacactgttgagttttctgtacataaaaataattgaaataatacaaattttccttcaaaaa

SEQ ID NO: 343332 - DNA, 964 bp, Homo sapiens
  misc_feature (878)..(878): n is a, c, g, or t
  misc_feature (883)..(886): n is a, c, g, or t
  misc_feature (897)..(897): n is a, c, g, or t
  misc_feature (910)..(910): n is a, c, g, or t
  misc_feature (915)..(916): n is a, c, g, or t
  misc_feature (924)..(924): n is a, c, g, or t
  misc_feature (932)..(932): n is a, c, g, or t
  misc_feature (938)..(938): n is a, c, g, or t
ccgccgcccaagatgccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaggtaaagaacttgccactaaactgggttaaatgtacactgttgagtttctggtcctaaaatattggattattccaattttccttcaaaaaaaaaatngggcnnnntgggggaaaangataaaggctggnagttnnaccttttnaagggaangggccnaaggagatatgagaatataaatatac

SEQ ID NO: 343333 - DNA, 545 bp, Homo sapiens
tattggagaaaacttagccctcattgaaaaaggctgccagagaaaagatatccacagggaaattcaggagttttgtttgtttttttttcttttaaggtggagttttgctcttgttgctcagtctggaatgcaatggcacgatctcagctcactgcatcctccgcctcctgggttcaagcaagtctcctgcctcagcctccctagtagctggggttacaggcatgcaccaccatgcccggctaatttttgtatttttagtagagatggggtttcaccatgttggtcaggctggtctcgaactcctgacctcaggtaatccacccgccctggcctcccaaagggctgagattacaggtgcgagctaccgcgcctggcttgttttgggttttggggttttttttgtgttttgtttgtttgtttgtttttggagacagtctctgtcacccaggctggagtgcagcagcgtgatctcggttgactgcaacctctgccttccaggttcaagtgattctcctgcctcagcctcccgaatagctgggattaca

SEQ ID NO: 343334 - DNA, 548 bp, Homo sapiens
ccattttcataatctattgccgccatttggaaatatctgttctcattagtaactatggcacttgcagcctaaatggtcatgaagtcactatccggaccatttttaggatgtccctgttggatgcaagtagtttaaagccatatgattcgtttttattagctgtgctgttcttaaccagggataataaaggctttgcaagtcaagtctgcatggcaaaaaaggtgtccacaagtgtgaatggctcatttttaatgactagccaacagccacttgtaaaagatgtaattgaaattgttcagagattaggttccgtctgctttgtcctccttctcaaaagttttcatggatccaagctattcttaagcattgtttaatactagaaataacctttatggactaataataagaaagaaaaaggcaaattttaaaagatattccaaattcaaagaaaataagtttggcagcctgacttttgattatctgtaaaaatcagggccaatagtttgaacggaagagtaaatatgaaggttttctaaacagttttttct

SEQ ID NO: 343335 - DNA, 241 bp, Homo sapiens
aagaggcagtagcattttgggccttaagaaaaggagaattggttgggagagtgtagacagagtgaacaggagactgcttaacagctcagaggtccatgctgggatcaggcagcaggatttttgggcagactcgggaatttcagataaagaatcccagcaggctgaagaagagctacttagagccacagggatgtaagcattgagaagactcagtggtgagtagaggtactttgcaaactgg

SEQ ID NO: 343336 - DNA, 1344 bp, Homo sapiens
ctctgaggatcccaacttcgacggacgcattcagcttacaattggagatggtctacaacatgacagtctggaatgtaaaaaggaagcaggatattgaagagggagcaccaccgcaagtgagaaaagagccagggagagagacgtcagtcaatacaccagaagagaaaatggacatagggaagcccaatgcccagatactcatcaatgaggcaagagcttcatgggcgcccactattattaactaggtagaataagaagtttaccaggtagggaaaaccagaaggtggggaagggaaggaggctgaggagtaactcttggaggtttaaaaaaaatgttagaaaaggtgagcatccggagtccatgacaaagcgaagattattcataggcctgggcaaagtcaagagatgaaggaaggaagtctttcttcctgtgcggggtggggagagcagcagcagcaaactttatcactaggttgaaaggggaaataacagaaacaaaactgctgtttgtattgatggcagtcacacaggggaaatctggttcctctttctatgagtgaagaaagaggtcaggggaggtacttggcactaaaggatgatataaccttgaaaggactggctcagggaggacaagagaatggtgtgtgtgtgtgtgtgtgtgtgtgtgtgtgtgtgtgtgtgtgtgaaggggagacctggtggagtgtgaatggcaatatgctatgggagtcgttttcactcaaaaaggaatagcaaaaccctctcatacagagaaaatgacagggcgcaaggagctcaaaaatgaagaggagccttccacttctaacaagaacacactagatgtaaattggcaatgctgaaagagcagtgagtcccagagccagaaggaactttcctaaggtatccagcccgtggatagtctaaatgtcccacgtagatgtgacaagccaggaatgatcccaatttacctagctccagaattgcctgatcttcttcttgactcaatgcccccaacctcacattcatccccttgcttcccatttctagctagtaggtaacagcactgagcccgttcaaatttctcacagacagtctctattcattctgacattatctctccagtaagtcctactctggttatcaaactttctgtagtctggagaacaaacaaatccctaatatggtcattcttttcatgctgagagatcaaactcatcctattactgggatcagtaatagtaaatgcaaccctgacaccgacaggagagagtcgtcaggtacattaccacttttcttcacagctgcccctatgaatgccatgaaggaccacggaattagggatgg

SEQ ID NO: 343337 - DNA, 1470 bp, Homo sapiens
ttgtgctgacagtggaaggttttttgacaacgtatggacagttctatagagcaaaatataagtatctagaaaaacaacatcaatataattaaaaatcagattaaaaattaggattcaaaacactaacaaagaggaaaatggcaaaatatcaagcactcagcttacaattggagatggtctacaacatgacagtctggaatgtaaaaaggaagcaggatattgaagagggagcaccaccgcaagtgagaaaagagccagggagagagacgtcagtcaatacaccagaagagaaaatggacatagggaagcccaatgcccagatactcatcaatgaggcaagagcttcatgggcgcccactattattaactaggtagaataagaagtttaccaggtagggaaaaccagaaggtggggaagggaaggaggctgaggagtaactcttggaggtttaaaaaaaatgttagaaaaggtgagcatccggagtccatgacaaagcgaagattattcataggcctgggcaaagtcaagagatgaaggaaggaagtctttcttcctgtgcggggtggggagagcagcagcagcaaactttatcactaggttgaaaggggaaataacagaaacaaaactgctgtttgtattgatggcagtcacacaggggaaatctggttcctctttctatgagtgaagaaagaggtcaggggaggtacttggcactaaaggatgatataaccttgaaaggactggctcagggaggacaagagaatggtgtgtgtgtgtgtgtgtgtgtgtgtgtgtgtgtgtgtgtgtgtgaaggggagacctggtggagtgtgaatggcaatatgctatgggagtcgttttcactcaaaaaggaatagcaaaaccctctcatacagagaaaatgacagggcgcaaggagctcaaaaatgaagaggagccttccacttctaacaagaacacactagatgtaaattggcaatgctgaaagagcagtgagtcccagagccagaaggaactttcctaaggtatccagcccgtggatagtctaaatgtcccacgtagatgtgacaagccaggaatgatcccaatttacctagctccagaattgcctgatcttcttcttgactcaatgcccccaacctcacattcatccccttgcttcccatttctagctagtaggtaacagcactgagcccgttcaaatttctcacagacagtctctattcattctgacattatctctccagtaagtcctactctggttatcaaactttctgtagtctggagaacaaacaaatccctaatatggtcattcttttcatgctgagagatcaaactcatcctattactgggatcagtaatagtaaatgcaaccctgacaccgacaggagagagtcgtcaggtacattaccacttttcttcacagctgcccctatgaatgccatgaaggaccacggaattagggatgg

SEQ ID NO: 343338 - DNA, 1028 bp, Homo sapiens
gaggctccactcacctgtccatttcaggcatcaacatttatgagccagcaccccctactggtcccacccagcgacccctggaaactctgggcaatttccgtggctggtacattagaactgaaaagctccagcagaaccaaagctggacagtgaagcagcagtgtgtggaccttctggccgagggcctgtgggaggagctgctggatgacgaacaaccagccattacggtcatggactggttcgaggacagccggctggatgcgtgcgtctatgagctgcatgtctggctgctggcggccgaccgccgcacggtcattgctcagcaccacgtggccccccgaacttctgggagaggaccccctggccgctgggtccaggtgtcccacgtattccgccattatggtcccggtgtgcgctttatccacttcctgcacaaggccaagaaccgcatggagcctggtgggctgcggcggacacgggtgaccgactcctccgtgtctgtgcagctccgggagtgactggctggctcctctgtcctgaccccacagcacctccctgacctttaggagccccaactcttagtcacctcctaggcctcttatttctccctggcccttggcttctcacttgatggacagcttcacacacccttaagcggtggactccagcattttcccagcactgtctgagccccatgagggcggagccactccttgtaaattcagtgcccgacagatgctctggcacagatgctttgtagatctctgttgagagaatgcatagacacctgtgcccaaggatgctgagggctggtctctgcttctttgaacttcactgaaactgaatgctcactgctgtgttgccagcaccacccagcccagggctgtgaacggagtgggtggcagcaaatgtgtgttgaaaggggaatgaagccattcacttcactcagttcctgtcccatttaaccgccccgatccttgatcttccattaccttcacatcccggggtccttctgaactgaccttgac

SEQ ID NO: 343339 - DNA, 809 bp, Homo sapiens
cgctgggtggggccggcgtcgggcggggccggcggggtcttcagggtaccgggctggttacagcagctctacccctcacgacgcaaacatggcagcgcagaaggaccagcagaaagatgccgaggcggaagggctgagcggcacgaccctgctgccgaagctgattccctccggtgcaggccgggagtggctggagcggcgccgcgcgaccatccggccctggagcaccttcgtggaccagcagcgcttctcacggccccgcaacctgggagagctgtgccagcgcctcgtacgcaacgtggagtactaccagagcaactatgtgttcgtgttcctgggcctcatcctgtactgtgtggtgacgtcccctatgttgctggtggctctggctgtctttttcggcgcctgttacattctctatctgcgcaccttggagtccaagcttgtgctctttggccgagaggtgagcccagcgcatcagtatgctctggctggaggcatctccttccccttcttctggctggctggtgcgggctcggccgtcttctgggtgctgggagccaccctggtggtcatcggctcccacgctgccttccaccagattgaggctgtggacggggaggagctgcagatggaacccgtgtgaggtgtcttctgggacctgccggcctcccgggccagctgccccacccctgcccatgcctgtcctgcacggctctgctgctcgggcccacagcgccgtcccatcacaagcccggggagggatcccgcctttgaaaataaagctgttatgggtgtcattcaggaaa

SEQ ID NO: 343340 - DNA, 783 bp, Homo sapiens
ccgggggtaaaaactaatggctaaggtcaggcctggtgttaactcggcaccgaggcgcaaacatggcagcgcagaaggaccagcagaaagatgccgaggcggaagggctgagcggcacgaccctgctgccgaagctgattccctccggtgcaggccgggagtggctggagcggcgccgcgcgaccatccggccctggagcaccttcgtggaccagcagcgcttctcacggccccgcaacctgggagagctgtgccagcgcctcgtacgcaacgtggagtactaccagagcaactatgtgttcgtgttcctgggcctcatcctgtactgtgtggtgacgtcccctatgttgctggtggctctggctgtctttttcggcgcctgttacattctctatctgcgcaccttggagtccaagcttgtgctctttggccgagaggtgagcccagcgcatcagtatgctctggctggaggcatctccttccccttcttctggctggctggtgcgggctcggccgtcttctgggtgctgggagccaccctggtggtcatcggctcccacgctgccttccaccagattgaggctgtggacggggaggagctgcagatggaacccgtgtgaggtgtcttctgggacctgccggcctcccgggccagctgccccacccctgcccatgcctgtcctgcacggctctgctgctcgggcccacagcgccgtcccatcacaagcccggggagggatcccgcctttgaaaataaagctgttatgggtgtcattcaggaaa

SEQ ID NO: 343341 - DNA, 167 bp, Homo sapiens
gcggccgcctactactactactgctcgaattcaagcttctaacgatgtacggggacatgcctgtcctgcacggctctgctgctcgggcccacagcgccgtcccatcacaagcccggggagggatcccgcctttgaaaataaagctgttatgggtgtcattcaggaaa

SEQ ID NO: 343342 - DNA, 905 bp, Homo sapiens
ccgggggtaaaaactaatggctaaggtcaggcctggtgttaactcggcaccgaggcgcaaacatggcagcgcagaaggaccagcagaaagatgccgaggcggaagggctgagcggcacgtgagcgagctggctctaggccctcggaccagagacccgggagtccgggcccccggccccctcctccctcctccctcgagagcctggagtcccagccccgagccgcagaagtgttggccccggaccctgctgccgaagctgattccctccggtgcaggccgggagtggctggagcggcgccgcgcgaccatccggccctggagcaccttcgtggaccagcagcgcttctcacggccccgcaacctgggagagctgtgccagcgcctcgtacgcaacgtggagtactaccagagcaactatgtgttcgtgttcctgggcctcatcctgtactgtgtggtgacgtcccctatgttgctggtggctctggctgtctttttcggcgcctgttacattctctatctgcgcaccttggagtccaagcttgtgctctttggccgagaggtgagcccagcgcatcagtatgctctggctggaggcatctccttccccttcttctggctggctggtgcgggctcggccgtcttctgggtgctgggagccaccctggtggtcatcggctcccacgctgccttccaccagattgaggctgtggacggggaggagctgcagatggaacccgtgtgaggtgtcttctgggacctgccggcctcccgggccagctgccccacccctgcccatgcctgtcctgcacggctctgctgctcgggcccacagcgccgtcccatcacaagcccggggagggatcccgcctttgaaaataaagctgttatgggtgtcattcaggaaa

SEQ ID NO: 343343 - DNA, 765 bp, Homo sapiens
cgctgggtggggccggcgtcgggcggggccggcggggtcttcagggtaccgggctggttacagcagctctacccctcacgacgcaaacatggcagcgcagaaggaccagcagaaagatgccgaggcggaagggctgagcggcacgaccctgctgccgaagctgattccctccggtgcaggccgggagtggctggagcggcgccgcgcgaccatccggccctggagcaccttcgtggaccagcagcgcttctcacggccccgcaacctgggagagctgtgccagcgcctcgtacgcaacgtggagtactaccagagcaactatgtgttcgtgttcctgggcctcatcctgtactgtgtggtgacgtcccctatgttgctggtggctctggctgtctttttcggcgcctgttacattctctatctgcgcaccttggagtccaagcttgtgctctttggccgagaggtgagcccagcgcatcagtatgctctggctggaggcatctccttccccttcttctggctggctggtgcgggctcggccgtcttctgggtgctggattgaggctgtggacggggaggagctgcagatggaacccgtgtgaggtgtcttctgggacctgccggcctcccgggccagctgccccacccctgcccatgcctgtcctgcacggctctgctgctcgggcccacagcgccgtcccatcacaagcccggggagggatcccgcctttgaaaataaagctgttatgggtgtcattcaggaaa

SEQ ID NO: 343344 - DNA, 681 bp, Homo sapiens
ccgggggtaaaaactaatggctaaggtcaggcctggtgttaactcggcaccgaggcgcaaacatggcagcgcagaaggaccagcagaaagatgccgaggcggaagggctgagcggcacgaccctgctgccgaagctgattccctccggtgcaggccgggagtggctggagcggcgccgcgcgaccatccggccctggagcaccttcgtggaccagcagcgcttctcacggccccgcaacctgggagagctgtgccagcgcctcgtacgcaacgtggagtactaccagagcaactatgtgttcgtgttcctgggcctcatcctgtactgtgtggtgacgtcccctatgttgctggtggctctggctgtctttttcggcgcctgttacattctctatctgcgcaccttggagtccaagcttgtgctctttggagccaccctggtggtcatcggctcccacgctgccttccaccagattgaggctgtggacggggaggagctgcagatggaacccgtgtgaggtgtcttctgggacctgccggcctcccgggccagctgccccacccctgcccatgcctgtcctgcacggctctgctgctcgggcccacagcgccgtcccatcacaagcccggggagggatcccgcctttgaaaataaagctgttatgggtgtcattcaggaaa

SEQ ID NO: 343345 - DNA, 1237 bp, Homo sapiens
ccgggggtaaaaactaatggctaaggtcaggcctggtgttaactcggcaccgaggcgcaaacatggcagcgcagaaggaccagcagaaagatgccgaggcggaagggctgagcggcacgtgagcgagctggctctaggccctcggaccagagacccgggagtccgggcccccggccccctcctccctcctccctcgagagcctggagtcccagccccgagccgcagaagtgttggccccggtctcctctaatgggaccctggagtctgggcccctagtcccctccctgcctgctgtacaggaatctggggtcccgggagggagtccaggcacccttagtccccttcttttgcgggggtctggggctccatcccggtccaccactgacccggccccaccccccgcaggaccctgctgccgaagctgattccctccggtgcaggccgggagtggctggagcggcgccgcgcgaccatccggccctggagcaccttcgtggaccagcagcgcttctcacggccccgcaacctgggagagctgtgccagcgcctcgtacgcaacgtggagtactaccagagcaactatgtgttcgtgttcctgggcctcatcctgtactgtgtggtgacgtcccctatgttgctggtggctctggctgtctttttcggcgcctgttacattctctatctgcgcaccttggagtccaagcttgtgctctttggtgagaaaccccctgcccagatgaatccttggtccctcaaatcttggtcttttggaatgcagacagacctcagaccccaaatccaagtccttcaaaacccaagtccgcccaagcctagatgtacactagatcccccaaacctgatcccttaaaatctcagacacaaccgatccttccatcgagtctcagccccctcaaattgctattcctcaaacccaggatccacctggctgctgtgccttaaacctactccttttcaaaccacatgactcctcccctctctctcctccccttgccgctctctgcggccaacatcagctgcaggtgcccacactggacaccaggtggccaccttacactggcctagatctgttcccgtttcttttcctgctttctggggtgtgaccagaaagaacttggaacttagagagggaagccgaggagtatgtttcatgtggttcccagactagtagtaccaaggaccactgggaaaacaaaatgccaggggaaattcccccca

SEQ ID NO: 343346 - DNA, 953 bp, Homo sapiens
  misc_feature (862)..(862): n is a, c, g, or t
ccgggggtaaaaactaatggctaaggtcaggcctggtgttaactcggcaccgaggcgcaaacatggcagcgcagaaggaccagcagaaagatgccgaggcggaagggctgagcggcacgaccctgctgccgaagctgattccctccggtgcaggccgggagtggctggagcggcgccgcgcgaccatccggccctggagcaccttcgtggaccagcagcgcttctcacggccccgcaacctgggagagctgtgccagcgcctcgtacgcaacgtggagtactaccagagcaactatgtgttcgtgttcctgggcctcatcctgtactgtgtggtgacgtcccctatgttgctggtggctctggctgtctttttcggcgcctgttacattctctatctgcgcaccttggagtccaagcttgtgctctttggccgagaggtgagcccagcgcatcagtatgctctggctggaggcatctccttccccttcttctggctggctggtgcgggctcggccgtcttctgggtgctgggagccaccctggtggtcatcggctcccacgctgccttccaccagattgaggctgtggacggggaggagctgcagatggaacccgtgtgaggtgtcttctgggacctgccggcctcccgggccagctgccccacccctgcccatgcctgtcctgcacggctctgctgctcgggcccacagcgccgtcccatcacaagcccggggagggatcccgcctttgaaaataaagctgttatgggtgtcattcaggaaaaaaaaacatccccccaaaaaacaaaaaactcgagggggggccccgtacccaattcggcctatagggggccgattacaantcactgcccgccgtttacaaggccggactggaaaaccctgcgttcccaacttattgccttgagacatccccttcggcaggtgcgtaaaacg

SEQ ID NO: 343347 - DNA, 628 bp, Homo sapiens
  misc_feature (28)..(28): n is a, c, g, or t
gcagcctgactcttgaggatcccccganattggtggctctggctgtctttttcggcgcctgttacattctctatctgcgcaccttggagtccaagcttgtgctctttggtgagaaaccccctgcccagatgaatccttggtccctcaaatcttggtcttttggaatgcagacagacctcagaccccaaatccaagtccttcaaaacccaagtccgcccaagcctagatgtacactagatcccccaaacctgatcccttaaaatctcagacacaaccgatccttccatcgagtctcagccccctcaaattgctattcctcaaacccaggatccacctggctgctgtgccttaaacctactccttttcaaaccacatgactcctcccctctctctcctccccttgccgctctctgcggccaacatcagctgcaggtgcccacactggacaccaggtggccaccttacactggcctagatctgttcccgtttcttttcctgctttctggggtgtgaccagaaagaacttggaacttagagagggaagccgaggagtatgtttcatgtggttcccagactagtagtaccaaggaccactgggaaaacaaaatgccaggggaaattcccccca

SEQ ID NO: 343348 - DNA, 979 bp, Homo sapiens
  misc_feature (888)..(888): n is a, c, g, or t
cgctgggtggggccggcgtcgggcggggccggcggggtcttcagggtaccgggctggttacagcagctctacccctcacgacgcaaacatggcagcgcagaaggaccagcagaaagatgccgaggcggaagggctgagcggcacgaccctgctgccgaagctgattccctccggtgcaggccgggagtggctggagcggcgccgcgcgaccatccggccctggagcaccttcgtggaccagcagcgcttctcacggccccgcaacctgggagagctgtgccagcgcctcgtacgcaacgtggagtactaccagagcaactatgtgttcgtgttcctgggcctcatcctgtactgtgtggtgacgtcccctatgttgctggtggctctggctgtctttttcggcgcctgttacattctctatctgcgcaccttggagtccaagcttgtgctctttggccgagaggtgagcccagcgcatcagtatgctctggctggaggcatctccttccccttcttctggctggctggtgcgggctcggccgtcttctgggtgctgggagccaccctggtggtcatcggctcccacgctgccttccaccagattgaggctgtggacggggaggagctgcagatggaacccgtgtgaggtgtcttctgggacctgccggcctcccgggccagctgccccacccctgcccatgcctgtcctgcacggctctgctgctcgggcccacagcgccgtcccatcacaagcccggggagggatcccgcctttgaaaataaagctgttatgggtgtcattcaggaaaaaaaaacatccccccaaaaaacaaaaaactcgagggggggccccgtacccaattcggcctatagggggccgattacaantcactgcccgccgtttacaaggccggactggaaaaccctgcgttcccaacttattgccttgagacatccccttcggcaggtgcgtaaaacg

SEQ ID NO: 343349 - DNA, 685 bp, Homo sapiens
ccgggggtaaaaactaatggctaaggtcaggcctggtgttaactcggcaccgaggcgcaaacatggcagcgcagaaggaccagcagaaagatgccgaggcggaagggctgagcggcacgaccctgctgccgaagctgattccctccggtgcaggccgggagtggctggagcggcgccgcgcgaccatccggccctggagcaccttcgtggaccagcagcgcttctcacggccccgcaacctgggagagctgtgccagcgcctcgtacgcaacgtggagtactaccagagcaactatgtgttcgtgttcctgggcctcatcctgtactgtgtgccgagaggtgagcccagcgcatcagtatgctctggctggaggcatctccttccccttcttctggctggctggtgcgggctcggccgtcttctgggtgctgggagccaccctggtggtcatcggctcccacgctgccttccaccagattgaggctgtggacggggaggagctgcagatggaacccgtgtgaggtgtcttctgggacctgccggcctcccgggccagctgccccacccctgcccatgcctgtcctgcacggctctgctgctcgggcccacagcgccgtcccatcacaagcccggggagggatcccgcctttgaaaataaagctgttatgggtgtcattcaggaaa

SEQ ID NO: 343350 - DNA, 949 bp, Homo sapiens
ccgggggtaaaaactaatggctaaggtcaggcctggtgttaactcggcaccgaggcgcaaacatggcagcgcagaaggaccagcagaaagatgccgaggcggaagggctgagcggcacgaccctgctgccgaagctgattccctccggtgcaggccgggagtggctggagcggcgccgcgcgaccatccggccctggagcaccttcgtggaccagcagcgcttctcacggccccgcaacctgggagagctgtgccagcgcctcgtacgcaacgtggagtactaccagagcaactatgtgttcgtgttcctgggcctcatcctgtactgtgtggtgacgtcccctatgttgctggtggctctggctgtctttttcggcgcctgttacattctctatctgcgcaccttggagtccaagcttgtgctctttggtgagaaaccccctgcccagatgaatccttggtccctcaaatcttggtcttttggaatgcagacagacctcagaccccaaatccaagtccttcaaaacccaagtccgcccaagcctagatgtacactagatcccccaaacctgatcccttaaaatctcagacacaaccgatccttccatcgagtctcagccccctcaaattgctattcctcaaacccaggatccacctggctgctgtgccttaaacctactccttttcaaaccacatgactcctcccctctctctcctccccttgccgctctctgcggccaacatcagctgcaggtgcccacactggacaccaggtggccaccttacactggcctagatctgttcccgtttcttttcctgctttctggggtgtgaccagaaagaacttggaacttagagagggaagccgaggagtatgtttcatgtggttcccagactagtagtaccaaggaccactgggaaaacaaaatgccaggggaaattcccccca

SEQ ID NO: 343351 - DNA, 425 bp, Homo sapiens
gagcccagcgcatcagtatgctctggctggaggcatctccttccccttcttctggctggctggtgcgggctcggccgtcttctgggtgctgggtgagtacagggtctgagcagctggggtggatggtgggagccaggtgcaggagtgtggccctgagctgccggctttcctgcaggagccaccctggtggtcatcggctcccacgctgccttccaccagattgaggctgtggacggggaggagctgcagatggaacccgtgtgaggtgtcttctgggacctgccggcctcccgggccagctgccccacccctgcccatgcctgtcctgcacggctctgctgctcgggcccacagcgccgtcccatcacaagcccggggagggatcccgcctttgaaaataaagctgttatgggtgtcattcagga

SEQ ID NO: 343352 - DNA, 383 bp, Homo sapiens
  misc_feature (365)..(365): n is a, c, g, or t
  misc_feature (371)..(371): n is a, c, g, or t
ccgggaaaggtacctgttatacatataagaattcgtgcaaagagccagggaatggccttaagtcttggagataaaatcaacttgtcacagaagaaaactagtatataaaaataaacaaaaagtccttgaagctttacagttaatttaggtatgggcttactggactccaacatcttttgtactctttcatgcttatatagaatctgagttcatgctgaatacttttcagccaataatttatagcctttcccttaaatcaagattgagtttaaaattatagtttgtcttttgtcttaacagttctgaatgctgtcctcaaagtatataatgtttcatgtaccaagacccttttcacagtaacagcnaccttnccgtccggcccc

SEQ ID NO: 343353 - DNA, 304 bp, Homo sapiens
actactaaattcgcggccgtcgacgtttcccagcgtctgattgtgctttccttttggcctttactttcattgggggtgattgaggtagtctgattttttagctaagtctaaacttaaggctattatttgtctaccagctagggttcaggctgcattccctgtgagtccttagataaggtctgtgaaagactgaaagcatctcctatttcattaagaatgaaatgatttgtttggagtataaggagattgataccttgtatgatgtcataaactgtgaagccacttgcttttaaaaaaaaaaaaa

SEQ ID NO: 343354 - DNA, 315 bp, Homo sapiens
acgtcagccaaggactctggagccgccgccgccgctgctgcggttcatatccggagtagacggagccgcagtagacggatccgcggctgcaccaaaccactgcccctcggagcctggtagtgggccacaagcccccagtcccagaggcgtggtgggtcgggcagagtcggaagaactggctttctagctggaagatgcggaaggggagcgactaggccgcttgcgtctgggcctggcagaagggaccgggtgggggtacgggtgggggtgcgggtcggggtgggggcggagggctaggaagctccgggtcggacg

SEQ ID NO: 343355 - DNA, 4702 bp, Homo sapiens
acgtcagccaaggactctggagccgccgccgccgctgctgcggttcatatccggagtagacggagccgcagtagacggatccgcggctgcaccaaaccactgcccctcggagcctggtagtgggccacaagcccccagtcccagaggcgtgattttctggcatccttaaatcttgtgtcaaggattggttataatataaccagaaaccatgacggcggctgagaacgtatgctacacgttaattaacgtgccaatggattcagaaccaccatctgaaattagcttaaaaaatgatctagaaaaaggagatgtaaagtcaaagactgaagctttgaagaaagtaatcattatgattctgaatggtgaaaaacttcctggacttctgatgaccatcattcgttttgtgctacctcttcaggatcacactatcaagaaattacttctggtattttgggaaattgttcctaaaacaactccagatgggagacttttacatgagatgatccttgtatgtgatgcatacagaaaggatcttcaacatcctaatgaatttattcgaggatctactcttcgttttctttgcaaattgaaagaagcagaattgctagaacctttaatgccagctattcgtgcatgtttggagcatcgacacagctatgttagaagaaatgctgttttggccatctataccatctatagaaattttgaacatcttatacctgatgctcctgaactgatacatgattttctggtgaatgagaaggatgcaagttgcaaaaggaatgcatttatgatgctaattcatgcagatcaggatcgagctttggattacttaagtacttgcattgatcaagttcaaacatttggagacattctgcagctggttattgttgaactgatttataaggtctgtcatgctaatccatcagaaagagctcgttttattcgctgcatctataacttattacagtcatccagccctgctgtaaaatatgaagctgctgggacattagtgacactctctagtgcaccaactgcaatcaaggctgctgctcagtgttacattgatttaattattaaggagagcgacaacaatgtaaaactcatagttttggatcgcttgatagaattaaaagagcatcctgctcatgaacgagtactacaggatctggttatggatatcctaagagtattgagcacaccagacttagaagtacgaaagaaaactctgcagttagcactggatcttgtctcttctagaaatgttgaagagctggttattgtcctgaagaaggaagtgataaaaacaaataatgtgtctgagcatgaagatactgacaaatacagacaactcctagtgcgaacattgcattcctgttctgtccgatttccagatatggctgcaaatgttattcctgtgttaatggaatttctcagtgacaacaacgaagcagcagctgctgatgtcttggagtttgttcgtgaagccattcagcgctttgataacctgagaatgcttattgttgagaagatgcttgaagtctttcatgctattaaatctgtcaagatttaccgaggagcattatggatcctgggagaatactgtagtaccaaggaagacattcagagtgtgatgactgagatccgcaggtcccttggagagatcccaattgtagagtcagaaataaagaaagaagctggtgaattaaaacctgaagaagaaataactgtagggccagttcagaaattggttactgaaatgggtacctatgcaactcagagtgcccttagcagttctagacccaccaagaaagaggaagacagacctcccttgagaggattccttctggatggagatttctttgttgctgcctcccttgccacaactctgaccaagattgcattgcgctatgtagctttggttcaggagaagaaaaagcaaaattcttttgttgctgaggctatgttgctcatggctactatcctgcatttgggaaaatcctctcttcctaagaagccaattactgatgatgatgtggatcgaatttccctgtgcctcaaggtcttgtctgaatgttcacctttaatgaatgacattttcaataaggaatgcagacagtccctttctcacatgttatctgctaaactagaagaagagaaattatcccaaaagaaagaatctgaaaagaggaatgtgacagtacagcctgatgaccccatttccttcatgcaactaactgctaagaatgaaatgaactgcaaggaagatcagtttcagctgagtttactggcagcaatgggtaacacacagaggaaagaggcagcagatcccctagcatctaaacttaacaaggtcacccaattgacaggtttctcagatcctgtatatgcagaagcttacgttcatgtcaaccaatatgatattgtcctggatgtacttgttgtgaaccaaaccagtgatactttgcagaattgcacattagaactagctacactaggggatctgaaacttgtggaaaagccgtctcctttgactcttgctcctcatgacttcgcaaatattaaagctaacgtcaaagtagcatcaacagaaaatggaataatttttggtaatatagtttatgatgtctctggagcagcaagtgacagaaattgtgtggttctcagtgatattcacatcgacatcatggactatatccagcctgcaacttgcactgatgcagaattccgtcagatgtgggccgaatttgaatgggaaaacaaagtgacagttaacaccaacatggttgatttaaatgactacttacagcacatattaaagtcaaccaatatgaaatgcctgactccagaaaaggccctttctggttactgtggctttatggcagccaacctttatgctcgttccatatttggtgaagatgcacttgcaaatgtcagcattgagaagccaattcaccagggaccagatgctgctgttaccggccatataagaattcgtgcaaagagccagggaatggccttaagtcttggagataaaatcaacttgtcacagaagaaaactagtatataaaaataaacaaaaagtccttgaagctttacagttaatttaggtatgggcttactggactccaacatcttttgtactctttcatgcttatatagaatctgagttcatgctgaatacttttcagccaataatttatagcctttcccttaaatcaagattgagtttaaaattatagtttgtcttttgtcttaacagttctgaatgctgtcctcaaagtatataatgtttcatgtaccaagacccttttcacagtacaataaacagatctattcataaatttttgttattttataaataaatgattacataattttagttatatggcaatggatttcttttagttgggttataaatttctattataaatttaaattactgagttgtgaatatatgcagctttattaagagaatttacaaattcaatgatataaaataaggtaggccttgattcacttggttgttttttacttatttaatattccaacattgctatctctaaaaatgcattatcatgttttgaagggatttgctcttgaatttagctccagggagaaagtatcaaaataacttttttttttttttttgagatggagtctggctctgtcacccaggctggagtgcagtggcgtgatcttggctcactgcaagctccacctcccgggtttacaccattctcctgcctcagcctcccaagtagctgggactacaggtgcccgccaccacgcctggctaattttttgtatttttagtagagacgggctttcaccatgttggccaggatggtctcgatctcctgacctcgtgatccgcccgcctcagcctcccggagtgttgggattacaggcatgagccaccgcacccggcccaaaataacttgagaaaacagatcgctctgcagtttaaagaagtattatgtacccgaactgaaatagatatactgttcttaattatcctgaatcataatgaagagtagataatccaaaatagattttttaatcattcacatttagtttggggtgttctatgtttgttaggaataaaactggttctaaccaattactgaagctggtactgggaggattcaactagagaggattcaaaaagctgcctttttctctgttgcctccgtgccttactcacatttagtttagggtgttctatgtttgttaggaataaaactggttctaaccaattactgaagctggtactgggaggattcaactagagaggattcaaaaagctgcctttttctctgttgcctctgtgccttactcactcgtctccttttcctcacttcacactaggactgggtaccatcacactgcagtataattccaaatgcatttccaagctaagtttcccagcgtctgattgtgctttccttttggcctttactttcattgggggtgattgaggtagtctgattttttagctaagtctaaacttaaggctattatttgtctaccagctagggttcaggctgcattccctgtgagtccttagataaggtctgtgaaagactgaaagcatctcctatttcattaagaatgaaatgatttgtttggagtataaggagattgataccttgtatgatgtcataaactgtgaagccacttgcttttaaaaaaaaaaaaa

SEQ ID NO: 343356 - DNA, 4800 bp, Homo sapiens
acgtcagccaaggactctggagccgccgccgccgctgctgcggttcatatccggagtagacggagccgcagtagacggatccgcggctgcaccaaaccactgcccctcggagcctggtagtgggccacaagcccccagtcccagaggcgtggtgggtcgggcagagtcggaagaactggctttctagctggaagatgcggaaggggagcgactaggccgcttgcgtctgggcctggcagaagggaccggattttctggcatccttaaatcttgtgtcaaggattggttataatataaccagaaaccatgacggcggctgagaacgtatgctacacgttaattaacgtgccaatggattcagaaccaccatctgaaattagcttaaaaaatgatctagaaaaaggagatgtaaagtcaaagactgaagctttgaagaaagtaatcattatgattctgaatggtgaaaaacttcctggacttctgatgaccatcattcgttttgtgctacctcttcaggatcacactatcaagaaattacttctggtattttgggaaattgttcctaaaacaactccagatgggagacttttacatgagatgatccttgtatgtgatgcatacagaaaggatcttcaacatcctaatgaatttattcgaggatctactcttcgttttctttgcaaattgaaagaagcagaattgctagaacctttaatgccagctattcgtgcatgtttggagcatcgacacagctatgttagaagaaatgctgttttggccatctataccatctatagaaattttgaacatcttatacctgatgctcctgaactgatacatgattttctggtgaatgagaaggatgcaagttgcaaaaggaatgcatttatgatgctaattcatgcagatcaggatcgagctttggattacttaagtacttgcattgatcaagttcaaacatttggagacattctgcagctggttattgttgaactgatttataaggtctgtcatgctaatccatcagaaagagctcgttttattcgctgcatctataacttattacagtcatccagccctgctgtaaaatatgaagctgctgggacattagtgacactctctagtgcaccaactgcaatcaaggctgctgctcagtgttacattgatttaattattaaggagagcgacaacaatgtaaaactcatagttttggatcgcttgatagaattaaaagagcatcctgctcatgaacgagtactacaggatctggttatggatatcctaagagtattgagcacaccagacttagaagtacgaaagaaaactctgcagttagcactggatcttgtctcttctagaaatgttgaagagctggttattgtcctgaagaaggaagtgataaaaacaaataatgtgtctgagcatgaagatactgacaaatacagacaactcctagtgcgaacattgcattcctgttctgtccgatttccagatatggctgcaaatgttattcctgtgttaatggaatttctcagtgacaacaacgaagcagcagctgctgatgtcttggagtttgttcgtgaagccattcagcgctttgataacctgagaatgcttattgttgagaagatgcttgaagtctttcatgctattaaatctgtcaagatttaccgaggagcattatggatcctgggagaatactgtagtaccaaggaagacattcagagtgtgatgactgagatccgcaggtcccttggagagatcccaattgtagagtcagaaataaagaaagaagctggtgaattaaaacctgaagaagaaataactgtagggccagttcagaaattggttactgaaatgggtacctatgcaactcagagtgcccttagcagttctagacccaccaagaaagaggaagacagacctcccttgagaggattccttctggatggagatttctttgttgctgcctcccttgccacaactctgaccaagattgcattgcgctatgtagctttggttcaggagaagaaaaagcaaaattcttttgttgctgaggctatgttgctcatggctactatcctgcatttgggaaaatcctctcttcctaagaagccaattactgatgatgatgtggatcgaatttccctgtgcctcaaggtcttgtctgaatgttcacctttaatgaatgacattttcaataaggaatgcagacagtccctttctcacatgttatctgctaaactagaagaagagaaattatcccaaaagaaagaatctgaaaagaggaatgtgacagtacagcctgatgaccccatttccttcatgcaactaactgctaagaatgaaatgaactgcaaggaagatcagtttcagctgagtttactggcagcaatgggtaacacacagaggaaagaggcagcagatcccctagcatctaaacttaacaaggtcacccaattgacaggtttctcagatcctgtatatgcagaagcttacgttcatgtcaaccaatatgatattgtcctggatgtacttgttgtgaaccaaaccagtgatactttgcagaattgcacattagaactagctacactaggggatctgaaacttgtggaaaagccgtctcctttgactcttgctcctcatgacttcgcaaatattaaagctaacgtcaaagtagcatcaacagaaaatggaataatttttggtaatatagtttatgatgtctctggagcagcaagtgacagaaattgtgtggttctcagtgatattcacatcgacatcatggactatatccagcctgcaacttgcactgatgcagaattccgtcagatgtgggccgaatttgaatgggaaaacaaagtgacagttaacaccaacatggttgatttaaatgactacttacagcacatattaaagtcaaccaatatgaaatgcctgactccagaaaaggccctttctggttactgtggctttatggcagccaacctttatgctcgttccatatttggtgaagatgcacttgcaaatgtcagcattgagaagccaattcaccagggaccagatgctgctgttaccggccatataagaattcgtgcaaagagccagggaatggccttaagtcttggagataaaatcaacttgtcacagaagaaaactagtatataaaaataaacaaaaagtccttgaagctttacagttaatttaggtatgggcttactggactccaacatcttttgtactctttcatgcttatatagaatctgagttcatgctgaatacttttcagccaataatttatagcctttcccttaaatcaagattgagtttaaaattatagtttgtcttttgtcttaacagttctgaatgctgtcctcaaagtatataatgtttcatgtaccaagacccttttcacagtacaataaacagatctattcataaatttttgttattttataaataaatgattacataattttagttatatggcaatggatttcttttagttgggttataaatttctattataaatttaaattactgagttgtgaatatatgcagctttattaagagaatttacaaattcaatgatataaaataaggtaggccttgattcacttggttgttttttacttatttaatattccaacattgctatctctaaaaatgcattatcatgttttgaagggatttgctcttgaatttagctccagggagaaagtatcaaaataacttttttttttttttttgagatggagtctggctctgtcacccaggctggagtgcagtggcgtgatcttggctcactgcaagctccacctcccgggtttacaccattctcctgcctcagcctcccaagtagctgggactacaggtgcccgccaccacgcctggctaattttttgtatttttagtagagacgggctttcaccatgttggccaggatggtctcgatctcctgacctcgtgatccgcccgcctcagcctcccggagtgttgggattacaggcatgagccaccgcacccggcccaaaataacttgagaaaacagatcgctctgcagtttaaagaagtattatgtacccgaactgaaatagatatactgttcttaattatcctgaatcataatgaagagtagataatccaaaatagattttttaatcattcacatttagtttggggtgttctatgtttgttaggaataaaactggttctaaccaattactgaagctggtactgggaggattcaactagagaggattcaaaaagctgcctttttctctgttgcctccgtgccttactcacatttagtttagggtgttctatgtttgttaggaataaaactggttctaaccaattactgaagctggtactgggaggattcaactagagaggattcaaaaagctgcctttttctctgttgcctctgtgccttactcactcgtctccttttcctcacttcacactaggactgggtaccatcacactgcagtataattccaaatgcatttccaagctaagtttcccagcgtctgattgtgctttccttttggcctttactttcattgggggtgattgaggtagtctgattttttagctaagtctaaacttaaggctattatttgtctaccagctagggttcaggctgcattccctgtgagtccttagataaggtctgtgaaagactgaaagcatctcctatttcattaagaatgaaatgatttgtttggagtataaggagattgataccttgtatgatgtcataaactgtgaagccacttgcttttaaaaaaaaaaaaa

SEQ ID NO: 343357 - DNA, 4963 bp, Homo sapiens
gacccgcggacatagagtcggaacccaccaaggaccgcgataaagcgctttagggttttggcagagtattcaggcacaaggtctcttaacttgagcatgcagattgtgtgttgtgtaaaaaccatacggtccataacattgtggggtgtggctggggggactgtcactgttctgtgggccttcattcggctatacagcattctcaaacactggaccgggatgcgatgagggagtgatagataatataccttatgccagagctgataatgtggtttttactagaatttatttttatgggaacacgatatagattgacctgccctttctaatactttaaaaggtcactataggtacttgtttgtgggttttttttttttaatttgtaatgatatgtctgtgtttatttttctagattttctggcatccttaaatcttgtgtcaaggattggttataatataaccagaaaccatgacggcggctgagaacgtatgctacacgttaattaacgtgccaatggattcagaaccaccatctgaaattagcttaaaaaatgatctagaaaaaggagatgtaaagtcaaagactgaagctttgaagaaagtaatcattatgattctgaatggtgaaaaacttcctggacttctgatgaccatcattcgttttgtgctacctcttcaggatcacactatcaagaaattacttctggtattttgggaaattgttcctaaaacaactccagatgggagacttttacatgagatgatccttgtatgtgatgcatacagaaaggatcttcaacatcctaatgaatttattcgaggatctactcttcgttttctttgcaaattgaaagaagcagaattgctagaacctttaatgccagctattcgtgcatgtttggagcatcgacacagctatgttagaagaaatgctgttttggccatctataccatctatagaaattttgaacatcttatacctgatgctcctgaactgatacatgattttctggtgaatgagaaggatgcaagttgcaaaaggaatgcatttatgatgctaattcatgcagatcaggatcgagctttggattacttaagtacttgcattgatcaagttcaaacatttggagacattctgcagctggttattgttgaactgatttataaggtctgtcatgctaatccatcagaaagagctcgttttattcgctgcatctataacttattacagtcatccagccctgctgtaaaatatgaagctgctgggacattagtgacactctctagtgcaccaactgcaatcaaggctgctgctcagtgttacattgatttaattattaaggagagcgacaacaatgtaaaactcatagttttggatcgcttgatagaattaaaagagcatcctgctcatgaacgagtactacaggatctggttatggatatcctaagagtattgagcacaccagacttagaagtacgaaagaaaactctgcagttagcactggatcttgtctcttctagaaatgttgaagagctggttattgtcctgaagaaggaagtgataaaaacaaataatgtgtctgagcatgaagatactgacaaatacagacaactcctagtgcgaacattgcattcctgttctgtccgatttccagatatggctgcaaatgttattcctgtgttaatggaatttctcagtgacaacaacgaagcagcagctgctgatgtcttggagtttgttcgtgaagccattcagcgctttgataacctgagaatgcttattgttgagaagatgcttgaagtctttcatgctattaaatctgtcaagatttaccgaggagcattatggatcctgggagaatactgtagtaccaaggaagacattcagagtgtgatgactgagatccgcaggtcccttggagagatcccaattgtagagtcagaaataaagaaagaagctggtgaattaaaacctgaagaagaaataactgtagggccagttcagaaattggttactgaaatgggtacctatgcaactcagagtgcccttagcagttctagacccaccaagaaagaggaagacagacctcccttgagaggattccttctggatggagatttctttgttgctgcctcccttgccacaactctgaccaagattgcattgcgctatgtagctttggttcaggagaagaaaaagcaaaattcttttgttgctgaggctatgttgctcatggctactatcctgcatttgggaaaatcctctcttcctaagaagccaattactgatgatgatgtggatcgaatttccctgtgcctcaaggtcttgtctgaatgttcacctttaatgaatgacattttcaataaggaatgcagacagtccctttctcacatgttatctgctaaactagaagaagagaaattatcccaaaagaaagaatctgaaaagaggaatgtgacagtacagcctgatgaccccatttccttcatgcaactaactgctaagaatgaaatgaactgcaaggaagatcagtttcagctgagtttactggcagcaatgggtaacacacagaggaaagaggcagcagatcccctagcatctaaacttaacaaggtcacccaattgacaggtttctcagatcctgtatatgcagaagcttacgttcatgtcaaccaatatgatattgtcctggatgtacttgttgtgaaccaaaccagtgatactttgcagaattgcacattagaactagctacactaggggatctgaaacttgtggaaaagccgtctcctttgactcttgctcctcatgacttcgcaaatattaaagctaacgtcaaagtagcatcaacagaaaatggaataatttttggtaatatagtttatgatgtctctggagcagcaagtgacagaaattgtgtggttctcagtgatattcacatcgacatcatggactatatccagcctgcaacttgcactgatgcagaattccgtcagatgtgggccgaatttgaatgggaaaacaaagtgacagttaacaccaacatggttgatttaaatgactacttacagcacatattaaagtcaaccaatatgaaatgcctgactccagaaaaggccctttctggttactgtggctttatggcagccaacctttatgctcgttccatatttggtgaagatgcacttgcaaatgtcagcattgagaagccaattcaccagggaccagatgctgctgttaccggccatataagaattcgtgcaaagagccagggaatggccttaagtcttggagataaaatcaacttgtcacagaagaaaactagtatataaaaataaacaaaaagtccttgaagctttacagttaatttaggtatgggcttactggactccaacatcttttgtactctttcatgcttatatagaatctgagttcatgctgaatacttttcagccaataatttatagcctttcccttaaatcaagattgagtttaaaattatagtttgtcttttgtcttaacagttctgaatgctgtcctcaaagtatataatgtttcatgtaccaagacccttttcacagtacaataaacagatctattcataaatttttgttattttataaataaatgattacataattttagttatatggcaatggatttcttttagttgggttataaatttctattataaatttaaattactgagttgtgaatatatgcagctttattaagagaatttacaaattcaatgatataaaataaggtaggccttgattcacttggttgttttttacttatttaatattccaacattgctatctctaaaaatgcattatcatgttttgaagggatttgctcttgaatttagctccagggagaaagtatcaaaataacttttttttttttttttgagatggagtctggctctgtcacccaggctggagtgcagtggcgtgatcttggctcactgcaagctccacctcccgggtttacaccattctcctgcctcagcctcccaagtagctgggactacaggtgcccgccaccacgcctggctaattttttgtatttttagtagagacgggctttcaccatgttggccaggatggtctcgatctcctgacctcgtgatccgcccgcctcagcctcccggagtgttgggattacaggcatgagccaccgcacccggcccaaaataacttgagaaaacagatcgctctgcagtttaaagaagtattatgtacccgaactgaaatagatatactgttcttaattatcctgaatcataatgaagagtagataatccaaaatagattttttaatcattcacatttagtttggggtgttctatgtttgttaggaataaaactggttctaaccaattactgaagctggtactgggaggattcaactagagaggattcaaaaagctgcctttttctctgttgcctccgtgccttactcacatttagtttagggtgttctatgtttgttaggaataaaactggttctaaccaattactgaagctggtactgggaggattcaactagagaggattcaaaaagctgcctttttctctgttgcctctgtgccttactcactcgtctccttttcctcacttcacactaggactgggtaccatcacactgcagtataattccaaatgcatttccaagctaagtttcccagcgtctgattgtgctttccttttggcctttactttcattgggggtgattgaggtagtctgattttttagctaagtctaaacttaaggctattatttgtctaccagctagggttcaggctgcattccctgtgagtccttagataaggtctgtgaaagactgaaagcatctcctatttcattaagaatgaaatgatttgtttggagtataaggagattgataccttgtatgatgtcataaactgtgaagccacttgcttttaaaaaaaaaaaaa

SEQ ID NO: 343358 - DNA, 4648 bp, Homo sapiens
acgtcagccaaggactctggagccgccgccgccgctgctgcggttcatatccggagtagacggagccgcagtagacggatccgcggctgcaccaaaccactgcccctcggagcctggtagtgggccacaagcccccagtcccagaggcgtgattttctggcatccttaaatcttgtgtcaaggattggttataatataaccagaaaccatgacggcggctgagaacgtatgctacacgttaattaacgtgccaatggattcagaaccaccatctgaaattagcttaaaaaatgatctagaaaaaggagatgtaaagtcaaagactgaagctttgaagaaagtaatcattatgattctgaatggtgaaaaacttcctggacttctgatgaccatcattcgttttgtgctacctcttcaggatcacactatcaagaaattacttctggtattttgggaaattgttcctaaaacaactccagatgggagacttttacatgagatgatccttgtatgtgatgcatacagaaaggatcttcaacatcctaatgaatttattcgaggatctactcttcgttttctttgcaaattgaaagaagcagaattgctagaacctttaatgccagctattcgtgcatgtttggagcatcgacacagctatgttagaagaaatgctgttttggccatctataccatctatagaaattttgaacatcttatacctgatgctcctgaactgatacatgattttctggtgaatgagaaggatgcaagttgcaaaaggaatgcatttatgatgctaattcatgcagatcaggatcgagctttggattacttaagtacttgcattgatcaagttcaaacatttggagacattctgcagctggttattgttgaactgatttataaggtctgtcatgctaatccatcagaaagagctcgttttattcgctgcatctataacttattacagtcatccagccctgctgtaaaatatgaagctgctgggacattagtgacactctctagtgcaccaactgcaatcaaggctgctgctcagtgttacattgatttaattattaaggagagcgacaacaatgtaaaactcatagttttggatcgcttgatagaattaaaagagcatcctgctcatgaacgagtactacaggatctggttatggatatcctaagagtattgagcacaccagacttagaagtacgaaagaaaactctgcagttagcactggatcttgtctcttctagaaatgttgaagagctggttattgtcctgaagaaggaagtgataatgcgaacattgcattcctgttctgtccgatttccagatatggctgcaaatgttattcctgtgttaatggaatttctcagtgacaacaacgaagcagcagctgctgatgtcttggagtttgttcgtgaagccattcagcgctttgataacctgagaatgcttattgttgagaagatgcttgaagtctttcatgctattaaatctgtcaagatttaccgaggagcattatggatcctgggagaatactgtagtaccaaggaagacattcagagtgtgatgactgagatccgcaggtcccttggagagatcccaattgtagagtcagaaataaagaaagaagctggtgaattaaaacctgaagaagaaataactgtagggccagttcagaaattggttactgaaatgggtacctatgcaactcagagtgcccttagcagttctagacccaccaagaaagaggaagacagacctcccttgagaggattccttctggatggagatttctttgttgctgcctcccttgccacaactctgaccaagattgcattgcgctatgtagctttggttcaggagaagaaaaagcaaaattcttttgttgctgaggctatgttgctcatggctactatcctgcatttgggaaaatcctctcttcctaagaagccaattactgatgatgatgtggatcgaatttccctgtgcctcaaggtcttgtctgaatgttcacctttaatgaatgacattttcaataaggaatgcagacagtccctttctcacatgttatctgctaaactagaagaagagaaattatcccaaaagaaagaatctgaaaagaggaatgtgacagtacagcctgatgaccccatttccttcatgcaactaactgctaagaatgaaatgaactgcaaggaagatcagtttcagctgagtttactggcagcaatgggtaacacacagaggaaagaggcagcagatcccctagcatctaaacttaacaaggtcacccaattgacaggtttctcagatcctgtatatgcagaagcttacgttcatgtcaaccaatatgatattgtcctggatgtacttgttgtgaaccaaaccagtgatactttgcagaattgcacattagaactagctacactaggggatctgaaacttgtggaaaagccgtctcctttgactcttgctcctcatgacttcgcaaatattaaagctaacgtcaaagtagcatcaacagaaaatggaataatttttggtaatatagtttatgatgtctctggagcagcaagtgacagaaattgtgtggttctcagtgatattcacatcgacatcatggactatatccagcctgcaacttgcactgatgcagaattccgtcagatgtgggccgaatttgaatgggaaaacaaagtgacagttaacaccaacatggttgatttaaatgactacttacagcacatattaaagtcaaccaatatgaaatgcctgactccagaaaaggccctttctggttactgtggctttatggcagccaacctttatgctcgttccatatttggtgaagatgcacttgcaaatgtcagcattgagaagccaattcaccagggaccagatgctgctgttaccggccatataagaattcgtgcaaagagccagggaatggccttaagtcttggagataaaatcaacttgtcacagaagaaaactagtatataaaaataaacaaaaagtccttgaagctttacagttaatttaggtatgggcttactggactccaacatcttttgtactctttcatgcttatatagaatctgagttcatgctgaatacttttcagccaataatttatagcctttcccttaaatcaagattgagtttaaaattatagtttgtcttttgtcttaacagttctgaatgctgtcctcaaagtatataatgtttcatgtaccaagacccttttcacagtacaataaacagatctattcataaatttttgttattttataaataaatgattacataattttagttatatggcaatggatttcttttagttgggttataaatttctattataaatttaaattactgagttgtgaatatatgcagctttattaagagaatttacaaattcaatgatataaaataaggtaggccttgattcacttggttgttttttacttatttaatattccaacattgctatctctaaaaatgcattatcatgttttgaagggatttgctcttgaatttagctccagggagaaagtatcaaaataacttttttttttttttttgagatggagtctggctctgtcacccaggctggagtgcagtggcgtgatcttggctcactgcaagctccacctcccgggtttacaccattctcctgcctcagcctcccaagtagctgggactacaggtgcccgccaccacgcctggctaattttttgtatttttagtagagacgggctttcaccatgttggccaggatggtctcgatctcctgacctcgtgatccgcccgcctcagcctcccggagtgttgggattacaggcatgagccaccgcacccggcccaaaataacttgagaaaacagatcgctctgcagtttaaagaagtattatgtacccgaactgaaatagatatactgttcttaattatcctgaatcataatgaagagtagataatccaaaatagattttttaatcattcacatttagtttggggtgttctatgtttgttaggaataaaactggttctaaccaattactgaagctggtactgggaggattcaactagagaggattcaaaaagctgcctttttctctgttgcctccgtgccttactcacatttagtttagggtgttctatgtttgttaggaataaaactggttctaaccaattactgaagctggtactgggaggattcaactagagaggattcaaaaagctgcctttttctctgttgcctctgtgccttactcactcgtctccttttcctcacttcacactaggactgggtaccatcacactgcagtataattccaaatgcatttccaagctaagtttcccagcgtctgattgtgctttccttttggcctttactttcattgggggtgattgaggtagtctgattttttagctaagtctaaacttaaggctattatttgtctaccagctagggttcaggctgcattccctgtgagtccttagataaggtctgtgaaagactgaaagcatctcctatttcattaagaatgaaatgatttgtttggagtataaggagattgataccttgtatgatgtcataaactgtgaagccacttgcttttaaaaaaaaaaaaa

SEQ ID NO: 343359 - DNA, 4648 bp, Homo sapiens
acgtcagccaaggactctggagccgccgccgccgctgctgcggttcatatccggagtagacggagccgcagtagacggatccgcggctgcaccaaaccactgcccctcggagcctggtagtgggccacaagcccccagtcccagaggcgtgattttctggcatccttaaatcttgtgtcaaggattggttataatataaccagaaaccatgacggcggctgagaacgtatgctacacgttaattaacgtgccaatggattcagaaccaccatctgaaattagcttaaaaaatgatctagaaaaaggagatgtaaagtcaaagactgaagctttgaagaaagtaatcattatgattctgaatggtgaaaaacttcctggacttctgatgaccatcattcgttttgtgctacctcttcaggatcacactatcaagaaattacttctggtattttgggaaattgttcctaaaacaactccagatgggagacttttacatgagatgatccttgtatgtgatgcatacagaaaggatcttcaacatcctaatgaatttattcgaggatctactcttcgttttctttgcaaattgaaagaagcagaattgctagaacctttaatgccagctattcgtgcatgtttggagcatcgacacagctatgttagaagaaatgctgttttggccatctataccatctatagaaattttgaacatcttatacctgatgctcctgaactgatacatgattttctggtgaatgagaaggatgcaagttgcaaaaggaatgcatttatgatgctaattcatgcagatcaggatcgagctttggattacttaagtacttgcattgatcaagttcaaacatttggagacattctgcagctggttattgttgaactgatttataaggtctgtcatgctaatccatcagaaagagctcgttttattcgctgcatctataacttattacagtcatccagccctgctgtaaaatatgaagctgctgggacattagtgacactctctagtgcaccaactgcaatcaaggctgctgctcagtgttacattgatttaattattaaggagagcgacaacaatgtaaaactcatagttttggatcgcttgatagaattaaaagagcatcctgctcatgaacgagtactacaggatctggttatggatatcctaagagtattgagcacaccagacttagaagtacgaaagaaaactctgcagttagcactggatcttgtctcttctagaaatgttgaagagctggttattgtcctgaagaaggaagtgataaaaacaaataatgtgtctgagcatgaagatactgacaaatacagacaactcctagtgcgaacattgcattcctgttctgtccgatttccagatatggctgcaaatgttattcctgtgttaatggaatttctcagtgacaacaacgaagcagcagctgctgatgtcttggagtttgttcgtgaagccattcagcgctttgataacctgagaatgcttattgttgagaagatgcttgaagtctttcatgctattaaatctgtcaagatttaccgaggagcattatggatcctgggagaatactgtagtaccaaggaagacattcagagtgtgatgactgagatccgcaggtcccttggagagatcccaattgtagagtcagaaataaagaaagaagctggtgaattaaaacctgaagaagaaataactgtagggccagttcagaaattggttactgaaatgggtacctatgcaactcagagtgcccttagcagttctagacccaccaagaaagaggaagacagacctcccttgagaggattccttctggatggagatttctttgttgctgcctcccttgccacaactctgaccaagattgcattgcgctatgtagctttggttcaggagaagaaaaagcaaaattcttttgttgctgaggctatgttgctcatggctactatcctgcatttgggaaaatcctctcttcctaagaagccaattactgatgatgatgtggatcgaatttccctgtgcctcaaggtcttgtctgaatgttcacctttaatgaatgacattttcaataaggaatgcagacagtccctttctcacatgttatctgctaaactagaagaagagaaattatcccaaaagatgcaactaactgctaagaatgaaatgaactgcaaggaagatcagtttcagctgagtttactggcagcaatgggtaacacacagaggaaagaggcagcagatcccctagcatctaaacttaacaaggtcacccaattgacaggtttctcagatcctgtatatgcagaagcttacgttcatgtcaaccaatatgatattgtcctggatgtacttgttgtgaaccaaaccagtgatactttgcagaattgcacattagaactagctacactaggggatctgaaacttgtggaaaagccgtctcctttgactcttgctcctcatgacttcgcaaatattaaagctaacgtcaaagtagcatcaacagaaaatggaataatttttggtaatatagtttatgatgtctctggagcagcaagtgacagaaattgtgtggttctcagtgatattcacatcgacatcatggactatatccagcctgcaacttgcactgatgcagaattccgtcagatgtgggccgaatttgaatgggaaaacaaagtgacagttaacaccaacatggttgatttaaatgactacttacagcacatattaaagtcaaccaatatgaaatgcctgactccagaaaaggccctttctggttactgtggctttatggcagccaacctttatgctcgttccatatttggtgaagatgcacttgcaaatgtcagcattgagaagccaattcaccagggaccagatgctgctgttaccggccatataagaattcgtgcaaagagccagggaatggccttaagtcttggagataaaatcaacttgtcacagaagaaaactagtatataaaaataaacaaaaagtccttgaagctttacagttaatttaggtatgggcttactggactccaacatcttttgtactctttcatgcttatatagaatctgagttcatgctgaatacttttcagccaataatttatagcctttcccttaaatcaagattgagtttaaaattatagtttgtcttttgtcttaacagttctgaatgctgtcctcaaagtatataatgtttcatgtaccaagacccttttcacagtacaataaacagatctattcataaatttttgttattttataaataaatgattacataattttagttatatggcaatggatttcttttagttgggttataaatttctattataaatttaaattactgagttgtgaatatatgcagctttattaagagaatttacaaattcaatgatataaaataaggtaggccttgattcacttggttgttttttacttatttaatattccaacattgctatctctaaaaatgcattatcatgttttgaagggatttgctcttgaatttagctccagggagaaagtatcaaaataacttttttttttttttttgagatggagtctggctctgtcacccaggctggagtgcagtggcgtgatcttggctcactgcaagctccacctcccgggtttacaccattctcctgcctcagcctcccaagtagctgggactacaggtgcccgccaccacgcctggctaattttttgtatttttagtagagacgggctttcaccatgttggccaggatggtctcgatctcctgacctcgtgatccgcccgcctcagcctcccggagtgttgggattacaggcatgagccaccgcacccggcccaaaataacttgagaaaacagatcgctctgcagtttaaagaagtattatgtacccgaactgaaatagatatactgttcttaattatcctgaatcataatgaagagtagataatccaaaatagattttttaatcattcacatttagtttggggtgttctatgtttgttaggaataaaactggttctaaccaattactgaagctggtactgggaggattcaactagagaggattcaaaaagctgcctttttctctgttgcctccgtgccttactcacatttagtttagggtgttctatgtttgttaggaataaaactggttctaaccaattactgaagctggtactgggaggattcaactagagaggattcaaaaagctgcctttttctctgttgcctctgtgccttactcactcgtctccttttcctcacttcacactaggactgggtaccatcacactgcagtataattccaaatgcatttccaagctaagtttcccagcgtctgattgtgctttccttttggcctttactttcattgggggtgattgaggtagtctgattttttagctaagtctaaacttaaggctattatttgtctaccagctagggttcaggctgcattccctgtgagtccttagataaggtctgtgaaagactgaaagcatctcctatttcattaagaatgaaatgatttgtttggagtataaggagattgataccttgtatgatgtcataaactgtgaagccacttgcttttaaaaaaaaaaaaa

SEQ ID NO: 343360 - DNA, 4654 bp, Homo sapiens
acgtcagccaaggactctggagccgccgccgccgctgctgcggttcatatccggagtagacggagccgcagtagacggatccgcggctgcaccaaaccactgcccctcggagcctggtagtgggccacaagcccccagtcccagaggcgtgattttctggcatccttaaatcttgtgtcaaggattggttataatataaccagaaaccatgacggcggctgagaacgtatgctacacgttaattaacgtgccaatggattcagaaccaccatctgaaattagcttaaaaaatgatctagaaaaaggagatgtaaagtcaaagactgaagctttgaagaaagtaatcattatgattctgaatggtgaaaaacttcctggacttctgatgaccatcattcgttttgtgctacctcttcaggatcacactatcaagaaattacttctggtattttgggaaattgttcctaaaacaactccagatgggagacttttacatgagatgatccttgtatgtgatgcatacagaaaggatcttcaacatcctaatgaatttattcgaggatctactcttcgttttctttgcaaattgaaagaagcagaattgctagaacctttaatgccagctattcgtgcatgtttggagcatcgacacagctatgttagaagaaatgctgttttggccatctataccatctatagaaattttgaacatcttatacctgatgctcctgaactgatacatgattttctggtgaatgagaaggatgcaagttgcaaaaggaatgcatttatgatgctaattcatgcagatcaggatcgagctttggattacttaagtacttgcattgatcaagttcaaacatttggagacattctgcagctggttattgttgaactgatttataaggtctgtcatgctaatccatcagaaagagctcgttttattcgctgcatctataacttattacagtcatccagccctgctgtaaaatatgaagctgctgggacattagtgacactctctagtgcaccaactgcaatcaaggctgctgctcagtgttacattgatttaattattaaggagagcgacaacaatgtaaaactcatagttttggatcgcttgatagaattaaaagagcatcctgctcatgaacgagtactacaggatctggttatggatatcctaagagtattgagcacaccagacttagaagtacgaaagaaaactctgcagttagcactggatcttgtctcttctagaaatgttgaagagctggttattgtcctgaagaaggaagtgataaaaacaaataatgtgtctgagcatgaagatactgacaaatacagacaactcctagtgcgaacattgcattcctgttctgtccgatttccagatatggctgcaaatgttattcctgtgttaatggaatttctcagtgacaacaacgaagcagcagctgctgatgtcttggagtttgttcgtgaagccattcagcgctttgataacctgagaatgcttattgttgagaagatgcttgaagtctttcatgctattaaatctgtcaagatttaccgaggagcattatggatcctgggagaatactgtagtaccaaggaagacattcagagtgtgatgactgagatccgcaggtcccttggagagatcccaattgtagagtcagaaataaagaaagaagctggtgaattaaaacctgaagaagaaataactgtagggccagttcagaaattggttactgaaatgggtacctatgcaactcagagtgcccttagcagttctagacccaccaagaaagaggaagacagacctcccttgagaggattccttctggatggagatttctttgttgctgcctcccttgccacaactctgaccaagattgcattgcgctatgtagctttggttcaggagaagaaaaagcaaaattcttttgttgctgaggctatgttgctcatggctactatcctgcatttgggaaaatcctctcttcctaagaagccaattactgatgatgatgtggatcgaatttccctgtgcctcaaggtcttgtctgaatgttcacctttaatgaatgacattttcaataaggaatgcagacagtccctttctcacatgttatctgctaaactagaagaagagaaattatcccaaaagaaagaatctgaaaagaggaatgtgacagtacagcctgatgaccccatttccttcatgcaactaactgctaagaatgaaatgaactgcaaggaagatcagtttcagctgagtttactggcagcaatgggtaacacacagaggaaagaggcagcagatcccctagcatctaaacttaacaaggtcacccaattgacaggtttctcagatcctgtatatgcagaagcttacgttcatgtcaaccaatatgatattgtcctggatgtacttgttgtgaaccaaaccagtgatactttgcagaattgcacattagaactagctacactaggggatctgaaacttgtggaaaagccgtctcctttgactcttgctcctcatgacttcgcaaatattaaagctaacgtcaaagtagcatcaacagaaaatggaataatttttggtaatatagtttatgatgtctctggagcagcaagtgacagaaattgtgtggttctcagtgatattcacatcgacatcatggactatatccagcctgcaacttgcactgatgcagaattccgtcagatgtgggccgaatttgaatgggaaaacaaaatattaaagtcaaccaatatgaaatgcctgactccagaaaaggccctttctggttactgtggctttatggcagccaacctttatgctcgttccatatttggtgaagatgcacttgcaaatgtcagcattgagaagccaattcaccagggaccagatgctgctgttaccggccatataagaattcgtgcaaagagccagggaatggccttaagtcttggagataaaatcaacttgtcacagaagaaaactagtatataaaaataaacaaaaagtccttgaagctttacagttaatttaggtatgggcttactggactccaacatcttttgtactctttcatgcttatatagaatctgagttcatgctgaatacttttcagccaataatttatagcctttcccttaaatcaagattgagtttaaaattatagtttgtcttttgtcttaacagttctgaatgctgtcctcaaagtatataatgtttcatgtaccaagacccttttcacagtacaataaacagatctattcataaatttttgttattttataaataaatgattacataattttagttatatggcaatggatttcttttagttgggttataaatttctattataaatttaaattactgagttgtgaatatatgcagctttattaagagaatttacaaattcaatgatataaaataaggtaggccttgattcacttggttgttttttacttatttaatattccaacattgctatctctaaaaatgcattatcatgttttgaagggatttgctcttgaatttagctccagggagaaagtatcaaaataacttttttttttttttttgagatggagtctggctctgtcacccaggctggagtgcagtggcgtgatcttggctcactgcaagctccacctcccgggtttacaccattctcctgcctcagcctcccaagtagctgggactacaggtgcccgccaccacgcctggctaattttttgtatttttagtagagacgggctttcaccatgttggccaggatggtctcgatctcctgacctcgtgatccgcccgcctcagcctcccggagtgttgggattacaggcatgagccaccgcacccggcccaaaataacttgagaaaacagatcgctctgcagtttaaagaagtattatgtacccgaactgaaatagatatactgttcttaattatcctgaatcataatgaagagtagataatccaaaatagattttttaatcattcacatttagtttggggtgttctatgtttgttaggaataaaactggttctaaccaattactgaagctggtactgggaggattcaactagagaggattcaaaaagctgcctttttctctgttgcctccgtgccttactcacatttagtttagggtgttctatgtttgttaggaataaaactggttctaaccaattactgaagctggtactgggaggattcaactagagaggattcaaaaagctgcctttttctctgttgcctctgtgccttactcactcgtctccttttcctcacttcacactaggactgggtaccatcacactgcagtataattccaaatgcatttccaagctaagtttcccagcgtctgattgtgctttccttttggcctttactttcattgggggtgattgaggtagtctgattttttagctaagtctaaacttaaggctattatttgtctaccagctagggttcaggctgcattccctgtgagtccttagataaggtctgtgaaagactgaaagcatctcctatttcattaagaatgaaatgatttgtttggagtataaggagattgataccttgtatgatgtcataaactgtgaagccacttgcttttaaaaaaaaaaaaa

SEQ ID NO: 343361 - DNA, 3294 bp, Homo sapiens
acgtcagccaaggactctggagccgccgccgccgctgctgcggttcatatccggagtagacggagccgcagtagacggatccgcggctgcaccaaaccactgcccctcggagcctggtagtgggccacaagcccccagtcccagaggcgtgattttctggcatccttaaatcttgtgtcaaggattggttataatataaccagaaaccatgacggcggctgagaacgtatgctacacgttaattaacgtgccaatggattcagaaccaccatctgaaattagcttaaaaaatgatctagaaaaaggagatgtaaagtcaaagactgaagctttgaagaaagtaatcattatgattctgaatggtgaaaaacttcctggacttctgatgaccatcattcgttttgtgctacctcttcaggatcacactatcaagaaattacttctggtattttgggaaattgttcctaaaacaactccagatgggagacttttacatgagatgatccttgtatgtgatgcatacagaaaggatcttcaacatcctaatgaatttattcgaggatctactcttcgttttctttgcaaattgaaagaagcagaattgctagaacctttaatgccagctattcgtgcatgtttggagcatcgacacagctatgttagaagaaatgctgttttggccatctataccatctatagaaattttgaacatcttatacctgatgctcctgaactgatacatgattttctggtgaatgagaaggatgcaagttgcaaaaggaatgcatttatgatgctaattcatgcagatcaggatcgagctttggattacttaagtacttgcattgatcaagttcaaacatttggagacattctgcagctggttattgttgaactgatttataaggtctgtcatgctaatccatcagaaagagctcgttttattcgctgcatctataacttattacagtcatccagccctgctgtaaaatatgaagctgctgggacattagtgacactctctagtgcaccaactgcaatcaaggctgctgctcagtgttacattgatttaattattaaggagagcgacaacaatgtaaaactcatagttttggatcgcttgatagaattaaaagagcatcctgctcatgaacgagtactacaggatctggttatggatatcctaagagtattgagcacaccagacttagaagtacgaaagaaaactctgcagttagcactggatcttgtctcttctagaaatgttgaagagctggttattgtcctgaagaaggaagtgataaaaacaaataatgtgtctgagcatgaagatactgacaaatacagacaactcctagtgcgaacattgcattcctgttctgtccgatttccagatatggctgcaaatgttattcctgtgttaatggaatttctcagtgacaacaacgaagcagcagctgctgatgtcttggagtttgttcgtgaagccattcagcgctttgataacctgagaatgcttattgttgagaagatgcttgaagtctttcatgctattaaatctgtcaagatttaccgaggagcattatggatcctgggagaatactgtagtaccaaggaagacattcagagtgtgatgactgagatccgcaggtcccttggagagatcccaattgtagagtcagaaataaagaaagaagctggtgaattaaaacctgaagaagaaataactgtagggccagttcagaaattggttactgaaatgggtacctatgcaactcagagtgcccttagcagttctagacccaccaagaaagaggaagacagacctcccttgagaggattccttctggatggagatttctttgttgctgcctcccttgccacaactctgaccaagattgcattgcgctatgtagctttggttcaggagaagaaaaagcaaaattcttttgttgctgaggctatgttgctcatggctactatcctgcatttgggaaaatcctctcttcctaagaagccaattactgatgatgatgtggatcgaatttccctgtgcctcaaggtcttgtctgaatgttcacctttaatgaatgacattttcaataaggaatgcagacagtccctttctcacatgttatctgctaaactagaagaagagaaattatcccaaaagaaagaatctgaaaagaggaatgtgacagtacagcctgatgaccccatttccttcatgcaactaactgctaagaatgaaatgaactgcaaggaagatcagtttcagctgagtttactggcagcaatgggtaacacacagaggaaagaggcagcagatcccctagcatctaaacttaacaaggtcacccaattgacaggtttctcagatcctgtatatgcagaagcttacgttcatgtcaaccaatatgatattgtcctggatgtacttgttgtgaaccaaaccagtgatactttgcagaattgcacattagaactagctacactaggggatctgaaacttgtggaaaagccgtctcctttgactcttgctcctcatgacttcgcaaatattaaagctaacgtcaaagtagcatcaacagaaaatggaataatttttggtaatatagtttatgatgtctctggagcagcaagtgacagaaattgtgtggttctcagtgatattcacatcgacatcatggactatatccagcctgcaacttgcactgatgcagaattccgtcagatgtgggccgaatttgaatgggaaaacaaagtgacagttaacaccaacatggttgatttaaatgactacttacagcacatattaaagtcaaccaatatgaaatgcctgactccagaaaaggccctttctggttactgtggctttatggcagccaacctttatgctcgttccatatttggtgaagatgcacttgcaaatgtcagcattgagaagccaattcaccagggaccagatgctgctgttaccggccatataagaattcgtgcaaagagccagggaatggccttaagtcttggagataaaatcaacttgtcacagaagaaaactagtatataaaaataaacaaaaagtccttgaagctttacagttaatttagattctcagtacaccatcactgttactgtccccagctccattctctacctccaggatctcaggagcctacagaagtaaccagcaatggcagaatctctgagaagtcagtcatgcagtgacaaaagaatgcaagtgggatttgtgtcttttatctgggctctgtatataattataggattctgaga

SEQ ID NO: 343362 - DNA, 3102 bp, Homo sapiens
acgtcagccaaggactctggagccgccgccgccgctgctgcggttcatatccggagtagacggagccgcagtagacggatccgcggctgcaccaaaccactgcccctcggagcctggtagtgggccacaagcccccagtcccagaggcgtgattttctggcatccttaaatcttgtgtcaaggattggttataatataaccagaaaccatgacggcggctgagaacgtatgctacacgttaattaacgtgccaatggattcagaaccaccatctgaaattagcttaaaaaatgatctagaaaaaggagatgtaaagtcaaagactgaagctttgaagaaagtaatcattatgattctgaatggtgaaaaacttcctggacttctgatgaccatcattcgttttgtgctacctcttcaggatcacactatcaagaaattacttctggtattttgggaaattgttcctaaaacaactccagatgggagacttttacatgagatgatccttgtatgtgatgcatacagaaaggatcttcaacatcctaatgaatttattcgaggatctactcttcgttttctttgcaaattgaaagaagcagaattgctagaacctttaatgccagctattcgtgcatgtttggagcatcgacacagctatgttagaagaaatgctgttttggccatctataccatctatagaaattttgaacatcttatacctgatgctcctgaactgatacatgattttctggtgaatgagaaggatgcaagttgcaaaaggaatgcatttatgatgctaattcatgcagatcaggatcgagctttggattacttaagtacttgcattgatcaagttcaaacatttggagacattctgcagctggttattgttgaactgatttataaggtctgtcatgctaatccatcagaaagagctcgttttattcgctgcatctataacttattacagtcatccagccctgctgtaaaatatgaagctgctgggacattagtgacactctctagtgcaccaactgcaatcaaggctgctgctcagtgttacattgatttaattattaaggagagcgacaacaatgtaaaactcatagttttggatcgcttgatagaattaaaagagcatcctgctcatgaacgagtactacaggatctggttatggatatcctaagagtattgagcacaccagacttagaagtacgaaagaaaactctgcagttagcactggatcttgtctcttctagaaatgttgaagagctggttattgtcctgaagaaggaagtgataaaaacaaataatgtgtctgagcatgaagatactgacaaatacagacaactcctagtgcgaacattgcattcctgttctgtccgatttccagatatggctgcaaatgttattcctgtgttaatggaatttctcagtgacaacaacgaagcagcagctgctgatgtcttggagtttgttcgtgaagccattcagcgctttgataacctgagaatgcttattgttgagaagatgcttgaagtctttcatgctattaaatctgtcaagatttaccgaggagcattatggatcctgggagaatactgtagtaccaaggaagacattcagagtgtgatgactgagatccgcaggtcccttggagagatcccaattgtagagtcagaaataaagaaagaagctggtgaattaaaacctgaagaagaaataactgtagggccagttcagaaattggttactgaaatgggtacctatgcaactcagagtgcccttagcagttctagacccaccaagaaagaggaagacagacctcccttgagaggattccttctggatggagatttctttgttgctgcctcccttgccacaactctgaccaagattgcattgcgctatgtagctttggttcaggagaagaaaaagcaaaattcttttgttgctgaggctatgttgctcatggctactatcctgcatttgggaaaatcctctcttcctaagaagccaattactgatgatgatgtggatcgaatttccctgtgcctcaaggtcttgtctgaatgttcacctttaatgaatgacattttcaataaggaatgcagacagtccctttctcacatgttatctgctaaactagaagaagagaaattatcccaaaagaaagaatctgaaaagaggaatgtgacagtacagcctgatgaccccatttccttcatgcaactaactgctaagaatgaaatgaactgcaaggaagatcagtttcagctgagtttactggcagcaatgggtaacacacagaggaaagaggcagcagatcccctagcatctaaacttaacaaggtcacccaattgacaggtttctcagatcctgtatatgcagaagcttacgttcatgtcaaccaatatgatattgtcctggatgtacttgttgtgaaccaaaccagtgatactttgcagaattgcacattagaactagctacactaggggatctgaaacttgtggaaaagccgtctcctttgactcttgctcctcatgacttcgcaaatattaaagctaacgtcaaagtagcatcaacagaaaatggaataatttttggtaatatagtttatgatgtctctggagcagcaagtgacagaaattgtgtggttctcagtgatattcacatcgacatcatggactatatccagcctgcaacttgcactgatgcagaattccgtcagatgtgggccgaatttgaatgggaaaacaaagtgacagttaacaccaacatggttgatttaaatgactacttacagcacatattaaagtcaaccaatatgaaatgcctgactccagaaaaggccctttctggttactgtggctttatggcagccaacctttatgctcgttccatatttggtgaagatgcacttgcaaatgtcagcattgagaagccaattcaccagggaccagatgctgctgttaccggccatataagaattcgtgcaaagagccaggtaacagttcctttttttttgagagtatctctggactgacaaaggggggaggaatttatgactttattatttctatatgtagtatcttttta

SEQ ID NO: 343363 - DNA, 3046 bp, Homo sapiens
acgtcagccaaggactctggagccgccgccgccgctgctgcggttcatatccggagtagacggagccgcagtagacggatccgcggctgcaccaaaccactgcccctcggagcctggtagtgggccacaagcccccagtcccagaggcgtgattttctggcatccttaaatcttgtgtcaaggattggttataatataaccagaaaccatgacggcggctgagaacgtatgctacacgttaattaacgtgccaatggattcagaaccaccatctgaaattagcttaaaaaatgatctagaaaaaggagatgtaaagtcaaagactgaagctttgaagaaagtaatcattatgattctgaatggtgaaaaacttcctggacttctgatgaccatcattcgttttgtgctacctcttcaggatcacactatcaagaaattacttctggtattttgggaaattgttcctaaaacaactccagatgggagacttttacatgagatgatccttgtatgtgatgcatacagaaaggatcttcaacatcctaatgaatttattcgaggatctactcttcgttttctttgcaaattgaaagaagcagaattgctagaacctttaatgccagctattcgtgcatgtttggagcatcgacacagctatgttagaagaaatgctgttttggccatctataccatctatagaaattttgaacatcttatacctgatgctcctgaactgatacatgattttctggtgaatgagaaggatgcaagttgcaaaaggaatgcatttatgatgctaattcatgcagatcaggatcgagctttggattacttaagtacttgcattgatcaagttcaaacatttggagacattctgcagctggttattgttgaactgatttataaggtctgtcatgctaatccatcagaaagagctcgttttattcgctgcatctataacttattacagtcatccagccctgctgtaaaatatgaagctgctgggacattagtgacactctctagtgcaccaactgcaatcaaggctgctgctcagtgttacattgatttaattattaaggagagcgacaacaatgtaaaactcatagttttggatcgcttgatagaattaaaagagcatcctgctcatgaacgagtactacaggatctggttatggatatcctaagagtattgagcacaccagacttagaagtacgaaagaaaactctgcagttagcactggatcttgtctcttctagaaatgttgaagagctggttattgtcctgaagaaggaagtgataaaaacaaataatgtgtctgagcatgaagatactgacaaatacagacaactcctagtgcgaacattgcattcctgttctgtccgatttccagatatggctgcaaatgttattcctgtgttaatggaatttctcagtgacaacaacgaagcagcagctgctgatgtcttggagtttgttcgtgaagccattcagcgctttgataacctgagaatgcttattgttgagaagatgcttgaagtctttcatgctattaaatctgtcaagatttaccgaggagcattatggatcctgggagaatactgtagtaccaaggaagacattcagagtgtgatgactgagatccgcaggtcccttggagagatcccaattgtagagtcagaaataaagaaagaagctggtgaattaaaacctgaagaagaaataactgtagggccagttcagaaattggttactgaaatgggtacctatgcaactcagagtgcccttagcagttctagacccaccaagaaagaggaagacagacctcccttgagaggattccttctggatggagatttctttgttgctgcctcccttgccacaactctgaccaagattgcattgcgctatgtagctttggttcaggagaagaaaaagcaaaattcttttgttgctgaggctatgttgctcatggctactatcctgcatttgggaaaatcctctcttcctaagaagccaattactgatgatgatgtggatcgaatttccctgtgcctcaaggtcttgtctgaatgttcacctttaatgaatgacattttcaataaggaatgcagacagtccctttctcacatgttatctgctaaactagaagaagagaaattatcccaaaagaaagaatctgaaaagaggaatgtgacagtacagcctgatgaccccatttccttcatgcaactaactgctaagaatgaaatgaactgcaaggaagatcagtttcagctgagtttactggcagcaatgggtaacacacagaggaaagaggcagcagatcccctagcatctaaacttaacaaggtcacccaattgacaggtttctcagatcctgtatatgcagaagcttacgttcatgtcaaccaatatgatattgtcctggatgtacttgttgtgaaccaaaccagtgatactttgcagaattgcacattagaactagctacactaggggatctgaaacttgtggaaaagccgtctcctttgactcttgctcctcatgacttcgcaaatattaaagctaacgtcaaagtagcatcaacagaaaatggaataatttttggtaatatagtttatgatgtctctggagcagcaagtgacagaaattgtgtggttctcagtgatattcacatcgacatcatggactatatccagcctgcaacttgcactgatgcagaattccgtcagatgtgggccgaatttgaatgggaaaacaaagtgacagttaacaccaacatggttgatttaaatgactacttacagcacatattaaagtcaaccaatatgaaatgcctgactccagaaaaggtaaaatttgactaggaaattcagaaatctgatggaatggtagagtaggttcctggccttcctgtatttcctctagcacatttttgttattcaatatgcagtaccattctaggctatctaaaagatgttatcccatagaatgttggaatctgcttacctctttctattggactataccatcctactttttcc

SEQ ID NO: 343364 - DNA, 1740 bp, Homo sapiens
ccgggaaaggtacctgttatacatataagaattcgtgcaaagagccagggaatggccttaagtcttggagataaaatcaacttgtcacagaagaaaactagtatataaaaataaacaaaaagtccttgaagctttacagttaatttaggtatgggcttactggactccaacatcttttgtactctttcatgcttatatagaatctgagttcatgctgaatacttttcagccaataatttatagcctttcccttaaatcaagattgagtttaaaattatagtttgtcttttgtcttaacagttctgaatgctgtcctcaaagtatataatgtttcatgtaccaagacccttttcacagtacaataaacagatctattcataaatttttgttattttataaataaatgattacataattttagttatatggcaatggatttcttttagttgggttataaatttctattataaatttaaattactgagttgtgaatatatgcagctttattaagagaatttacaaattcaatgatataaaataaggtaggccttgattcacttggttgttttttacttatttaatattccaacattgctatctctaaaaatgcattatcatgttttgaagggatttgctcttgaatttagctccagggagaaagtatcaaaataacttttttttttttttttgagatggagtctggctctgtcacccaggctggagtgcagtggcgtgatcttggctcactgcaagctccacctcccgggtttacaccattctcctgcctcagcctcccaagtagctgggactacaggtgcccgccaccacgcctggctaattttttgtatttttagtagagacgggctttcaccatgttggccaggatggtctcgatctcctgacctcgtgatccgcccgcctcagcctcccggagtgttgggattacaggcatgagccaccgcacccggcccaaaataacttgagaaaacagatcgctctgcagtttaaagaagtattatgtacccgaactgaaatagatatactgttcttaattatcctgaatcataatgaagagtagataatccaaaatagattttttaatcattcacatttagtttggggtgttctatgtttgttaggaataaaactggttctaaccaattactgaagctggtactgggaggattcaactagagaggattcaaaaagctgcctttttctctgttgcctccgtgccttactcacatttagtttagggtgttctatgtttgttaggaataaaactggttctaaccaattactgaagctggtactgggaggattcaactagagaggattcaaaaagctgcctttttctctgttgcctctgtgccttactcactcgtctccttttcctcacttcacactaggactgggtaccatcacactgcagtataattccaaatgcatttccaagctaagtttcccagcgtctgattgtgctttccttttggcctttactttcattgggggtgattgaggtagtctgattttttagctaagtctaaacttaaggctattatttgtctaccagctagggttcaggctgcattccctgtgagtccttagataaggtctgtgaaagactgaaagcatctcctatttcattaagaatgaaatgatttgtttggagtataaggagattgataccttgtatgatgtcataaactgtgaagccacttgcttttaaaaaaaaaaaaa

SEQ ID NO: 343365 - DNA, 1629 bp, Homo sapiens
cttaaatcaagattgagtttaagggaaaggctataaattattggctgaaaagtattcagcatgaactcagattctatataagcatgaaagagtacaaaagatgttggagtccagtaagccaataatttatagcctttcccttaaatcaagattgagtttaaaattatagtttgtcttttgtcttaacagttctgaatgctgtcctcaaagtatataatgtttcatgtaccaagacccttttcacagtacaataaacagatctattcataaatttttgttattttataaataaatgattacataattttagttatatggcaatggatttcttttagttgggttataaatttctattataaatttaaattactgagttgtgaatatatgcagctttattaagagaatttacaaattcaatgatataaaataaggtaggccttgattcacttggttgttttttacttatttaatattccaacattgctatctctaaaaatgcattatcatgttttgaagggatttgctcttgaatttagctccagggagaaagtatcaaaataacttttttttttttttttgagatggagtctggctctgtcacccaggctggagtgcagtggcgtgatcttggctcactgcaagctccacctcccgggtttacaccattctcctgcctcagcctcccaagtagctgggactacaggtgcccgccaccacgcctggctaattttttgtatttttagtagagacgggctttcaccatgttggccaggatggtctcgatctcctgacctcgtgatccgcccgcctcagcctcccggagtgttgggattacaggcatgagccaccgcacccggcccaaaataacttgagaaaacagatcgctctgcagtttaaagaagtattatgtacccgaactgaaatagatatactgttcttaattatcctgaatcataatgaagagtagataatccaaaatagattttttaatcattcacatttagtttggggtgttctatgtttgttaggaataaaactggttctaaccaattactgaagctggtactgggaggattcaactagagaggattcaaaaagctgcctttttctctgttgcctccgtgccttactcacatttagtttagggtgttctatgtttgttaggaataaaactggttctaaccaattactgaagctggtactgggaggattcaactagagaggattcaaaaagctgcctttttctctgttgcctctgtgccttactcactcgtctccttttcctcacttcacactaggactgggtaccatcacactgcagtataattccaaatgcatttccaagctaagtttcccagcgtctgattgtgctttccttttggcctttactttcattgggggtgattgaggtagtctgattttttagctaagtctaaacttaaggctattatttgtctaccagctagggttcaggctgcattccctgtgagtccttagataaggtctgtgaaagactgaaagcatctcctatttcattaagaatgaaatgatttgtttggagtataaggagattgataccttgtatgatgtcataaactgtgaagccacttgcttttaaaaaaaaaaaaa

SEQ ID NO: 343366 - DNA, 187 bp, Homo sapiens
aaggaagacattcagagtgtgatgactgagatccgcaggtcccttggagaggtatgttttactttagtaaatgttagtttatatggtaatttttcctttaggaaaatctgactttttatagtgatttgcttacattatttacacttctgagttagattttgtttgaacaaaatgttctgtgtttatt

SEQ ID NO: 343367 - DNA, 343 bp, Homo sapiens
caaattttatgatagatgaataacttcttaaaatgtatttctttttttatataggctgctgctcagtgttacattgatttaattattaaggagagcgacaacaatgtaaaactcatagttttggatcgcttgatagaattaaaagagcatcctgctcatgaacgagtactacaggtaagtgttatctgaaaaagagagatcctaaataaaatgtttttcaaatttaggtcattctcaagctttgcccatcttggttaacctaaatgcttggaaactgagcagtttatattttgatcagctaaagtgttaactattgagtcatcatagccttttggggtattat

SEQ ID NO: 343368 - DNA, 1723 bp, Homo sapiens
acgtcagccaaggactctggagccgccgccgccgctgctgcggttcatatccggagtagacggagccgcagtagacggatccgcggctgcaccaaaccactgcccctcggagcctgattttctggcatccttaaatcttgtgtcaaggattggttataatataaccagaaaccatgacggcggctgagaacgtatgctacacgttaattaacgtgccaatggattcagaaccaccatctgaaattagcttaaaaaatgatctagaaaaaggagatgtaaagtcaaagactgaagctttgaagaaagtaatcattatgattctgaatggtgaaaaacttcctggacttctgatgaccatcattcgttttgtgctacctcttcaggatcacactatcaagaaattacttctggtattttgggaaattgttcctaaaacaactccagatgggagacttttacatgagatgatccttgtatgtgatgcatacagaaaggatcttcaacatcctaatgaatttattcgaggatctactcttcgttttctttgcaaattgaaagaagcagaattgctagaacctttaatgccagctattcgtgcatgtttggagcatcgacacagctatgttagaagaaatgctgttttggccatctataccatctatagaaattttgaacatcttatacctgatgctcctgaactgatacatgattttctggtgaatgagaaggatgcaagttgcaaaaggaatgcatttatgatgctaattcatgcagatcaggatcgagctttggattacttaagtacttgcattgatcaagttcaaacatttggagacattctgcagctggttattgttgaactgatttataaggtctgtcatgctaatccatcagaaagagctcgttttattcgctgcatctataacttattacagtcatccagccctgctgtaaaatatgaagctgctgggacattagtgacactctctagtgcaccaactgcaatcaaggctgctgctcagtgttacattgatttaattattaaggagagcgacaacaatgtaaaactcatagttttggatcgcttgatagaattaaaagagcatcctgctcatgaacgagtactacaggatctggttatggatatcctaagagtattgagcacaccagacttagaagtacgaaagaaaactctgcagttagcactggatcttgtctcttctagaaatgttgaagagctggttattgtcctgaagaaggaagtgataaaaacaaataatgtgtctgagcatgaagatactgacaaatacagacaactcctagtgcgaacattgcattcctgttctgtccgatttccagatatggctgcaaatgttattcctgtgttaatggaatttctcagtgacaacaacgaagcagcagctgctgatgtcttggagtttgttcgtgaagccattcagcgctttgataacctgagaatgcttattgttgagaagatgcttgaagtctttcatgctattaaatctgtcaagatttaccgaggagcattatggatcctgggagaatactgtagtaccaaggaagacattcagagtgtgatgactgagatccgcaggtcccttggagagatcccaattgtagagtcagaaataaagaaagatgtggaaagtaactgaagcagcatcaggtaccaactgtagtgacgttcctcatcaagatcctg

SEQ ID NO: 343369 - DNA, 3666 bp, Homo sapiens
acgtcagccaaggactctggagccgccgccgccgctgctgcggttcatatccggagtagacggagccgcagtagacggatccgcggctgcaccaaaccactgcccctcggagcctggtagtgggccacaagcccccagtcccagaggcgtgattttctggcatccttaaatcttgtgtcaaggattggttataatataaccagaaaccatgacggcggctgagaacgtatgctacacgttaattaacgtgccaatggattcagaaccaccatctgaaattagcttaaaaaatgatctagaaaaaggagatgtaaagtcaaagactgaagctttgaagaaagtaatcattatgattctgaatggtgaaaaacttcctggacttctgatgaccatcattcgttttgtgctacctcttcaggatcacactatcaagaaattacttctggtattttgggaaattgttcctaaaacaactccagatgggagacttttacatgagatgatccttgtatgtgatgcatacagaaaggatcttcaacatcctaatgaatttattcgaggatctactcttcgttttctttgcaaattgaaagaagcagaattgctagaacctttaatgccagctattcgtgcatgtttggagcatcgacacagctatgttagaagaaatgctgttttggccatctataccatctatagaaattttgaacatcttatacctgatgctcctgaactgatacatgattttctggtgaatgagaaggatgcaagttgcaaaaggaatgcatttatgatgctaattcatgcagatcaggatcgagctttggattacttaagtacttgcattgatcaagttcaaacatttggagacattctgcagctggttattgttgaactgatttataaggtctgtcatgctaatccatcagaaagagctcgttttattcgctgcatctataacttattacagtcatccagccctgctgtaaaatatgaagctgctgggacattagtgacactctctagtgcaccaactgcaatcaaggctgctgctcagtgttacattgatttaattattaaggagagcgacaacaatgtaaaactcatagttttggatcgcttgatagaattaaaagagcatcctgctcatgaacgagtactacaggatctggttatggatatcctaagagtattgagcacaccagacttagaagtacgaaagaaaactctgcagttagcactggatcttgtctcttctagaaatgttgaagagctggttattgtcctgaagaaggaagtgataaaaacaaataatgtgtctgagcatgaagatactgacaaatacagacaactcctagtgcgaacattgcattcctgttctgtccgatttccagatatggctgcaaatgttattcctgtgttaatggaatttctcagtgacaacaacgaagcagcagctgctgatgtcttggagtttgttcgtgaagccattcagcgctttgataacctgagaatgcttattgttgagaagatgcttgaagtctttcatgctattaaatctgtcaagatttaccgaggagcattatggatcctgggagaatactgtagtaccaaggaagacattcagagtgtgatgactgagatccgcaggtcccttggagagatcccaattgtagagtcagaaataaagaaagaagctggtgaattaaaacctgaagaagaaataactgtagggccagttcagaaattggttactgaaatgggtacctatgcaactcagagtgcccttagcagttctagacccaccaagaaagaggaagacagacctcccttgagaggattccttctggatggagatttctttgttgctgcctcccttgccacaactctgaccaagattgcattgcgctatgtagctttggttcaggagaagaaaaagcaaaattcttttgttgctgaggctatgttgctcatggctactatcctgcatttgggaaaatcctctcttcctaagaagccaattactgatgatgatgtggatcgaatttccctgtgcctcaaggtcttgtctgaatgttcacctttaatgaatgacattttcaataaggaatgcagacagtccctttctcacatgttatctgctaaactagaagaagagaaattatcccaaaagaaagaatctgaaaagaggaatgtgacagtacagcctgatgaccccatttccttcatgcaactaactgctaagaatgaaatgaactgcaaggaagatcagtttcagctgagtttactggcagcaatgggtaacacacagaggaaagaggcagcagatcccctagcatctaaacttaacaaggtcacccaattgacaggtttctcagatcctgtatatgcagaagcttacgttcatgtcaaccaatatgatattgtcctggatgtacttgttgtgaaccaaaccagtgatactttgcagaattgcacattagaactagctacactaggggatctgaaacttgtggaaaagccgtctcctttgactcttgctcctcatgacttcgcaaatattaaagctaacgtcaaagtagcatcaacagaaaatggaataatttttggtaatatagtttatgatgtctctggagcagcaagtgacagaaattgtgtggttctcagtgatattcacatcgacatcatggactatatccagcctgcaacttgcactgatgcagaattccgtcagatgtgggccgaatttgaatgggaaaacaaagtgacagttaacaccaacatggttgatttaaatgactacttacagcacatattaaagtcaaccaatatgaaatgcctgactccagaaaaggccctttctggttactgtggctttatggcagccaacctttatgctcgttccatatttggtgaagatgcacttgcaaatgtcagcattgagaagccaattcaccagggaccagatgctgctgttaccggccatataagaattcgtgcaaagagccagggaatggccttaagtcttggagataaaatcaacttgtcacagaagaaaactagtatataaaaataaacaaaaagtccttgaagctttacagttaatttaggtatgggcttactggactccaacatcttttgtactctttcatgcttatatagaatctgagttcatgctgaatacttttcagccaataatttatagcctttcccttaaatcaagattgagtttaaaattatagtttgtcttttgtcttaacagttctgaatgctgtcctcaaagtatataatgtttcatgtaccaagacccttttcacagtacaataaacagatctattcataaatttttgttattttataaataaatgattacataaattccaaaaaaaaaaaaaaaaaaaaaaaaaaaaacgggtggtgggcgcgcgccccggggcccccagaaaaagttttctcaaaaaccatcgcgtgggggcgcgcgcggggccccagttgggttaggtgaacgtgggccaaaaggcgtggccccaaggaaaaatcggcccacgaaacagggggcgggggttccccccaaaataaaaaggccggggggaaacggaggttctggaacaatcccaaggggtcggggggcctcggttctacacggggtcccaggagcgaaaaaac

SEQ ID NO: 343370 - DNA, 4667 bp, Homo sapiens
acgtcagccaaggactctggagccgccgccgccgctgctgcggttcatatccggagtagacggagccgcagtagacggatccgcggctgcaccaaaccactgcccctcggagcctgattttctggcatccttaaatcttgtgtcaaggattggttataatataaccagaaaccatgacggcggctgagaacgtatgctacacgttaattaacgtgccaatggattcagaaccaccatctgaaattagcttaaaaaatgatctagaaaaaggagatgtaaagtcaaagactgaagctttgaagaaagtaatcattatgattctgaatggtgaaaaacttcctggacttctgatgaccatcattcgttttgtgctacctcttcaggatcacactatcaagaaattacttctggtattttgggaaattgttcctaaaacaactccagatgggagacttttacatgagatgatccttgtatgtgatgcatacagaaaggatcttcaacatcctaatgaatttattcgaggatctactcttcgttttctttgcaaattgaaagaagcagaattgctagaacctttaatgccagctattcgtgcatgtttggagcatcgacacagctatgttagaagaaatgctgttttggccatctataccatctatagaaattttgaacatcttatacctgatgctcctgaactgatacatgattttctggtgaatgagaaggatgcaagttgcaaaaggaatgcatttatgatgctaattcatgcagatcaggatcgagctttggattacttaagtacttgcattgatcaagttcaaacatttggagacattctgcagctggttattgttgaactgatttataaggtctgtcatgctaatccatcagaaagagctcgttttattcgctgcatctataacttattacagtcatccagccctgctgtaaaatatgaagctgctgggacattagtgacactctctagtgcaccaactgcaatcaaggctgctgctcagtgttacattgatttaattattaaggagagcgacaacaatgtaaaactcatagttttggatcgcttgatagaattaaaagagcatcctgctcatgaacgagtactacaggatctggttatggatatcctaagagtattgagcacaccagacttagaagtacgaaagaaaactctgcagttagcactggatcttgtctcttctagaaatgttgaagagctggttattgtcctgaagaaggaagtgataaaaacaaataatgtgtctgagcatgaagatactgacaaatacagacaactcctagtgcgaacattgcattcctgttctgtccgatttccagatatggctgcaaatgttattcctgtgttaatggaatttctcagtgacaacaacgaagcagcagctgctgatgtcttggagtttgttcgtgaagccattcagcgctttgataacctgagaatgcttattgttgagaagatgcttgaagtctttcatgctattaaatctgtcaagatttaccgaggagcattatggatcctgggagaatactgtagtaccaaggaagacattcagagtgtgatgactgagatccgcaggtcccttggagagatcccaattgtagagtcagaaataaagaaagaagctggtgaattaaaacctgaagaagaaataactgtagggccagttcagaaattggttactgaaatgggtacctatgcaactcagagtgcccttagcagttctagacccaccaagaaagaggaagacagacctcccttgagaggattccttctggatggagatttctttgttgctgcctcccttgccacaactctgaccaagattgcattgcgctatgtagctttggttcaggagaagaaaaagcaaaattcttttgttgctgaggctatgttgctcatggctactatcctgcatttgggaaaatcctctcttcctaagaagccaattactgatgatgatgtggatcgaatttccctgtgcctcaaggtcttgtctgaatgttcacctttaatgaatgacattttcaataaggaatgcagacagtccctttctcacatgttatctgctaaactagaagaagagaaattatcccaaaagaaagaatctgaaaagaggaatgtgacagtacagcctgatgaccccatttccttcatgcaactaactgctaagaatgaaatgaactgcaaggaagatcagtttcagctgagtttactggcagcaatgggtaacacacagaggaaagaggcagcagatcccctagcatctaaacttaacaaggtcacccaattgacaggtttctcagatcctgtatatgcagaagcttacgttcatgtcaaccaatatgatattgtcctggatgtacttgttgtgaaccaaaccagtgatactttgcagaattgcacattagaactagctacactaggggatctgaaacttgtggaaaagccgtctcctttgactcttgctcctcatgacttcgcaaatattaaagctaacgtcaaagtagcatcaacagaaaatggaataatttttggtaatatagtttatgatgtctctggagcagcaagtgacagaaattgtgtggttctcagtgatattcacatcgacatcatggactatatccagcctgcaacttgcactgatgcagaattccgtcagatgtgggccgaatttgaatgggaaaacaaagtgacagttaacaccaacatggttgatttaaatgactacttacagcacatattaaagtcaaccaatatgaaatgcctgactccagaaaaggccctttctggttactgtggctttatggcagccaacctttatgctcgttccatatttggtgaagatgcacttgcaaatgtcagcattgagaagccaattcaccagggaccagatgctgctgttaccggccatataagaattcgtgcaaagagccagggaatggccttaagtcttggagataaaatcaacttgtcacagaagaaaactagtatataaaaataaacaaaaagtccttgaagctttacagttaatttaggtatgggcttactggactccaacatcttttgtactctttcatgcttatatagaatctgagttcatgctgaatacttttcagccaataatttatagcctttcccttaaatcaagattgagtttaaaattatagtttgtcttttgtcttaacagttctgaatgctgtcctcaaagtatataatgtttcatgtaccaagacccttttcacagtacaataaacagatctattcataaatttttgttattttataaataaatgattacataattttagttatatggcaatggatttcttttagttgggttataaatttctattataaatttaaattactgagttgtgaatatatgcagctttattaagagaatttacaaattcaatgatataaaataaggtaggccttgattcacttggttgttttttacttatttaatattccaacattgctatctctaaaaatgcattatcatgttttgaagggatttgctcttgaatttagctccagggagaaagtatcaaaataacttttttttttttttttgagatggagtctggctctgtcacccaggctggagtgcagtggcgtgatcttggctcactgcaagctccacctcccgggtttacaccattctcctgcctcagcctcccaagtagctgggactacaggtgcccgccaccacgcctggctaattttttgtatttttagtagagacgggctttcaccatgttggccaggatggtctcgatctcctgacctcgtgatccgcccgcctcagcctcccggagtgttgggattacaggcatgagccaccgcacccggcccaaaataacttgagaaaacagatcgctctgcagtttaaagaagtattatgtacccgaactgaaatagatatactgttcttaattatcctgaatcataatgaagagtagataatccaaaatagattttttaatcattcacatttagtttggggtgttctatgtttgttaggaataaaactggttctaaccaattactgaagctggtactgggaggattcaactagagaggattcaaaaagctgcctttttctctgttgcctccgtgccttactcacatttagtttagggtgttctatgtttgttaggaataaaactggttctaaccaattactgaagctggtactgggaggattcaactagagaggattcaaaaagctgcctttttctctgttgcctctgtgccttactcactcgtctccttttcctcacttcacactaggactgggtaccatcacactgcagtataattccaaatgcatttccaagctaagtttcccagcgtctgattgtgctttccttttggcctttactttcattgggggtgattgaggtagtctgattttttagctaagtctaaacttaaggctattatttgtctaccagctagggttcaggctgcattccctgtgagtccttagataaggtctgtgaaagactgaaagcatctcctatttcattaagaatgaaatgatttgtttggagtataaggagattgataccttgtatgatgtcataaactgtgaagccacttgcttttaaaaaaaaaaaaa

SEQ ID NO: 343371 - DNA, 3565 bp, Homo sapiens
ctcggtgaactgtcgatctgacacacagtgaaagaggtatatcctatagattactggatcacatgagagtagaattacgaaaagaaaactctgtattacgcactaggatcttgtctctgctagaagtggtgaacagctggttattgtcctgaagaaggaagtgataaaaacaaataatgtgtctgagcatgaagatactgacaaatacagacaactcctagtgcgaacattgcattcctgttctgtccgatttccagatatggctgcaaatgttattcctgtgttaatggaatttctcagtgacaacaacgaagcagcagctgctgatgtcttggagtttgttcgtgaagccattcagcgctttgataacctgagaatgcttattgttgagaagatgcttgaagtctttcatgctattaaatctgtcaagatttaccgaggagcattatggatcctgggagaatactgtagtaccaaggaagacattcagagtgtgatgactgagatccgcaggtcccttggagagatcccaattgtagagtcagaaataaagaaagaagctggtgaattaaaacctgaagaagaaataactgtagggccagttcagaaattggttactgaaatgggtacctatgcaactcagagtgcccttagcagttctagacccaccaagaaagaggaagacagacctcccttgagaggattccttctggatggagatttctttgttgctgcctcccttgccacaactctgaccaagattgcattgcgctatgtagctttggttcaggagaagaaaaagcaaaattcttttgttgctgaggctatgttgctcatggctactatcctgcatttgggaaaatcctctcttcctaagaagccaattactgatgatgatgtggatcgaatttccctgtgcctcaaggtcttgtctgaatgttcacctttaatgaatgacattttcaataaggaatgcagacagtccctttctcacatgttatctgctaaactagaagaagagaaattatcccaaaagaaagaatctgaaaagaggaatgtgacagtacagcctgatgaccccatttccttcatgcaactaactgctaagaatgaaatgaactgcaaggaagatcagtttcagctgagtttactggcagcaatgggtaacacacagaggaaagaggcagcagatcccctagcatctaaacttaacaaggtcacccaattgacaggtttctcagatcctgtatatgcagaagcttacgttcatgtcaaccaatatgatattgtcctggatgtacttgttgtgaaccaaaccagtgatactttgcagaattgcacattagaactagctacactaggggatctgaaacttgtggaaaagccgtctcctttgactcttgctcctcatgacttcgcaaatattaaagctaacgtcaaagtagcatcaacagaaaatggaataatttttggtaatatagtttatgatgtctctggagcagcaagtgacagaaattgtgtggttctcagtgatattcacatcgacatcatggactatatccagcctgcaacttgcactgatgcagaattccgtcagatgtgggccgaatttgaatgggaaaacaaagtgacagttaacaccaacatggttgatttaaatgactacttacagcacatattaaagtcaaccaatatgaaatgcctgactccagaaaaggccctttctggttactgtggctttatggcagccaacctttatgctcgttccatatttggtgaagatgcacttgcaaatgtcagcattgagaagccaattcaccagggaccagatgctgctgttaccggccatataagaattcgtgcaaagagccagggaatggccttaagtcttggagataaaatcaacttgtcacagaagaaaactagtatataaaaataaacaaaaagtccttgaagctttacagttaatttaggtatgggcttactggactccaacatcttttgtactctttcatgcttatatagaatctgagttcatgctgaatacttttcagccaataatttatagcctttcccttaaatcaagattgagtttaaaattatagtttgtcttttgtcttaacagttctgaatgctgtcctcaaagtatataatgtttcatgtaccaagacccttttcacagtacaataaacagatctattcataaatttttgttattttataaataaatgattacataattttagttatatggcaatggatttcttttagttgggttataaatttctattataaatttaaattactgagttgtgaatatatgcagctttattaagagaatttacaaattcaatgatataaaataaggtaggccttgattcacttggttgttttttacttatttaatattccaacattgctatctctaaaaatgcattatcatgttttgaagggatttgctcttgaatttagctccagggagaaagtatcaaaataacttttttttttttttttgagatggagtctggctctgtcacccaggctggagtgcagtggcgtgatcttggctcactgcaagctccacctcccgggtttacaccattctcctgcctcagcctcccaagtagctgggactacaggtgcccgccaccacgcctggctaattttttgtatttttagtagagacgggctttcaccatgttggccaggatggtctcgatctcctgacctcgtgatccgcccgcctcagcctcccggagtgttgggattacaggcatgagccaccgcacccggcccaaaataacttgagaaaacagatcgctctgcagtttaaagaagtattatgtacccgaactgaaatagatatactgttcttaattatcctgaatcataatgaagagtagataatccaaaatagattttttaatcattcacatttagtttggggtgttctatgtttgttaggaataaaactggttctaaccaattactgaagctggtactgggaggattcaactagagaggattcaaaaagctgcctttttctctgttgcctccgtgccttactcacatttagtttagggtgttctatgtttgttaggaataaaactggttctaaccaattactgaagctggtactgggaggattcaactagagaggattcaaaaagctgcctttttctctgttgcctctgtgccttactcactcgtctccttttcctcacttcacactaggactgggtaccatcacactgcagtataattccaaatgcatttccaagctaagtttcccagcgtctgattgtgctttccttttggcctttactttcattgggggtgattgaggtagtctgattttttagctaagtctaaacttaaggctattatttgtctaccagctagggttcaggctgcattccctgtgagtccttagataaggtctgtgaaagactgaaagcatctcctatttcattaagaatgaaatgatttgtttggagtataaggagattgataccttgtatgatgtcataaactgtgaagccacttgcttttaaaaaaaaaaaaa

SEQ ID NO: 343372 - DNA, 4363 bp, Homo sapiens
acgtcagccaaggactctggagccgccgccgccgctgctgcggttcatatccggagtagacggagccgcagtagacggatccgcggctgcaccaaaccactgcccctcggagcctggtagtgggccacaagcccccagtcccagaggcgtgattttctggcatccttaaatcttgtgtcaaggattggttataatataaccagaaaccatgacggcggctgagaacgtatgctacacgttaattaacgtgccaatggattcagaaccaccatctgaaattagcttaaaaaatgatctagaaaaaggagatgtaaagtcaaagactgaagctttgaagaaagtaatcattatgattctgaatggtgaaaaacttcctggacttctgatgaccatcattcgttttgtgctacctcttcaggatcacactatcaagaaattacttctggtattttgggaaattgttcctaaaacaactccagatgggagacttttacatgagatgatccttgtatgtgatgcatacagaaaggatcttcaacatcctaatgaatttattcgaggatctactcttcgttttctttgcaaattgaaagaagcagaattgctagaacctttaatgccagctattcgtgcatgtttggagcatcgacacagctatgttagaagaaatgctgttttggccatctataccatctatagaaattttgaacatcttatacctgatgctcctgaactgatacatgattttctggtgaatgagaaggatgcaagttgcaaaaggaatgcatttatgatgctaattcatgcagatcaggatcgagctttggattacttaagtacttgcattgatcaagttcaaacatttggagacattctgcagctggttattgttgaactgatttataaggtctgtcatgctaatccatcagaaagagctcgttttattcgctgcatctataacttattacagtcatccagccctgctgtaaaatatgaagctgctgggacattagtgacactctctagtgcaccaactgcaatcaaggctgctgctcagtgttacattgatttaattattaaggagagcgacaacaatgtaaaactcatagttttggatcgcttgatagaattaaaagagcatcctgctcatgaacgagtactacaggatctggttatggatatcctaagagtattgagcacaccagacttagaagtacgaaagaaaactctgcagttagcactggatcttgtctcttctagaaatgttgaagagctggttattgtcctgaagaaggaagtgataaaaacaaataatgtgtctgagcatgaagatactgacaaatacagacaactcctagtgcgaacattgcattcctgttctgtccgatttccagatatggctgcaaatgttattcctgtgttaatggaatttctcagtgacaacaacgaagcagcagctgctgatgtcttggagtttgttcgtgaagccattcagcgctttgataacctgagaatgcttattgttgagaagatgcttgaagtctttcatgctattaaatctgtcaagatttaccgaggagcattatggatcctgggagaatactgtagtaccaaggaagacattcagagtgtgatgactgagatccgcaggtcccttggagagatcccaattgtagagtcagaaataaagaaagaagctggtgaattaaaacctgaagaagaaataactgtagggccagttcagaaattggttactgaaatgggtacctatgcaactcagagtgcccttagcagttctagacccaccaagaaagaggaagacagacctcccttgagaggattccttctggatggagatttctttgttgctgcctcccttgccacaactatgcaactaactgctaagaatgaaatgaactgcaaggaagatcagtttcagctgagtttactggcagcaatgggtaacacacagaggaaagaggcagcagatcccctagcatctaaacttaacaaggtcacccaattgacaggtttctcagatcctgtatatgcagaagcttacgttcatgtcaaccaatatgatattgtcctggatgtacttgttgtgaaccaaaccagtgatactttgcagaattgcacattagaactagctacactaggggatctgaaacttgtggaaaagccgtctcctttgactcttgctcctcatgacttcgcaaatattaaagctaacgtcaaagtagcatcaacagaaaatggaataatttttggtaatatagtttatgatgtctctggagcagcaagtgacagaaattgtgtggttctcagtgatattcacatcgacatcatggactatatccagcctgcaacttgcactgatgcagaattccgtcagatgtgggccgaatttgaatgggaaaacaaagtgacagttaacaccaacatggttgatttaaatgactacttacagcacatattaaagtcaaccaatatgaaatgcctgactccagaaaaggccctttctggttactgtggctttatggcagccaacctttatgctcgttccatatttggtgaagatgcacttgcaaatgtcagcattgagaagccaattcaccagggaccagatgctgctgttaccggccatataagaattcgtgcaaagagccagggaatggccttaagtcttggagataaaatcaacttgtcacagaagaaaactagtatataaaaataaacaaaaagtccttgaagctttacagttaatttaggtatgggcttactggactccaacatcttttgtactctttcatgcttatatagaatctgagttcatgctgaatacttttcagccaataatttatagcctttcccttaaatcaagattgagtttaaaattatagtttgtcttttgtcttaacagttctgaatgctgtcctcaaagtatataatgtttcatgtaccaagacccttttcacagtacaataaacagatctattcataaatttttgttattttataaataaatgattacataattttagttatatggcaatggatttcttttagttgggttataaatttctattataaatttaaattactgagttgtgaatatatgcagctttattaagagaatttacaaattcaatgatataaaataaggtaggccttgattcacttggttgttttttacttatttaatattccaacattgctatctctaaaaatgcattatcatgttttgaagggatttgctcttgaatttagctccagggagaaagtatcaaaataacttttttttttttttttgagatggagtctggctctgtcacccaggctggagtgcagtggcgtgatcttggctcactgcaagctccacctcccgggtttacaccattctcctgcctcagcctcccaagtagctgggactacaggtgcccgccaccacgcctggctaattttttgtatttttagtagagacgggctttcaccatgttggccaggatggtctcgatctcctgacctcgtgatccgcccgcctcagcctcccggagtgttgggattacaggcatgagccaccgcacccggcccaaaataacttgagaaaacagatcgctctgcagtttaaagaagtattatgtacccgaactgaaatagatatactgttcttaattatcctgaatcataatgaagagtagataatccaaaatagattttttaatcattcacatttagtttggggtgttctatgtttgttaggaataaaactggttctaaccaattactgaagctggtactgggaggattcaactagagaggattcaaaaagctgcctttttctctgttgcctccgtgccttactcacatttagtttagggtgttctatgtttgttaggaataaaactggttctaaccaattactgaagctggtactgggaggattcaactagagaggattcaaaaagctgcctttttctctgttgcctctgtgccttactcactcgtctccttttcctcacttcacactaggactgggtaccatcacactgcagtataattccaaatgcatttccaagctaagtttcccagcgtctgattgtgctttccttttggcctttactttcattgggggtgattgaggtagtctgattttttagctaagtctaaacttaaggctattatttgtctaccagctagggttcaggctgcattccctgtgagtccttagataaggtctgtgaaagactgaaagcatctcctatttcattaagaatgaaatgatttgtttggagtataaggagattgataccttgtatgatgtcataaactgtgaagccacttgcttttaaaaaaaaaaaaa

SEQ ID NO: 343373 - DNA, 3345 bp, Homo sapiens
  misc_feature (3327)..(3327): n is a, c, g, or t
  misc_feature (3333)..(3333): n is a, c, g, or t
acgtcagccaaggactctggagccgccgccgccgctgctgcggttcatatccggagtagacggagccgcagtagacggatccgcggctgcaccaaaccactgcccctcggagcctggtagtgggccacaagcccccagtcccagaggcgtgattttctggcatccttaaatcttgtgtcaaggattggttataatataaccagaaaccatgacggcggctgagaacgtatgctacacgttaattaacgtgccaatggattcagaaccaccatctgaaattagcttaaaaaatgatctagaaaaaggagatgtaaagtcaaagactgaagctttgaagaaagtaatcattatgattctgaatggtgaaaaacttcctggacttctgatgaccatcattcgttttgtgctacctcttcaggatcacactatcaagaaattacttctggtattttgggaaattgttcctaaaacaactccagatgggagacttttacatgagatgatccttgtatgtgatgcatacagaaaggatcttcaacatcctaatgaatttattcgaggatctactcttcgttttctttgcaaattgaaagaagcagaattgctagaacctttaatgccagctattcgtgcatgtttggagcatcgacacagctatgttagaagaaatgctgttttggccatctataccatctatagaaattttgaacatcttatacctgatgctcctgaactgatacatgattttctggtgaatgagaaggatgcaagttgcaaaaggaatgcatttatgatgctaattcatgcagatcaggatcgagctttggattacttaagtacttgcattgatcaagttcaaacatttggagacattctgcagctggttattgttgaactgatttataaggtctgtcatgctaatccatcagaaagagctcgttttattcgctgcatctataacttattacagtcatccagccctgctgtaaaatatgaagctgctgggacattagtgacactctctagtgcaccaactgcaatcaaggctgctgctcagtgttacattgatttaattattaaggagagcgacaacaatgtaaaactcatagttttggatcgcttgatagaattaaaagagcatcctgctcatgaacgagtactacaggatctggttatggatatcctaagagtattgagcacaccagacttagaagtacgaaagaaaactctgcagttagcactggatcttgtctcttctagaaatgttgaagagctggttattgtcctgaagaaggaagtgataaaaacaaataatgtgtctgagcatgaagatactgacaaatacagacaactcctagtgcgaacattgcattcctgttctgtccgatttccagatatggctgcaaatgttattcctgtgttaatggaatttctcagtgacaacaacgaagcagcagctgctgatgtcttggagtttgttcgtgaagccattcagcgctttgataacctgagaatgcttattgttgagaagatgcttgaagtctttcatgctattaaatctgtcaagatttaccgaggagcattatggatcctgggagaatactgtagtaccaaggaagacattcagagtgtgatgactgagatccgcaggtcccttggagagatcccaattgtagagtcagaaataaagaaagaagctggtgaattaaaacctgaagaagaaataactgtagggccagttcagaaattggttactgaaatgggtacctatgcaactcagagtgcccttagcagttctagacccaccaagaaagaggaagacagacctcccttgagaggattccttctggatggagatttctttgttgctgcctcccttgccacaactctgaccaagattgcattgcgctatgtagctttggttcaggagaagaaaaagcaaaattcttttgttgctgaggctatgttgctcatggctactatcctgcatttgggaaaatcctctcttcctaagaagccaattactgatgatgatgtggatcgaatttccctgtgcctcaaggtcttgtctgaatgttcacctttaatgaatgacattttcaataaggaatgcagacagtccctttctcacatgttatctgctaaactagaagaagagaaattatcccaaaagaaagaatctgaaaagaggaatgtgacagtacagcctgatgaccccatttccttcatgcaactaactgctaagaatgaaatgaactgcaaggaagatcagtttcagctgagtttactggcagcaatgggtaacacacagaggaaagaggcagcagatcccctagcatctaaacttaacaaggtcacccaattgacaggtttctcagatcctgtatatgcagaagcttacgttcatgtcaaccaatatgatattgtcctggatgtacttgttgtgaaccaaaccagtgatactttgcagaattgcacattagaactagctacactaggggatctgaaacttgtggaaaagccgtctcctttgactcttgctcctcatgacttcgcaaatattaaagctaacgtcaaagtagcatcaacagaaaatggaataatttttggtaatatagtttatgatgtctctggagcagcaagtgacagaaattgtgtggttctcagtgatattcacatcgacatcatggactatatccagcctgcaacttgcactgatgcagaattccgtcagatgtgggccgaatttgaatgggaaaacaaagtgacagttaacaccaacatggttgatttaaatgactacttacagcacatattaaagtcaaccaatatgaaatgcctgactccagaaaaggccctttctggttactgtggctttatggcagccaacctttatgctcgttccatatttggtgaagatgcacttgcaaatgtcagcattgagaagccaattcaccagggaccagatgctgctgttaccggccatataagaattcgtgcaaagagccagggaatggccttaagtcttggagataaaatcaacttgtcacagaagaaaactagtatataaaaataaacaaaaagtccttgaagctttacagttaatttaggtatgggcttactggactccaacatcttttgtactctttcatgcttatatagaatctgagttcatgctgaatacttttcagccaataatttatagcctttcccttaaatcaagattgagtttaaaattatagtttgtcttttgtcttaacagttctgaatgctgtcctcaaagtatataatgtttcatgtaccaagacccttttcacagtaacagcnaccttnccgtccggcccc

SEQ ID NO: 343374 - DNA, 2021 bp, Homo sapiens
  misc_feature (17)..(17): n is a, c, g, or t
  misc_feature (27)..(27): n is a, c, g, or t
aaggacggtagaggatnccccacggcnggtgtactgatgcagaattccgtcagatgtgggccgaatttgaatgggaaaacaaagtgacagttaacaccaacatggttgatttaaatgactacttacagcacatattaaagtcaaccaatatgaaatgcctgactccagaaaaggccctttctggttactgtggctttatggcagccaacctttatgctcgttccatatttggtgaagatgcacttgcaaatgtcagcattgagaagccaattcaccagggaccagatgctgctgttaccggccatataagaattcgtgcaaagagccagggaatggccttaagtcttggagataaaatcaacttgtcacagaagaaaactagtatataaaaataaacaaaaagtccttgaagctttacagttaatttaggtatgggcttactggactccaacatcttttgtactctttcatgcttatatagaatctgagttcatgctgaatacttttcagccaataatttatagcctttcccttaaatcaagattgagtttaaaattatagtttgtcttttgtcttaacagttctgaatgctgtcctcaaagtatataatgtttcatgtaccaagacccttttcacagtacaataaacagatctattcataaatttttgttattttataaataaatgattacataattttagttatatggcaatggatttcttttagttgggttataaatttctattataaatttaaattactgagttgtgaatatatgcagctttattaagagaatttacaaattcaatgatataaaataaggtaggccttgattcacttggttgttttttacttatttaatattccaacattgctatctctaaaaatgcattatcatgttttgaagggatttgctcttgaatttagctccagggagaaagtatcaaaataacttttttttttttttttgagatggagtctggctctgtcacccaggctggagtgcagtggcgtgatcttggctcactgcaagctccacctcccgggtttacaccattctcctgcctcagcctcccaagtagctgggactacaggtgcccgccaccacgcctggctaattttttgtatttttagtagagacgggctttcaccatgttggccaggatggtctcgatctcctgacctcgtgatccgcccgcctcagcctcccggagtgttgggattacaggcatgagccaccgcacccggcccaaaataacttgagaaaacagatcgctctgcagtttaaagaagtattatgtacccgaactgaaatagatatactgttcttaattatcctgaatcataatgaagagtagataatccaaaatagattttttaatcattcacatttagtttggggtgttctatgtttgttaggaataaaactggttctaaccaattactgaagctggtactgggaggattcaactagagaggattcaaaaagctgcctttttctctgttgcctccgtgccttactcacatttagtttagggtgttctatgtttgttaggaataaaactggttctaaccaattactgaagctggtactgggaggattcaactagagaggattcaaaaagctgcctttttctctgttgcctctgtgccttactcactcgtctccttttcctcacttcacactaggactgggtaccatcacactgcagtataattccaaatgcatttccaagctaagtttcccagcgtctgattgtgctttccttttggcctttactttcattgggggtgattgaggtagtctgattttttagctaagtctaaacttaaggctattatttgtctaccagctagggttcaggctgcattccctgtgagtccttagataaggtctgtgaaagactgaaagcatctcctatttcattaagaatgaaatgatttgtttggagtataaggagattgataccttgtatgatgtcataaactgtgaagccacttgcttttaaaaaaaaaaaaa

SEQ ID NO: 343375 - DNA, 2049 bp, Homo sapiens
caaacaaaaagtcaaaaatttgtggttcccatgtatttccactcgattcgtgcataacccgcctccatctgccaaacaaaaatccgaccattggggccattttaaatggaacacaaggtccctttacccccaacgtggttgattaagtgtctcctcacggcacatttaaggtcaccatatataaaagcctgtctcaaaaaagccctttctggttactgtggctttatggcagccaacctttatgctcgttccatatttggtgaagatgcacttgcaaatgtcagcattgagaagccaattcaccagggaccagatgctgctgttaccggccatataagaattcgtgcaaagagccagggaatggccttaagtcttggagataaaatcaacttgtcacagaagaaaactagtatataaaaataaacaaaaagtccttgaagctttacagttaatttaggtatgggcttactggactccaacatcttttgtactctttcatgcttatatagaatctgagttcatgctgaatacttttcagccaataatttatagcctttcccttaaatcaagattgagtttaaaattatagtttgtcttttgtcttaacagttctgaatgctgtcctcaaagtatataatgtttcatgtaccaagacccttttcacagtacaataaacagatctattcataaatttttgttattttataaataaatgattacataattttagttatatggcaatggatttcttttagttgggttataaatttctattataaatttaaattactgagttgtgaatatatgcagctttattaagagaatttacaaattcaatgatataaaataaggtaggccttgattcacttggttgttttttacttatttaatattccaacattgctatctctaaaaatgcattatcatgttttgaagggatttgctcttgaatttagctccagggagaaagtatcaaaataacttttttttttttttttgagatggagtctggctctgtcacccaggctggagtgcagtggcgtgatcttggctcactgcaagctccacctcccgggtttacaccattctcctgcctcagcctcccaagtagctgggactacaggtgcccgccaccacgcctggctaattttttgtatttttagtagagacgggctttcaccatgttggccaggatggtctcgatctcctgacctcgtgatccgcccgcctcagcctcccggagtgttgggattacaggcatgagccaccgcacccggcccaaaataacttgagaaaacagatcgctctgcagtttaaagaagtattatgtacccgaactgaaatagatatactgttcttaattatcctgaatcataatgaagagtagataatccaaaatagattttttaatcattcacatttagtttggggtgttctatgtttgttaggaataaaactggttctaaccaattactgaagctggtactgggaggattcaactagagaggattcaaaaagctgcctttttctctgttgcctccgtgccttactcacatttagtttagggtgttctatgtttgttaggaataaaactggttctaaccaattactgaagctggtactgggaggattcaactagagaggattcaaaaagctgcctttttctctgttgcctctgtgccttactcactcgtctccttttcctcacttcacactaggactgggtaccatcacactgcagtataattccaaatgcatttccaagctaagtttcccagcgtctgattgtgctttccttttggcctttactttcattgggggtgattgaggtagtctgattttttagctaagtctaaacttaaggctattatttgtctaccagctagggttcaggctgcattccctgtgagtccttagataaggtctgtgaaagactgaaagcatctcctatttcattaagaatgaaatgatttgtttggagtataaggagattgataccttgtatgatgtcataaactgtgaagccacttgcttttaaaaaaaaaaaaa

SEQ ID NO: 343376 - DNA, 7701 bp, Homo sapiens
  misc_feature (3489)..(3489): n is a, c, g, or t
atcgaggtccgcgggaggctcggagcgcgccaggcggacactcctctcggctcctccccggcagcggcggcggctcggagcgggctccggggctcgggtgcagcggccagcgggcgcctggcggcgaggattacccggggaagtggttgtctcctggctggagccgcgagacgggcgctcagggcgcggggccggcggcggcgaacgagaggacggactctggcggccgggtcgttggccgcggggagcgcgggcaccgggcgagcaggccgcgtcgcgctcaccatggtcagctactgggacaccggggtcctgctgtgcgcgctgctcagctgtctgcttctcacaggatctagttcaggttcaaaattaaaagatcctgaactgagtttaaaaggcacccagcacatcatgcaagcaggccagacactgcatctccaatgcaggggggaagcagcccataaatggtctttgcctgaaatggtgagtaaggaaagcgaaaggctgagcataactaaatctgcctgtggaagaaatggcaaacaattctgcagtactttaaccttgaacacagctcaagcaaaccacactggcttctacagctgcaaatatctagctgtacctacttcaaagaagaaggaaacagaatctgcaatctatatatttattagtgatacaggtagacctttcgtagagatgtacagtgaaatccccgaaattatacacatgactgaaggaagggagctcgtcattccctgccgggttacgtcacctaacatcactgttactttaaaaaagtttccacttgacactttgatccctgatggaaaacgcataatctgggacagtagaaagggcttcatcatatcaaatgcaacgtacaaagaaatagggcttctgacctgtgaagcaacagtcaatgggcatttgtataagacaaactatctcacacatcgacaaaccaatacaatcatagatgtccaaataagcacaccacgcccagtcaaattacttagaggccatactcttgtcctcaattgtactgctaccactcccttgaacacgagagttcaaatgacctggagttaccctgatgaaaaaaataagagagcttccgtaaggcgacgaattgaccaaagcaattcccatgccaacatattctacagtgttcttactattgacaaaatgcagaacaaagacaaaggactttatacttgtcgtgtaaggagtggaccatcattcaaatctgttaacacctcagtgcatatatatgataaagcattcatcactgtgaaacatcgaaaacagcaggtgcttgaaaccgtagctggcaagcggtcttaccggctctctatgaaagtgaaggcatttccctcgccggaagttgtatggttaaaagatgggttacctgcgactgagaaatctgctcgctatttgactcgtggctactcgttaattatcaaggacgtaactgaagaggatgcagggaattatacaatcttgctgagcataaaacagtcaaatgtgtttaaaaacctcactgccactctaattgtcaatgtgaaaccccagatttacgaaaaggccgtgtcatcgtttccagacccggctctctacccactgggcagcagacaaatcctgacttgtaccgcatatggtatccctcaacctacaatcaagtggttctggcacccctgtaaccataatcattccgaagcaaggtgtgacttttgttccaataatgaagagtcctttatcctggatgctgacagcaacatgggaaacagaattgagagcatcactcagcgcatggcaataatagaaggaaagaataagatggctagcaccttggttgtggctgactctagaatttctggaatctacatttgcatagcttccaataaagttgggactgtgggaagaaacataagcttttatatcacagatgtgccaaatgggtttcatgttaacttggaaaaaatgccgacggaaggagaggacctgaaactgtcttgcacagttaacaagttcttatacagagacgttacttggattttactgcggacagttaataacagaacaatgcactacagtattagcaagcaaaaaatggccatcactaaggagcactccatcactcttaatcttaccatcatgaatgtttccctgcaagattcaggcacctatgcctgcagagccaggaatgtatacacaggggaagaaatcctccagaagaaagaaattacaatcagagatcaggaagcaccatacctcctgcgaaacctcagtgatcacacagtggccatcagcagttccaccactttagactgtcatgctaatggtgtccccgagcctcagatcacttggtttaaaaacaaccacaaaatacaacaagagcctggaattattttaggaccaggaagcagcacgctgtttattgaaagagtcacagaagaggatgaaggtgtctatcactgcaaagccaccaaccagaagggctctgtggaaagttcagcatacctcactgttcaaggaacctcggacaagtctaatctggagctgatcactctaacatgcacctgtgtggctgcgactctcttctggctcctattaaccctctttatccgaaaaatgaaaaggtcttcttctgaaataaagactgactacctatcaattataatggacccagatgaagttcctttggatgagcagtgtgagcggctcccttatgatgccagcaagtgggagtttgcccgggagagacttaaactgggcaaatcacttggaagaggggcttttggaaaagtggttcaagcatcagcatttggcattaagaaatcacctacgtgccggactgtggctgtgaaaatgctgaaagagggggccacggccagcgagtacaaagctctgatgactgagctaaaaatcttgacccacattggccaccatctgaacgtggttaacctgctgggagcctgcaccaagcaaggagggcctctgatggtgattgttgaatactgcaaatatggaaatctctccaactacctcaagagcaaacgtgacttattttttctcaacaaggatgcagcactacacatggagcctaagaaagaaaaaatggagccaggcctggaacaaggcaagaaaccaagactagatagcgtcaccagcagcgaaagctttgcgagctccggctttcaggaagataaaagtctgagtgatgttgaggaagaggaggattctgacggtttctacaaggagcccatcactatggaagatctgatttcttacagttttcaagtggccagaggcatggagttcctgtcttccagaaagtgcattcatcgggacctggcagcgagaaacattcttttatctgagaacaacgtggtgaagatttgtgattttggccttgcccgggatatttataagaaccccgattatgtgagaaaaggagatactcgacttcctctgaaatggatggctccngaatctatctttgacaaaatctacagcaccaagagcgacgtgtggtcttacggagtattgctgtgggaaatcttctccttaggtgggtctccatacccaggagtacaaatggatgaggacttttgcagtcgcctgagggaaggcatgaggatgagagctcctgagtactctactcctgaaatctatcagatcatgctggactgctggcacagagacccaaaagaaaggccaagatttgcagaacttgtggaaaaactaggtgatttgcttcaagcaaatgtacaacaggatggtaaagactacatcccaatcaatgccatactgacaggaaatagtgggtttacatactcaactcctgccttctctgaggacttcttcaaggaaagtatttcagctccgaagtttaattcaggaagctctgatgatgtcagatatgtaaatgctttcaagttcatgagcctggaaagaatcaaaacctttgaagaacttttaccgaatgccacctccatgtttgatgactaccagggcgacagcagcactctgttggcctctcccatgctgaagcgcttcacctggactgacagcaaacccaaggcctcgctcaagattgacttgagagtaaccagtaaaagtaaggagtcggggctgtctgatgtcagcaggcccagtttctgccattccagctgtgggcacgtcagcgaaggcaagcgcaggttcacctacgaccacgctgagctggaaaggaaaatcgcgtgctgctccccgcccccagactacaactcggtggtcctgtactccaccccacccatctagagtttgacacgaagccttatttctagaagcacatgtgtatttatacccccaggaaactagcttttgccagtattatgcatatataagtttacacctttatctttccatgggagccagctgctttttgtgatttttttaatagtgctttttttttttgactaacaagaatgtaactccagatagagaaatagtgacaagtgaagaacactactgctaaatcctcatgttactcagtgttagagaaatccttcctaaacccaatgacttccctgctccaacccccgccacctcagggcacgcaggaccagtttgattgaggagctgcactgatcacccaatgcatcacgtaccccactgggccagccctgcagcccaaaacccagggcaacaagcccgttagccccagggatcactggctggcctgagcaacatctcgggagtcctctagcaggcctaagacatgtgaggaggaaaaggaaaaaaagcaaaaagcaagggagaaaagagaaaccgggagaaggcatgagaaagaatttgagacgcaccatgtgggcacggagggggacggggctcagcaatgccatttcagtggcttcccagctctgacccttctacatttgagggcccagccaggagcagatggacagcgatgaggggacattttctggattctgggaggcaagaaaaggacaaatatcttttttggaactaaagcaaattttagaactttacctatggaagtggttctatgtccattctcattcgtggcatgttttgatttgtagcactgagggtggcactcaactctgagcccatacttttggctcctctagtaagatgcactgaaaacttagccagagttaggttgtctccaggccatgatggccttacactgaaaatgtcacattctattttgggtattaatatatagtccagacacttaactcaatttcttggtattattctgttttgcacagttagttgtgaaagaaagctgagaagaatgaaaatgcagtcctgaggagaggagttttctccatatcaaaacgagggctgatggaggaaaaaggtcaataaggtcaagggaaaaccccgtctctataccaaccaaaccaattcaccaacacagttgggacccaaaacacaggaagtcagtcacgtttccttttcatttaatggggattccactatctcacactaatctgaaaggatgtggaagagcattagctggcgcatattaagcactttaagctccttgagtaaaaaggtggtatgtaatttatgcaaggtatttctccagttgggactcaggatattagttaatgagccatcactagaagaaaagcccattttcaactgctttgaaacttgcctggggtctgagcatgatgggaatagggagacagggtaggaaagggcgcctactcttcagggtctaaagatcaagtgggccttggatcgctaagctggctctgtttgatgctatttatgcaagttagggtctatgtatttaggatgcgcctactcttcagggtctaaagatcaagtgggccttggatcgctaagctggctctgtttgatgctatttatgcaagttagggtctatgtatttaggatgtctgcaccttctgcagccagtcagaagctggagaggcaacagtggattgctgcttcttggggagaagagtatgcttccttttatccatgtaatttaactgtagaacctgagctctaagtaaccgaagaatgtatgcctctgttcttatgtgccacatccttgtttaaaggctctctgtatgaagagatgggaccgtcatcagcacattccctagtgagcctactggctcctggcagcggcttttgtggaagactcactagccagaagagaggagtgggacagtcctctccaccaagatctaaatccaaacaaaagcaggctagagccagaagagaggacaaatctttgttcttcctcttctttacatacgcaaaccacctgtgacagctggcaattttataaatcaggtaactggaaggaggttaaacacagaaaaaagaagacctcagtcaattctctactttttttttttttttccaaatcagataatagcccagcaaatagtgataacaaataaaaccttagctattcatgtcttgatttcaataattaattcttaatcattaagagaccataataaatactccttttcaagagaaaagcaaaaccattagaattgttactcagctccttcaaactcaggtttgtagcatacatgagtccatccatcagtcaaagaatggttccatctggagtcttaatgtagaaagaaaaatggagacttgtaataatgagctagttacaaagtgcttgttcattaaaatagcactgaaaattgaaacatgaattaactgataatattccaatcatttgccatttatgacaaaaatggttggcactaacaaagaacgagcacttcctttcagagtttctgagataatgtacgtggaacagtctgggtggaatggggctgaaaccatgtgcaagtctgtgtcttgtcagtccaagaagtgacaccgagatgttaattttagggacccgtgccttgtttcctagcccacaagaatgcaaacatcaaacagatactcgctagcctcatttaaattgattaaaggaggagtgcatctttggccgacagtggtgtaactgtatgtgtgtgtgtgtgtgtgtgtgtgtgtgtgggtgtatgtgtgttttgtgcataactatttaaggaaactggaattttaaagttacttttatacaaaccaagaatatatgctacagatataagacagacatggtttggtcctatatttctagtcatgatgaatgtattttgtataccatcttcatataataaacttaaaaatatttcttaattgggatttgtaatcgtaccaacttaattgataaacttggcaactgcttttatgttctgtctccttccataaatttttcaaaatactaattcaacaaagaaaaagctcttttttttcctaaaataaactcaaatttatccttgtttagagcagagaaaaattaagaaaaactttgaaatggtctcaaaaaattgctaaatattttcaatggaaaactaaatgttagtttagctgattgtatggggttttcgaacctttcactttttgtttgttttacctatttcacaactgtgtaaattgccaataattcctgtccatgaaaatgcaaattatccagtgtagatatatttgaccatcaccctatggatattggctagttttgcctttattaagcaaattcatttcagcctgaatgtctgcctatatattctctgctctttgtattctcctttgaacccgttaaaacatcctgtggcactc

SEQ ID NO: 343377 - DNA, 1090 bp, Homo sapiens
atcgaggtccgcgggaggctcggagcgcgccaggcggacactcctctcggctcctccccggcagcggcggcggctcggagcgggctccggggctcgggtgcagcggccagcgggcgcctggcggcgaggattacccggggaagtggttgtctcctggctggagccgcgagacgggcgctcagggcgcggggccggcggcggcgaacgagaggacggactctggcggccgggtcgttggccgcggggagcgcgggcaccgggcgagcaggccgcgtcgcgctcaccatggtcagctactgggacaccggggtcctgctgtgcgcgctgctcagctgtctgcttctcacaggatctagttcaggttcaaaattaaaagatcctgaactgagtttaaaaggcacccagcacatcatgcaagcaggccagacactgcatctccaatgcaggggggaagcagcccataaatggtctttgcctgaaatggtgagtaaggaaagcgaaaggctgagcataactaaatctgcctgtggaagaaatggcaaacaattctgcagtactttaaccttgaacacagctcaagcaaaccacactggcttctacagctgcaaatatctagctgtacctacttcaaagaagaaggaaacagaatctgcaatctatatatttattagtggtaagacttccattttctacattctgtttgcttttgctttgcaaatgagtcataaatctaccctgatccattggaaaggttgctttcctagtgagtatgaaagaaacgggttaggaaagagattccatcctagttgtagacactttcgtggatgtcaattttaaccagaattgtcaaggcccagttagtcactatgtgctccacaaagagagagactggtctgtataggtcacctctgtacccacagctcctagcacagtatgtggcccatagttggatgaataagtgaataaaaggattttagttctatttcttagttattgagaagcccaaaatagaatacatgatttttgtcatttaacacagctgcattctcttatatgttggaactgtaaaatactgttgtttctactaaat

SEQ ID NO: 343378 - DNA, 1792 bp, Homo sapiens
atcgaggtccgcgggaggctcggagcgcgccaggcggacactcctctcggctcctccccggcagcggcggcggctcggagcgggctccggggctcgggtgcagcggccagcgggcgcctggcggcgaggattacccggggaagtggttgtctcctggctggagccgcgagacgggcgctcagggcgcggggccggcggcggcgaacgagaggacggactctggcggccgggtcgttggccgcggggagcgcgggcaccgggcgagcaggccgcgtcgcgctcaccatggtcagctactgggacaccggggtcctgctgtgcgcgctgctcagctgtctgcttctcacaggtgaggcgcggctgggggccggggcctgaggcgggctgcgatggggcggccggagggcagagcctccgaggccagggcggggtgcacgcggggagacgaggctgtagcccggagaagctggctacggcgagaacctgggacactagttgcagcgggcacgcttggggccgctgcgccctttctccgagggagcgcctcgaggagtggctggcctggacccgcgagcatcagcgctcagaccgggtccgcgctggggctgtccgtttgcgacaggatcgctgatcccttatccagctgtcgggttggggtctcactgccgaggccctgggcacttaggagcagcacgcaccgggacctgcctggcacccagagcccattcccagaggacctggggcaggtacgcagggtcccccggagccgggagcagagggtcctgaaaggcctgcccaggtggccgggggttggctgaggcccggggtcttttggtatttggtactggccgcgacctcgcgtcctcacggagagtgtaggaggggagccgatttggaggggactcgtgcctgcgggggagcaggaggatctcaggagagggccagcgccggcattcccatgacccgcttgagtccccaagccggactgtcccggggaacgcttcggcgagcgcccggctcctcccccgccgctctcggaccgcggggccccagtgcgctgcgctcagccacccgggtggggcctctgccgggagcaggcgtggtgcgcggtccagtccgtgtcgcggacatcagtgaccctgacccacaagggcagcccagggcccaaataccgttaacttactgacttacaagcctagcctttaaaatccgagcgaagagagggcgggcgattttgaccaaacgatgtggtttgaggaatcgatgaggtccgcccgccacctaagtcagccttcgctgggcgtttgggagacgggcggtggaacagtcaggggccgggggttttaccagcagttagaccgccgccattgaggggtcaaagccccgaggaacttgagggttcggactcgcagtctctgctcagtggggctgagtggcggagatttgtgcctcgttcccctgggcgcagagagccagatttcggagcgcctttcttttaagcatcgtggagaaaaggtaaaatatgaaataaaatatagtaatataaaataagtcattgcaatgattcccgggaagaaaagtcaataggatggagcgtagtacaacaacaacaacaacaaaaagcttgttaaacccaaaaagcagtaataattaaatattctttctcagtgggaagactaactagaccgtcagtttccaagtaacaagtaatagttccaattagattggagaaactactaaacccggagacagggcgaagtggtaacttctaagaacctcgctgtaggttggg

SEQ ID NO: 343379 - DNA, 973 bp, Homo sapiens
tgatcagctacacacaggaaccttgctcacagccccggaaactccacactgtgggcttcaccttctggaagtgacaaagtcatgtacgcaggaccttccccaccagtctccactgctgagcccataaagggaggtgtgaggacttggaaatgccacatgctttttaagaagccagctcaaaccaacctttgttacaactcgagaatgaaataagtactacaaactattcagccattgatatttatggctgtatgactttttttttttttaactttaaggacatcgtcctacttctgtaagtgtggggaggagtactccacttcacattgaactgcagtgagcggtggggtttcctttccgaattgctgtgtttcattcacagaactcagaccttccatctgcagaggccacaggcacaacaaagaacctgggtatccatgagctctggtgggttggttagtctgccttggtagacgtgttttccactgaccacaggacctggcccagacagccttttaagtgctggtgctataaacccaaacctaaaaatgaagcagggtcacatagtacagaaagcttgggctttatgcggatgatgacagccctccctttgtagtacgtaaggcaatgcataggatgatcactgctctccaactatttctgttgctgttttccccaccagctatcagatcatgctggactgctggcacagagacccaaaagaaaggccaagatttgcagaacttgtggaaaaactaggtgatttgcttcaagcaaatgtacaacaggatggtaaagactacatcccaatcaatgccatactgacaggaaatagtgggtttacatactcaactcctgccttctctgaggacttcttcaaggaaagtatttcagctccgaagtttaattcaggaagctctgatgatgtcaggtaagatttctttctcaaactttatatcacagaattttccaa

SEQ ID NO: 343380 - DNA, 296 bp, Homo sapiens
  misc_feature (170)..(170): n is a, c, g, or t
  misc_feature (230)..(230): n is a, c, g, or t
  misc_feature (234)..(234): n is a, c, g, or t
  misc_feature (244)..(244): n is a, c, g, or t
  misc_feature (248)..(248): n is a, c, g, or t
  misc_feature (265)..(265): n is a, c, g, or t
  misc_feature (279)..(279): n is a, c, g, or t
  misc_feature (293)..(293): n is a, c, g, or t
atcgaggtccgcgggaggctcggagcgcgccaggcggacactcctctcggctcctccccggcagcggcggcggctcggagcgggctccggggctcgggtgcagcggccagcgggcgcctggcggcgaggattacccggggaagtggttgtctcctttctttatcctctanactttctctcatttctcttttccttcttcttctaactatattacttactctttcttccgnttcnttgtccgcgnttancgcttgcacctttctancattcctcttctcnctcaccattttcancta

SEQ ID NO: 343381 - DNA, 6510 bp, Homo sapiens
  misc_feature (3489)..(3489): n is a, c, g, or t
atcgaggtccgcgggaggctcggagcgcgccaggcggacactcctctcggctcctccccggcagcggcggcggctcggagcgggctccggggctcgggtgcagcggccagcgggcgcctggcggcgaggattacccggggaagtggttgtctcctggctggagccgcgagacgggcgctcagggcgcggggccggcggcggcgaacgagaggacggactctggcggccgggtcgttggccgcggggagcgcgggcaccgggcgagcaggccgcgtcgcgctcaccatggtcagctactgggacaccggggtcctgctgtgcgcgctgctcagctgtctgcttctcacaggatctagttcaggttcaaaattaaaagatcctgaactgagtttaaaaggcacccagcacatcatgcaagcaggccagacactgcatctccaatgcaggggggaagcagcccataaatggtctttgcctgaaatggtgagtaaggaaagcgaaaggctgagcataactaaatctgcctgtggaagaaatggcaaacaattctgcagtactttaaccttgaacacagctcaagcaaaccacactggcttctacagctgcaaatatctagctgtacctacttcaaagaagaaggaaacagaatctgcaatctatatatttattagtgatacaggtagacctttcgtagagatgtacagtgaaatccccgaaattatacacatgactgaaggaagggagctcgtcattccctgccgggttacgtcacctaacatcactgttactttaaaaaagtttccacttgacactttgatccctgatggaaaacgcataatctgggacagtagaaagggcttcatcatatcaaatgcaacgtacaaagaaatagggcttctgacctgtgaagcaacagtcaatgggcatttgtataagacaaactatctcacacatcgacaaaccaatacaatcatagatgtccaaataagcacaccacgcccagtcaaattacttagaggccatactcttgtcctcaattgtactgctaccactcccttgaacacgagagttcaaatgacctggagttaccctgatgaaaaaaataagagagcttccgtaaggcgacgaattgaccaaagcaattcccatgccaacatattctacagtgttcttactattgacaaaatgcagaacaaagacaaaggactttatacttgtcgtgtaaggagtggaccatcattcaaatctgttaacacctcagtgcatatatatgataaagcattcatcactgtgaaacatcgaaaacagcaggtgcttgaaaccgtagctggcaagcggtcttaccggctctctatgaaagtgaaggcatttccctcgccggaagttgtatggttaaaagatgggttacctgcgactgagaaatctgctcgctatttgactcgtggctactcgttaattatcaaggacgtaactgaagaggatgcagggaattatacaatcttgctgagcataaaacagtcaaatgtgtttaaaaacctcactgccactctaattgtcaatgtgaaaccccagatttacgaaaaggccgtgtcatcgtttccagacccggctctctacccactgggcagcagacaaatcctgacttgtaccgcatatggtatccctcaacctacaatcaagtggttctggcacccctgtaaccataatcattccgaagcaaggtgtgacttttgttccaataatgaagagtcctttatcctggatgctgacagcaacatgggaaacagaattgagagcatcactcagcgcatggcaataatagaaggaaagaataagatggctagcaccttggttgtggctgactctagaatttctggaatctacatttgcatagcttccaataaagttgggactgtgggaagaaacataagcttttatatcacagatgtgccaaatgggtttcatgttaacttggaaaaaatgccgacggaaggagaggacctgaaactgtcttgcacagttaacaagttcttatacagagacgttacttggattttactgcggacagttaataacagaacaatgcactacagtattagcaagcaaaaaatggccatcactaaggagcactccatcactcttaatcttaccatcatgaatgtttccctgcaagattcaggcacctatgcctgcagagccaggaatgtatacacaggggaagaaatcctccagaagaaagaaattacaatcagagatcaggaagcaccatacctcctgcgaaacctcagtgatcacacagtggccatcagcagttccaccactttagactgtcatgctaatggtgtccccgagcctcagatcacttggtttaaaaacaaccacaaaatacaacaagagcctggaattattttaggaccaggaagcagcacgctgtttattgaaagagtcacagaagaggatgaaggtgtctatcactgcaaagccaccaaccagaagggctctgtggaaagttcagcatacctcactgttcaaggaacctcggacaagtctaatctggagctgatcactctaacatgcacctgtgtggctgcgactctcttctggctcctattaaccctctttatccgaaaaatgaaaaggtcttcttctgaaataaagactgactacctatcaattataatggacccagatgaagttcctttggatgagcagtgtgagcggctcccttatgatgccagcaagtgggagtttgcccgggagagacttaaactgggcaaatcacttggaagaggggcttttggaaaagtggttcaagcatcagcatttggcattaagaaatcacctacgtgccggactgtggctgtgaaaatgctgaaagagggggccacggccagcgagtacaaagctctgatgactgagctaaaaatcttgacccacattggccaccatctgaacgtggttaacctgctgggagcctgcaccaagcaaggagggcctctgatggtgattgttgaatactgcaaatatggaaatctctccaactacctcaagagcaaacgtgacttattttttctcaacaaggatgcagcactacacatggagcctaagaaagaaaaaatggagccaggcctggaacaaggcaagaaaccaagactagatagcgtcaccagcagcgaaagctttgcgagctccggctttcaggaagataaaagtctgagtgatgttgaggaagaggaggattctgacggtttctacaaggagcccatcactatggaagatctgatttcttacagttttcaagtggccagaggcatggagttcctgtcttccagaaagtgcattcatcgggacctggcagcgagaaacattcttttatctgagaacaacgtggtgaagatttgtgattttggccttgcccgggatatttataagaaccccgattatgtgagaaaaggagatactcgacttcctctgaaatggatggctccngaatctatctttgacaaaatctacagcaccaagagcgacgtgtggtcttacggagtattgctgtgggaaatcttctccttaggtgggtctccatacccaggagtacaaatggatgaggacttttgcagtcgcctgagggaaggcatgaggatgagagctcctgagtactctactcctgaaatctatcagatcatgctggactgctggcacagagacccaaaagaaaggccaagatttgcagaacttgtggaaaaactaggtgatttgcttcaagcaaatgtacaacaggatggtaaagactacatcccaatcaatgccatactgacaggaaatagtgggtttacatactcaactcctgccttctctgaggacttcttcaaggaaagtatttcagctccgaagtttaattcaggaagctctgatgatgtcagatatgtaaatgctttcaagttcatgagcctggaaagaatcaaaacctttgaagaacttttaccgaatgccacctccatgtttgatgactaccagggcgacagcagcactctgttggcctctcccatgctgaagcgcttcacctggactgacagcaaacccaaggcctcgctcaagattgacttgagagtaaccagtaaaagtaaggagtcggggctgtctgatgtcagcaggcccagtttctgccattccagctgtgggcacgtcagcgaaggcaagcgcaggttcacctacgaccacgctgagctggaaaggaaaatcgcgtgctgctccccgcccccagactacaactcggtggtcctgtactccaccccacccatctagagtttgacacgaagccttatttctagaagcacatgtgtatttatacccccaggaaactagcttttgccagtattatgcatatataagtttacacctttatctttccatgggagccagctgctttttgtgatttttttaatagtgctttttttttttgactaacaagaatgtaactccagatagagaaatagtgacaagtgaagaacactactgctaaatcctcatgttactcagtgttagagaaatccttcctaaacccaatgacttccctgctccaacccccgccacctcagggcacgcaggaccagtttgattgaggagctgcactgatcacccaatgcatcacgtaccccactgggccagccctgcagcccaaaacccagggcaacaagcccgttagccccagggatcactggctggcctgagcaacatctcgggagtcctctagcaggcctaagacatgtgaggaggaaaaggaaaaaaagcaaaaagcaagggagaaaagagaaaccgggagaaggcatgagaaagaatttgagacgcaccatgtgggcacggagggggacggggctcagcaatgccatttcagtggcttcccagctctgacccttctacatttgagggcccagccaggagcagatggacagcgatgaggggacattttctggattctgggaggcaagaaaaggacaaatatcttttttggaactaaagcaaattttagaactttacctatggaagtggttctatgtccattctcattcgtggcatgttttgatttgtagcactgagggtggcactcaactctgagcccatacttttggctcctctagtaagatgcactgaaaacttagccagagttaggttgtctccaggccatgatggccttacactgaaaatgtcacattctattttgggtattaatatatagtccagacacttaactcaatttcttggtattattctgttttgcacagttagttgtgaaagaaagctgagaagaatgaaaatgcagtcctgaggagaggagttttctccatatcaaaacgagggctgatggaggaaaaaggctctctgtatgaagagatgggaccgtcatcagcacattccctagtgagcctactggctcctggcagcggcttttgtggaagactcactagccagaagagaggagtgggacagtcctctccaccaagatctaaatccaaacaaaagcaggctagagccagaagagaggacaaatctttgttcttcctcttctttacatacgcaaaccacctgtgacagctggcaattttataaatcaggtaactggaaggaggttaaacacagaaaaaagaagacctcagtcaattctctactttttttttttttttccaaatcagataatagcccagcaaatagtgataacaaataaaaccttagctattcatgtcttgatttcaataattaattcttaatcattaagagaccataataaatactccttttcaagagaaaagcaaaaccattagaattgttactcagctccttcaaactcaggtttgtagcatacatgagtccatccatcagtcaaagaatggttccatctggagtcttaatgtagaaagaaaaatggagacttgtaataatgagctagttacaaagtgcttgttcattaaaatagcactgaaaattgaaacatgaattaactgataatattccaatcatttgccatttatgacaaaaatggttggcactaacaaagaacgagcacttcctttcagagtttctgagataatgtacgtggaacagtctgggtggaatggggctgaaaccatgtgcaagtctgtgtcttgtcagtccaagaagtgacaccgagatgttaattttagggacccgtgccttgtttcctagcccacaagaatgcaaacatcaaacagatactcgctagcctcatttaaattgattaaaggaggagtgcatctttggccgacagtggtgtaactgtatgtgtgtgtgtgtgtgtgtgtgtgtgtgtgggtgtatgtgtgttttgtgcataactatttaaggaaactggaattttaaagttacttttatacaaaccaagaatatatgctacagatataagacagacatggtttggtcctatatttctagtcatgatgaatgtattttgtataccatcttcatataataaacttccaaaaacacaaaaaaaaaaac

SEQ ID NO: 343382 - DNA, 7094 bp, Homo sapiens
  misc_feature (3489)..(3489): n is a, c, g, or t
atcgaggtccgcgggaggctcggagcgcgccaggcggacactcctctcggctcctccccggcagcggcggcggctcggagcgggctccggggctcgggtgcagcggccagcgggcgcctggcggcgaggattacccggggaagtggttgtctcctggctggagccgcgagacgggcgctcagggcgcggggccggcggcggcgaacgagaggacggactctggcggccgggtcgttggccgcggggagcgcgggcaccgggcgagcaggccgcgtcgcgctcaccatggtcagctactgggacaccggggtcctgctgtgcgcgctgctcagctgtctgcttctcacaggatctagttcaggttcaaaattaaaagatcctgaactgagtttaaaaggcacccagcacatcatgcaagcaggccagacactgcatctccaatgcaggggggaagcagcccataaatggtctttgcctgaaatggtgagtaaggaaagcgaaaggctgagcataactaaatctgcctgtggaagaaatggcaaacaattctgcagtactttaaccttgaacacagctcaagcaaaccacactggcttctacagctgcaaatatctagctgtacctacttcaaagaagaaggaaacagaatctgcaatctatatatttattagtgatacaggtagacctttcgtagagatgtacagtgaaatccccgaaattatacacatgactgaaggaagggagctcgtcattccctgccgggttacgtcacctaacatcactgttactttaaaaaagtttccacttgacactttgatccctgatggaaaacgcataatctgggacagtagaaagggcttcatcatatcaaatgcaacgtacaaagaaatagggcttctgacctgtgaagcaacagtcaatgggcatttgtataagacaaactatctcacacatcgacaaaccaatacaatcatagatgtccaaataagcacaccacgcccagtcaaattacttagaggccatactcttgtcctcaattgtactgctaccactcccttgaacacgagagttcaaatgacctggagttaccctgatgaaaaaaataagagagcttccgtaaggcgacgaattgaccaaagcaattcccatgccaacatattctacagtgttcttactattgacaaaatgcagaacaaagacaaaggactttatacttgtcgtgtaaggagtggaccatcattcaaatctgttaacacctcagtgcatatatatgataaagcattcatcactgtgaaacatcgaaaacagcaggtgcttgaaaccgtagctggcaagcggtcttaccggctctctatgaaagtgaaggcatttccctcgccggaagttgtatggttaaaagatgggttacctgcgactgagaaatctgctcgctatttgactcgtggctactcgttaattatcaaggacgtaactgaagaggatgcagggaattatacaatcttgctgagcataaaacagtcaaatgtgtttaaaaacctcactgccactctaattgtcaatgtgaaaccccagatttacgaaaaggccgtgtcatcgtttccagacccggctctctacccactgggcagcagacaaatcctgacttgtaccgcatatggtatccctcaacctacaatcaagtggttctggcacccctgtaaccataatcattccgaagcaaggtgtgacttttgttccaataatgaagagtcctttatcctggatgctgacagcaacatgggaaacagaattgagagcatcactcagcgcatggcaataatagaaggaaagaataagatggctagcaccttggttgtggctgactctagaatttctggaatctacatttgcatagcttccaataaagttgggactgtgggaagaaacataagcttttatatcacagatgtgccaaatgggtttcatgttaacttggaaaaaatgccgacggaaggagaggacctgaaactgtcttgcacagttaacaagttcttatacagagacgttacttggattttactgcggacagttaataacagaacaatgcactacagtattagcaagcaaaaaatggccatcactaaggagcactccatcactcttaatcttaccatcatgaatgtttccctgcaagattcaggcacctatgcctgcagagccaggaatgtatacacaggggaagaaatcctccagaagaaagaaattacaatcagagatcaggaagcaccatacctcctgcgaaacctcagtgatcacacagtggccatcagcagttccaccactttagactgtcatgctaatggtgtccccgagcctcagatcacttggtttaaaaacaaccacaaaatacaacaagagcctggaattattttaggaccaggaagcagcacgctgtttattgaaagagtcacagaagaggatgaaggtgtctatcactgcaaagccaccaaccagaagggctctgtggaaagttcagcatacctcactgttcaaggaacctcggacaagtctaatctggagctgatcactctaacatgcacctgtgtggctgcgactctcttctggctcctattaaccctctttatccgaaaaatgaaaaggtcttcttctgaaataaagactgactacctatcaattataatggacccagatgaagttcctttggatgagcagtgtgagcggctcccttatgatgccagcaagtgggagtttgcccgggagagacttaaactgggcaaatcacttggaagaggggcttttggaaaagtggttcaagcatcagcatttggcattaagaaatcacctacgtgccggactgtggctgtgaaaatgctgaaagagggggccacggccagcgagtacaaagctctgatgactgagctaaaaatcttgacccacattggccaccatctgaacgtggttaacctgctgggagcctgcaccaagcaaggagggcctctgatggtgattgttgaatactgcaaatatggaaatctctccaactacctcaagagcaaacgtgacttattttttctcaacaaggatgcagcactacacatggagcctaagaaagaaaaaatggagccaggcctggaacaaggcaagaaaccaagactagatagcgtcaccagcagcgaaagctttgcgagctccggctttcaggaagataaaagtctgagtgatgttgaggaagaggaggattctgacggtttctacaaggagcccatcactatggaagatctgatttcttacagttttcaagtggccagaggcatggagttcctgtcttccagaaagtgcattcatcgggacctggcagcgagaaacattcttttatctgagaacaacgtggtgaagatttgtgattttggccttgcccgggatatttataagaaccccgattatgtgagaaaaggagatactcgacttcctctgaaatggatggctccngaatctatctttgacaaaatctacagcaccaagagcgacgtgtggtcttacggagtattgctgtgggaaatcttctccttaggtgggtctccatacccaggagtacaaatggatgaggacttttgcagtcgcctgagggaaggcatgaggatgagagctcctgagtactctactcctgaaatctatcagatcatgctggactgctggcacagagacccaaaagaaaggccaagatttgcagaacttgtggaaaaactaggtgatttgcttcaagcaaatgtacaacaggatggtaaagactacatcccaatcaatgccatactgacaggaaatagtgggtttacatactcaactcctgccttctctgaggacttcttcaaggaaagtatttcagctccgaagtttaattcaggaagctctgatgatgtcagatatgtaaatgctttcaagttcatgagcctggaaagaatcaaaacctttgaagaacttttaccgaatgccacctccatgtttgatgactaccagggcgacagcagcactctgttggcctctcccatgctgaagcgcttcacctggactgacagcaaacccaaggcctcgctcaagattgacttgagagtaaccagtaaaagtaaggagtcggggctgtctgatgtcagcaggcccagtttctgccattccagctgtgggcacgtcagcgaaggcaagcgcaggttcacctacgaccacgctgagctggaaaggaaaatcgcgtgctgctccccgcccccagactacaactcggtggtcctgtactccaccccacccatctagagtttgacacgaagccttatttctagaagcacatgtgtatttatacccccaggaaactagcttttgccagtattatgcatatataagtttacacctttatctttccatgggagccagctgctttttgtgatttttttaatagtgctttttttttttgactaacaagaatgtaactccagatagagaaatagtgacaagtgaagaacactactgctaaatcctcatgttactcagtgttagagaaatccttcctaaacccaatgacttccctgctccaacccccgccacctcagggcacgcaggaccagtttgattgaggagctgcactgatcacccaatgcatcacgtaccccactgggccagccctgcagcccaaaacccagggcaacaagcccgttagccccagggatcactggctggcctgagcaacatctcgggagtcctctagcaggcctaagacatgtgaggaggaaaaggaaaaaaagcaaaaagcaagggagaaaagagaaaccgggagaaggcatgagaaagaatttgagacgcaccatgtgggcacggagggggacggggctcagcaatgccatttcagtggcttcccagctctgacccttctacatttgagggcccagccaggagcagatggacagcgatgaggggacattttctggattctgggaggcaagaaaaggacaaatatcttttttggaactaaagcaaattttagaactttacctatggaagtggttctatgtccattctcattcgtggcatgttttgatttgtagcactgagggtggcactcaactctgagcccatacttttggctcctctagtaagatgcactgaaaacttagccagagttaggttgtctccaggccatgatggccttacactgaaaatgtcacattctattttgggtattaatatatagtccagacacttaactcaatttcttggtattattctgttttgcacagttagttgtgaaagaaagctgagaagaatgaaaatgcagtcctgaggagaggagttttctccatatcaaaacgagggctgatggaggaaaaaggtcaataaggtcaagggaaaaccccgtctctataccaaccaaaccaattcaccaacacagttgggacccaaaacacaggaagtcagtcacgtttccttttcatttaatggggattccactatctcacactaatctgaaaggatgtggaagagcattagctggcgcatattaagcactttaagctccttgagtaaaaaggtggtatgtaatttatgcaaggtatttctccagttgggactcaggatattagttaatgagccatcactagaagaaaagcccattttcaactgctttgaaacttgcctggggtctgagcatgatgggaatagggagacagggtaggaaagggcgcctactcttcagggtctaaagatcaagtgggccttggatcgctaagctggctctgtttgatgctatttatgcaagttagggtctatgtatttaggatgtctgcaccttctgcagccagtcagaagctggagaggcaacagtggattgctgcttcttggggagaagagtatgcttccttttatccatgtaatttaactgtagaacctgagctctaagtaaccgaagaatgtatgcctctgttcttatgtgccacatccttgtttaaaggctctctgtatgaagagatgggaccgtcatcagcacattccctagtgagcctactggctcctggcagcggcttttgtggaagactcactagccagaagagaggagtgggacagtcctctccaccaagatctaaatccaaacaaaagcaggctagagccagaagagaggacaaatctttgttcttcctcttctttacatacgcaaaccacctgtgacagctggcaattttataaatcaggtaactggaaggaggttaaacacagaaaaaagaagacctcagtcaattctctactttttttttttttttccaaatcagataatagcccagcaaatagtgataacaaataaaaccttagctattcatgtcttgatttcaataattaattcttaatcattaagagaccataataaatactccttttcaagagaaaagcaaaaccattagaattgttactcagctccttcaaactcaggtttgtagcatacatgagtccatccatcagtcaaagaatggttccatctggagtcttaatgtagaaagaaaaatggagacttgtaataatgagctagttacaaagtgcttgttcattaaaatagcactgaaaattgaaacatgaattaactgataatattccaatcatttgccatttatgacaaaaatggttggcactaacaaagaacgagcacttcctttcagagtttctgagataatgtacgtggaacagtctgggtggaatggggctgaaaccatgtgcaagtctgtgtcttgtcagtccaagaagtgacaccgagatgttaattttagggacccgtgccttgtttcctagcccacaagaatgcaaacatcaaacagatactcgctagcctcatttaaattgattaaaggaggagtgcatctttggccgacagtggtgtaactgtatgtgtgtgtgtgtgtgtgtgtgtgtgtgtgggtgtatgtgtgttttgtgcataactatttaaggaaactggaattttaaagttacttttatacaaaccaagaatatatttcacacacataacccccacttgtgttcggtatcccacatccagtcaatatgaatggggtttgccccctataata

SEQ ID NO: 343383 - DNA, 7193 bp, Homo sapiens
  misc_feature (1992)..(1992): n is a, c, g, or t
  misc_feature (3554)..(3554): n is a, c, g, or t
atcgaggtccgcgggaggctcggagcgcgccaggcggacactcctctcggctcctccccggcagcggcggcggctcggagcgggctccggggctcgggtgcagcggccagcgggcgcctggcggcgaggattacccggggaagtggttgtctcctggctggagccgcgagacgggcgctcagggcgcggggccggcggcggcgaacgagaggacggactctggcggccgggtcgttggccgcggggagcgcgggcaccgggcgagcaggccgcgtcgcgctcaccatggtcagctactgggacaccggggtcctgctgtgcgcgctgctcagctgtctgcttctcacaggatctagttcaggttcaaaattaaaagatcctgaactgagtttaaaaggcacccagcacatcatgcaagcaggccagacactgcatctccaatgcaggggggaagcagcccataaatggtctttgcctgaaatggtgagtaaggaaagcgaaaggctgagcataactaaatctgcctgtggaagaaatggcaaacaattctgcagtactttaaccttgaacacagctcaagcaaaccacactggcttctacagctgcaaatatctagctgtacctacttcaaagaagaaggaaacagaatctgcaatctatatatttattagtgatacaggtagacctttcgtagagatgtacagtgaaatccccgaaattatacacatgactgaaggaagggagctcgtcattccctgccgggttacgtcacctaacatcactgttactttaaaaaagtttccacttgacactttgatccctgatggaaaacgcataatctgggacagtagaaagggcttcatcatatcaaatgcaacgtacaaagaaatagggcttctgacctgtgaagcaacagtcaatgggcatttgtataagacaaactatctcacacatcgacaaaccaatacaatcatagatgtccaaataagcacaccacgcccagtcaaattacttagaggccatactcttgtcctcaattgtactgctaccactcccttgaacacgagagttcaaatgacctggagttaccctgatgaaaaaaataagagagcttccgtaaggcgacgaattgaccaaagcaattcccatgccaacatattctacagtgttcttactattgacaaaatgcagaacaaagacaaaggactttatacttgtcgtgtaaggagtggaccatcattcaaatctgttaacacctcagtgcatatatatgataaagcattcatcactgtgaaacatcgaaaacagcaggtgcttgaaaccgtagctggcaagcggtcttaccggctctctatgaaagtgaaggcatttccctcgccggaagttgtatggttaaaagatgggttacctgcgactgagaaatctgctcgctatttgactcgtggctactcgttaattatcaaggacgtaactgaagaggatgcagggaattatacaatcttgctgagcataaaacagtcaaatgtgtttaaaaacctcactgccactctaattgtcaatgtgaaaccccagatttacgaaaaggccgtgtcatcgtttccagacccggctctctacccactgggcagcagacaaatcctgacttgtaccgcatatggtatccctcaacctacaatcaagtggttctggcacccctgtaaccataatcattccgaagcaaggtgtgacttttgttccaataatgaagagtcctttatcctggatgctgacagcaacatgggaaacagaattgagagcatcactcagcgcatggcaataatagaaggaaagaataagatggctagcaccttggttgtggctgactctagaatttctggaatctacatttgcatagcttccaataaagttgggactgtgggaagaaacataagcttttatatcacagaattgtcaaactttgagtgccttcatccttgctctcaggaatagaantctacctcatcggatctcatgtgccaaatgggtttcatgttaacttggaaaaaatgccgacggaaggagaggacctgaaactgtcttgcacagttaacaagttcttatacagagacgttacttggattttactgcggacagttaataacagaacaatgcactacagtattagcaagcaaaaaatggccatcactaaggagcactccatcactcttaatcttaccatcatgaatgtttccctgcaagattcaggcacctatgcctgcagagccaggaatgtatacacaggggaagaaatcctccagaagaaagaaattacaatcagagatcaggaagcaccatacctcctgcgaaacctcagtgatcacacagtggccatcagcagttccaccactttagactgtcatgctaatggtgtccccgagcctcagatcacttggtttaaaaacaaccacaaaatacaacaagagcctggaattattttaggaccaggaagcagcacgctgtttattgaaagagtcacagaagaggatgaaggtgtctatcactgcaaagccaccaaccagaagggctctgtggaaagttcagcatacctcactgttcaaggaacctcggacaagtctaatctggagctgatcactctaacatgcacctgtgtggctgcgactctcttctggctcctattaaccctctttatccgaaaaatgaaaaggtcttcttctgaaataaagactgactacctatcaattataatggacccagatgaagttcctttggatgagcagtgtgagcggctcccttatgatgccagcaagtgggagtttgcccgggagagacttaaactgggcaaatcacttggaagaggggcttttggaaaagtggttcaagcatcagcatttggcattaagaaatcacctacgtgccggactgtggctgtgaaaatgctgaaagagggggccacggccagcgagtacaaagctctgatgactgagctaaaaatcttgacccacattggccaccatctgaacgtggttaacctgctgggagcctgcaccaagcaaggagggcctctgatggtgattgttgaatactgcaaatatggaaatctctccaactacctcaagagcaaacgtgacttattttttctcaacaaggatgcagcactacacatggagcctaagaaagaaaaaatggagccaggcctggaacaaggcaagaaaccaagactagatagcgtcaccagcagcgaaagctttgcgagctccggctttcaggaagataaaagtctgagtgatgttgaggaagaggaggattctgacggtttctacaaggagcccatcactatggaagatctgatttcttacagttttcaagtggccagaggcatggagttcctgtcttccagaaagtgcattcatcgggacctggcagcgagaaacattcttttatctgagaacaacgtggtgaagatttgtgattttggccttgcccgggatatttataagaaccccgattatgtgagaaaaggagatactcgacttcctctgaaatggatggctccngaatctatctttgacaaaatctacagcaccaagagcgacgtgtggtcttacggagtattgctgtgggaaatcttctccttaggtgggtctccatacccaggagtacaaatggatgaggacttttgcagtcgcctgagggaaggcatgaggatgagagctcctgagtactctactcctgaaatctatcagatcatgctggactgctggcacagagacccaaaagaaaggccaagatttgcagaacttgtggaaaaactaggtgatttgcttcaagcaaatgtacaacaggatggtaaagactacatcccaatcaatgccatactgacaggaaatagtgggtttacatactcaactcctgccttctctgaggacttcttcaaggaaagtatttcagctccgaagtttaattcaggaagctctgatgatgtcagatatgtaaatgctttcaagttcatgagcctggaaagaatcaaaacctttgaagaacttttaccgaatgccacctccatgtttgatgactaccagggcgacagcagcactctgttggcctctcccatgctgaagcgcttcacctggactgacagcaaacccaaggcctcgctcaagattgacttgagagtaaccagtaaaagtaaggagtcggggctgtctgatgtcagcaggcccagtttctgccattccagctgtgggcacgtcagcgaaggcaagcgcaggttcacctacgaccacgctgagctggaaaggaaaatcgcgtgctgctccccgcccccagactacaactcggtggtcctgtactccaccccacccatctagagtttgacacgaagccttatttctagaagcacatgtgtatttatacccccaggaaactagcttttgccagtattatgcatatataagtttacacctttatctttccatgggagccagctgctttttgtgatttttttaatagtgctttttttttttgactaacaagaatgtaactccagatagagaaatagtgacaagtgaagaacactactgctaaatcctcatgttactcagtgttagagaaatccttcctaaacccaatgacttccctgctccaacccccgccacctcagggcacgcaggaccagtttgattgaggagctgcactgatcacccaatgcatcacgtaccccactgggccagccctgcagcccaaaacccagggcaacaagcccgttagccccagggatcactggctggcctgagcaacatctcgggagtcctctagcaggcctaagacatgtgaggaggaaaaggaaaaaaagcaaaaagcaagggagaaaagagaaaccgggagaaggcatgagaaagaatttgagacgcaccatgtgggcacggagggggacggggctcagcaatgccatttcagtggcttcccagctctgacccttctacatttgagggcccagccaggagcagatggacagcgatgaggggacattttctggattctgggaggcaagaaaaggacaaatatcttttttggaactaaagcaaattttagaactttacctatggaagtggttctatgtccattctcattcgtggcatgttttgatttgtagcactgagggtggcactcaactctgagcccatacttttggctcctctagtaagatgcactgaaaacttagccagagttaggttgtctccaggccatgatggccttacactgaaaatgtcacattctattttgggtattaatatatagtccagacacttaactcaatttcttggtattattctgttttgcacagttagttgtgaaagaaagctgagaagaatgaaaatgcagtcctgaggagaggagttttctccatatcaaaacgagggctgatggaggaaaaaggtcaataaggtcaagggaaaaccccgtctctataccaaccaaaccaattcaccaacacagttgggacccaaaacacaggaagtcagtcacgtttccttttcatttaatggggattccactatctcacactaatctgaaaggatgtggaagagcattagctggcgcatattaagcactttaagctccttgagtaaaaaggtggtatgtaatttatgcaaggtatttctccagttgggactcaggatattagttaatgagccatcactagaagaaaagcccattttcaactgctttgaaacttgcctggggtctgagcatgatgggaatagggagacagggtaggaaagggcgcctactcttcagggtctaaagatcaagtgggccttggatcgctaagctggctctgtttgatgctatttatgcaagttagggtctatgtatttaggatgtctgcaccttctgcagccagtcagaagctggagaggcaacagtggattgctgcttcttggggagaagagtatgcttccttttatccatgtaatttaactgtagaacctgagctctaagtaaccgaagaatgtatgcctctgttcttatgtgccacatccttgtttaaaggctctctgtatgaagagatgggaccgtcatcagcacattccctagtgagcctactggctcctggcagcggcttttgtggaagactcactagccagaagagaggagtgggacagtcctctccaccaagatctaaatccaaacaaaagcaggctagagccagaagagaggacaaatctttgttcttcctcttctttacatacgcaaaccacctgtgacagctggcaattttataaatcaggtaactggaaggaggttaaacacagaaaaaagaagacctcagtcaattctctactttttttttttttttccaaatcagataatagcccagcaaatagtgataacaaataaaaccttagctattcatgtcttgatttcaataattaattcttaatcattaagagaccataataaatactccttttcaagagaaaagcaaaaccattagaattgttactcagctccttcaaactcaggtttgtagcatacatgagtccatccatcagtcaaagaatggttccatctggagtcttaatgtagaaagaaaaatggagacttgtaataatgagctagttacaaagtgcttgttcattaaaatagcactgaaaattgaaacatgaattaactgataatattccaatcatttgccatttatgacaaaaatggttggcactaacaaagaacgagcacttcctttcagagtttctgagataatgtacgtggaacagtctgggtggaatggggctgaaaccatgtgcaagtctgtgtcttgtcagtccaagaagtgacaccgagatgttaattttagggacccgtgccttgtttcctagcccacaagaatgcaaacatcaaacagatactcgctagcctcatttaaattgattaaaggaggagtgcatctttggccgacagtggtgtaactgtatgtgtgtgtgtgtgtgtgtgtgtgtgtgtgggtgtatgtgtgttttgtgcataactatttaaggaaactggaattttaaagttacttttatacaaaccaagaatatatgctacagatataagacagacatggtttggtcctatatttctagtcatgatgaatgtattttgtataccatcttcatataataaacttccaaaaacacaaaaaaaaaaac

SEQ ID NO: 343384 - DNA, 7112 bp, Homo sapiens
  misc_feature (3489)..(3489): n is a, c, g, or t
atcgaggtccgcgggaggctcggagcgcgccaggcggacactcctctcggctcctccccggcagcggcggcggctcggagcgggctccggggctcgggtgcagcggccagcgggcgcctggcggcgaggattacccggggaagtggttgtctcctggctggagccgcgagacgggcgctcagggcgcggggccggcggcggcgaacgagaggacggactctggcggccgggtcgttggccgcggggagcgcgggcaccgggcgagcaggccgcgtcgcgctcaccatggtcagctactgggacaccggggtcctgctgtgcgcgctgctcagctgtctgcttctcacaggatctagttcaggttcaaaattaaaagatcctgaactgagtttaaaaggcacccagcacatcatgcaagcaggccagacactgcatctccaatgcaggggggaagcagcccataaatggtctttgcctgaaatggtgagtaaggaaagcgaaaggctgagcataactaaatctgcctgtggaagaaatggcaaacaattctgcagtactttaaccttgaacacagctcaagcaaaccacactggcttctacagctgcaaatatctagctgtacctacttcaaagaagaaggaaacagaatctgcaatctatatatttattagtgatacaggtagacctttcgtagagatgtacagtgaaatccccgaaattatacacatgactgaaggaagggagctcgtcattccctgccgggttacgtcacctaacatcactgttactttaaaaaagtttccacttgacactttgatccctgatggaaaacgcataatctgggacagtagaaagggcttcatcatatcaaatgcaacgtacaaagaaatagggcttctgacctgtgaagcaacagtcaatgggcatttgtataagacaaactatctcacacatcgacaaaccaatacaatcatagatgtccaaataagcacaccacgcccagtcaaattacttagaggccatactcttgtcctcaattgtactgctaccactcccttgaacacgagagttcaaatgacctggagttaccctgatgaaaaaaataagagagcttccgtaaggcgacgaattgaccaaagcaattcccatgccaacatattctacagtgttcttactattgacaaaatgcagaacaaagacaaaggactttatacttgtcgtgtaaggagtggaccatcattcaaatctgttaacacctcagtgcatatatatgataaagcattcatcactgtgaaacatcgaaaacagcaggtgcttgaaaccgtagctggcaagcggtcttaccggctctctatgaaagtgaaggcatttccctcgccggaagttgtatggttaaaagatgggttacctgcgactgagaaatctgctcgctatttgactcgtggctactcgttaattatcaaggacgtaactgaagaggatgcagggaattatacaatcttgctgagcataaaacagtcaaatgtgtttaaaaacctcactgccactctaattgtcaatgtgaaaccccagatttacgaaaaggccgtgtcatcgtttccagacccggctctctacccactgggcagcagacaaatcctgacttgtaccgcatatggtatccctcaacctacaatcaagtggttctggcacccctgtaaccataatcattccgaagcaaggtgtgacttttgttccaataatgaagagtcctttatcctggatgctgacagcaacatgggaaacagaattgagagcatcactcagcgcatggcaataatagaaggaaagaataagatggctagcaccttggttgtggctgactctagaatttctggaatctacatttgcatagcttccaataaagttgggactgtgggaagaaacataagcttttatatcacagatgtgccaaatgggtttcatgttaacttggaaaaaatgccgacggaaggagaggacctgaaactgtcttgcacagttaacaagttcttatacagagacgttacttggattttactgcggacagttaataacagaacaatgcactacagtattagcaagcaaaaaatggccatcactaaggagcactccatcactcttaatcttaccatcatgaatgtttccctgcaagattcaggcacctatgcctgcagagccaggaatgtatacacaggggaagaaatcctccagaagaaagaaattacaatcagagatcaggaagcaccatacctcctgcgaaacctcagtgatcacacagtggccatcagcagttccaccactttagactgtcatgctaatggtgtccccgagcctcagatcacttggtttaaaaacaaccacaaaatacaacaagagcctggaattattttaggaccaggaagcagcacgctgtttattgaaagagtcacagaagaggatgaaggtgtctatcactgcaaagccaccaaccagaagggctctgtggaaagttcagcatacctcactgttcaaggaacctcggacaagtctaatctggagctgatcactctaacatgcacctgtgtggctgcgactctcttctggctcctattaaccctctttatccgaaaaatgaaaaggtcttcttctgaaataaagactgactacctatcaattataatggacccagatgaagttcctttggatgagcagtgtgagcggctcccttatgatgccagcaagtgggagtttgcccgggagagacttaaactgggcaaatcacttggaagaggggcttttggaaaagtggttcaagcatcagcatttggcattaagaaatcacctacgtgccggactgtggctgtgaaaatgctgaaagagggggccacggccagcgagtacaaagctctgatgactgagctaaaaatcttgacccacattggccaccatctgaacgtggttaacctgctgggagcctgcaccaagcaaggagggcctctgatggtgattgttgaatactgcaaatatggaaatctctccaactacctcaagagcaaacgtgacttattttttctcaacaaggatgcagcactacacatggagcctaagaaagaaaaaatggagccaggcctggaacaaggcaagaaaccaagactagatagcgtcaccagcagcgaaagctttgcgagctccggctttcaggaagataaaagtctgagtgatgttgaggaagaggaggattctgacggtttctacaaggagcccatcactatggaagatctgatttcttacagttttcaagtggccagaggcatggagttcctgtcttccagaaagtgcattcatcgggacctggcagcgagaaacattcttttatctgagaacaacgtggtgaagatttgtgattttggccttgcccgggatatttataagaaccccgattatgtgagaaaaggagatactcgacttcctctgaaatggatggctccngaatctatctttgacaaaatctacagcaccaagagcgacgtgtggtcttacggagtattgctgtgggaaatcttctccttaggtgggtctccatacccaggagtacaaatggatgaggacttttgcagtcgcctgagggaaggcatgaggatgagagctcctgagtactctactcctgaaatctatcagatcatgctggactgctggcacagagacccaaaagaaaggccaagatttgcagaacttgtggaaaaactaggtgatttgcttcaagcaaatgtacaacaggatggtaaagactacatcccaatcaatgccatactgacaggaaatagtgggtttacatactcaactcctgccttctctgaggactttcagctccgaagtttaattcaggaagctctgatgatgtcagatatgtaaatgctttcaagttcatgagcctggaaagaatcaaaacctttgaagaacttttaccgaatgccacctccatgtttgatgactaccagggcgacagcagcactctgttggcctctcccatgctgaagcgcttcacctggactgacagcaaacccaaggcctcgctcaagattgacttgagagtaaccagtaaaagtaaggagtcggggctgtctgatgtcagcaggcccagtttctgccattccagctgtgggcacgtcagcgaaggcaagcgcaggttcacctacgaccacgctgagctggaaaggaaaatcgcgtgctgctccccgcccccagactacaactcggtggtcctgtactccaccccacccatctagagtttgacacgaagccttatttctagaagcacatgtgtatttatacccccaggaaactagcttttgccagtattatgcatatataagtttacacctttatctttccatgggagccagctgctttttgtgatttttttaatagtgctttttttttttgactaacaagaatgtaactccagatagagaaatagtgacaagtgaagaacactactgctaaatcctcatgttactcagtgttagagaaatccttcctaaacccaatgacttccctgctccaacccccgccacctcagggcacgcaggaccagtttgattgaggagctgcactgatcacccaatgcatcacgtaccccactgggccagccctgcagcccaaaacccagggcaacaagcccgttagccccagggatcactggctggcctgagcaacatctcgggagtcctctagcaggcctaagacatgtgaggaggaaaaggaaaaaaagcaaaaagcaagggagaaaagagaaaccgggagaaggcatgagaaagaatttgagacgcaccatgtgggcacggagggggacggggctcagcaatgccatttcagtggcttcccagctctgacccttctacatttgagggcccagccaggagcagatggacagcgatgaggggacattttctggattctgggaggcaagaaaaggacaaatatcttttttggaactaaagcaaattttagaactttacctatggaagtggttctatgtccattctcattcgtggcatgttttgatttgtagcactgagggtggcactcaactctgagcccatacttttggctcctctagtaagatgcactgaaaacttagccagagttaggttgtctccaggccatgatggccttacactgaaaatgtcacattctattttgggtattaatatatagtccagacacttaactcaatttcttggtattattctgttttgcacagttagttgtgaaagaaagctgagaagaatgaaaatgcagtcctgaggagaggagttttctccatatcaaaacgagggctgatggaggaaaaaggtcaataaggtcaagggaaaaccccgtctctataccaaccaaaccaattcaccaacacagttgggacccaaaacacaggaagtcagtcacgtttccttttcatttaatggggattccactatctcacactaatctgaaaggatgtggaagagcattagctggcgcatattaagcactttaagctccttgagtaaaaaggtggtatgtaatttatgcaaggtatttctccagttgggactcaggatattagttaatgagccatcactagaagaaaagcccattttcaactgctttgaaacttgcctggggtctgagcatgatgggaatagggagacagggtaggaaagggcgcctactcttcagggtctaaagatcaagtgggccttggatcgctaagctggctctgtttgatgctatttatgcaagttagggtctatgtatttaggatgtctgcaccttctgcagccagtcagaagctggagaggcaacagtggattgctgcttcttggggagaagagtatgcttccttttatccatgtaatttaactgtagaacctgagctctaagtaaccgaagaatgtatgcctctgttcttatgtgccacatccttgtttaaaggctctctgtatgaagagatgggaccgtcatcagcacattccctagtgagcctactggctcctggcagcggcttttgtggaagactcactagccagaagagaggagtgggacagtcctctccaccaagatctaaatccaaacaaaagcaggctagagccagaagagaggacaaatctttgttcttcctcttctttacatacgcaaaccacctgtgacagctggcaattttataaatcaggtaactggaaggaggttaaacacagaaaaaagaagacctcagtcaattctctactttttttttttttttccaaatcagataatagcccagcaaatagtgataacaaataaaaccttagctattcatgtcttgatttcaataattaattcttaatcattaagagaccataataaatactccttttcaagagaaaagcaaaaccattagaattgttactcagctccttcaaactcaggtttgtagcatacatgagtccatccatcagtcaaagaatggttccatctggagtcttaatgtagaaagaaaaatggagacttgtaataatgagctagttacaaagtgcttgttcattaaaatagcactgaaaattgaaacatgaattaactgataatattccaatcatttgccatttatgacaaaaatggttggcactaacaaagaacgagcacttcctttcagagtttctgagataatgtacgtggaacagtctgggtggaatggggctgaaaccatgtgcaagtctgtgtcttgtcagtccaagaagtgacaccgagatgttaattttagggacccgtgccttgtttcctagcccacaagaatgcaaacatcaaacagatactcgctagcctcatttaaattgattaaaggaggagtgcatctttggccgacagtggtgtaactgtatgtgtgtgtgtgtgtgtgtgtgtgtgtgtgggtgtatgtgtgttttgtgcataactatttaaggaaactggaattttaaagttacttttatacaaaccaagaatatatgctacagatataagacagacatggtttggtcctatatttctagtcatgatgaatgtattttgtataccatcttcatataataaacttccaaaaacacaaaaaaaaaaac

SEQ ID NO: 343385 - DNA, 7143 bp, Homo sapiens
  misc_feature (1779)..(1779): n is a, c, g, or t
  misc_feature (3504)..(3504): n is a, c, g, or t
atcgaggtccgcgggaggctcggagcgcgccaggcggacactcctctcggctcctccccggcagcggcggcggctcggagcgggctccggggctcgggtgcagcggccagcgggcgcctggcggcgaggattacccggggaagtggttgtctcctggctggagccgcgagacgggcgctcagggcgcggggccggcggcggcgaacgagaggacggactctggcggccgggtcgttggccgcggggagcgcgggcaccgggcgagcaggccgcgtcgcgctcaccatggtcagctactgggacaccggggtcctgctgtgcgcgctgctcagctgtctgcttctcacaggatctagttcaggttcaaaattaaaagatcctgaactgagtttaaaaggcacccagcacatcatgcaagcaggccagacactgcatctccaatgcaggggggaagcagcccataaatggtctttgcctgaaatggtgagtaaggaaagcgaaaggctgagcataactaaatctgcctgtggaagaaatggcaaacaattctgcagtactttaaccttgaacacagctcaagcaaaccacactggcttctacagctgcaaatatctagctgtacctacttcaaagaagaaggaaacagaatctgcaatctatatatttattagtgatacaggtagacctttcgtagagatgtacagtgaaatccccgaaattatacacatgactgaaggaagggagctcgtcattccctgccgggttacgtcacctaacatcactgttactttaaaaaagtttccacttgacactttgatccctgatggaaaacgcataatctgggacagtagaaagggcttcatcatatcaaatgcaacgtacaaagaaatagggcttctgacctgtgaagcaacagtcaatgggcatttgtataagacaaactatctcacacatcgacaaaccaatacaatcatagatgtccaaataagcacaccacgcccagtcaaattacttagaggccatactcttgtcctcaattgtactgctaccactcccttgaacacgagagttcaaatgacctggagttaccctgatgaaaaaaataagagagcttccgtaaggcgacgaattgaccaaagcaattcccatgccaacatattctacagtgttcttactattgacaaaatgcagaacaaagacaaaggactttatacttgtcgtgtaaggagtggaccatcattcaaatctgttaacacctcagtgcatatatatgataaagcattcatcactgtgaaacatcgaaaacagcaggtgcttgaaaccgtagctggcaagcggtcttaccggctctctatgaaagtgaaggcatttccctcgccggaagttgtatggttaaaagatgggttacctgcgactgagaaatctgctcgctatttgactcgtggctactcgttaattatcaaggacgtaactgaagaggatgcagggaattatacaatcttgctgagcataaaacagtcaaatgtgtttaaaaacctcactgccactctaattgtcaatgacaaatcctgacttgtaccgcatatggtatccctcaacctacaatcaagtggttctggcacccctgtaaccataatcattccgaagcaaggtgtgacttttgttccaataatgaagagtcctttatcctggatgctgacagcaacatgggaaacagaattgagagcatcactcagcgcatggcaataatagaaggaaagaataagcttccaccagctnacagttctttcatgttgccacctacaagcttctcttccaactacttccatttccttccgtgactctaaacggatggctagcaccttggttgtggctgactctagaatttctggaatctacatttgcatagcttccaataaagttgggactgtgggaagaaacataagcttttatatcacagatgtgccaaatgggtttcatgttaacttggaaaaaatgccgacggaaggagaggacctgaaactgtcttgcacagttaacaagttcttatacagagacgttacttggattttactgcggacagttaataacagaacaatgcactacagtattagcaagcaaaaaatggccatcactaaggagcactccatcactcttaatcttaccatcatgaatgtttccctgcaagattcaggcacctatgcctgcagagccaggaatgtatacacaggggaagaaatcctccagaagaaagaaattacaatcagagatcaggaagcaccatacctcctgcgaaacctcagtgatcacacagtggccatcagcagttccaccactttagactgtcatgctaatggtgtccccgagcctcagatcacttggtttaaaaacaaccacaaaatacaacaagagcctggaattattttaggaccaggaagcagcacgctgtttattgaaagagtcacagaagaggatgaaggtgtctatcactgcaaagccaccaaccagaagggctctgtggaaagttcagcatacctcactgttcaaggaacctcggacaagtctaatctggagctgatcactctaacatgcacctgtgtggctgcgactctcttctggctcctattaaccctctttatccgaaaaatgaaaaggtcttcttctgaaataaagactgactacctatcaattataatggacccagatgaagttcctttggatgagcagtgtgagcggctcccttatgatgccagcaagtgggagtttgcccgggagagacttaaactgggcaaatcacttggaagaggggcttttggaaaagtggttcaagcatcagcatttggcattaagaaatcacctacgtgccggactgtggctgtgaaaatgctgaaagagggggccacggccagcgagtacaaagctctgatgactgagctaaaaatcttgacccacattggccaccatctgaacgtggttaacctgctgggagcctgcaccaagcaaggagggcctctgatggtgattgttgaatactgcaaatatggaaatctctccaactacctcaagagcaaacgtgacttattttttctcaacaaggatgcagcactacacatggagcctaagaaagaaaaaatggagccaggcctggaacaaggcaagaaaccaagactagatagcgtcaccagcagcgaaagctttgcgagctccggctttcaggaagataaaagtctgagtgatgttgaggaagaggaggattctgacggtttctacaaggagcccatcactatggaagatctgatttcttacagttttcaagtggccagaggcatggagttcctgtcttccagaaagtgcattcatcgggacctggcagcgagaaacattcttttatctgagaacaacgtggtgaagatttgtgattttggccttgcccgggatatttataagaaccccgattatgtgagaaaaggagatactcgacttcctctgaaatggatggctccngaatctatctttgacaaaatctacagcaccaagagcgacgtgtggtcttacggagtattgctgtgggaaatcttctccttaggtgggtctccatacccaggagtacaaatggatgaggacttttgcagtcgcctgagggaaggcatgaggatgagagctcctgagtactctactcctgaaatctatcagatcatgctggactgctggcacagagacccaaaagaaaggccaagatttgcagaacttgtggaaaaactaggtgatttgcttcaagcaaatgtacaacaggatggtaaagactacatcccaatcaatgccatactgacaggaaatagtgggtttacatactcaactcctgccttctctgaggacttcttcaaggaaagtatttcagctccgaagtttaattcaggaagctctgatgatgtcagatatgtaaatgctttcaagttcatgagcctggaaagaatcaaaacctttgaagaacttttaccgaatgccacctccatgtttgatgactaccagggcgacagcagcactctgttggcctctcccatgctgaagcgcttcacctggactgacagcaaacccaaggcctcgctcaagattgacttgagagtaaccagtaaaagtaaggagtcggggctgtctgatgtcagcaggcccagtttctgccattccagctgtgggcacgtcagcgaaggcaagcgcaggttcacctacgaccacgctgagctggaaaggaaaatcgcgtgctgctccccgcccccagactacaactcggtggtcctgtactccaccccacccatctagagtttgacacgaagccttatttctagaagcacatgtgtatttatacccccaggaaactagcttttgccagtattatgcatatataagtttacacctttatctttccatgggagccagctgctttttgtgatttttttaatagtgctttttttttttgactaacaagaatgtaactccagatagagaaatagtgacaagtgaagaacactactgctaaatcctcatgttactcagtgttagagaaatccttcctaaacccaatgacttccctgctccaacccccgccacctcagggcacgcaggaccagtttgattgaggagctgcactgatcacccaatgcatcacgtaccccactgggccagccctgcagcccaaaacccagggcaacaagcccgttagccccagggatcactggctggcctgagcaacatctcgggagtcctctagcaggcctaagacatgtgaggaggaaaaggaaaaaaagcaaaaagcaagggagaaaagagaaaccgggagaaggcatgagaaagaatttgagacgcaccatgtgggcacggagggggacggggctcagcaatgccatttcagtggcttcccagctctgacccttctacatttgagggcccagccaggagcagatggacagcgatgaggggacattttctggattctgggaggcaagaaaaggacaaatatcttttttggaactaaagcaaattttagaactttacctatggaagtggttctatgtccattctcattcgtggcatgttttgatttgtagcactgagggtggcactcaactctgagcccatacttttggctcctctagtaagatgcactgaaaacttagccagagttaggttgtctccaggccatgatggccttacactgaaaatgtcacattctattttgggtattaatatatagtccagacacttaactcaatttcttggtattattctgttttgcacagttagttgtgaaagaaagctgagaagaatgaaaatgcagtcctgaggagaggagttttctccatatcaaaacgagggctgatggaggaaaaaggtcaataaggtcaagggaaaaccccgtctctataccaaccaaaccaattcaccaacacagttgggacccaaaacacaggaagtcagtcacgtttccttttcatttaatggggattccactatctcacactaatctgaaaggatgtggaagagcattagctggcgcatattaagcactttaagctccttgagtaaaaaggtggtatgtaatttatgcaaggtatttctccagttgggactcaggatattagttaatgagccatcactagaagaaaagcccattttcaactgctttgaaacttgcctggggtctgagcatgatgggaatagggagacagggtaggaaagggcgcctactcttcagggtctaaagatcaagtgggccttggatcgctaagctggctctgtttgatgctatttatgcaagttagggtctatgtatttaggatgtctgcaccttctgcagccagtcagaagctggagaggcaacagtggattgctgcttcttggggagaagagtatgcttccttttatccatgtaatttaactgtagaacctgagctctaagtaaccgaagaatgtatgcctctgttcttatgtgccacatccttgtttaaaggctctctgtatgaagagatgggaccgtcatcagcacattccctagtgagcctactggctcctggcagcggcttttgtggaagactcactagccagaagagaggagtgggacagtcctctccaccaagatctaaatccaaacaaaagcaggctagagccagaagagaggacaaatctttgttcttcctcttctttacatacgcaaaccacctgtgacagctggcaattttataaatcaggtaactggaaggaggttaaacacagaaaaaagaagacctcagtcaattctctactttttttttttttttccaaatcagataatagcccagcaaatagtgataacaaataaaaccttagctattcatgtcttgatttcaataattaattcttaatcattaagagaccataataaatactccttttcaagagaaaagcaaaaccattagaattgttactcagctccttcaaactcaggtttgtagcatacatgagtccatccatcagtcaaagaatggttccatctggagtcttaatgtagaaagaaaaatggagacttgtaataatgagctagttacaaagtgcttgttcattaaaatagcactgaaaattgaaacatgaattaactgataatattccaatcatttgccatttatgacaaaaatggttggcactaacaaagaacgagcacttcctttcagagtttctgagataatgtacgtggaacagtctgggtggaatggggctgaaaccatgtgcaagtctgtgtcttgtcagtccaagaagtgacaccgagatgttaattttagggacccgtgccttgtttcctagcccacaagaatgcaaacatcaaacagatactcgctagcctcatttaaattgattaaaggaggagtgcatctttggccgacagtggtgtaactgtatgtgtgtgtgtgtgtgtgtgtgtgtgtgtgggtgtatgtgtgttttgtgcataactatttaaggaaactggaattttaaagttacttttatacaaaccaagaatatatgctacagatataagacagacatggtttggtcctatatttctagtcatgatgaatgtattttgtataccatcttcatataataaacttccaaaaacacaaaaaaaaaaac

SEQ ID NO: 343386 - DNA, 5423 bp, Homo sapiens
  misc_feature (3489)..(3489): n is a, c, g, or t
atcgaggtccgcgggaggctcggagcgcgccaggcggacactcctctcggctcctccccggcagcggcggcggctcggagcgggctccggggctcgggtgcagcggccagcgggcgcctggcggcgaggattacccggggaagtggttgtctcctggctggagccgcgagacgggcgctcagggcgcggggccggcggcggcgaacgagaggacggactctggcggccgggtcgttggccgcggggagcgcgggcaccgggcgagcaggccgcgtcgcgctcaccatggtcagctactgggacaccggggtcctgctgtgcgcgctgctcagctgtctgcttctcacaggatctagttcaggttcaaaattaaaagatcctgaactgagtttaaaaggcacccagcacatcatgcaagcaggccagacactgcatctccaatgcaggggggaagcagcccataaatggtctttgcctgaaatggtgagtaaggaaagcgaaaggctgagcataactaaatctgcctgtggaagaaatggcaaacaattctgcagtactttaaccttgaacacagctcaagcaaaccacactggcttctacagctgcaaatatctagctgtacctacttcaaagaagaaggaaacagaatctgcaatctatatatttattagtgatacaggtagacctttcgtagagatgtacagtgaaatccccgaaattatacacatgactgaaggaagggagctcgtcattccctgccgggttacgtcacctaacatcactgttactttaaaaaagtttccacttgacactttgatccctgatggaaaacgcataatctgggacagtagaaagggcttcatcatatcaaatgcaacgtacaaagaaatagggcttctgacctgtgaagcaacagtcaatgggcatttgtataagacaaactatctcacacatcgacaaaccaatacaatcatagatgtccaaataagcacaccacgcccagtcaaattacttagaggccatactcttgtcctcaattgtactgctaccactcccttgaacacgagagttcaaatgacctggagttaccctgatgaaaaaaataagagagcttccgtaaggcgacgaattgaccaaagcaattcccatgccaacatattctacagtgttcttactattgacaaaatgcagaacaaagacaaaggactttatacttgtcgtgtaaggagtggaccatcattcaaatctgttaacacctcagtgcatatatatgataaagcattcatcactgtgaaacatcgaaaacagcaggtgcttgaaaccgtagctggcaagcggtcttaccggctctctatgaaagtgaaggcatttccctcgccggaagttgtatggttaaaagatgggttacctgcgactgagaaatctgctcgctatttgactcgtggctactcgttaattatcaaggacgtaactgaagaggatgcagggaattatacaatcttgctgagcataaaacagtcaaatgtgtttaaaaacctcactgccactctaattgtcaatgtgaaaccccagatttacgaaaaggccgtgtcatcgtttccagacccggctctctacccactgggcagcagacaaatcctgacttgtaccgcatatggtatccctcaacctacaatcaagtggttctggcacccctgtaaccataatcattccgaagcaaggtgtgacttttgttccaataatgaagagtcctttatcctggatgctgacagcaacatgggaaacagaattgagagcatcactcagcgcatggcaataatagaaggaaagaataagatggctagcaccttggttgtggctgactctagaatttctggaatctacatttgcatagcttccaataaagttgggactgtgggaagaaacataagcttttatatcacagatgtgccaaatgggtttcatgttaacttggaaaaaatgccgacggaaggagaggacctgaaactgtcttgcacagttaacaagttcttatacagagacgttacttggattttactgcggacagttaataacagaacaatgcactacagtattagcaagcaaaaaatggccatcactaaggagcactccatcactcttaatcttaccatcatgaatgtttccctgcaagattcaggcacctatgcctgcagagccaggaatgtatacacaggggaagaaatcctccagaagaaagaaattacaatcagagatcaggaagcaccatacctcctgcgaaacctcagtgatcacacagtggccatcagcagttccaccactttagactgtcatgctaatggtgtccccgagcctcagatcacttggtttaaaaacaaccacaaaatacaacaagagcctggaattattttaggaccaggaagcagcacgctgtttattgaaagagtcacagaagaggatgaaggtgtctatcactgcaaagccaccaaccagaagggctctgtggaaagttcagcatacctcactgttcaaggaacctcggacaagtctaatctggagctgatcactctaacatgcacctgtgtggctgcgactctcttctggctcctattaaccctctttatccgaaaaatgaaaaggtcttcttctgaaataaagactgactacctatcaattataatggacccagatgaagttcctttggatgagcagtgtgagcggctcccttatgatgccagcaagtgggagtttgcccgggagagacttaaactgggcaaatcacttggaagaggggcttttggaaaagtggttcaagcatcagcatttggcattaagaaatcacctacgtgccggactgtggctgtgaaaatgctgaaagagggggccacggccagcgagtacaaagctctgatgactgagctaaaaatcttgacccacattggccaccatctgaacgtggttaacctgctgggagcctgcaccaagcaaggagggcctctgatggtgattgttgaatactgcaaatatggaaatctctccaactacctcaagagcaaacgtgacttattttttctcaacaaggatgcagcactacacatggagcctaagaaagaaaaaatggagccaggcctggaacaaggcaagaaaccaagactagatagcgtcaccagcagcgaaagctttgcgagctccggctttcaggaagataaaagtctgagtgatgttgaggaagaggaggattctgacggtttctacaaggagcccatcactatggaagatctgatttcttacagttttcaagtggccagaggcatggagttcctgtcttccagaaagtgcattcatcgggacctggcagcgagaaacattcttttatctgagaacaacgtggtgaagatttgtgattttggccttgcccgggatatttataagaaccccgattatgtgagaaaaggagatactcgacttcctctgaaatggatggctccngaatctatctttgacaaaatctacagcaccaagagcgacgtgtggtcttacggagtattgctgtgggaaatcttctccttaggtgggtctccatacccaggagtacaaatggatgaggacttttgcagtcgcctgagggaaggcatgaggatgagagctcctgagtactctactcctgaaatctatcagatcatgctggactgctggcacagagacccaaaagaaaggccaagatttgcagaacttgtggaaaaactaggtgatttgcttcaagcaaatgtacaacaggatggtaaagactacatcccaatcaatgccatactgacaggaaatagtgggtttacatactcaactcctgccttctctgaggacttcttcaaggaaagtatttcagctccgaagtttaattcaggaagctctgatgatgtcagatatgtaaatgctttcaagttcatgagcctggaaagaatcaaaacctttgaagaacttttaccgaatgccacctccatgtttgatgactaccagggcgacagcagcactctgttggcctctcccatgctgaagcgcttcacctggactgacagcaaacccaaggcctcgctcaagattgacttgagagtaaccagtaaaagtaaggagtcggggctgtctgatgtcagcaggcccagtttctgccattccagctgtgggcacgtcagcgaagttagttgtgaaagaaagctgagaagaatgaaaatgcagtcctgaggagaggagttttctccatatcaaaacgagggctgatggaggaaaaaggctctctgtatgaagagatgggaccgtcatcagcacattccctagtgagcctactggctcctggcagcggcttttgtggaagactcactagccagaagagaggagtgggacagtcctctccaccaagatctaaatccaaacaaaagcaggctagagccagaagagaggacaaatctttgttcttcctcttctttacatacgcaaaccacctgtgacagctggcaattttataaatcaggtaactggaaggaggttaaacacagaaaaaagaagacctcagtcaattctctactttttttttttttttccaaatcagataatagcccagcaaatagtgataacaaataaaaccttagctattcatgtcttgatttcaataattaattcttaatcattaagagaccataataaatactccttttcaagagaaaagcaaaaccattagaattgttactcagctccttcaaactcaggtttgtagcatacatgagtccatccatcagtcaaagaatggttccatctggagtcttaatgtagaaagaaaaatggagacttgtaataatgagctagttacaaagtgcttgttcattaaaatagcactgaaaattgaaacatgaattaactgataatattccaatcatttgccatttatgacaaaaatggttggcactaacaaagaacgagcacttcctttcagagtttctgagataatgtacgtggaacagtctgggtggaatggggctgaaaccatgtgcaagtctgtgtcttgtcagtccaagaagtgacaccgagatgttaattttagggacccgtgccttgtttcctagcccacaagaatgcaaacatcaaacagatactcgctagcctcatttaaattgattaaaggaggagtgcatctttggccgacagtggtgtaactgtatgtgtgtgtgtgtgtgtgtgtgtgtgtgtgggtgtatgtgtgttttgtgcataactatttaaggaaactggaattttaaagttacttttatacaaaccaagaatatatgctacagatataagacagacatggtttggtcctatatttctagtcatgatgaatgtattttgtataccatcttcatataataaacttccaaaaacacaaaaaaaaaaac

SEQ ID NO: 343387 - DNA, 2967 bp, Homo sapiens
atcgaggtccgcgggaggctcggagcgcgccaggcggacactcctctcggctcctccccggcagcggcggcggctcggagcgggctccggggctcgggtgcagcggccagcgggcgcctggcggcgaggattacccggggaagtggttgtctcctggctggagccgcgagacgggcgctcagggcgcggggccggcggcggcgaacgagaggacggactctggcggccgggtcgttggccgcggggagcgcgggcaccgggcgagcaggccgcgtcgcgctcaccatggtcagctactgggacaccggggtcctgctgtgcgcgctgctcagctgtctgcttctcacaggatctagttcaggttcaaaattaaaagatcctgaactgagtttaaaaggcacccagcacatcatgcaagcaggccagacactgcatctccaatgcaggggggaagcagcccataaatggtctttgcctgaaatggtgagtaaggaaagcgaaaggctgagcataactaaatctgcctgtggaagaaatggcaaacaattctgcagtactttaaccttgaacacagctcaagcaaaccacactggcttctacagctgcaaatatctagctgtacctacttcaaagaagaaggaaacagaatctgcaatctatatatttattagtgatacaggtagacctttcgtagagatgtacagtgaaatccccgaaattatacacatgactgaaggaagggagctcgtcattccctgccgggttacgtcacctaacatcactgttactttaaaaaagtttccacttgacactttgatccctgatggaaaacgcataatctgggacagtagaaagggcttcatcatatcaaatgcaacgtacaaagaaatagggcttctgacctgtgaagcaacagtcaatgggcatttgtataagacaaactatctcacacatcgacaaaccaatacaatcatagatgtccaaataagcacaccacgcccagtcaaattacttagaggccatactcttgtcctcaattgtactgctaccactcccttgaacacgagagttcaaatgacctggagttaccctgatgaaaaaaataagagagcttccgtaaggcgacgaattgaccaaagcaattcccatgccaacatattctacagtgttcttactattgacaaaatgcagaacaaagacaaaggactttatacttgtcgtgtaaggagtggaccatcattcaaatctgttaacacctcagtgcatatatatgataaagcattcatcactgtgaaacatcgaaaacagcaggtgcttgaaaccgtagctggcaagcggtcttaccggctctctatgaaagtgaaggcatttccctcgccggaagttgtatggttaaaagatgggttacctgcgactgagaaatctgctcgctatttgactcgtggctactcgttaattatcaaggacgtaactgaagaggatgcagggaattatacaatcttgctgagcataaaacagtcaaatgtgtttaaaaacctcactgccactctaattgtcaatgtgaaaccccagatttacgaaaaggccgtgtcatcgtttccagacccggctctctacccactgggcagcagacaaatcctgacttgtaccgcatatggtatccctcaacctacaatcaagtggttctggcacccctgtaaccataatcattccgaagcaaggtgtgacttttgttccaataatgaagagtcctttatcctggatgctgacagcaacatgggaaacagaattgagagcatcactcagcgcatggcaataatagaaggaaagaataagatggctagcaccttggttgtggctgactctagaatttctggaatctacatttgcatagcttccaataaagttgggactgtgggaagaaacataagcttttatatcacagatgtgccaaatgggtttcatgttaacttggaaaaaatgccgacggaaggagaggacctgaaactgtcttgcacagttaacaagttcttatacagagacgttacttggattttactgcggacagttaataacagaacaatgcactacagtattagcaagcaaaaaatggccatcactaaggagcactccatcactcttaatcttaccatcatgaatgtttccctgcaagattcaggcacctatgcctgcagagccaggaatgtatacacaggggaagaaatcctccagaagaaagaaattacaatcagagatcaggaagcaccatacctcctgcgaaacctcagtgatcacacagtggccatcagcagttccaccactttagactgtcatgctaatggtgtccccgagcctcagatcacttggtttaaaaacaaccacaaaatacaacaagagcctgaactgtatacatcaacgtcaccatcgtcatcgtcatcatcaccattgtcatcatcatcatcatcgtcatcatcatcatcatcatagctatcatcattatcatcatcatcatcatcatcatcatagctaccatttattgaaaactattatgtgtcaacttcaaagaacttatcctttagttggagagccaagacaatcataacaataacaaatggccgggcatggtgctcacgcctgtaatcccagcactttgggaggccaaggcaggtggatcatttgaggtcaggagttcaagaccagcctgaccaagatggtgaaatgctgtctctattaaaaatacaaaattagccgggcatggtggctcatgcctgtaatgccagctactcgggaggctgagacaggagaatcacttgaacccaggaggcagaggttgcagggagccgagatcgtgtactgcactccagcctgggcaacaagagcgaaactccgtctcaaaaaaacaaataaataaataaataaataaacagacaaaattcactttttattctattaaacttaacatacatg

SEQ ID NO: 343388 - DNA, 4233 bp, Homo sapiens
  misc_feature (3489)..(3489): n is a, c, g, or t
atcgaggtccgcgggaggctcggagcgcgccaggcggacactcctctcggctcctccccggcagcggcggcggctcggagcgggctccggggctcgggtgcagcggccagcgggcgcctggcggcgaggattacccggggaagtggttgtctcctggctggagccgcgagacgggcgctcagggcgcggggccggcggcggcgaacgagaggacggactctggcggccgggtcgttggccgcggggagcgcgggcaccgggcgagcaggccgcgtcgcgctcaccatggtcagctactgggacaccggggtcctgctgtgcgcgctgctcagctgtctgcttctcacaggatctagttcaggttcaaaattaaaagatcctgaactgagtttaaaaggcacccagcacatcatgcaagcaggccagacactgcatctccaatgcaggggggaagcagcccataaatggtctttgcctgaaatggtgagtaaggaaagcgaaaggctgagcataactaaatctgcctgtggaagaaatggcaaacaattctgcagtactttaaccttgaacacagctcaagcaaaccacactggcttctacagctgcaaatatctagctgtacctacttcaaagaagaaggaaacagaatctgcaatctatatatttattagtgatacaggtagacctttcgtagagatgtacagtgaaatccccgaaattatacacatgactgaaggaagggagctcgtcattccctgccgggttacgtcacctaacatcactgttactttaaaaaagtttccacttgacactttgatccctgatggaaaacgcataatctgggacagtagaaagggcttcatcatatcaaatgcaacgtacaaagaaatagggcttctgacctgtgaagcaacagtcaatgggcatttgtataagacaaactatctcacacatcgacaaaccaatacaatcatagatgtccaaataagcacaccacgcccagtcaaattacttagaggccatactcttgtcctcaattgtactgctaccactcccttgaacacgagagttcaaatgacctggagttaccctgatgaaaaaaataagagagcttccgtaaggcgacgaattgaccaaagcaattcccatgccaacatattctacagtgttcttactattgacaaaatgcagaacaaagacaaaggactttatacttgtcgtgtaaggagtggaccatcattcaaatctgttaacacctcagtgcatatatatgataaagcattcatcactgtgaaacatcgaaaacagcaggtgcttgaaaccgtagctggcaagcggtcttaccggctctctatgaaagtgaaggcatttccctcgccggaagttgtatggttaaaagatgggttacctgcgactgagaaatctgctcgctatttgactcgtggctactcgttaattatcaaggacgtaactgaagaggatgcagggaattatacaatcttgctgagcataaaacagtcaaatgtgtttaaaaacctcactgccactctaattgtcaatgtgaaaccccagatttacgaaaaggccgtgtcatcgtttccagacccggctctctacccactgggcagcagacaaatcctgacttgtaccgcatatggtatccctcaacctacaatcaagtggttctggcacccctgtaaccataatcattccgaagcaaggtgtgacttttgttccaataatgaagagtcctttatcctggatgctgacagcaacatgggaaacagaattgagagcatcactcagcgcatggcaataatagaaggaaagaataagatggctagcaccttggttgtggctgactctagaatttctggaatctacatttgcatagcttccaataaagttgggactgtgggaagaaacataagcttttatatcacagatgtgccaaatgggtttcatgttaacttggaaaaaatgccgacggaaggagaggacctgaaactgtcttgcacagttaacaagttcttatacagagacgttacttggattttactgcggacagttaataacagaacaatgcactacagtattagcaagcaaaaaatggccatcactaaggagcactccatcactcttaatcttaccatcatgaatgtttccctgcaagattcaggcacctatgcctgcagagccaggaatgtatacacaggggaagaaatcctccagaagaaagaaattacaatcagagatcaggaagcaccatacctcctgcgaaacctcagtgatcacacagtggccatcagcagttccaccactttagactgtcatgctaatggtgtccccgagcctcagatcacttggtttaaaaacaaccacaaaatacaacaagagcctggaattattttaggaccaggaagcagcacgctgtttattgaaagagtcacagaagaggatgaaggtgtctatcactgcaaagccaccaaccagaagggctctgtggaaagttcagcatacctcactgttcaaggaacctcggacaagtctaatctggagctgatcactctaacatgcacctgtgtggctgcgactctcttctggctcctattaaccctctttatccgaaaaatgaaaaggtcttcttctgaaataaagactgactacctatcaattataatggacccagatgaagttcctttggatgagcagtgtgagcggctcccttatgatgccagcaagtgggagtttgcccgggagagacttaaactgggcaaatcacttggaagaggggcttttggaaaagtggttcaagcatcagcatttggcattaagaaatcacctacgtgccggactgtggctgtgaaaatgctgaaagagggggccacggccagcgagtacaaagctctgatgactgagctaaaaatcttgacccacattggccaccatctgaacgtggttaacctgctgggagcctgcaccaagcaaggagggcctctgatggtgattgttgaatactgcaaatatggaaatctctccaactacctcaagagcaaacgtgacttattttttctcaacaaggatgcagcactacacatggagcctaagaaagaaaaaatggagccaggcctggaacaaggcaagaaaccaagactagatagcgtcaccagcagcgaaagctttgcgagctccggctttcaggaagataaaagtctgagtgatgttgaggaagaggaggattctgacggtttctacaaggagcccatcactatggaagatctgatttcttacagttttcaagtggccagaggcatggagttcctgtcttccagaaagtgcattcatcgggacctggcagcgagaaacattcttttatctgagaacaacgtggtgaagatttgtgattttggccttgcccgggatatttataagaaccccgattatgtgagaaaaggagatactcgacttcctctgaaatggatggctccngaatctatctttgacaaaatctacagcaccaagagcgacgtgtggtcttacggagtattgctgtgggaaatcttctccttaggtgggtctccatacccaggagtacaaatggatgaggacttttgcagtcgcctgagggaaggcatgaggatgagagctcctgagtactctactcctgaaatctatcagatcatgctggactgctggcacagagacccaaaagaaaggccaagatttgcagaacttgtggaaaaactaggtgatttgcttcaagcaaatgtacaacaggatggtaaagactacatcccaatcaatgccatactgacaggaaatagtgggtttacatactcaactcctgccttctctgaggactttcagctccgaagtttaattcaggaagctctgatgatgtcagatatgtaaatgctttcaagttcatgagcctggaaagaatcaaaacctttgaagaacttttaccgaatgccacctccatgtttgatgtaagtcgtgaagttaaggtacctagtgcaccccgatagaccccttcttcagatcccttccaaacaccaacgccagtaatgtagtagttcttggtcagtgagggtctggattcaggagtggctgaaatgacagtgtggggaggactgacaactagacctagctgtgcagaactaatttgaaagtagagttccatgcactcactccaggacccaagtccctgcgtggtaggaatttagaccctga

SEQ ID NO: 343389 - DNA, 3646 bp, Homo sapiens
tcgattatgccattaaataatatttagccgtgtagccatgccaggtcactttgccacctcacatccttttcagagcacctgataaagtcataccacttccctgcacatcatttctctcctgtgccattgggcactcagacgagatgatgcctccagtctctcctacgtctggcattctctgatttcacaacggaccagagtaggtccctctgggagtttcctcaaccctacagaatgtgaattgacaaccacgggaggcagtggcaatgctgtcaggattcccaggggtcacggcggggagatcggggcctcaggagttaggtgattcctgttggtgtgttggttcatcttagctgggatatggtgcctgtggtctcctgactcattagagctggatgccttttcctgtcttgataattctttctgtttcttcattagatatgtaaatgctttcaagttcatgagcctggaaagaatcaaaacctttgaagaacttttaccgaatgccacctccatgtttgatgactaccagggcgacagcagcactctgttggcctctcccatgctgaagcgcttcacctggactgacagcaaacccaaggcctcgctcaagattgacttgagagtaaccagtaaaagtaaggagtcggggctgtctgatgtcagcaggcccagtttctgccattccagctgtgggcacgtcagcgaaggcaagcgcaggttcacctacgaccacgctgagctggaaaggaaaatcgcgtgctgctccccgcccccagactacaactcggtggtcctgtactccaccccacccatctagagtttgacacgaagccttatttctagaagcacatgtgtatttatacccccaggaaactagcttttgccagtattatgcatatataagtttacacctttatctttccatgggagccagctgctttttgtgatttttttaatagtgctttttttttttgactaacaagaatgtaactccagatagagaaatagtgacaagtgaagaacactactgctaaatcctcatgttactcagtgttagagaaatccttcctaaacccaatgacttccctgctccaacccccgccacctcagggcacgcaggaccagtttgattgaggagctgcactgatcacccaatgcatcacgtaccccactgggccagccctgcagcccaaaacccagggcaacaagcccgttagccccagggatcactggctggcctgagcaacatctcgggagtcctctagcaggcctaagacatgtgaggaggaaaaggaaaaaaagcaaaaagcaagggagaaaagagaaaccgggagaaggcatgagaaagaatttgagacgcaccatgtgggcacggagggggacggggctcagcaatgccatttcagtggcttcccagctctgacccttctacatttgagggcccagccaggagcagatggacagcgatgaggggacattttctggattctgggaggcaagaaaaggacaaatatcttttttggaactaaagcaaattttagaactttacctatggaagtggttctatgtccattctcattcgtggcatgttttgatttgtagcactgagggtggcactcaactctgagcccatacttttggctcctctagtaagatgcactgaaaacttagccagagttaggttgtctccaggccatgatggccttacactgaaaatgtcacattctattttgggtattaatatatagtccagacacttaactcaatttcttggtattattctgttttgcacagttagttgtgaaagaaagctgagaagaatgaaaatgcagtcctgaggagaggagttttctccatatcaaaacgagggctgatggaggaaaaaggtcaataaggtcaagggaaaaccccgtctctataccaaccaaaccaattcaccaacacagttgggacccaaaacacaggaagtcagtcacgtttccttttcatttaatggggattccactatctcacactaatctgaaaggatgtggaagagcattagctggcgcatattaagcactttaagctccttgagtaaaaaggtggtatgtaatttatgcaaggtatttctccagttgggactcaggatattagttaatgagccatcactagaagaaaagcccattttcaactgctttgaaacttgcctggggtctgagcatgatgggaatagggagacagggtaggaaagggcgcctactcttcagggtctaaagatcaagtgggccttggatcgctaagctggctctgtttgatgctatttatgcaagttagggtctatgtatttaggatgtctgcaccttctgcagccagtcagaagctggagaggcaacagtggattgctgcttcttggggagaagagtatgcttccttttatccatgtaatttaactgtagaacctgagctctaagtaaccgaagaatgtatgcctctgttcttatgtgccacatccttgtttaaaggctctctgtatgaagagatgggaccgtcatcagcacattccctagtgagcctactggctcctggcagcggcttttgtggaagactcactagccagaagagaggagtgggacagtcctctccaccaagatctaaatccaaacaaaagcaggctagagccagaagagaggacaaatctttgttcttcctcttctttacatacgcaaaccacctgtgacagctggcaattttataaatcaggtaactggaaggaggttaaacacagaaaaaagaagacctcagtcaattctctactttttttttttttttccaaatcagataatagcccagcaaatagtgataacaaataaaaccttagctattcatgtcttgatttcaataattaattcttaatcattaagagaccataataaatactccttttcaagagaaaagcaaaaccattagaattgttactcagctccttcaaactcaggtttgtagcatacatgagtccatccatcagtcaaagaatggttccatctggagtcttaatgtagaaagaaaaatggagacttgtaataatgagctagttacaaagtgcttgttcattaaaatagcactgaaaattgaaacatgaattaactgataatattccaatcatttgccatttatgacaaaaatggttggcactaacaaagaacgagcacttcctttcagagtttctgagataatgtacgtggaacagtctgggtggaatggggctgaaaccatgtgcaagtctgtgtcttgtcagtccaagaagtgacaccgagatgttaattttagggacccgtgccttgtttcctagcccacaagaatgcaaacatcaaacagatactcgctagcctcatttaaattgattaaaggaggagtgcatctttggccgacagtggtgtaactgtatgtgtgtgtgtgtgtgtgtgtgtgtgtgtgggtgtatgtgtgttttgtgcataactatttaaggaaactggaattttaaagttacttttatacaaaccaagaatatatgctacagatataagacagacatggtttggtcctatatttctagtcatgatgaatgtattttgtataccatcttcatataataaacttccaaaaacacaaaaaaaaaaac

SEQ ID NO: 343390 - DNA, 2564 bp, Homo sapiens
atcgaggtccgcgggaggctcggagcgcgccaggcggacactcctctcggctcctccccggcagcggcggcggctcggagcgggctccggggctcgggtgcagcggccagcgggcgcctggcggcgaggattacccggggaagtggttgtctcctggctggagccgcgagacgggcgctcagggcgcggggccggcggcggcgaacgagaggacggactctggcggccgggtcgttggccgcggggagcgcgggcaccgggcgagcaggccgcgtcgcgctcaccatggtcagctactgggacaccggggtcctgctgtgcgcgctgctcagctgtctgcttctcacaggatctagttcaggttcaaaattaaaagatcctgaactgagtttaaaaggcacccagcacatcatgcaagcaggccagacactgcatctccaatgcaggggggaagcagcccataaatggtctttgcctgaaatggtgagtaaggaaagcgaaaggctgagcataactaaatctgcctgtggaagaaatggcaaacaattctgcagtactttaaccttgaacacagctcaagcaaaccacactggcttctacagctgcaaatatctagctgtacctacttcaaagaagaaggaaacagaatctgcaatctatatatttattagtgatacaggtagacctttcgtagagatgtacagtgaaatccccgaaattatacacatgactgaaggaagggagctcgtcattccctgccgggttacgtcacctaacatcactgttactttaaaaaagtttccacttgacactttgatccctgatggaaaacgcataatctgggacagtagaaagggcttcatcatatcaaatgcaacgtacaaagaaatagggcttctgacctgtgaagcaacagtcaatgggcatttgtataagacaaactatctcacacatcgacaaaccaatacaatcatagatgtccaaataagcacaccacgcccagtcaaattacttagaggccatactcttgtcctcaattgtactgctaccactcccttgaacacgagagttcaaatgacctggagttaccctgatgaaaaaaataagagagcttccgtaaggcgacgaattgaccaaagcaattcccatgccaacatattctacagtgttcttactattgacaaaatgcagaacaaagacaaaggactttatacttgtcgtgtaaggagtggaccatcattcaaatctgttaacacctcagtgcatatatatgataaagcattcatcactgtgaaacatcgaaaacagcaggtgcttgaaaccgtagctggcaagcggtcttaccggctctctatgaaagtgaaggcatttccctcgccggaagttgtatggttaaaagatgggttacctgcgactgagaaatctgctcgctatttgactcgtggctactcgttaattatcaaggacgtaactgaagaggatgcagggaattatacaatcttgctgagcataaaacagtcaaatgtgtttaaaaacctcactgccactctaattgtcaatgtgaaaccccagatttacgaaaaggccgtgtcatcgtttccagacccggctctctacccactgggcagcagacaaatcctgacttgtaccgcatatggtatccctcaacctacaatcaagtggttctggcacccctgtaaccataatcattccgaagcaaggtgtgacttttgttccaataatgaagagtcctttatcctggatgctgacagcaacatgggaaacagaattgagagcatcactcagcgcatggcaataatagaaggaaagaataagatggctagcaccttggttgtggctgactctagaatttctggaatctacatttgcatagcttccaataaagttgggactgtgggaagaaacataagcttttatatcacagatgtgccaaatgggtttcatgttaacttggaaaaaatgccgacggaaggagaggacctgaaactgtcttgcacagttaacaagttcttatacagagacgttacttggattttactgcggacagttaataacagaacaatgcactacagtattagcaagcaaaaaatggccatcactaaggagcactccatcactcttaatcttaccatcatgaatgtttccctgcaagattcaggcacctatgcctgcagagccaggaatgtatacacaggggaagaaatcctccagaagaaagaaattacaatcagagatcaggaagcaccatacctcctgcgaaacctcagtgatcacacagtggccatcagcagttccaccactttagactgtcatgctaatggtgtccccgagcctcagatcacttggtttaaaaacaaccacaaaatacaacaagagcctgaccaggcttcagtgcctgaccaggcttcagtgcctgaccaggcttcagtgcctgaccaggcttcagtgcctgaccaggcttcagtgcctgaccaggcttcagtgcctgaccaggcttcagtgcgaccaggcttcagtgcctgaccaggcttcagtgcctgacc

SEQ ID NO: 343391 - DNA, 1921 bp, Homo sapiens
atcgaggtccgcgggaggctcggagcgcgccaggcggacactcctctcggctcctccccggcagcggcggcggctcggagcgggctccggggctcgggtgcagcggccagcgggcgcctggcggcgaggattacccggggaagtggttgtctcctggctggagccgcgagacgggcgctcagggcgcggggccggcggcggcgaacgagaggacggactctggcggccgggtcgttggccgcggggagcgcgggcaccgggcgagcaggccgcgtcgcgctcaccatggtcagctactgggacaccggggtcctgctgtgcgcgctgctcagctgtctgcttctcacaggatctagttcaggttcaaaattaaaagatcctgaactgagtttaaaaggcacccagcacatcatgcaagcaggccagacactgcatctccaatgcaggggggaagcagcccataaatggtctttgcctgaaatggtgagtaaggaaagcgaaaggctgagcataactaaatctgcctgtggaagaaatggcaaacaattctgcagtactttaaccttgaacacagctcaagcaaaccacactggcttctacagctgcaaatatctagctgtacctacttcaaagaagaaggaaacagaatctgcaatctatatatttattagtgatacaggtagacctttcgtagagatgtacagtgaaatccccgaaattatacacatgactgaaggaagggagctcgtcattccctgccgggttacgtcacctaacatcactgttactttaaaaaagtttccacttgacactttgatccctgatggaaaacgcataatctgggacagtagaaagggcttcatcatatcaaatgcaacgtacaaagaaatagggcttctgacctgtgaagcaacagtcaatgggcatttgtataagacaaactatctcacacatcgacaaaccaatacaatcatagatgtccaaataagcacaccacgcccagtcaaattacttagaggccatactcttgtcctcaattgtactgctaccactcccttgaacacgagagttcaaatgacctggagttaccctgatgaaaaaaataagagagcttccgtaaggcgacgaattgaccaaagcaattcccatgccaacatattctacagtgttcttactattgacaaaatgcagaacaaagacaaaggactttatacttgtcgtgtaaggagtggaccatcattcaaatctgttaacacctcagtgcatatatatgataaagcattcatcactgtgaaacatcgaaaacagcaggtgcttgaaaccgtagctggcaagcggtcttaccggctctctatgaaagtgaaggcatttccctcgccggaagttgtatggttaaaagatgggttacctgcgactgagaaatctgctcgctatttgactcgtggctactcgttaattatcaaggacgtaactgaagaggatgcagggaattatacaatcttgctgagcataaaacagtcaaatgtgtttaaaaacctcactgccactctaattgtcaatgtgaaaccccagatttacgaaaaggccgtgtcatcgtttccagacccggctctctacccactgggcagcagacaaatcctgacttgtaccgcatatggtatccctcaacctacaatcaagtggttctggcacccctgtaaccataatcattccgaagcaaggtgtgacttttgttccaataatgaagagtcctttatcctggatgctgacagcaacatgggaaacagaattgagagcatcactcagcgcatggcaataatagaaggaaagaataagttatagaatcagcggcctatcaccagtgttgcaggctgactgtagaacttttaggaattcaccataccatagacgtgtcctagta

SEQ ID NO: 343392 - DNA, 1462 bp, Homo sapiens
atcacaatgggagaagctaaccagtatagcctggcaaacaagaggactaccagggcgacagcagcactctgttggcctctcccatgctgaagcgcttcacctggactgacagcaaacccaaggcctcgctcaagattgacttgagagtaaccagtaaaagtaaggagtcggggctgtctgatgtcagcaggcccagtttctgccattccagctgtgggcacgtcagcgaagttagttgtgaaagaaagctgagaagaatgaaaatgcagtcctgaggagaggagttttctccatatcaaaacgagggctgatggaggaaaaaggctctctgtatgaagagatgggaccgtcatcagcacattccctagtgagcctactggctcctggcagcggcttttgtggaagactcactagccagaagagaggagtgggacagtcctctccaccaagatctaaatccaaacaaaagcaggctagagccagaagagaggacaaatctttgttcttcctcttctttacatacgcaaaccacctgtgacagctggcaattttataaatcaggtaactggaaggaggttaaacacagaaaaaagaagacctcagtcaattctctactttttttttttttttccaaatcagataatagcccagcaaatagtgataacaaataaaaccttagctattcatgtcttgatttcaataattaattcttaatcattaagagaccataataaatactccttttcaagagaaaagcaaaaccattagaattgttactcagctccttcaaactcaggtttgtagcatacatgagtccatccatcagtcaaagaatggttccatctggagtcttaatgtagaaagaaaaatggagacttgtaataatgagctagttacaaagtgcttgttcattaaaatagcactgaaaattgaaacatgaattaactgataatattccaatcatttgccatttatgacaaaaatggttggcactaacaaagaacgagcacttcctttcagagtttctgagataatgtacgtggaacagtctgggtggaatggggctgaaaccatgtgcaagtctgtgtcttgtcagtccaagaagtgacaccgagatgttaattttagggacccgtgccttgtttcctagcccacaagaatgcaaacatcaaacagatactcgctagcctcatttaaattgattaaaggaggagtgcatctttggccgacagtggtgtaactgtatgtgtgtgtgtgtgtgtgtgtgtgtgtgtgggtgtatgtgtgttttgtgcataactatttaaggaaactggaattttaaagttacttttatacaaaccaagaatatatgctacagatataagacagacatggtttggtcctatatttctagtcatgatgaatgtattttgtataccatcttcatataataaacttccaaaaacacaaaaaaaaaaac

SEQ ID NO: 343393 - DNA, 420 bp, Homo sapiens
ggagacccgtctcttcaaaaaaaacaaaagctcactaacccaaaggatgagtctctaatgatgggacttctttagttacttgtggggagaaggcaaggacccttcagacgacaccccttcctctgaccacacaggcagaagtagccataggaatagcctgtgagcaccaggtgccccgcaccatgtgaccacccaaccaagcgggtgtccttagcaaggatttgctgagcttctctgtgtgttgtacggtatgttgagatctgttgtaatccctgggaatttattactaaaacgtagctttaaagggaggaaagaaacactgaattgtcccctcttggtcttttgtacccttaagccataacaggccctgtgttttccacattgtctcccgcaggtgggtctccatacccaggagtacaa

SEQ ID NO: 343394 - DNA, 363 bp, Homo sapiens
ctgatggtgattgttgaatactgcaaatatggaaatctctccaactacctcaagagcaaacgtgacttattttttctcaacaaggtaaggatttcaaaagttggaggtttttaaagatagcaatgagttttcatttagtctgtaacaacataaagcaagagaaacctgtattgtgttgttaatgattaaacttaaaactcaatctctgcttcttctccttttttcatgttttttcccctgataatctgttacactctagtgtggatagcacagagaatcatttgatccctgtgtgcgtatgcagccataattggagagtaaatctactagccacttatctaaatatctaacaataactttctc

SEQ ID NO: 343395 - DNA, 555 bp, Homo sapiens
atgccaacatattctacagtgttcttactattgacaaaatgcagaacaaagacaaaggactttatacttgtcgtgtaaggagtggaccatcattcaaatctgttaacacctcagtgcatatatatggtaagcatagttcagcgttgccaactcatgctatgctttctaatcattgtagatgtctgtgttctctaaataagtcagttttctgttggccaagagttacattatcatgaatgaatacagcttggccatggttccctcctccccctgtcaaaaagcaaaccacattaagtactctttacatttaatacttttgaattgaacagagagtcctttctttagatgcttattatggctaataattcggttagaacctaatatatttatgaaattcttagtgttctgtataaacaaaacagaaaaagatgatgagttttatctttattatctaagaaaaatttctcaggtactaccatgaattagagaaataaaaatatggtatgctaaatcatttagaattaatgctattttattcctgcttttactctcaag

SEQ ID NO: 343396 - DNA, 445 bp, Homo sapiens
tttttccgtgtttgaatgttacttccactaaaaactaaaatctagatactaaattttctaatttatgcatttttatttaatattaacatttacaacgaaaaggatgtatggtgacacactagtgtggggcttttttcaagtatcagccaaatatatttgctatttttaagttttgaggatgaatataggaaaaaatctaaggaaaagaagatcacacataaaatttgtgactttgttatctgaggacttacaccaagttttcatttcacctgtccccattgactgaaccatgctgtaaagccacattgtgacaacttttttttttaataggtgtgacttttgttccaataatgaagagtcctttatcctggatgctgacagcaacatgggaaacagaattgagagcatcactcagcgcatggcaataatagaaggaaagaataag

SEQ ID NO: 343397 - DNA, 794 bp, Homo sapiens
cttgagagtttttactaagttattgcatatttgaatattataactagttatatattttaatataatttcattgaacctatatgaatccattaccattctacataaataggcttttggatgttatttaggtcatttggtataaaaggatatataatatttatgagcaagggtagagctagaaaaaatttgtgaattaagagaaatttgtattagtgtatcttttgcttataaattaaagatacaagtaaattaaagatgtaaataaattaaaaatgaaaaactcaccttcatggaaagataacttaaaaaaaggtaagaagacaatttacaaataatacattttaaaaatttgtttttcaggatctagttcaggttcaaaattaaaagatcctgaactgagtttaaaaggcacccagcacatcatgcaagcaggccagacactgcatctccaatgcaggtaagtggctgtgttggtttgggaataatctagttgccatgcctaaggcaaaatcattccctggcagagtaaaaaggtagggacctcagtgatctcctgtgatctgcaaagtgcaaaccataggcatccagcttcccatgaaaggggattcatggggaagggagagcattactcactcagggaaatgggggaagggatgcccaaatagttctgcatctttattctgagtattgttctacagcttttctgaatgtgttgctttcccgtaaagaggaagatgactacacttaagagaggacctccgcttcctaataaaatgaatgctgaggaactggtg

SEQ ID NO: 343398 - DNA, 3800 bp, Homo sapiens
atcgaggtccgcgggaggctcggagcgcgccaggcggacactcctctcggctcctccccggcagcggcggcggctcggagcgggctccggggctcgggtgcagcggccagcgggcgcctggcggcgaggattacccggggaagtggttgtctcctggctggagccgcgagacgggcgctcagggcgcggggccggcggcggcgaacgagaggacggactctggcggccgggtcgttggccgcggggagcgcgggcaccgggcgagcaggccgcgtcgcgctcaccatggtcagctactgggacaccggggtcctgctgtgcgcgctgctcagctgtctgcttctcacaggatctagttcaggttcaaaattaaaagatcctgaactgagtttaaaaggcacccagcacatcatgcaagcaggccagacactgcatctccaatgcaggggggaagcagcccataaatggtctttgcctgaaatggtgagtaaggaaagcgaaaggctgagcataactaaatctgcctgtggaagaaatggcaaacaattctgcagtactttaaccttgaacacagctcaagcaaaccacactggcttctacagctgcaaatatctagctgtacctacttcaaagaagaaggaaacagaatctgcaatctatatatttattagtgatacaggtagacctttcgtagagatgtacagtgaaatccccgaaattatacacatgactgaaggaagggagctcgtcattccctgccgggttacgtcacctaacatcactgttactttaaaaaagtttccacttgacactttgatccctgatggaaaacgcataatctgggacagtagaaagggcttcatcatatcaaatgcaacgtacaaagaaatagggcttctgacctgtgaagcaacagtcaatgggcatttgtataagacaaactatctcacacatcgacaaaccaatacaatcatagatgtccaaataagcacaccacgcccagtcaaattacttagaggccatactcttgtcctcaattgtactgctaccactcccttgaacacgagagttcaaatgacctggagttaccctgatgaaaaaaataagagagcttccgtaaggcgacgaattgaccaaagcaattcccatgccaacatattctacagtgttcttactattgacaaaatgcagaacaaagacaaaggactttatacttgtcgtgtaaggagtggaccatcattcaaatctgttaacacctcagtgcatatatatgataaagcattcatcactgtgaaacatcgaaaacagcaggtgcttgaaaccgtagctggcaagcggtcttaccggctctctatgaaagtgaaggcatttccctcgccggaagttgtatggttaaaagatgggttacctgcgactgagaaatctgctcgctatttgactcgtggctactcgttaattatcaaggacgtaactgaagaggatgcagggaattatacaatcttgctgagcataaaacagtcaaatgtgtttaaaaacctcactgccactctaattgtcaatgtgaaaccccagatttacgaaaaggccgtgtcatcgtttccagacccggctctctacccactgggcagcagacaaatcctgacttgtaccgcatatggtatccctcaacctacaatcaagtggttctggcacccctgtaaccataatcattccgaagcaaggtgtgacttttgttccaataatgaagagtcctttatcctggatgctgacagcaacatgggaaacagaattgagagcatcactcagcgcatggcaataatagaaggaaagaataagatggctagcaccttggttgtggctgactctagaatttctggaatctacatttgcatagcttccaataaagttgggactgtgggaagaaacataagcttttatatcacagatgtgccaaatgggtttcatgttaacttggaaaaaatgccgacggaaggagaggacctgaaactgtcttgcacagttaacaagttcttatacagagacgttacttggattttactgcggacagttaataacagaacaatgcactacagtattagcaagcaaaaaatggccatcactaaggagcactccatcactcttaatcttaccatcatgaatgtttccctgcaagattcaggcacctatgcctgcagagccaggaatgtatacacaggggaagaaatcctccagaagaaagaaattacaatcagaggtgagcactgcaacaaaaaggctgttttctctcggatctccaaatttaaaagcacaaggaatgattgtaccacacaaagtaatgtaaaacattaaaggactcattaaaaagtaacagttgtctcatatcatcttgatttattgtcactgttgctaactttcaggctcggaggagatgctcctcccaaaatgagttcggagatgatagcagtaataatgagacccccgggccccagctctgggccccccattcaggccgagggggctgctccggggggccgacttggtgcacgtttggatttggaggatccctgcactgccttctctgtgtttgttgctcttgctgttttctcctgcctgataaacaacaacttgggatgatcctttccttccattttgatgccaacctctttttatttttaagtgttgaagctgcacaaactgaataatttaaacaaatgctggtttctgccaaagatggacacgaataagttaattttccagctcagaatgagtacagttgaatttgagactctgtcggacttctgcctggttttatttgggactatttcatctgctcttgatttgtaaatagcacctggatagcaagttataatgcttatttatttgaaaatgctttttttttttttacgttaagcacatttatcttgaactggagcttctaaaatgggccccaggggtgcaagatgttggtgtaattcagagatagtaaaggtttatcgcagtgtgaattataagagtccatccaaatcaacgtcccctccctcctctcatgcgatccaggtaattatgcagttagtgccacagtagactagcctagcaaagggtttgctccttgctgtctctgactgcaccacacagctattgatggcagctgaaagaaagtggatcatgccttaattttaaatattcctgtcctctggttattattttaaggaacttcatcatgttaaaatgacagcattcaaaggtgtaccacaatcaatttatcaaggaaataaaggctattgtaaccagagatttaatgcattcttctaaatgtaaatttaaaatttgccctttaaaaaagtccactttccccatatggcaaatgttaataggatttttatgggggattaaggaagcgggcaaaactacagaaggcaggatttcaaaggtaatttaaaaaatacacacccgtttaaatcaagagaagttgtaatctcttgttttaagcttgcgtttgagggaaaatgactttttcaccaatttagtatgcattgttctgttgtttttatttatgattgatcattatatgtgacttgcataaactatttaaaaaaaaaaactattaatgacccaaaatagccatggctgagaaacacagtggctgggcagttcaataggaggtgacaatatgacaacttctcaagcttgggaactcaccagactgtttcctcctttaggtaacagattctgtcccacggctaaacttgtctttcacgtgggaattgcttttgtcaaacgtgaaagagtaaacaatagca

SEQ ID NO: 343399 - DNA, 7128 bp, Homo sapiens
  misc_feature (3489)..(3489): n is a, c, g, or t
atcgaggtccgcgggaggctcggagcgcgccaggcggacactcctctcggctcctccccggcagcggcggcggctcggagcgggctccggggctcgggtgcagcggccagcgggcgcctggcggcgaggattacccggggaagtggttgtctcctggctggagccgcgagacgggcgctcagggcgcggggccggcggcggcgaacgagaggacggactctggcggccgggtcgttggccgcggggagcgcgggcaccgggcgagcaggccgcgtcgcgctcaccatggtcagctactgggacaccggggtcctgctgtgcgcgctgctcagctgtctgcttctcacaggatctagttcaggttcaaaattaaaagatcctgaactgagtttaaaaggcacccagcacatcatgcaagcaggccagacactgcatctccaatgcaggggggaagcagcccataaatggtctttgcctgaaatggtgagtaaggaaagcgaaaggctgagcataactaaatctgcctgtggaagaaatggcaaacaattctgcagtactttaaccttgaacacagctcaagcaaaccacactggcttctacagctgcaaatatctagctgtacctacttcaaagaagaaggaaacagaatctgcaatctatatatttattagtgatacaggtagacctttcgtagagatgtacagtgaaatccccgaaattatacacatgactgaaggaagggagctcgtcattccctgccgggttacgtcacctaacatcactgttactttaaaaaagtttccacttgacactttgatccctgatggaaaacgcataatctgggacagtagaaagggcttcatcatatcaaatgcaacgtacaaagaaatagggcttctgacctgtgaagcaacagtcaatgggcatttgtataagacaaactatctcacacatcgacaaaccaatacaatcatagatgtccaaataagcacaccacgcccagtcaaattacttagaggccatactcttgtcctcaattgtactgctaccactcccttgaacacgagagttcaaatgacctggagttaccctgatgaaaaaaataagagagcttccgtaaggcgacgaattgaccaaagcaattcccatgccaacatattctacagtgttcttactattgacaaaatgcagaacaaagacaaaggactttatacttgtcgtgtaaggagtggaccatcattcaaatctgttaacacctcagtgcatatatatgataaagcattcatcactgtgaaacatcgaaaacagcaggtgcttgaaaccgtagctggcaagcggtcttaccggctctctatgaaagtgaaggcatttccctcgccggaagttgtatggttaaaagatgggttacctgcgactgagaaatctgctcgctatttgactcgtggctactcgttaattatcaaggacgtaactgaagaggatgcagggaattatacaatcttgctgagcataaaacagtcaaatgtgtttaaaaacctcactgccactctaattgtcaatgtgaaaccccagatttacgaaaaggccgtgtcatcgtttccagacccggctctctacccactgggcagcagacaaatcctgacttgtaccgcatatggtatccctcaacctacaatcaagtggttctggcacccctgtaaccataatcattccgaagcaaggtgtgacttttgttccaataatgaagagtcctttatcctggatgctgacagcaacatgggaaacagaattgagagcatcactcagcgcatggcaataatagaaggaaagaataagatggctagcaccttggttgtggctgactctagaatttctggaatctacatttgcatagcttccaataaagttgggactgtgggaagaaacataagcttttatatcacagatgtgccaaatgggtttcatgttaacttggaaaaaatgccgacggaaggagaggacctgaaactgtcttgcacagttaacaagttcttatacagagacgttacttggattttactgcggacagttaataacagaacaatgcactacagtattagcaagcaaaaaatggccatcactaaggagcactccatcactcttaatcttaccatcatgaatgtttccctgcaagattcaggcacctatgcctgcagagccaggaatgtatacacaggggaagaaatcctccagaagaaagaaattacaatcagagatcaggaagcaccatacctcctgcgaaacctcagtgatcacacagtggccatcagcagttccaccactttagactgtcatgctaatggtgtccccgagcctcagatcacttggtttaaaaacaaccacaaaatacaacaagagcctggaattattttaggaccaggaagcagcacgctgtttattgaaagagtcacagaagaggatgaaggtgtctatcactgcaaagccaccaaccagaagggctctgtggaaagttcagcatacctcactgttcaaggaacctcggacaagtctaatctggagctgatcactctaacatgcacctgtgtggctgcgactctcttctggctcctattaaccctctttatccgaaaaatgaaaaggtcttcttctgaaataaagactgactacctatcaattataatggacccagatgaagttcctttggatgagcagtgtgagcggctcccttatgatgccagcaagtgggagtttgcccgggagagacttaaactgggcaaatcacttggaagaggggcttttggaaaagtggttcaagcatcagcatttggcattaagaaatcacctacgtgccggactgtggctgtgaaaatgctgaaagagggggccacggccagcgagtacaaagctctgatgactgagctaaaaatcttgacccacattggccaccatctgaacgtggttaacctgctgggagcctgcaccaagcaaggagggcctctgatggtgattgttgaatactgcaaatatggaaatctctccaactacctcaagagcaaacgtgacttattttttctcaacaaggatgcagcactacacatggagcctaagaaagaaaaaatggagccaggcctggaacaaggcaagaaaccaagactagatagcgtcaccagcagcgaaagctttgcgagctccggctttcaggaagataaaagtctgagtgatgttgaggaagaggaggattctgacggtttctacaaggagcccatcactatggaagatctgatttcttacagttttcaagtggccagaggcatggagttcctgtcttccagaaagtgcattcatcgggacctggcagcgagaaacattcttttatctgagaacaacgtggtgaagatttgtgattttggccttgcccgggatatttataagaaccccgattatgtgagaaaaggagatactcgacttcctctgaaatggatggctccngaatctatctttgacaaaatctacagcaccaagagcgacgtgtggtcttacggagtattgctgtgggaaatcttctccttaggtgggtctccatacccaggagtacaaatggatgaggacttttgcagtcgcctgagggaaggcatgaggatgagagctcctgagtactctactcctgaaatctatcagatcatgctggactgctggcacagagacccaaaagaaaggccaagatttgcagaacttgtggaaaaactaggtgatttgcttcaagcaaatgtacaacaggatggtaaagactacatcccaatcaatgccatactgacaggaaatagtgggtttacatactcaactcctgccttctctgaggacttcttcaaggaaagtatttcagctccgaagtttaattcaggaagctctgatgatgtcagatatgtaaatgctttcaagttcatgagcctggaaagaatcaaaacctttgaagaacttttaccgaatgccacctccatgtttgatgactaccagggcgacagcagcactctgttggcctctcccatgctgaagcgcttcacctggactgacagcaaacccaaggcctcgctcaagattgacttgagagtaaccagtaaaagtaaggagtcggggctgtctgatgtcagcaggcccagtttctgccattccagctgtgggcacgtcagcgaaggcaagcgcaggttcacctacgaccacgctgagctggaaaggaaaatcgcgtgctgctccccgcccccagactacaactcggtggtcctgtactccaccccacccatctagagtttgacacgaagccttatttctagaagcacatgtgtatttatacccccaggaaactagcttttgccagtattatgcatatataagtttacacctttatctttccatgggagccagctgctttttgtgatttttttaatagtgctttttttttttgactaacaagaatgtaactccagatagagaaatagtgacaagtgaagaacactactgctaaatcctcatgttactcagtgttagagaaatccttcctaaacccaatgacttccctgctccaacccccgccacctcagggcacgcaggaccagtttgattgaggagctgcactgatcacccaatgcatcacgtaccccactgggccagccctgcagcccaaaacccagggcaacaagcccgttagccccagggatcactggctggcctgagcaacatctcgggagtcctctagcaggcctaagacatgtgaggaggaaaaggaaaaaaagcaaaaagcaagggagaaaagagaaaccgggagaaggcatgagaaagaatttgagacgcaccatgtgggcacggagggggacggggctcagcaatgccatttcagtggcttcccagctctgacccttctacatttgagggcccagccaggagcagatggacagcgatgaggggacattttctggattctgggaggcaagaaaaggacaaatatcttttttggaactaaagcaaattttagaactttacctatggaagtggttctatgtccattctcattcgtggcatgttttgatttgtagcactgagggtggcactcaactctgagcccatacttttggctcctctagtaagatgcactgaaaacttagccagagttaggttgtctccaggccatgatggccttacactgaaaatgtcacattctattttgggtattaatatatagtccagacacttaactcaatttcttggtattattctgttttgcacagttagttgtgaaagaaagctgagaagaatgaaaatgcagtcctgaggagaggagttttctccatatcaaaacgagggctgatggaggaaaaaggtcaataaggtcaagggaaaaccccgtctctataccaaccaaaccaattcaccaacacagttgggacccaaaacacaggaagtcagtcacgtttccttttcatttaatggggattccactatctcacactaatctgaaaggatgtggaagagcattagctggcgcatattaagcactttaagctccttgagtaaaaaggtggtatgtaatttatgcaaggtatttctccagttgggactcaggatattagttaatgagccatcactagaagaaaagcccattttcaactgctttgaaacttgcctggggtctgagcatgatgggaatagggagacagggtaggaaagggcgcctactcttcagggtctaaagatcaagtgggccttggatcgctaagctggctctgtttgatgctatttatgcaagttagggtctatgtatttaggatgtctgcaccttctgcagccagtcagaagctggagaggcaacagtggattgctgcttcttggggagaagagtatgcttccttttatccatgtaatttaactgtagaacctgagctctaagtaaccgaagaatgtatgcctctgttcttatgtgccacatccttgtttaaaggctctctgtatgaagagatgggaccgtcatcagcacattccctagtgagcctactggctcctggcagcggcttttgtggaagactcactagccagaagagaggagtgggacagtcctctccaccaagatctaaatccaaacaaaagcaggctagagccagaagagaggacaaatctttgttcttcctcttctttacatacgcaaaccacctgtgacagctggcaattttataaatcaggtaactggaaggaggttaaacacagaaaaaagaagacctcagtcaattctctactttttttttttttttccaaatcagataatagcccagcaaatagtgataacaaataaaaccttagctattcatgtcttgatttcaataattaattcttaatcattaagagaccataataaatactccttttcaagagaaaagcaaaaccattagaattgttactcagctccttcaaactcaggtttgtagcatacatgagtccatccatcagtcaaagaatggttccatctggagtcttaatgtagaaagaaaaatggagacttgtaataatgagctagttacaaagtgcttgttcattaaaatagcactgaaaattgaaacatgaattaactgataatattccaatcatttgccatttatgacaaaaatggttggcactaacaaagaacgagcacttcctttcagagtttctgagataatgtacgtggaacagtctgggtggaatggggctgaaaccatgtgcaagtctgtgtcttgtcagtccaagaagtgacaccgagatgttaattttagggacccgtgccttgtttcctagcccacaagaatgcaaacatcaaacagatactcgctagcctcatttaaattgattaaaggaggagtgcatctttggccgacagtggtgtaactgtatgtgtgtgtgtgtgtgtgtgtgtgtgtgtgggtgtatgtgtgttttgtgcataactatttaaggaaactggaattttaaagttacttttatacaaaccaagaatatatgctacagatataagacagacatggtttggtcctatatttctagtcatgatgaatgtattttgtataccatcttcatataataaacttccaaaaacacaaaaaaaaaaac

SEQ ID NO: 343400 - DNA, 7213 bp, Homo sapiens
  misc_feature (1849)..(1849): n is a, c, g, or t
  misc_feature (3574)..(3574): n is a, c, g, or t
atcgaggtccgcgggaggctcggagcgcgccaggcggacactcctctcggctcctccccggcagcggcggcggctcggagcgggctccggggctcgggtgcagcggccagcgggcgcctggcggcgaggattacccggggaagtggttgtctcctggctggagccgcgagacgggcgctcagggcgcggggccggcggcggcgaacgagaggacggactctggcggccgggtcgttggccgcggggagcgcgggcaccgggcgagcaggccgcgtcgcgctcaccatggtcagctactgggacaccggggtcctgctgtgcgcgctgctcagctgtctgcttctcacaggatctagttcaggttcaaaattaaaagatcctgaactgagtttaaaaggcacccagcacatcatgcaagcaggccagacactgcatctccaatgcaggggggaagcagcccataaatggtctttgcctgaaatggtgagtaaggaaagcgaaaggctgagcataactaaatctgcctgtggaagaaatggcaaacaattctgcagtactttaaccttgaacacagctcaagcaaaccacactggcttctacagctgcaaatatctagctgtacctacttcaaagaagaaggaaacagaatctgcaatctatatatttattagtgatacaggtagacctttcgtagagatgtacagtgaaatccccgaaattatacacatgactgaaggaagggagctcgtcattccctgccgggttacgtcacctaacatcactgttactttaaaaaagtttccacttgacactttgatccctgatggaaaacgcataatctgggacagtagaaagggcttcatcatatcaaatgcaacgtacaaagaaatagggcttctgacctgtgaagcaacagtcaatgggcatttgtataagacaaactatctcacacatcgacaaaccaatacaatcatagatgtccaaataagcacaccacgcccagtcaaattacttagaggccatactcttgtcctcaattgtactgctaccactcccttgaacacgagagttcaaatgacctggagttaccctgatgaaaaaaataagagagcttccgtaaggcgacgaattgaccaaagcaattcccatgccaacatattctacagtgttcttactattgacaaaatgcagaacaaagacaaaggactttatacttgtcgtgtaaggagtggaccatcattcaaatctgttaacacctcagtgcatatatatgataaagcattcatcactgtgaaacatcgaaaacagcaggtgcttgaaaccgtagctggcaagcggtcttaccggctctctatgaaagtgaaggcatttccctcgccggaagttgtatggttaaaagatgggttacctgcgactgagaaatctgctcgctatttgactcgtggctactcgttaattatcaaggacgtaactgaagaggatgcagggaattatacaatcttgctgagcataaaacagtcaaatgtgtttaaaaacctcactgccactctaattgtcaatgtgaaaccccagatttacgaaaaggccgtgtcatcgtttccagacccggctctctacccactgggcagcagacaaatcctgacttgtaccgcatatggtatccctcaacctacaatcaagtggttctggcacccctgtaaccataatcattccgaagcaaggtgtgacttttgttccaataatgaagagtcctttatcctggatgctgacagcaacatgggaaacagaattgagagcatcactcagcgcatggcaataatagaaggaaagaataagcttccaccagctnacagttctttcatgttgccacctacaagcttctcttccaactacttccatttccttccgtgactctaaacggatggctagcaccttggttgtggctgactctagaatttctggaatctacatttgcatagcttccaataaagttgggactgtgggaagaaacataagcttttatatcacagatgtgccaaatgggtttcatgttaacttggaaaaaatgccgacggaaggagaggacctgaaactgtcttgcacagttaacaagttcttatacagagacgttacttggattttactgcggacagttaataacagaacaatgcactacagtattagcaagcaaaaaatggccatcactaaggagcactccatcactcttaatcttaccatcatgaatgtttccctgcaagattcaggcacctatgcctgcagagccaggaatgtatacacaggggaagaaatcctccagaagaaagaaattacaatcagagatcaggaagcaccatacctcctgcgaaacctcagtgatcacacagtggccatcagcagttccaccactttagactgtcatgctaatggtgtccccgagcctcagatcacttggtttaaaaacaaccacaaaatacaacaagagcctggaattattttaggaccaggaagcagcacgctgtttattgaaagagtcacagaagaggatgaaggtgtctatcactgcaaagccaccaaccagaagggctctgtggaaagttcagcatacctcactgttcaaggaacctcggacaagtctaatctggagctgatcactctaacatgcacctgtgtggctgcgactctcttctggctcctattaaccctctttatccgaaaaatgaaaaggtcttcttctgaaataaagactgactacctatcaattataatggacccagatgaagttcctttggatgagcagtgtgagcggctcccttatgatgccagcaagtgggagtttgcccgggagagacttaaactgggcaaatcacttggaagaggggcttttggaaaagtggttcaagcatcagcatttggcattaagaaatcacctacgtgccggactgtggctgtgaaaatgctgaaagagggggccacggccagcgagtacaaagctctgatgactgagctaaaaatcttgacccacattggccaccatctgaacgtggttaacctgctgggagcctgcaccaagcaaggagggcctctgatggtgattgttgaatactgcaaatatggaaatctctccaactacctcaagagcaaacgtgacttattttttctcaacaaggatgcagcactacacatggagcctaagaaagaaaaaatggagccaggcctggaacaaggcaagaaaccaagactagatagcgtcaccagcagcgaaagctttgcgagctccggctttcaggaagataaaagtctgagtgatgttgaggaagaggaggattctgacggtttctacaaggagcccatcactatggaagatctgatttcttacagttttcaagtggccagaggcatggagttcctgtcttccagaaagtgcattcatcgggacctggcagcgagaaacattcttttatctgagaacaacgtggtgaagatttgtgattttggccttgcccgggatatttataagaaccccgattatgtgagaaaaggagatactcgacttcctctgaaatggatggctccngaatctatctttgacaaaatctacagcaccaagagcgacgtgtggtcttacggagtattgctgtgggaaatcttctccttaggtgggtctccatacccaggagtacaaatggatgaggacttttgcagtcgcctgagggaaggcatgaggatgagagctcctgagtactctactcctgaaatctatcagatcatgctggactgctggcacagagacccaaaagaaaggccaagatttgcagaacttgtggaaaaactaggtgatttgcttcaagcaaatgtacaacaggatggtaaagactacatcccaatcaatgccatactgacaggaaatagtgggtttacatactcaactcctgccttctctgaggacttcttcaaggaaagtatttcagctccgaagtttaattcaggaagctctgatgatgtcagatatgtaaatgctttcaagttcatgagcctggaaagaatcaaaacctttgaagaacttttaccgaatgccacctccatgtttgatgactaccagggcgacagcagcactctgttggcctctcccatgctgaagcgcttcacctggactgacagcaaacccaaggcctcgctcaagattgacttgagagtaaccagtaaaagtaaggagtcggggctgtctgatgtcagcaggcccagtttctgccattccagctgtgggcacgtcagcgaaggcaagcgcaggttcacctacgaccacgctgagctggaaaggaaaatcgcgtgctgctccccgcccccagactacaactcggtggtcctgtactccaccccacccatctagagtttgacacgaagccttatttctagaagcacatgtgtatttatacccccaggaaactagcttttgccagtattatgcatatataagtttacacctttatctttccatgggagccagctgctttttgtgatttttttaatagtgctttttttttttgactaacaagaatgtaactccagatagagaaatagtgacaagtgaagaacactactgctaaatcctcatgttactcagtgttagagaaatccttcctaaacccaatgacttccctgctccaacccccgccacctcagggcacgcaggaccagtttgattgaggagctgcactgatcacccaatgcatcacgtaccccactgggccagccctgcagcccaaaacccagggcaacaagcccgttagccccagggatcactggctggcctgagcaacatctcgggagtcctctagcaggcctaagacatgtgaggaggaaaaggaaaaaaagcaaaaagcaagggagaaaagagaaaccgggagaaggcatgagaaagaatttgagacgcaccatgtgggcacggagggggacggggctcagcaatgccatttcagtggcttcccagctctgacccttctacatttgagggcccagccaggagcagatggacagcgatgaggggacattttctggattctgggaggcaagaaaaggacaaatatcttttttggaactaaagcaaattttagaactttacctatggaagtggttctatgtccattctcattcgtggcatgttttgatttgtagcactgagggtggcactcaactctgagcccatacttttggctcctctagtaagatgcactgaaaacttagccagagttaggttgtctccaggccatgatggccttacactgaaaatgtcacattctattttgggtattaatatatagtccagacacttaactcaatttcttggtattattctgttttgcacagttagttgtgaaagaaagctgagaagaatgaaaatgcagtcctgaggagaggagttttctccatatcaaaacgagggctgatggaggaaaaaggtcaataaggtcaagggaaaaccccgtctctataccaaccaaaccaattcaccaacacagttgggacccaaaacacaggaagtcagtcacgtttccttttcatttaatggggattccactatctcacactaatctgaaaggatgtggaagagcattagctggcgcatattaagcactttaagctccttgagtaaaaaggtggtatgtaatttatgcaaggtatttctccagttgggactcaggatattagttaatgagccatcactagaagaaaagcccattttcaactgctttgaaacttgcctggggtctgagcatgatgggaatagggagacagggtaggaaagggcgcctactcttcagggtctaaagatcaagtgggccttggatcgctaagctggctctgtttgatgctatttatgcaagttagggtctatgtatttaggatgtctgcaccttctgcagccagtcagaagctggagaggcaacagtggattgctgcttcttggggagaagagtatgcttccttttatccatgtaatttaactgtagaacctgagctctaagtaaccgaagaatgtatgcctctgttcttatgtgccacatccttgtttaaaggctctctgtatgaagagatgggaccgtcatcagcacattccctagtgagcctactggctcctggcagcggcttttgtggaagactcactagccagaagagaggagtgggacagtcctctccaccaagatctaaatccaaacaaaagcaggctagagccagaagagaggacaaatctttgttcttcctcttctttacatacgcaaaccacctgtgacagctggcaattttataaatcaggtaactggaaggaggttaaacacagaaaaaagaagacctcagtcaattctctactttttttttttttttccaaatcagataatagcccagcaaatagtgataacaaataaaaccttagctattcatgtcttgatttcaataattaattcttaatcattaagagaccataataaatactccttttcaagagaaaagcaaaaccattagaattgttactcagctccttcaaactcaggtttgtagcatacatgagtccatccatcagtcaaagaatggttccatctggagtcttaatgtagaaagaaaaatggagacttgtaataatgagctagttacaaagtgcttgttcattaaaatagcactgaaaattgaaacatgaattaactgataatattccaatcatttgccatttatgacaaaaatggttggcactaacaaagaacgagcacttcctttcagagtttctgagataatgtacgtggaacagtctgggtggaatggggctgaaaccatgtgcaagtctgtgtcttgtcagtccaagaagtgacaccgagatgttaattttagggacccgtgccttgtttcctagcccacaagaatgcaaacatcaaacagatactcgctagcctcatttaaattgattaaaggaggagtgcatctttggccgacagtggtgtaactgtatgtgtgtgtgtgtgtgtgtgtgtgtgtgtgggtgtatgtgtgttttgtgcataactatttaaggaaactggaattttaaagttacttttatacaaaccaagaatatatgctacagatataagacagacatggtttggtcctatatttctagtcatgatgaatgtattttgtataccatcttcatataataaacttccaaaaacacaaaaaaaaaaac

SEQ ID NO: 343401 - DNA, 7158 bp, Homo sapiens
  misc_feature (1794)..(1794): n is a, c, g, or t
  misc_feature (3519)..(3519): n is a, c, g, or t
atcgaggtccgcgggaggctcggagcgcgccaggcggacactcctctcggctcctccccggcagcggcggcggctcggagcgggctccggggctcgggtgcagcggccagcgggcgcctggcggcgaggattacccggggaagtggttgtctcctggctggagccgcgagacgggcgctcagggcgcggggccggcggcggcgaacgagaggacggactctggcggccgggtcgttggccgcggggagcgcgggcaccgggcgagcaggccgcgtcgcgctcaccatggtcagctactgggacaccggggtcctgctgtgcgcgctgctcagctgtctgcttctcacaggatctagttcaggttcaaaattaaaagatcctgaactgagtttaaaaggcacccagcacatcatgcaagcaggccagacactgcatctccaatgcaggggggaagcagcccataaatggtctttgcctgaaatggtgagtaaggaaagcgaaaggctgagcataactaaatctgcctgtggaagaaatggcaaacaattctgcagtactttaaccttgaacacagctcaagcaaaccacactggcttctacagctgcaaatatctagctgtacctacttcaaagaagaaggaaacagaatctgcaatctatatatttattagtgatacaggtagacctttcgtagagatgtacagtgaaatccccgaaattatacacatgactgaaggaagggagctcgtcattccctgccgggttacgtcacctaacatcactgttactttaaaaaagtttccacttgacactttgatccctgatggaaaacgcataatctgggacagtagaaagggcttcatcatatcaaatgcaacgtacaaagaaatagggcttctgacctgtgaagcaacagtcaatgggcatttgtataagacaaactatctcacacatcgacaaaccaatacaatcatagatgtccaaataagcacaccacgcccagtcaaattacttagaggccatactcttgtcctcaattgtactgctaccactcccttgaacacgagagttcaaatgacctggagttaccctgatgaaaaaaataagagagcttccgtaaggcgacgaattgaccaaagcaattcccatgccaacatattctacagtgttcttactattgacaaaatgcagaacaaagacaaaggactttatacttgtcgtgtaaggagtggaccatcattcaaatctgttaacacctcagtgcatatatatgataaagcattcatcactgtgaaacatcgaaaacagcaggtgcttgaaaccgtagctggcaagcggtcttaccggctctctatgaaagtgaaggcatttccctcgccggaagttgtatgtactcgttaattatcaaggacgtaactgaagaggatgcagggaattatacaatcttgctgagcataaaacagtcaaatgtgtttaaaaacctcactgccactctaattgtcaatgtgaaaccccagatttacgaaaaggccgtgtcatcgtttccagacccggctctctacccactgggcagcagacaaatcctgacttgtaccgcatatggtatccctcaacctacaatcaagtggttctggcacccctgtaaccataatcattccgaagcaaggtgtgacttttgttccaataatgaagagtcctttatcctggatgctgacagcaacatgggaaacagaattgagagcatcactcagcgcatggcaataatagaaggaaagaataagcttccaccagctnacagttctttcatgttgccacctacaagcttctcttccaactacttccatttccttccgtgactctaaacggatggctagcaccttggttgtggctgactctagaatttctggaatctacatttgcatagcttccaataaagttgggactgtgggaagaaacataagcttttatatcacagatgtgccaaatgggtttcatgttaacttggaaaaaatgccgacggaaggagaggacctgaaactgtcttgcacagttaacaagttcttatacagagacgttacttggattttactgcggacagttaataacagaacaatgcactacagtattagcaagcaaaaaatggccatcactaaggagcactccatcactcttaatcttaccatcatgaatgtttccctgcaagattcaggcacctatgcctgcagagccaggaatgtatacacaggggaagaaatcctccagaagaaagaaattacaatcagagatcaggaagcaccatacctcctgcgaaacctcagtgatcacacagtggccatcagcagttccaccactttagactgtcatgctaatggtgtccccgagcctcagatcacttggtttaaaaacaaccacaaaatacaacaagagcctggaattattttaggaccaggaagcagcacgctgtttattgaaagagtcacagaagaggatgaaggtgtctatcactgcaaagccaccaaccagaagggctctgtggaaagttcagcatacctcactgttcaaggaacctcggacaagtctaatctggagctgatcactctaacatgcacctgtgtggctgcgactctcttctggctcctattaaccctctttatccgaaaaatgaaaaggtcttcttctgaaataaagactgactacctatcaattataatggacccagatgaagttcctttggatgagcagtgtgagcggctcccttatgatgccagcaagtgggagtttgcccgggagagacttaaactgggcaaatcacttggaagaggggcttttggaaaagtggttcaagcatcagcatttggcattaagaaatcacctacgtgccggactgtggctgtgaaaatgctgaaagagggggccacggccagcgagtacaaagctctgatgactgagctaaaaatcttgacccacattggccaccatctgaacgtggttaacctgctgggagcctgcaccaagcaaggagggcctctgatggtgattgttgaatactgcaaatatggaaatctctccaactacctcaagagcaaacgtgacttattttttctcaacaaggatgcagcactacacatggagcctaagaaagaaaaaatggagccaggcctggaacaaggcaagaaaccaagactagatagcgtcaccagcagcgaaagctttgcgagctccggctttcaggaagataaaagtctgagtgatgttgaggaagaggaggattctgacggtttctacaaggagcccatcactatggaagatctgatttcttacagttttcaagtggccagaggcatggagttcctgtcttccagaaagtgcattcatcgggacctggcagcgagaaacattcttttatctgagaacaacgtggtgaagatttgtgattttggccttgcccgggatatttataagaaccccgattatgtgagaaaaggagatactcgacttcctctgaaatggatggctccngaatctatctttgacaaaatctacagcaccaagagcgacgtgtggtcttacggagtattgctgtgggaaatcttctccttaggtgggtctccatacccaggagtacaaatggatgaggacttttgcagtcgcctgagggaaggcatgaggatgagagctcctgagtactctactcctgaaatctatcagatcatgctggactgctggcacagagacccaaaagaaaggccaagatttgcagaacttgtggaaaaactaggtgatttgcttcaagcaaatgtacaacaggatggtaaagactacatcccaatcaatgccatactgacaggaaatagtgggtttacatactcaactcctgccttctctgaggacttcttcaaggaaagtatttcagctccgaagtttaattcaggaagctctgatgatgtcagatatgtaaatgctttcaagttcatgagcctggaaagaatcaaaacctttgaagaacttttaccgaatgccacctccatgtttgatgactaccagggcgacagcagcactctgttggcctctcccatgctgaagcgcttcacctggactgacagcaaacccaaggcctcgctcaagattgacttgagagtaaccagtaaaagtaaggagtcggggctgtctgatgtcagcaggcccagtttctgccattccagctgtgggcacgtcagcgaaggcaagcgcaggttcacctacgaccacgctgagctggaaaggaaaatcgcgtgctgctccccgcccccagactacaactcggtggtcctgtactccaccccacccatctagagtttgacacgaagccttatttctagaagcacatgtgtatttatacccccaggaaactagcttttgccagtattatgcatatataagtttacacctttatctttccatgggagccagctgctttttgtgatttttttaatagtgctttttttttttgactaacaagaatgtaactccagatagagaaatagtgacaagtgaagaacactactgctaaatcctcatgttactcagtgttagagaaatccttcctaaacccaatgacttccctgctccaacccccgccacctcagggcacgcaggaccagtttgattgaggagctgcactgatcacccaatgcatcacgtaccccactgggccagccctgcagcccaaaacccagggcaacaagcccgttagccccagggatcactggctggcctgagcaacatctcgggagtcctctagcaggcctaagacatgtgaggaggaaaaggaaaaaaagcaaaaagcaagggagaaaagagaaaccgggagaaggcatgagaaagaatttgagacgcaccatgtgggcacggagggggacggggctcagcaatgccatttcagtggcttcccagctctgacccttctacatttgagggcccagccaggagcagatggacagcgatgaggggacattttctggattctgggaggcaagaaaaggacaaatatcttttttggaactaaagcaaattttagaactttacctatggaagtggttctatgtccattctcattcgtggcatgttttgatttgtagcactgagggtggcactcaactctgagcccatacttttggctcctctagtaagatgcactgaaaacttagccagagttaggttgtctccaggccatgatggccttacactgaaaatgtcacattctattttgggtattaatatatagtccagacacttaactcaatttcttggtattattctgttttgcacagttagttgtgaaagaaagctgagaagaatgaaaatgcagtcctgaggagaggagttttctccatatcaaaacgagggctgatggaggaaaaaggtcaataaggtcaagggaaaaccccgtctctataccaaccaaaccaattcaccaacacagttgggacccaaaacacaggaagtcagtcacgtttccttttcatttaatggggattccactatctcacactaatctgaaaggatgtggaagagcattagctggcgcatattaagcactttaagctccttgagtaaaaaggtggtatgtaatttatgcaaggtatttctccagttgggactcaggatattagttaatgagccatcactagaagaaaagcccattttcaactgctttgaaacttgcctggggtctgagcatgatgggaatagggagacagggtaggaaagggcgcctactcttcagggtctaaagatcaagtgggccttggatcgctaagctggctctgtttgatgctatttatgcaagttagggtctatgtatttaggatgtctgcaccttctgcagccagtcagaagctggagaggcaacagtggattgctgcttcttggggagaagagtatgcttccttttatccatgtaatttaactgtagaacctgagctctaagtaaccgaagaatgtatgcctctgttcttatgtgccacatccttgtttaaaggctctctgtatgaagagatgggaccgtcatcagcacattccctagtgagcctactggctcctggcagcggcttttgtggaagactcactagccagaagagaggagtgggacagtcctctccaccaagatctaaatccaaacaaaagcaggctagagccagaagagaggacaaatctttgttcttcctcttctttacatacgcaaaccacctgtgacagctggcaattttataaatcaggtaactggaaggaggttaaacacagaaaaaagaagacctcagtcaattctctactttttttttttttttccaaatcagataatagcccagcaaatagtgataacaaataaaaccttagctattcatgtcttgatttcaataattaattcttaatcattaagagaccataataaatactccttttcaagagaaaagcaaaaccattagaattgttactcagctccttcaaactcaggtttgtagcatacatgagtccatccatcagtcaaagaatggttccatctggagtcttaatgtagaaagaaaaatggagacttgtaataatgagctagttacaaagtgcttgttcattaaaatagcactgaaaattgaaacatgaattaactgataatattccaatcatttgccatttatgacaaaaatggttggcactaacaaagaacgagcacttcctttcagagtttctgagataatgtacgtggaacagtctgggtggaatggggctgaaaccatgtgcaagtctgtgtcttgtcagtccaagaagtgacaccgagatgttaattttagggacccgtgccttgtttcctagcccacaagaatgcaaacatcaaacagatactcgctagcctcatttaaattgattaaaggaggagtgcatctttggccgacagtggtgtaactgtatgtgtgtgtgtgtgtgtgtgtgtgtgtgtgggtgtatgtgtgttttgtgcataactatttaaggaaactggaattttaaagttacttttatacaaaccaagaatatatgctacagatataagacagacatggtttggtcctatatttctagtcatgatgaatgtattttgtataccatcttcatataataaacttccaaaaacacaaaaaaaaaaac

SEQ ID NO: 343402 - DNA, 5639 bp, Homo sapiens
  misc_feature (3489)..(3489): n is a, c, g, or t
atcgaggtccgcgggaggctcggagcgcgccaggcggacactcctctcggctcctccccggcagcggcggcggctcggagcgggctccggggctcgggtgcagcggccagcgggcgcctggcggcgaggattacccggggaagtggttgtctcctggctggagccgcgagacgggcgctcagggcgcggggccggcggcggcgaacgagaggacggactctggcggccgggtcgttggccgcggggagcgcgggcaccgggcgagcaggccgcgtcgcgctcaccatggtcagctactgggacaccggggtcctgctgtgcgcgctgctcagctgtctgcttctcacaggatctagttcaggttcaaaattaaaagatcctgaactgagtttaaaaggcacccagcacatcatgcaagcaggccagacactgcatctccaatgcaggggggaagcagcccataaatggtctttgcctgaaatggtgagtaaggaaagcgaaaggctgagcataactaaatctgcctgtggaagaaatggcaaacaattctgcagtactttaaccttgaacacagctcaagcaaaccacactggcttctacagctgcaaatatctagctgtacctacttcaaagaagaaggaaacagaatctgcaatctatatatttattagtgatacaggtagacctttcgtagagatgtacagtgaaatccccgaaattatacacatgactgaaggaagggagctcgtcattccctgccgggttacgtcacctaacatcactgttactttaaaaaagtttccacttgacactttgatccctgatggaaaacgcataatctgggacagtagaaagggcttcatcatatcaaatgcaacgtacaaagaaatagggcttctgacctgtgaagcaacagtcaatgggcatttgtataagacaaactatctcacacatcgacaaaccaatacaatcatagatgtccaaataagcacaccacgcccagtcaaattacttagaggccatactcttgtcctcaattgtactgctaccactcccttgaacacgagagttcaaatgacctggagttaccctgatgaaaaaaataagagagcttccgtaaggcgacgaattgaccaaagcaattcccatgccaacatattctacagtgttcttactattgacaaaatgcagaacaaagacaaaggactttatacttgtcgtgtaaggagtggaccatcattcaaatctgttaacacctcagtgcatatatatgataaagcattcatcactgtgaaacatcgaaaacagcaggtgcttgaaaccgtagctggcaagcggtcttaccggctctctatgaaagtgaaggcatttccctcgccggaagttgtatggttaaaagatgggttacctgcgactgagaaatctgctcgctatttgactcgtggctactcgttaattatcaaggacgtaactgaagaggatgcagggaattatacaatcttgctgagcataaaacagtcaaatgtgtttaaaaacctcactgccactctaattgtcaatgtgaaaccccagatttacgaaaaggccgtgtcatcgtttccagacccggctctctacccactgggcagcagacaaatcctgacttgtaccgcatatggtatccctcaacctacaatcaagtggttctggcacccctgtaaccataatcattccgaagcaaggtgtgacttttgttccaataatgaagagtcctttatcctggatgctgacagcaacatgggaaacagaattgagagcatcactcagcgcatggcaataatagaaggaaagaataagatggctagcaccttggttgtggctgactctagaatttctggaatctacatttgcatagcttccaataaagttgggactgtgggaagaaacataagcttttatatcacagatgtgccaaatgggtttcatgttaacttggaaaaaatgccgacggaaggagaggacctgaaactgtcttgcacagttaacaagttcttatacagagacgttacttggattttactgcggacagttaataacagaacaatgcactacagtattagcaagcaaaaaatggccatcactaaggagcactccatcactcttaatcttaccatcatgaatgtttccctgcaagattcaggcacctatgcctgcagagccaggaatgtatacacaggggaagaaatcctccagaagaaagaaattacaatcagagatcaggaagcaccatacctcctgcgaaacctcagtgatcacacagtggccatcagcagttccaccactttagactgtcatgctaatggtgtccccgagcctcagatcacttggtttaaaaacaaccacaaaatacaacaagagcctggaattattttaggaccaggaagcagcacgctgtttattgaaagagtcacagaagaggatgaaggtgtctatcactgcaaagccaccaaccagaagggctctgtggaaagttcagcatacctcactgttcaaggaacctcggacaagtctaatctggagctgatcactctaacatgcacctgtgtggctgcgactctcttctggctcctattaaccctctttatccgaaaaatgaaaaggtcttcttctgaaataaagactgactacctatcaattataatggacccagatgaagttcctttggatgagcagtgtgagcggctcccttatgatgccagcaagtgggagtttgcccgggagagacttaaactgggcaaatcacttggaagaggggcttttggaaaagtggttcaagcatcagcatttggcattaagaaatcacctacgtgccggactgtggctgtgaaaatgctgaaagagggggccacggccagcgagtacaaagctctgatgactgagctaaaaatcttgacccacattggccaccatctgaacgtggttaacctgctgggagcctgcaccaagcaaggagggcctctgatggtgattgttgaatactgcaaatatggaaatctctccaactacctcaagagcaaacgtgacttattttttctcaacaaggatgcagcactacacatggagcctaagaaagaaaaaatggagccaggcctggaacaaggcaagaaaccaagactagatagcgtcaccagcagcgaaagctttgcgagctccggctttcaggaagataaaagtctgagtgatgttgaggaagaggaggattctgacggtttctacaaggagcccatcactatggaagatctgatttcttacagttttcaagtggccagaggcatggagttcctgtcttccagaaagtgcattcatcgggacctggcagcgagaaacattcttttatctgagaacaacgtggtgaagatttgtgattttggccttgcccgggatatttataagaaccccgattatgtgagaaaaggagatactcgacttcctctgaaatggatggctccngaatctatctttgacaaaatctacagcaccaagagcgacgtgtggtcttacggagtattgctgtgggaaatcttctccttaggtgggtctccatacccaggagtacaaatggatgaggacttttgcagtcgcctgagggaaggcatgaggatgagagctcctgagtactctactcctgaaatctatcagatcatgctggactgctggcacagagacccaaaagaaaggccaagatttgcagaacttgtggaaaaactaggtgatttgcttcaagcaaatgtacaacaggatggtaaagactacatcccaatcaatgccatactgacaggaaatagtgggtttacatactcaactcctgccttctctgaggacttcttcaaggaaagtatttcagctccgaagtttaattcaggaagctctgatgatgtcagatatgtaaatgctttcaagttcatgagcctggaaagaatcaaaacctttgaagaacttttaccgaatgccacctccatgtttgatgactaccagggcgacagcagcactctgttggcctctcccatgctgaagcgcttcacctggactgacagcaaacccaaggcctcgctcaagattgacttgagagtaaccagtaaaagtaaggagtcggggctgtctgatgtcagcaggcccagtttctgccattccagctgtgggcacgtcagcgaaggcaagcgcaggttcacctacgaccacgctgagctggaaaggaaaatcgcgtgctgctccccgcccccagactacaactcggtgttagttgtgaaagaaagctgagaagggaaaatttgggaaaagccgtggccaaaggggaagccccctttggtggggccaccgaaggggggttggggaaaagcggcggcgggtgtggggtggggtgggaaggggcggtagtgttggttgaggggggtgtgggaggaggggggtgggggtgtgggggagttttctccatatcaaaacgagggctgatggaggaaaaaggctctctgtatgaagagatgggaccgtcatcagcacattccctagtgagcctactggctcctggcagcggcttttgtggaagactcactagccagaagagaggagtgggacagtcctctccaccaagatctaaatccaaacaaaagcaggctagagccagaagagaggacaaatctttgttcttcctcttctttacatacgcaaaccacctgtgacagctggcaattttataaatcaggtaactggaaggaggttaaacacagaaaaaagaagacctcagtcaattctctactttttttttttttttccaaatcagataatagcccagcaaatagtgataacaaataaaaccttagctattcatgtcttgatttcaataattaattcttaatcattaagagaccataataaatactccttttcaagagaaaagcaaaaccattagaattgttactcagctccttcaaactcaggtttgtagcatacatgagtccatccatcagtcaaagaatggttccatctggagtcttaatgtagaaagaaaaatggagacttgtaataatgagctagttacaaagtgcttgttcattaaaatagcactgaaaattgaaacatgaattaactgataatattccaatcatttgccatttatgacaaaaatggttggcactaacaaagaacgagcacttcctttcagagtttctgagataatgtacgtggaacagtctgggtggaatggggctgaaaccatgtgcaagtctgtgtcttgtcagtccaagaagtgacaccgagatgttaattttagggacccgtgccttgtttcctagcccacaagaatgcaaacatcaaacagatactcgctagcctcatttaaattgattaaaggaggagtgcatctttggccgacagtggtgtaactgtatgtgtgtgtgtgtgtgtgtgtgtgtgtgtgggtgtatgtgtgttttgtgcataactatttaaggaaactggaattttaaagttacttttatacaaaccaagaatatatgctacagatataagacagacatggtttggtcctatatttctagtcatgatgaatgtattttgtataccatcttcatataataaacttccaaaaacacaaaaaaaaaaac

SEQ ID NO: 343403 - DNA, 4277 bp, Homo sapiens
  misc_feature (638)..(638): n is a, c, g, or t
tccttgctttgtgggctgcatgcccagcccaggcatgcagtggaaacgcagggcaggagagaggaggccttcagagtgcagctggacttccttcccaaccctcttgcttccttcagaccggggtcgggttggcaaaccaagggcctctgatggtgattgttgaatactgcaaatatggaaatctctccaactacctcaagagcaaacgtgacttattttttctcaacaaggatgcagcactacacatggagcctaagaaagaaaaaatggagccaggcctggaacaaggcaagaaaccaagactagatagcgtcaccagcagcgaaagctttgcgagctccggctttcaggaagataaaagtctgagtgatgttgaggaagaggaggattctgacggtttctacaaggagcccatcactatggaagatctgatttcttacagttttcaagtggccagaggcatggagttcctgtcttccagaaagtgcattcatcgggacctggcagcgagaaacattcttttatctgagaacaacgtggtgaagatttgtgattttggccttgcccgggatatttataagaaccccgattatgtgagaaaaggagatactcgacttcctctgaaatggatggctccngaatctatctttgacaaaatctacagcaccaagagcgacgtgtggtcttacggagtattgctgtgggaaatcttctccttaggtgggtctccatacccaggagtacaaatggatgaggacttttgcagtcgcctgagggaaggcatgaggatgagagctcctgagtactctactcctgaaatctatcagatcatgctggactgctggcacagagacccaaaagaaaggccaagatttgcagaacttgtggaaaaactaggtgatttgcttcaagcaaatgtacaacaggatggtaaagactacatcccaatcaatgccatactgacaggaaatagtgggtttacatactcaactcctgccttctctgaggacttcttcaaggaaagtatttcagctccgaagtttaattcaggaagctctgatgatgtcagatatgtaaatgctttcaagttcatgagcctggaaagaatcaaaacctttgaagaacttttaccgaatgccacctccatgtttgatgactaccagggcgacagcagcactctgttggcctctcccatgctgaagcgcttcacctggactgacagcaaacccaaggcctcgctcaagattgacttgagagtaaccagtaaaagtaaggagtcggggctgtctgatgtcagcaggcccagtttctgccattccagctgtgggcacgtcagcgaaggcaagcgcaggttcacctacgaccacgctgagctggaaaggaaaatcgcgtgctgctccccgcccccagactacaactcggtggtcctgtactccaccccacccatctagagtttgacacgaagccttatttctagaagcacatgtgtatttatacccccaggaaactagcttttgccagtattatgcatatataagtttacacctttatctttccatgggagccagctgctttttgtgatttttttaatagtgctttttttttttgactaacaagaatgtaactccagatagagaaatagtgacaagtgaagaacactactgctaaatcctcatgttactcagtgttagagaaatccttcctaaacccaatgacttccctgctccaacccccgccacctcagggcacgcaggaccagtttgattgaggagctgcactgatcacccaatgcatcacgtaccccactgggccagccctgcagcccaaaacccagggcaacaagcccgttagccccagggatcactggctggcctgagcaacatctcgggagtcctctagcaggcctaagacatgtgaggaggaaaaggaaaaaaagcaaaaagcaagggagaaaagagaaaccgggagaaggcatgagaaagaatttgagacgcaccatgtgggcacggagggggacggggctcagcaatgccatttcagtggcttcccagctctgacccttctacatttgagggcccagccaggagcagatggacagcgatgaggggacattttctggattctgggaggcaagaaaaggacaaatatcttttttggaactaaagcaaattttagaactttacctatggaagtggttctatgtccattctcattcgtggcatgttttgatttgtagcactgagggtggcactcaactctgagcccatacttttggctcctctagtaagatgcactgaaaacttagccagagttaggttgtctccaggccatgatggccttacactgaaaatgtcacattctattttgggtattaatatatagtccagacacttaactcaatttcttggtattattctgttttgcacagttagttgtgaaagaaagctgagaagaatgaaaatgcagtcctgaggagaggagttttctccatatcaaaacgagggctgatggaggaaaaaggtcaataaggtcaagggaaaaccccgtctctataccaaccaaaccaattcaccaacacagttgggacccaaaacacaggaagtcagtcacgtttccttttcatttaatggggattccactatctcacactaatctgaaaggatgtggaagagcattagctggcgcatattaagcactttaagctccttgagtaaaaaggtggtatgtaatttatgcaaggtatttctccagttgggactcaggatattagttaatgagccatcactagaagaaaagcccattttcaactgctttgaaacttgcctggggtctgagcatgatgggaatagggagacagggtaggaaagggcgcctactcttcagggtctaaagatcaagtgggccttggatcgctaagctggctctgtttgatgctatttatgcaagttagggtctatgtatttaggatgtctgcaccttctgcagccagtcagaagctggagaggcaacagtggattgctgcttcttggggagaagagtatgcttccttttatccatgtaatttaactgtagaacctgagctctaagtaaccgaagaatgtatgcctctgttcttatgtgccacatccttgtttaaaggctctctgtatgaagagatgggaccgtcatcagcacattccctagtgagcctactggctcctggcagcggcttttgtggaagactcactagccagaagagaggagtgggacagtcctctccaccaagatctaaatccaaacaaaagcaggctagagccagaagagaggacaaatctttgttcttcctcttctttacatacgcaaaccacctgtgacagctggcaattttataaatcaggtaactggaaggaggttaaacacagaaaaaagaagacctcagtcaattctctactttttttttttttttccaaatcagataatagcccagcaaatagtgataacaaataaaaccttagctattcatgtcttgatttcaataattaattcttaatcattaagagaccataataaatactccttttcaagagaaaagcaaaaccattagaattgttactcagctccttcaaactcaggtttgtagcatacatgagtccatccatcagtcaaagaatggttccatctggagtcttaatgtagaaagaaaaatggagacttgtaataatgagctagttacaaagtgcttgttcattaaaatagcactgaaaattgaaacatgaattaactgataatattccaatcatttgccatttatgacaaaaatggttggcactaacaaagaacgagcacttcctttcagagtttctgagataatgtacgtggaacagtctgggtggaatggggctgaaaccatgtgcaagtctgtgtcttgtcagtccaagaagtgacaccgagatgttaattttagggacccgtgccttgtttcctagcccacaagaatgcaaacatcaaacagatactcgctagcctcatttaaattgattaaaggaggagtgcatctttggccgacagtggtgtaactgtatgtgtgtgtgtgtgtgtgtgtgtgtgtgtgggtgtatgtgtgttttgtgcataactatttaaggaaactggaattttaaagttacttttatacaaaccaagaatatatgctacagatataagacagacatggtttggtcctatatttctagtcatgatgaatgtattttgtataccatcttcatataataaacttccaaaaacacaaaaaaaaaaac

SEQ ID NO: 343404 - DNA, 4139 bp, Homo sapiens
tgatcagctacacacaggaaccttgctcacagccccggaaactccacactgtgggcttcaccttctggaagtgacaaagtcatgtacgcaggaccttccccaccagtctccactgctgagcccataaagggaggtgtgaggacttggaaatgccacatgctttttaagaagccagctcaaaccaacctttgttacaactcgagaatgaaataagtactacaaactattcagccattgatatttatggctgtatgactttttttttttttaactttaaggacatcgtcctacttctgtaagtgtggggaggagtactccacttcacattgaactgcagtgagcggtggggtttcctttccgaattgctgtgtttcattcacagaactcagaccttccatctgcagaggccacaggcacaacaaagaacctgggtatccatgagctctggtgggttggttagtctgccttggtagacgtgttttccactgaccacaggacctggcccagacagccttttaagtgctggtgctataaacccaaacctaaaaatgaagcagggtcacatagtacagaaagcttgggctttatgcggatgatgacagccctccctttgtagtacgtaaggcaatgcataggatgatcactgctctccaactatttctgttgctgttttccccaccagctatcagatcatgctggactgctggcacagagacccaaaagaaaggccaagatttgcagaacttgtggaaaaactaggtgatttgcttcaagcaaatgtacaacaggatggtaaagactacatcccaatcaatgccatactgacaggaaatagtgggtttacatactcaactcctgccttctctgaggacttcttcaaggaaagtatttcagctccgaagtttaattcaggaagctctgatgatgtcagatatgtaaatgctttcaagttcatgagcctggaaagaatcaaaacctttgaagaacttttaccgaatgccacctccatgtttgatgactaccagggcgacagcagcactctgttggcctctcccatgctgaagcgcttcacctggactgacagcaaacccaaggcctcgctcaagattgacttgagagtaaccagtaaaagtaaggagtcggggctgtctgatgtcagcaggcccagtttctgccattccagctgtgggcacgtcagcgaaggcaagcgcaggttcacctacgaccacgctgagctggaaaggaaaatcgcgtgctgctccccgcccccagactacaactcggtggtcctgtactccaccccacccatctagagtttgacacgaagccttatttctagaagcacatgtgtatttatacccccaggaaactagcttttgccagtattatgcatatataagtttacacctttatctttccatgggagccagctgctttttgtgatttttttaatagtgctttttttttttgactaacaagaatgtaactccagatagagaaatagtgacaagtgaagaacactactgctaaatcctcatgttactcagtgttagagaaatccttcctaaacccaatgacttccctgctccaacccccgccacctcagggcacgcaggaccagtttgattgaggagctgcactgatcacccaatgcatcacgtaccccactgggccagccctgcagcccaaaacccagggcaacaagcccgttagccccagggatcactggctggcctgagcaacatctcgggagtcctctagcaggcctaagacatgtgaggaggaaaaggaaaaaaagcaaaaagcaagggagaaaagagaaaccgggagaaggcatgagaaagaatttgagacgcaccatgtgggcacggagggggacggggctcagcaatgccatttcagtggcttcccagctctgacccttctacatttgagggcccagccaggagcagatggacagcgatgaggggacattttctggattctgggaggcaagaaaaggacaaatatcttttttggaactaaagcaaattttagaactttacctatggaagtggttctatgtccattctcattcgtggcatgttttgatttgtagcactgagggtggcactcaactctgagcccatacttttggctcctctagtaagatgcactgaaaacttagccagagttaggttgtctccaggccatgatggccttacactgaaaatgtcacattctattttgggtattaatatatagtccagacacttaactcaatttcttggtattattctgttttgcacagttagttgtgaaagaaagctgagaagaatgaaaatgcagtcctgaggagaggagttttctccatatcaaaacgagggctgatggaggaaaaaggtcaataaggtcaagggaaaaccccgtctctataccaaccaaaccaattcaccaacacagttgggacccaaaacacaggaagtcagtcacgtttccttttcatttaatggggattccactatctcacactaatctgaaaggatgtggaagagcattagctggcgcatattaagcactttaagctccttgagtaaaaaggtggtatgtaatttatgcaaggtatttctccagttgggactcaggatattagttaatgagccatcactagaagaaaagcccattttcaactgctttgaaacttgcctggggtctgagcatgatgggaatagggagacagggtaggaaagggcgcctactcttcagggtctaaagatcaagtgggccttggatcgctaagctggctctgtttgatgctatttatgcaagttagggtctatgtatttaggatgtctgcaccttctgcagccagtcagaagctggagaggcaacagtggattgctgcttcttggggagaagagtatgcttccttttatccatgtaatttaactgtagaacctgagctctaagtaaccgaagaatgtatgcctctgttcttatgtgccacatccttgtttaaaggctctctgtatgaagagatgggaccgtcatcagcacattccctagtgagcctactggctcctggcagcggcttttgtggaagactcactagccagaagagaggagtgggacagtcctctccaccaagatctaaatccaaacaaaagcaggctagagccagaagagaggacaaatctttgttcttcctcttctttacatacgcaaaccacctgtgacagctggcaattttataaatcaggtaactggaaggaggttaaacacagaaaaaagaagacctcagtcaattctctactttttttttttttttccaaatcagataatagcccagcaaatagtgataacaaataaaaccttagctattcatgtcttgatttcaataattaattcttaatcattaagagaccataataaatactccttttcaagagaaaagcaaaaccattagaattgttactcagctccttcaaactcaggtttgtagcatacatgagtccatccatcagtcaaagaatggttccatctggagtcttaatgtagaaagaaaaatggagacttgtaataatgagctagttacaaagtgcttgttcattaaaatagcactgaaaattgaaacatgaattaactgataatattccaatcatttgccatttatgacaaaaatggttggcactaacaaagaacgagcacttcctttcagagtttctgagataatgtacgtggaacagtctgggtggaatggggctgaaaccatgtgcaagtctgtgtcttgtcagtccaagaagtgacaccgagatgttaattttagggacccgtgccttgtttcctagcccacaagaatgcaaacatcaaacagatactcgctagcctcatttaaattgattaaaggaggagtgcatctttggccgacagtggtgtaactgtatgtgtgtgtgtgtgtgtgtgtgtgtgtgtgggtgtatgtgtgttttgtgcataactatttaaggaaactggaattttaaagttacttttatacaaaccaagaatatatgctacagatataagacagacatggtttggtcctatatttctagtcatgatgaatgtattttgtataccatcttcatataataaacttccaaaaacacaaaaaaaaaaac

SEQ ID NO: 343405 - DNA, 2594 bp, Homo sapiens
atcgaggtccgcgggaggctcggagcgcgccaggcggacactcctctcggctcctccccggcagcggcggcggctcggagcgggctccggggctcgggtgcagcggccagcgggcgcctggcggcgaggattacccggggaagtggttgtctcctggctggagccgcgagacgggcgctcagggcgcggggccggcggcggcgaacgagaggacggactctggcggccgggtcgttggccgcggggagcgcgggcaccgggcgagcaggccgcgtcgcgctcaccatggtcagctactgggacaccggggtcctgctgtgcgcgctgctcagctgtctgcttctcacaggatctagttcaggttcaaaattaaaagatcctgaactgagtttaaaaggcacccagcacatcatgcaagcaggccagacactgcatctccaatgcaggggggaagcagcccataaatggtctttgcctgaaatggtgagtaaggaaagcgaaaggctgagcataactaaatctgcctgtggaagaaatggcaaacaattctgcagtactttaaccttgaacacagctcaagcaaaccacactggcttctacagctgcaaatatctagctgtacctacttcaaagaagaaggaaacagaatctgcaatctatatatttattagtgatacaggtagacctttcgtagagatgtacagtgaaatccccgaaattatacacatgactgaaggaagggagctcgtcattccctgccgggttacgtcacctaacatcactgttactttaaaaaagtttccacttgacactttgatccctgatggaaaacgcataatctgggacagtagaaagggcttcatcatatcaaatgcaacgtacaaagaaatagggcttctgacctgtgaagcaacagtcaatgggcatttgtataagacaaactatctcacacatcgacaaaccaatacaatcatagatgtccaaataagcacaccacgcccagtcaaattacttagaggccatactcttgtcctcaattgtactgctaccactcccttgaacacgagagttcaaatgacctggagttaccctgatgaaaaaaataagagagcttccgtaaggcgacgaattgaccaaagcaattcccatgccaacatattctacagtgttcttactattgacaaaatgcagaacaaagacaaaggactttatacttgtcgtgtaaggagtggaccatcattcaaatctgttaacacctcagtgcatatatatgataaagcattcatcactgtgaaacatcgaaaacagcaggtgcttgaaaccgtagctggcaagcggtcttaccggctctctatgaaagtgaaggcatttccctcgccggaagttgtatggttaaaagatgggttacctgcgactgagaaatctgctcgctatttgactcgtggctactcgttaattatcaaggacgtaactgaagaggatgcagggaattatacaatcttgctgagcataaaacagtcaaatgtgtttaaaaacctcactgccactctaattgtcaatgtgaaaccccagatttacgaaaaggccgtgtcatcgtttccagacccggctctctacccactgggcagcagacaaatcctgacttgtaccgcatatggtatccctcaacctacaatcaagtggttctggcacccctgtaaccataatcattccgaagcaaggtgtgacttttgttccaataatgaagagtcctttatcctggatgctgacagcaacatgggaaacagaattgagagcatcactcagcgcatggcaataatagaaggaaagaataagatggctagcaccttggttgtggctgactctagaatttctggaatctacatttgcatagcttccaataaagttgggactgtgggaagaaacataagcttttatatcacagatgtgccaaatgggtttcatgttaacttggaaaaaatgccgacggaaggagaggacctgaaactgtcttgcacagttaacaagttcttatacagagacgttacttggattttactgcggacagttaataacagaacaatgcactacagtattagcaagcaaaaaatggccatcactaaggagcactccatcactcttaatcttaccatcatgaatgtttccctgcaagattcaggcacctatgcctgcagagccaggaatgtatacacaggggaagaaatcctccagaagaaagaaattacaatcagagatcaggaagcaccatacctcctgcgaaacctcagtgatcacacagtggccatcagcagttccaccactttagactgtcatgctaatggtgtccccgagcctcagatcacttggtttaaaaacaaccacaaaatacaacaagagcctggctctgcaaatacagcagtgaacaagaaaactgaaatctgaagaaccaaaaatctagagtaattaagtgatgcatgtatttacctgaaatacgcttcttcaagcaacaaccctgtgtgtcctgccttattcgctattatcgtgtcaattggtctaaaaatggaataaggcaaattaataaatgggcaatcaga

SEQ ID NO: 343406 - DNA, 2683 bp, Homo sapiens
atcgaggtccgcgggaggctcggagcgcgccaggcggacactcctctcggctcctccccggcagcggcggcggctcggagcgggctccggggctcgggtgcagcggccagcgggcgcctggcggcgaggattacccggggaagtggttgtctcctggctggagccgcgagacgggcgctcagggcgcggggccggcggcggcgaacgagaggacggactctggcggccgggtcgttggccgcggggagcgcgggcaccgggcgagcaggccgcgtcgcgctcaccatggtcagctactgggacaccggggtcctgctgtgcgcgctgctcagctgtctgcttctcacaggatctagttcaggttcaaaattaaaagatcctgaactgagtttaaaaggcacccagcacatcatgcaagcaggccagacactgcatctccaatgcaggggggaagcagcccataaatggtctttgcctgaaatggtgagtaaggaaagcgaaaggctgagcataactaaatctgcctgtggaagaaatggcaaacaattctgcagtactttaaccttgaacacagctcaagcaaaccacactggcttctacagctgcaaatatctagctgtacctacttcaaagaagaaggaaacagaatctgcaatctatatatttattagtgatacaggtagacctttcgtagagatgtacagtgaaatccccgaaattatacacatgactgaaggaagggagctcgtcattccctgccgggttacgtcacctaacatcactgttactttaaaaaagtttccacttgacactttgatccctgatggaaaacgcataatctgggacagtagaaagggcttcatcatatcaaatgcaacgtacaaagaaatagggcttctgacctgtgaagcaacagtcaatgggcatttgtataagacaaactatctcacacatcgacaaaccaatacaatcatagatgtccaaataagcacaccacgcccagtcaaattacttagaggccatactcttgtcctcaattgtactgctaccactcccttgaacacgagagttcaaatgacctggagttaccctgatgaaaaaaataagagagcttccgtaaggcgacgaattgaccaaagcaattcccatgccaacatattctacagtgttcttactattgacaaaatgcagaacaaagacaaaggactttatacttgtcgtgtaaggagtggaccatcattcaaatctgttaacacctcagtgcatatatatgataaagcattcatcactgtgaaacatcgaaaacagcaggtgcttgaaaccgtagctggcaagcggtcttaccggctctctatgaaagtgaaggcatttccctcgccggaagttgtatggttaaaagatgggttacctgcgactgagaaatctgctcgctatttgactcgtggctactcgttaattatcaaggacgtaactgaagaggatgcagggaattatacaatcttgctgagcataaaacagtcaaatgtgtttaaaaacctcactgccactctaattgtcaatgtgaaaccccagatttacgaaaaggccgtgtcatcgtttccagacccggctctctacccactgggcagcagacaaatcctgacttgtaccgcatatggtatccctcaacctacaatcaagtggttctggcacccctgtaaccataatcattccgaagcaaggtgtgacttttgttccaataatgaagagtcctttatcctggatgctgacagcaacatgggaaacagaattgagagcatcactcagcgcatggcaataatagaaggaaagaataagatggctagcaccttggttgtggctgactctagaatttctggaatctacatttgcatagcttccaataaagttgggactgtgggaagaaacataagcttttatatcacagatgtgccaaatgggtttcatgttaacttggaaaaaatgccgacggaaggagaggacctgaaactgtcttgcacagttaacaagttcttatacagagacgttacttggattttactgcggacagttaataacagaacaatgcactacagtattagcaagcaaaaaatggccatcactaaggagcactccatcactcttaatcttaccatcatgaatgtttccctgcaagattcaggcacctatgcctgcagagccaggaatgtatacacaggggaagaaatcctccagaagaaagaaattacaatcagagatcaggaagcaccatacctcctgcgaaacctcagtgatcacacagtggccatcagcagttccaccactttagactgtcatgctaatggtgtccccgagcctcagatcacttggtttaaaaacaaccacaaaatacaacaagagcctggtaagagacttttttttcttccatttattatttctcatctttcatcagcccccctttcccttaacagtcccgtcacctgcttccagtatgtatagacctacttgctgatagagccccaaacactgggatctggttcatgctgatagcaatgtccagtgaggaatatttgggccagttcctatgcagaccatattcctaacccatagaaagatcctgcagaatctattcagctggaagtctttaaatagtgcattcagaaagaaatgagaagagccatgtaga

SEQ ID NO: 343407 - DNA, 1537 bp, Homo sapiens
atcgaggtccgcgggaggctcggagcgcgccaggcggacactcctctcggctcctccccggcagcggcggcggctcggagcgggctccggggctcgggtgcagcggccagcgggcgcctggcggcgaggattacccggggaagtggttgtctcctggctggagccgcgagacgggcgctcagggcgcggggccggcggcggcgaacgagaggacggactctggcggccgggtcgttggccgcggggagcgcgggcaccgggcgagcaggccgcgtcgcgctcaccatggtcagctactgggacaccggggtcctgctgtgcgcgctgctcagctgtctgcttctcacaggatctagttcaggttcaaaattaaaagatcctgaactgagtttaaaaggcacccagcacatcatgcaagcaggccagacactgcatctccaatgcaggggggaagcagcccataaatggtctttgcctgaaatggtgagtaaggaaagcgaaaggctgagcataactaaatctgcctgtggaagaaatggcaaacaattctgcagtactttaaccttgaacacagctcaagcaaaccacactggcttctacagctgcaaatatctagctgtacctacttcaaagaagaaggaaacagaatctgcaatctatatatttattagtgatacaggtagacctttcgtagagatgtacagtgaaatccccgaaattatacacatgactgaaggaagggagctcgtcattccctgccgggttacgtcacctaacatcactgttactttaaaaaagtttccacttgacactttgatccctgatggaaaacgcataatctgggacagtagaaagggcttcatcatatcaaatgcaacgtacaaagaaatagggcttctgacctgtgaagcaacagtcaatgggcatttgtataagacaaactatctcacacatcgacaaaccaatacaatcatagatgtccaaataagcacaccacgcccagtcaaattacttagaggccatactcttgtcctcaattgtactgctaccactcccttgaacacgagagttcaaatgacctggagttaccctgatgaaaaaaataagagagcttccgtaaggcgacgaattgaccaaagcaattcccatgccaacatattctacagtgttcttactattgacaaaatgcagaacaaagacaaaggactttatacttgtcgtgtaaggagtggaccatcattcaaatctgttaacacctcagtgcatatatatgataaagcattcatcactgtgaaacatcgaaaacagcaggtgcttgaaaccgtagctggcaagcggtcttaccggctctctatgaaagtgaaggcatttccctcgccggaagttgtatggttaaaagatgggttacctgcgactgagaaatctgctcgctatttgactcgtggctactcgttaattatcaaggacgtaactgaagaggaggaggaattcgcccaggaggaggaggaattcgcccaggaggaggaggaattcgccc

SEQ ID NO: 343408 - DNA, 420 bp, Homo sapiens
gagctgacctatgcactgaaagatgtttaacagcatctctggcctctacaaggagtacctccaaagctatgacaacccaaaattacaatgttccctggaaagcaaaactgcccccattgagacacactgatccaagattagtagtctccaaagtgagttacatgtactcagagcaggtgctgtgaaaagactaaattctctgcttgtgttatttttattatctacttatagattttagtgaatgtataagcaataaagtctgttaccaatagggaggcagtatgaaagtgctgtggcagtaactggcaatggccttccaattgtcctctctattccacttccttaattattttacacagcaaccagataacttttttcaatataaataaaatcacgacatgccagaatttgaaatccttc

SEQ ID NO: 343409 - DNA, 233 bp, Homo sapiens
ctctagcggatccctaaaagtgcctcttctatatctacttatagattttagtgaatgtataagcaataaagtctgttaccaatagggaggcagtatgaaagtgctgtggcagtaactggcaatggccttccaattgtcctctctattccacttccttaattattttacacagcaaccagataacttttttcaatataaataaaatcacgacatgccagaatttgaaatccttc

SEQ ID NO: 343410 - DNA, 339 bp, Homo sapiens
cttaaagtttttcttctgtttcttttcctttccttctttttttgagacagagtttcactctttcacccaggccggagtgaagtggtgtgatctcagctcactgcaaccttccaccccctgggttcaagcgattcccctgctttagcctcccgagtagctgggattacaggcgtgagccattgcacccaacctcattcttttttggtcagcctcttctagctcttaactcatagttcctgggaattccttcatcagcatcctaagttctcctttcctgactacaaagggaaatagtaaagagctttttctaggttgtcactggaatattctaggcccctc

SEQ ID NO: 343411 - DNA, 275 bp, Homo sapiens
attgggtgaactggcacagtggtgtttgggagtagtagcatcctttactaacttaatcaagcccattaatacttctgcattgtaatttatcattattcatggaaattagggtaattaagactaaaatgggtccgtgtcaagttttatcactaggttttgaaaaaacttggatttcagagttttttggacttcaggattgtgagcccatcatggagaagataggactttgtactttttattttttgttttagagtttatttttttaatttactttt

SEQ ID NO: 343412 - DNA, 390 bp, Homo sapiens
cacctcagcctcccaaagagctgggattacaggcgtgagtcaccttgcctggcctgctctagttattctattttattattagttattgtttttaatctcccgtgcaaacattataaattaaaccatcataggtacatatgtataggaaaatgtatacaggatttagtactaatctagttttagacatccactgggggtcgtgaaatgtaatcctcatgaataacggcagggggattactgcagctttttgttttgttttgtttttaaactattgagctgtaaaagcaaactgtagacgatcatatttaatatacaccattgatataaagtttaaaaacagtcaacttgctaaatattgtttagggacacacacacacacacacacacaca

SEQ ID NO: 343413 - DNA, 180 bp, Homo sapiens
gtgggagtttcacttgagtccaggagctcaagaccaagctgagcaatacaagacacctctccagaaaaattaaagttaaaattttaaaattgagccaggcctggtggagcatgtctacagtcctagttactaaggaggctgaggaggcggaaggatcacttgaacccaggagtttgaggt

SEQ ID NO: 343414 - DNA, 237 bp, Homo sapiens
agtcccagctactcgggaggctgagacagcgagaatcgcttgaacatgggaggaggttgcagtgagccgagatcgtgctaatgcactccagcctaggcaacagaaggagacactgtctcaaaaacaaacaaacatacagttcaaatattccagcctccattatttgtaaatcagaaggttaaatacttcaaaagtgaagcagtagtttagtcacatttccagccaggcactttggga

SEQ ID NO: 343415 - DNA, 254 bp, Homo sapiens
ctaacatctgctttgaagtgttagtaagaaatttcaaatatactgtgatggcaatacaaatgagcaaattaatctctagtgattgtgaaattcattttaatgttcatcaggtttatgaagtcctccatgaggacttctattttgtgtcatgcagaaactcatcccattgtgctacacttgctctattataatagtggggcttaacatcactttgagctctcatcacttcacagtgttagtttttacttaccctc

SEQ ID NO: 343416 - DNA, 550 bp, Homo sapiens
cactttatagtcatactattaatttggttattttttgtgtggtaagaatacctaacatcagagcaccctcttttttgagacggagattccttcttgttgctcaggctggagtgcaatggcgcaatctcggctcactgcaacctccacttcccaggctgaggcaggagaattgcttgaacctccgggaggcggaggttgcagtgagccgagattgtgccactgcactccagcctgggtgacagagtgaaactccgtctcaaaaattaaataaaataaaataggagtttatttttgccactgagtttaaggagttgcttatatattctggatattagccccttatcaggtgtatggtttgcaaatgttttcttccattctgtagttgcgttttcactctgttaatgttttctttattcagttttaaaatggtaagccaaggcacagagctggaatgggagtggcccaggacacagctggtgaggtgcagagctggggtcccagagcctggcacctcacatggtgctatcctgctttgctgatttttcttgct

SEQ ID NO: 343417 - DNA, 393 bp, Homo sapiens
cccaaaattgtggcagcaaaaagaacacttcatatgcttaaaacccattctttttgaattagattttgattttaaatatttaagtctggtgtttgtgagaacacttttctctttgctcagtcttttcgatctggttgggtagggaaggtgttcctcatgctctctgggtggctgccttattcatagttgagagagctgttaggtaaaatctttatatgtgttggggtttttttggtagggggggtagcaggtaaaggtggcccatggctagggcagcaaagatgaataatttgaggaagcatttggttggtggactcatttgcagagaaacagtggtgacaacaaatcagagctgtttccctcaactctggctataagaggtcattctctgca

SEQ ID NO: 343418 - DNA, 1319 bp, Homo sapiens
ttgtagagatgggatctcactatgttgtccaggctggtcaaaaagacactcttcatataccaacatgggataatctccaaaatatagtgggtgaaaaaatacagataaatgtgatataagaaagacagaagaggacacatatgcatttgtgtgcagcataaaacacctctgaagttcacacaagaatctgacttctagggaggtggctgggtggagtgggagggagaattttcactgtatatccttctgaatctggatctacctgtgtatttccggtccccacagggtcagtaagggtgtttagacttagaaggttggtacatacccaatccatgcaggaagaaagagcactggatggggaggcagacggcctaactctagtcctaccttcccactgacctgacagtgatctggggcgagtcactcccctccccacctggggctcaatttccccatctgtataaggggattaaacttgatggttttcaagtcccttccagtttcatgatcggcctatgtctatgtctcagtcccaacttccagccctgttttacagaagggagggcaggcacagagaacctgttcttggctgtctcagttgtctgctgcacccatcccctccatgcacaggtttgtgaccaggatgcaccttagagtcactcgcagagcttctgaagaaacacacagccaggccccaccactgaagatgctatctctgtctcaaacaagcccagtactcatgtttttttaaaaaataacataaggtgacatttattgggtgcttactatgtgccaggcactgttccaagcacttttatagcataacttgcctcagaggtcagtagctattcacaggcacaatcatggtaaaccacagtcctggggacaggacccagatggaagcccaggcaatagggagctgaagcctgtgggctcccccagcgaggccactggaaacacagagggtttccaggcaaaaaataagtgaattctacagcttggatttcatgttttcaaacacacagtgtgatctttttttacggctaactggccaccctacagttttccaccttgccgcccactgactcactgcaacttttgagtgaaatcacccacagtctttgctcggagggcagccgtgttctgaaccacacagccctagcccttccctgcccactgggcaaggctgactggaccagggctgacacctgctatggtttgaatgtgtccccaaaagctcatgtgttgaaaacctaatccccaatgcaacagtattgagaggtgggacacattcaacacattcaattgcgctacgagca

SEQ ID NO: 343419 - DNA, 298 bp, Homo sapiens
ttgctgtatagtcataattaaaattccttattccctagtcccaacgagaagttttatagcattacacatatagaacacattcctatagtacaaaaggaaactctgttgagaattcctggggaggatcactgtaacaatataaaaatgaaataaaagacaaccaatggtgtctaattatcaaagcatcatttgcttagaagcacctctaaatcaaaagcctcacattcgctagcatcctctctctacagggctattcaggagcattcatatactgaatgtcaacaacaggaagcaaaaa

SEQ ID NO: 343420 - DNA, 339 bp, Homo sapiens
agggtaggaagactggggggtcctgtaattagcattccaggactgttttggtgtctgcaaattaggggtgacagtgggctggttatggtgggtttcttcttgaggggtaagaacaagggtctttgttaatgaaggaagcctctggctaattgtggagggtggagatgcttttgtaaaacacagtttttttattaagccgttctcacactgctataaagaaatacctgaggctgaggaatttacaaagaacagaggtttaattggctcacggttctgcaggctgtagaagcaaagacctagaatgtgcttctgatgagggcctcaggaggcttacaatca

SEQ ID NO: 343421 - DNA, 664 bp, Homo sapiens
agagagggtcttgctgtgttgtccaggctggaatgcggtggcatgatcatagctcactataattgtgaactcctgggctcaagcaatcttcctgccttgaccttccaaagtactagaattatagatgtaagctaccatgtccagcttctgtttaggtattttatactacgaagagtcaccagccgtagatcaaccactatctagccagctccagcttcctcgtccagcatataggaaactaaggcctagggaaattaagtgacttgcctctggtgaccaagctagtcagtggcagagccagaatgagaaactagtctaatgccctttctaccatcccgtagcaactttttttttttttttgagacggagtctcactctgtcgcccaggctggagtgcagtggtgcgatctcagctcactgcaacctctgcctcccaggttcaagcaattctcctgcctcagcctcccgagtagctgggattacaggcgcacaccaccatgcccggctaattttttgtatttttagtagagacagggtttcaccatgttggccaggctggcctcgaacgcctgacctcatgatccacccgccttggcctcccaaagtgctgggattacaggcatgagccaccgcgcccagcccctgtagcaacttttatgaggta

SEQ ID NO: 343422 - DNA, 178 bp, Homo sapiens
tccccagtacctaccatggtgtctggcccacatgctcaaggaaggcttactgagttaaaggacggagccatcacctggtggtctaaccaccctcaactcctgacttttctcttgccctcttctttacttttttctttctttcttttttctttttctttttctttttttttttttttgg

SEQ ID NO: 343423 - DNA, 368 bp, Homo sapiens
atttatctttgtactctcaaagtttaataattgaacaaattaacaaagcaaacaagtttctggcaggaatatctgacctaagtaagaaaaaattgcttgaaattgccctattatttatatgcagatgatttttgctagcatgatgagttcaaactattcattaaaacacatctagcaattgtaattattgtttgtatccaatggaaataaaattcagaattcaaaatatacttttctactatatttaccctatggttcaactttaaatttggttagtattttatacaaagaagtctttcagattgaatgtcttaatttgcatgcacacattttcacattcaaatttcaagaactgggagacatttcag

SEQ ID NO: 343424 - DNA, 845 bp, Homo sapiens
agagaagagagggagccagccaggcatggggaggataacaaaaggggcaatcgtcatgagccttgaaatatttctgacataccctcaaatgaccgattaatactgtttttctactcttccccttttcttattattccagtatccctagactccatgttaaaaactcttccgaatttctttaactttacaatacttcattttaaacactgtgtattagaaattatctggatggctcacagctgaaaacagaaaagacaagttaggaaacagaaaggattctatcctaaattgatctcaaattcaaaccaattttgtaaaaaattcactgaaatctgtttagatcactcaattgcatttgaaaagttcagcagtgaaattgaaaacctagacttgacagatgcatactgtgtgaaatttgatcttgatgtataagttttaagcaatgcgggagaactttgtatgatgtaattctgtagtatgtgataatatgtgctttcctccatcaaaaatgtttatgaaaatgccagagagaaggtttggaaataaaactcttcctcctccactccccaccccaatgtttttggaccccagagaggatgagatagagggatttgaaaggagaccctgtgacttccatatggccaacttgggcactggaaattctcccagaagataaacaatttctctccctcttcacacttcgtgtccaagttgcctgaaatctctctttagctttttagtgtatctgaggttttattctacaggtgtacctcattttattgtgtttgcacatagtgcattttttttttaaagttggttgtagccttgatggaagcgtcgcgcat

SEQ ID NO: 343425 - DNA, 184 bp, Homo sapiens
ctttcttttctttcctttctttcttttctttctctttctttcttcctttcttttctttctttctctttcttcctttcttccttttttttcgggtcgggctccatctatctatctttctttcttttcgggtctggcttctttctttcttttcttttctttctctttctttctttttttttcaggg

SEQ ID NO: 343426 - DNA, 450 bp, Homo sapiens
gtaaagcagctacggcttagaaaggctgaggaacttgcctgaggctatccagctactgagagataaactggggtgtgaattcagagagcttgactcctgaggctccacctgtgcctataattccagcatgacacctgacatgtgccttgggagctttgagctgacatgttagaagtcagtctacattgaagctgccatgctgaagaactcatgtgggagaacacacagaaatcgagatgcctgaggagccccagctgtaccagcctctagctctctgagtcttctcagcaagaactgtcaaacatgagagtgaagcagccttcagatgactctggccccagtcttcaagtgccctagctggtgccaagtggagcagacaagctgccacccaccaagcccttcccaaattgcagactaggaacaaaataaatgttattttaagccactaaa

SEQ ID NO: 343427 - DNA, 401 bp, Homo sapiens
aactagtagaattcagtagatgtgacactgcatgactctccatgctaggttcacaagtgatgcggtttctgcctttttcttctctctgacatgtgccttgggagctttgagctgacatgttagaagtcagtctacattgaagctgccatgctgaagaactcatgtgggagaacacacagaaatcgagatgcctgaggagccccagctgtaccagcctctagctctctgagtcttctcagcaagaactgtcaaacatgagagtgaagcagccttcagatgactctggccccagtcttcaagtgccctagctggtgccaagtggagcagacaagctgccacccaccaagcccttcccaaattgcagactaggaacaaaataaatgttattttaagccactaaa

SEQ ID NO: 343428 - DNA, 592 bp, Homo sapiens
gtaaagcagctacggcttagaaaggctgaggaacttgcctgaggctatccagctactgagagataaactggggtgtgaattcagagagcttgactcctgaggctccacctgtgcctataattccagcatgacacctgacatgtgccttgggagctttgagctgacatgttagaagtcagtctacattgaagctgccatgctgaagaactcatgtgggagaacacacagaaatcgagatgcctgaggagccccagctgtaccagcctctagctctctgagtcttctcagcaagaactgtcaaacatgagagtgaagcagccttcagatgactctggccccagtcttcaagtgccctagctggtgccaagtggagcagacaagctgccacccaccaagcccttcccaaattgcagactaggaacaaaataaatgttattttaagccactaaattttggtttgttatatattatagcaatagaaaaccagaacccctttttttaatgccactgttagttggatattctgttacttgcagccaaaagcatccttatgtgaaatacttagtagtagagaagattaaaagaaatcact

SEQ ID NO: 343429 - DNA, 262 bp, Homo sapiens
gtaaagcagctacggcttagaaaggctgaggaacttgcctgaggctatccagctactgagagataaactggggtgtgaattcagagagcttgactcctgaggctccacctgtgcctataattccagcatgacacctggtaatgggcactcagtatatgcttgttgatctaaactcagtgtgtgtgtgtgtgtctgtgtgtgtctgtgtgtgtgtgtgtgtgtggtcttcctctcacatccaaagctactagcactgaggaag

SEQ ID NO: 343430 - DNA, 630 bp, Homo sapiens
  misc_feature (9)..(9): n is a, c, g, or t
gcttcctgncctgctgtcgctatgttaacgtacgttatggtagaaccgactagtcggttctaccatatagagatttttgttccttgctccttagggtttgaaagaaaagttcagtgttgagagctggacttcagggataggggtaggcaagagtagagttgaatgctgtttgtatttagaatttcaacaattttagttaaaaaaaaaaacattcctttggatgctagtatatggtaagaagtacaacgaattcaaaaacattcctgtataatcacatgaagactataggtcagtggtgcagagctcagcatgtcgtctgtgtcatgacaattttgttcttttcacttcttaatagccaatttaattttgcagcaaaatgtgtccaatgttgaattttccaggttctctaaagtatgtctcgtgcaaagatagctctgacattagggtccttttcagtggtccagttgggtggccatgttgctggagtgggaggggagtgggatttaactttaggccttgtgttagcaaaagtattactctttgtttgtttgccatgtaggcagtccaacctcccctgaaatagaaatgactagtaatgatttgtttcttgtcagtatgaggtagaccaca

SEQ ID NO: 343431 - DNA, 296 bp, Homo sapiens
cttttatattgctgattcagttagggcaccccaattcaaagacacaatgcagcatgtaaatgcatctacttaaagtgtatgtgtgtgtgtgtgtgtgtgtgtgtgtgtgtgtgtgtgtggtgggggggtagtgtgtgtgtgtgtgtgtgtatatatatatatatatattactagtccattggagatacaacaaactcaccaatatgtaccggcatcaaacaaatttattacactcctgtatgtcagagtatgatgtgtatctcactgagctaaaatccacgtggtgaaaaggctaa

SEQ ID NO: 343432 - DNA, 1352 bp, Homo sapiens
gatgtaagaagtgtctttcgcctcctgccatgattctgaggtctccccagccatgtggaactgggaagaatggaaggcaacgcctccgaattaaattttgggacccccagtaaaatttcaggaaagcccagaattgatctgagaatgcacaaactcggcatgtctttgacagagaaggctctgggatttcagcgcgttcattgccctccactaaggagctgctcagcaaaggggcttccctctgctctgctctcgggttcggaatccggagcgagtttccagtgagcggcgcccgctgagcgagtgggaaagcatcgcgcgtgcctttccccgcgcgcgtctgcggatcagcgcaggcgaggtgggtgggaatgcagatgtgaggctggaggcagtagagccatctcgcaatcatgcagcaacaagcaaggcagagctggcatgttgttgactgataacatcgagaagctgctatattaatcctggactgccaatctctgaacttcttggtatattgggaacataaactcttttggttaggcactgcgtcagatttctactacatgcagccaaatgcaatctagattgaaatacccctttacctaagttagctttagctgttctcacaacttgctgtttgtgctccacccacagcatatgagatcccttttgcccacagcaccctccctcagtgtgatgtcgtcccccaaccagtatttgcaggttttttgttttttttttttaatcacaaaactgctctcagtctgccaaatctgttggccctagagccagaagtgctatctcctgggaattttttttttttttgagacaggatcttgctgtcatccaggctggagggcagtggcacacactcctgggctcaagcgatcctcctgcttcagccttccgagtggttgggactataggtgagtgccaccactcccagctaattgtttttattttttgtagagatggggatgggcagggatcttactttttgcccaggctggtcttgaactcctggactcaagccatcctcctgccttgatctctcaaagtgctgggattacaggcatgagccaccatgcccggcctgggatctattcttaacccttgccctagtcagggtggtcttcctgcaggattaagagttagactctgagactctgatatcacaccctggcttggccttcccttccctgtcctacctccccaccctgctaccagtttcttctggagatatttcctgatagactacagtagtcctcccttacctgaggtttaactttctgcagtttcagttattggcagtcaacttaggtctgaaaatactaaataaaatatccagaaat

SEQ ID NO: 343433 - DNA, 1159 bp, Homo sapiens
gatgtaagaagtgtctttcgcctcctgccatgattctgaggtctccccagccatgtggaactgggaagaatggaaggcaacgcctccgaattaaattttgggacccccagtaaaatttcaggaaagcccagaattgatctgagaatgcacaaactcggcatgtctttgacagagaaggctctgggatttcagcgcgttcattgccctccactaaggagctgctcagcaaaggggcttccctctgctctgctctcgggttcggaatccggagcgagtttccagtgagcggcgcccgctgagcgagtgggaaagcatcgcgcgtgcctttccccgcgcgcgtctgcggatcagcgcaggcgaggtgggtgggaatgcagatgtgaggctggaggcagtagagccatctcgcaatcatgcagcaacaagcaaggcagagctggcatgttgttgactgataacatcgagaagctgctatattaatcctggactgccaatctctgaacttcttgagatgggtcttgctctgtcacccaggctggagtgcagtggcaggattgcagctcactggagcctccaaatcctggcctcaagcgatcctcccgcctcagcctcctgagtatctgggactacaggtgtgcaccaccacactaggctatttattatttttgttattattttgtaaagatagggtctcaccatcttgctcaggctggtcttaaactcctgggctcaagcgatgctccccctgtggcccctcaaagtgcaaagaaaacttaacagctttatccacagtgttattttcttttctcttgatgctgtgaattatccccttgatgtcagtgaagctggggttgttttgaaagacttaaatcaatacttccattgagaaaattggaccttgctggctaaagatgaaaagctggaaccctttccaacagctcacttctgtgggctgagatcaggggcagatggctcagtgtcccttgaggtgatttgattacccgtcacggccggacgcctggtctgggtacgtgaagagaagcacagacaggcagctgtagttacactgtttaaaaaagcagaggtactttttcaattcaatgacaggaaggcaaaatacccctacaggtttgaaggaaaaataatttttttcaaaatg

SEQ ID NO: 343434 - DNA, 340 bp, Homo sapiens
tcaaactcctgatctcaggtgatctgcctgcctcggcctcccaaagtgctgggattacaagcgtgatccaccacgcccggcctccattgctttctgttcccagtccccgacacacacatctaaaaaggcaagttcgacgagagccaggatttttatctgtcccgtttctggttgtatccctgacacctagaacagatgagagttcttgacacagagtatgaactccataaatatttttaggccgagcatggtggttcacgcctgtagtcccagcactttgggaggccaaggagggaggattgcttgaccccaggagtttaagacctgcctgggcaacata

SEQ ID NO: 343435 - DNA, 239 bp, Homo sapiens
ttccagtgctaatgtttactttggatatataatgtcaaattttgtttttctgtaagatttttaaaaagcataaaacagttactcttaattttggatggagtcatttccagtcccttctgaaataaggcagattatgaataagtaaatggaaactattgggccaattttaggatttctctgtaactaccctgcttgataatttttatatccacttatagtcaagaatgtagtatcttttt

SEQ ID NO: 343436 - DNA, 447 bp, Homo sapiens
ggaggtggaggttgcagtgagctgagatcacgtcactgcactccagcctaggcgacagaatgagactccgtctcaaaaaaacaaaacaaaacaaaaaggcgagcaagaaagagaagggagactcccaggtttctgacttaagcaactgtgtggctggtggtgccattcacagtggtggcgattcaaggaaaggacttggtgtcgttggggagaaaagctttggttttgaggtgtccaagagacctcatgtggagatgcccagcacatggtagatatccgagtctggcactcaggagagaagtctgaggtagagattaggagttactggcagatggcagaaattgaaaccacaggagaggatgagagcatggagagagaatggaaaagggcccaaggcactgcctgcttcctgggaagggccaacgtgaaccttctgtggaagcatga

SEQ ID NO: 343437 - DNA, 696 bp, Homo sapiens
  misc_feature (137)..(137): n is a, c, g, or t
ctttgtggaatttgtaccggaaacatttcccacagaaacagttatgacaatgattcgccaagctggaatttaactccatttaaggggacaaaacttgagcttcccgcggtgcggcccgctctaacctagtggatccnccggctcgagctcctgtcagcctggtgtcaaactcctgggctcaagtgatcctcctgccttggcctcccagggtgctggggttataggcatgagccactgcattgggtatgcacggaacacatcacttgcagtttaggcacatctcaatatgagaataacttacatcctctgttaaacccagttggggtgagataaacacagcctccttactgcacattcggtacaatgtgccagtgtcttatgtgcttcctgtatataatctcacttaatactgaaaagaagtcttggccaggcatggtggctcacgcctgtaatcctagcactttgtgaggccaaggtgggcggatcatgaggtcaggagttcaagaccagcctggccaacatggtgaaaccccgtctctaataaaaatacaaaaattggccaggtgtggtggtgcacgcctggggtcccggctgctcgggaggctgaggcaggagaatcactgaaccgggacccgggaggcagaggttgcagtgagccgagatcacgcggctgcactctgggctgcagagcgagac

SEQ ID NO: 343438 - DNA, 689 bp, Homo sapiens
  misc_feature (1)..(1): n is a, c, g, or t
nggttcctcttaacacaggggctgcataatcctccctgtctccaccctctctaacaagaggtgccagccacaataaagcagttggggcaaaatcccccctcccaaataatgcatggattagtaatgcccaagaatatatgtccgactcaaaaaaaataacatctgtgtgctattacccacatttatataagccccaaagggggaataaagtgaaaattaaaatagcatactagcgtaggtgccaatagtacactactagcacttaagtactagccccatataagaattgcctgcatcctctgttaaacccagttggggtgagataaacacagcctccttactgcacattcggtacaatgtgccagtgtcttatgtgcttcctgtatataatctcacttaatactgaaaagaagtcttggccaggcatggtggctcacgcctgtaatcctagcactttgtgaggccaaggtgggcggatcatgaggtcaggagttcaagaccagcctggccaacatggtgaaaccccgtctctaataaaaatacaaaaattggccaggtgtggtggtgcacgcctggggtcccggctgctcgggaggctgaggcaggagaatcactgaaccgggacccgggaggcagaggttgcagtgagccgagatcacgcggctgcactctgggctgcagagcgagac

SEQ ID NO: 343439 - DNA, 226 bp, Homo sapiens
tgctgattgcatgtgtctaacttaaaaaccaagagacctagggcatgataacagctcattgcagcctcaattctctcaggctccagtgatcctcctacttcagcttctcgagtagctgggaccacaggtacacaccaccatgcctggctaatttttttttttttttaagtagacacggggtttcaccatgttggccaggctcgagctcctgtcagcctggtgtcaa

SEQ ID NO: 343440 - DNA, 367 bp, Homo sapiens
ttgaaaagataacttgaactttctgtatatcagtttcctcatctgaaaatgataagatattcttactttgaagaactgtgaatacaatttgagataatttatgcaaactgcatagtacaatgcttggtacctagcacatagataaaattcaataaatatagttaatgtgataatgaagatgatgatgacagtagtggtgatgactatgatgataactacaataaattttgtttgctttcattcccatctctctattttatttcatttgttcgttacacaatttgaaagtggaagcatttcccaagcatgaattttatgtcaagtattatgttaggtgttgggcatataatatctaataaaacattat

SEQ ID NO: 343441 - DNA, 368 bp, Homo sapiens
ctcccaaagtgctgggattacaggcgtgagccactgcgctcagccaggtgtcaattttctttttggatttcaacactgagtccatagtaccctgctgaagaagccccagagcctgggttctcccctgataactctctagggcagctaagttaatccttcagtggactctgctgtccaactctcaaccttttctctagcagaagccagagagagaggacataggaaaggggaggaagcaagagggcggaggcttgaggggagagcactggggctgtgctgcatcattcaggtgaactgcgaggtatgcaacatgcaactggatacagggctcaagccactggaggcccacgctgtgagtgagcctgcct

SEQ ID NO: 343442 - DNA, 412 bp, Homo sapiens
tatatactcattaaagaaaccactttccaactcattcttggtttgggaattttatttcaaggcttctcctgtaaacctgggaaaagctcttaggtcactggtgagaggactttcctaactgactacagataactctgtgagctaactgtgagttagagagctttacatagccttcaccctagaaaaaaaatggttctcacctgctcataactaaatgtagtaatttgtaccaacaacaagttgagtttcttgctgcgcatctgctacttttccataagtctcatttgtttttgtcttcaaggctttggtttaacctttccagcgctctcctgtatttctggagtggcgggtttggcctcagatgagcctccaggtttcattttggttgatatgccattcttgactggggtct

SEQ ID NO: 343443 - DNA, 551 bp, Homo sapiens
ccatcagcttcctcatagaaaccggcaccctgctccatttcccggacaccagccacggcctgaggaacctctacttcctcgaccctatttggctctccgaatgtctgcagaggatctttaatattaagggctctcggtcagtggccaagaatggggtgatcagagcagaagacctcaggatgctgctggtggggactggcttcacgcagcagacggaagagcagtacttccagttcctggccaagtttgagatcgccctgcccgtcgccaatgacagctacctcctgccccatctccttccatctaaacctggcctggacacccacggtatgcggcaccccacagccaacaccattcagagggtatttaagatgagcttcgttcccgttggcttctggcaaaggtttatagcacggatgctgatcagcctggcggagatggacctgcagctttttgaaaacaagaagaatactaaaagcaggaacaggaaagtcaccatttacagttttacaggaaaccagagaagtcgctgtagcacattcagagtgaaa

SEQ ID NO: 343444 - DNA, 588 bp, Homo sapiens
ccatcagcttcctcatagaaaccggcaccctgctccatttcccggacaccagccacggcctgaggaacctctacttcctcgaccctatttggctctccgaatgtctgcagaggatctttaatattaagggctctcggtcagtggccaagaatggggtgatcagagcagaagacctcaggatgctgctggtggggactggcttcacgcagcagacggaagagcagtacttccagttcctggccaagtttgagatcgccctgcccgtcgccaatgacaggtgaggacacaacttaacacgccaggctgtgcaggttgctccccgaaagagggagttggggtctggagccactggtggcctgaacaagatttccagggatcagtgctgccactgctgccccctacggacaggccagcacccgatgacctgcctgccgggcctgggtcagcaggacagtgagcacggctggccgctccctcctgtgccacgggcttctctgttcagggagttaaaagaaatccacttattgaaaaggtgtaggaaaacatggaaggatgtcattaaaaataatttgtgggaatttcacttta

SEQ ID NO: 343445 - DNA, 272 bp, Homo sapiens
acatacaatggctcttaaagctttcactcagtcatgttgtatgtcacatcagctcacatgtcagtggccaaagcaagtcatatggtcagagctcactgtcagtggggtaaggatgtatagtccttccacaggtggcattgcaagttgcatgataacagataaggctgtataatcctcttaaggaaagtggaggttaaataatttggaacaataaataatatagtctacatcaacaagttcagtaaatgcttgttaaatgggttatttggagt

SEQ ID NO: 343446 - DNA, 335 bp, Homo sapiens
tccatttgctctagatgtttctaaaatgcttagtctcaagttccatatgtatcttgttgcagagcagcaacaatttgaggatatggttaattttatgtgtcaactcaactgggccaggtggtacccaaatatgtgatcaaacatcattttgggtgtttttttttaaaggtgtttttggatgaggttaacatttaaattggtagacagagtaaagcaggtgtcctcccctggtgtgggttggctacctcccattagttgaaggcatgagtagaacaaaaatgctgaccatcttccacattcaagagaactcatcttgcctgacagccattgaattg

SEQ ID NO: 343447 - DNA, 617 bp, Homo sapiens
caattctcctgcctcggcctcccaagtaggtgggattacaggtgggcaccaccacacccagctaatttttgtatttttagtagagatgagatttcaccatgtcgcccaggcggctggagttgaactcctgacctcaagcgatccacccacctcggcctcccaaagtgctgggattacaggtgtgatccaccacgcccagccccagagtgatttctgaaaggctaatttgattgttactcccttgcttagaaacctttaaactccacccttgcatcctctctaatctctgtcatttctgtattatgtaagagctcctttaatgtgctgtgatgtgttaggcctcagtgctttcaaacattctgtttcctcctttgcaatattgaatcccacctccacccctaatgtggccagactgctgcttatctttcaaaacccaacttgaggattacttcatttcttgcttttcattttggctttttgtgctgtatcacaattcttttatcacatttgtctttttaatagactgcccttcaagacaatagagatagatcagtaatattcttacatgtcttatttccattgcctactatgatgtcttgacccagagagcactcagt

SEQ ID NO: 343448 - DNA, 597 bp, Homo sapiens
ttcaaatgatagctcttcattcttcctggctgtgttagaactctttaagttatggacggaagcaacccaactctaattggggtaaagagagaatgtgtgggaaggatactgaggtattttatgtaaccatgaaaagaacaggtacagccggaaccaggaggttttagagcaggtaacttccctaccagcccccaaatttcagtggctcaataaaaatgaagtttatttcttgtgtgtacagcagttcaacatggttattcctggctaagctgcctttaatgtttcgggcacccaggctccttccatcttgtgactcctctgttcttagagctttctccttttaacctgcagatggagaaggagatggaaggatctcacatggaaggattccatgggccaggtctgaaagtggcttatatcacttctgtcctcaatctattgattataatttagtttgtgaccccataatttagttgtgacccagtaacaactgagaaaggcctgtttgcccaggaagaaaacaaaataggtttggtgagcacctagctagtttgaaccgcggtgcgcgtggggtcctctagataagcctagcacaac

SEQ ID NO: 343449 - DNA, 347 bp, Homo sapiens
gtgaaaaatgctgtatttagaaaagtatctggcgtcacttaaaataattaacagcttaatttctaacctggaaattcagaaagtccaataatgggctttgtgtgtgctgtgggaaaatatacaactgattatggctaatgacctttttaaaatgacattttctatttgtctgaaattcattactaatcccaaaattaatagaagtcaggttagcacagaattaagatctgggaattcagatggaaaaggctcacattaggcttagatttcaagagagcaacattcaagataataaattgagactgttctagaaaaccctttataaagggaagcaaaaatataggaat

SEQ ID NO: 343450 - DNA, 635 bp, Homo sapiens
tgctggaaattttattttggaattgtttaatagagaaagacaataaataatgttcaagaacagacattgattcataacatcaaagtatattgtgagaagatggtatttcagaatagaggaagaatttcttatgtgctggtaagattgtagataatcatttctgcataattttcatagctggattgctttaataaagccatttaaaggttaagttctagattgcttcatgttgcttatcaatgttttaaagctaaaatagaaaattagctgttaagttggctcaaccggaaattcagtatatcctttaaaaagagaaatttagtaagcagtgtgtctaaagaatgacatatggttgggtacagtggctcgtgactgcaatcccaacactgtgaggctgaagtgggaggatcacttgagcccaggaatttgagaccagcctggaaaacagtgagacctgcatctctacaaaaaaacaaaaaattacccaggcatggtggtacacaccttgtggtcccagttgcttgggaggctgaggtgggagaatcacttgagcctgggagatcaaggctgcattgaagtctcatcacgccactgcactcgagcctgggtgacagagcaagaccctatctcaaaaa

SEQ ID NO: 343451 - DNA, 1270 bp, Homo sapiens
agagatgccggaatctcgcgagagctcccgggggccgttgggtagcgtcttcgctgttgcccttagggacggctgtgggcctgctgggggtgggggcccgaagcgccagagatggctgctcagcgagggatgcccagctccgccgtgagggtcctggaagaggcgttgggcatgggtttgacggcagccggggacgcgagggacacggcggacgcggtggcggctgagggcgcctactacctggaacaggtcaccataactgaagcatctgaagatgactatgaatatgaagagataccagatgacaattttagcatcccagaaggtgaagaagatctggcaaaagcaattcagatggcccaagaacaggctacagatactgaaattttggaacggaaaacagttcttccttcaaagcatgcagtacctgaagtaatagaagactttctctgcaatttcttgatcaaaatgggaatgaccagaactcttgattgctttcagtctgaatggtatgagttaatacagaaaggagtgactgaacttagaactgttgggaatgttccagatgtctacacccagattatgcttttggaaaatgagaacaaaaatttaaagaaagatttgaagcactacaaacaagcagctgagtatgttattttttaaatgacattttcttctttttcttttggactaaataaaagagttgagtgaagctgatatatgtaatataccagagccttaatttttgaaaactgaatttttctagttgtaaagaatgtgagaggcttcattagcaaattaattaaacagatgatcagaactatcacaattataacttaccaacaagaagggaatgcaggtagttgtttaggagatggtacattttttatataacattcacttccttgtgtatttgatagtcttttcatggtttataacattttctcctgtaaagataggctaatttctgaaataataattaaatttatagaaagccgagaggaaattgctagtttattcctggtagaggaatttctgtatttgaaaattctccagaaggaataatataaactgtggactttgggtgataatgatatgtaggttcgtcagttgttaacaaatgtatccctctgttgggggctattgataatggggaaggctgtgcatgtgtgggagtaggaggtgtatgggacatctctgtaccttctaatcaattttgctatgaacttaaaactgctctaaaaataaagtttattaaaaaaaagttaat

SEQ ID NO: 343452 - DNA, 869 bp, Homo sapiens
agagatgccggaatctcgcgagagctcccgggggccgttgggtagcgtcttcgctgttgcccttagggacggctgtgggcctgctgggggtgggggcccgaagcgccagagatggctgctcagcgagggatgcccagctccgccgtgagggtcctggaagaggcgttgggcatgggtttgacggcagccggggacgcgagggacacggcggacgcggtggcggctgagggcgcctactacctggaacaggtcaccataactgaagcatctgaagatgactatgaatatgaagagataccagatgacaattttagcatcccagaaggtgaagaagatctggcaaaagcaattcagatggcccaagaacaggctacagatactgaaattttggtatgagttaatacagaaaggagtgactgaacttagaactgttgggaatgttccagatgtctacacccagattatgcttttggaaaatgagaacaaaaatttaaagaaagatttgaagcactacaaacaagcagctgacaaagctagagaagatttgctgaaaattcagaaagaacgtgattttcatcgaatgcatcataagcgaatagtccaggaaaaaaacaaattaattaatgacctcaaagggttgaagttacattatgcatcttatgaaccgactataagggtgttacatgagaaacaccacactttactgaaggagaaaatgctgacctccttggaaagagacaaagtagttgggcagatttctggacttcaagaaacattgaagaaactgcaaagaggacatagttaccatggtcctcaaattaaagttgatcatagtcgtgaaaaagaaaatgcaccagaaggtcctactc

SEQ ID NO: 343453 - DNA, 1445 bp, Homo sapiens
agagatgccggaatctcgcgagagctcccgggggccgttgggtagcgtcttcgctgttgcccttagggacggctgtgggcctgctgggggtgggggcccgaagcgccagagatggctgctcagcgagggatgcccagctccgccgtgagggtcctggaagaggcgttgggcatgggtttgacggcagccggggacgcgagggacacggcggacgcggtggcggctgagggcgcctactacctggaaccttatctatatccagtgcccttgctactgaatgattaaaacttgacaagatattcagaggtcaccataactgaagcatctgaagatgactatgaatatgaagagataaaagcagttgcccacaaactaatcctgaatttattagaagtgacgtttattgacatttacaaggaagtcagaagaaagcagttattcatttttcatggatcttcagaatgacatgataccagatgacaattttagcatcccagaaggtgaagaagatctggcaaaagcaattcagatggcccaagaacaggctacagatactgaaattttggaacggaaaacagttcttccttcaaagcatgcagtacctgaagtaatagaagactttctctgcaatttcttgatcaaaatgggaatgaccagaactcttgattgctttcagtctgaatggtatgagttaatacagaaaggagtgactgaacttagaactgttgggaatgttccagatgtctacacccagattatgcttttggaaaatgagaacaaaaatttaaagaaagatttgaagcactacaaacaagcagctgagtatgttattttttaaatgacattttcttctttttcttttggactaaataaaagagttgagtgaagctgatatatgtaatataccagagccttaatttttgaaaactgaatttttctagttgtaaagaatgtgagaggcttcattagcaaattaattaaacagatgatcagaactatcacaattataacttaccaacaagaagggaatgcaggtagttgtttaggagatggtacattttttatataacattcacttccttgtgtatttgatagtcttttcatggtttataacattttctcctgtaaagataggctaatttctgaaataataattaaatttatagaaagccgagaggaaattgctagtttattcctggtagaggaatttctgtatttgaaaattctccagaaggaataatataaactgtggactttgggtgataatgatatgtaggttcgtcagttgttaacaaatgtatccctctgttgggggctattgataatggggaaggctgtgcatgtgtgggagtaggaggtgtatgggacatctctgtaccttctaatcaattttgctatgaacttaaaactgctctaaaaataaagtttattaaaaaaaagttaat

SEQ ID NO: 343454 - DNA, 1095 bp, Homo sapiens
agagatgccggaatctcgcgagagctcccgggggccgttgggtagcgtcttcgctgttgcccttagggacggctgtgggcctgctgggggtgggggcccgaagcgccagagatggctgctcagcgagggatgcccagctccgccgtgagggtcctggaagaggcgttgggcatgggtttgacggcagccggggacgcgagggacacggcggacgcggtggcggctgagggcgcctactacctggaacaggtcaccataactgaagcatctgaagatgactatgaatatgaagagataccagatgacaattttagcatcccagaaggtgaagaagatctggcaaaagcaattcagatggcccaagaacaggctacagatactgaaattttggaacggaaaacagttcttccttcaaagcatgcagtacctgaagtaatagaagactttctctgcaatttcttgatcaaaatgggaatgaccagaactcttgattgctttcagtctgaatggtatgagttaatacagaaaggagtgactgaacttagaactgttgggaatgttccagatgtctacacccagattatgcttttggaaaatgagaacaaaaatttaaagaaagatttgaagcactacaaacaagcagctgacaaagctagagaagatttgctgaaaattcagaaagaacgtgattttcatcgaatgcatcataagcgaatagtccaggaaaaaaacaaattaattaatgacctcaaagggttgaagttacattatgcatcttatgaaccgactataagggtgttacatgagaaacaccacactttactgaaggagaaaatgctgacctccttggaaagagacaaagtagttgggcagatttctggacttcaagaaacattgaagaaactgcaaagaggacatagttaccatggtcctcaaattaaaggtaaatgtaaaatgtgatgaagctctcatttaatatagtttggtgatttctcaaccttatcagtgattaatattctagagatatttaaaagtgagtaagtggtggctatttcacaaattaaaattttaataaaaagattaagaaaaaatata

SEQ ID NO: 343455 - DNA, 410 bp, Homo sapiens
catgatggtattggtacctagaagtcatattttattctaaaatatattatgactgttggacattttaacttataaatgtaatactgcaactaattactataacactccctgagacttaactttttgaattgtacataaattaagccaatttggcagaaagaaatgatataaacccttttgtttgattttatcctaggtatgagttaatacagaaaggagtgactgaacttagaactgttgggaatgttccagatgtctacacccagattatgcttttggaaaatgagaacaaaaatttaaagaaagatttgaagcactacaaacaagcagctgagtatgttattttttaaatgacattttcttctttttcttttggactaaataaaagagttgagtgaagctgatatatg

SEQ ID NO: 343456 - DNA, 315 bp, Homo sapiens
ttctctttctctgtgatctagataccagatgacaattttagcatcccagaaggtgaagaagatctggcaaaagcaattcagatggcccaagaacaggctacagatactgaaattttggtgagaatttgaacactagtgtagtctatagtttagtggtagtgctttttatatgaagtttggaaagtcttttaaatgtaaatactagtgtagctcagtcatctgttatatcattttcatctctgtttatttgtgatcaagccttcactttaaggtaagcagtcatatttactcttttttggattgccattctccaca

SEQ ID NO: 343457 - DNA, 325 bp, Homo sapiens
tgagttttattttttaataaacgagagattttcagttgctagtagttctgaaaaagtgatggtggaaagcacttgagatggggcaagaatggtgatatttagatagccttattattttttcagcagaattgttagattacattttctattatagataaaagcagttgcccacaaactaatcctgaatttattagaagtgacgtttattgacatttacaaggaagtcagaagaaagcagttattcatttttcatggatcttcagaatgacatggtattttacataaagtatttctttgatcctttgatttgtgaagcaaaattatt

SEQ ID NO: 343458 - DNA, 1458 bp, Homo sapiens
agagatgccggaatctcgcgagagctcccgggggccgttgggtagcgtcttcgctgttgcccttagggacggctgtgggcctgctgggggtgggggcccgaagcgccagagatggctgctcagcgagggatgcccagctccgccgtgagggtcctggaagaggcgttgggcatgggtttgacggcagccggggacgcgagggacacggcggacgcggtggcggctgagggcgcctactacctggaacaggtcaccataactgaagcatctgaagatgactatgaatatgaagagataaaagcagttgcccacaaactaatcctgaatttattagaagtgacgtttattgacatttacaaggaagtcagaagaaagcagttattcatttttcatggatcttcagaatgacatgataccagatgacaattttagcatcccagaaggtgaagaagatctggcaaaagcaattcagatggcccaagaacaggctacagatactgaaattttgcacctttcatggtacctggtacatgggagatgttcaccaattatatgttgaataaatatcctacgtaaaggaacggaaaacagttcttccttcaaagcatgcagtacctgaagtaatagaagactttctctgcaatttcttgatcaaaatgggaatgaccagaactcttgattgctttcagtctgaatggtatgagttaatacagaaaggagtgactgaacttagaactgttgggaatgttccagatgtctacacccagattatgcttttggaaaatgagaacaaaaatttaaagaaagatttgaagcactacaaacaagcagctgagtatgttattttttaaatgacattttcttctttttcttttggactaaataaaagagttgagtgaagctgatatatgtaatataccagagccttaatttttgaaaactgaatttttctagttgtaaagaatgtgagaggcttcattagcaaattaattaaacagatgatcagaactatcacaattataacttaccaacaagaagggaatgcaggtagttgtttaggagatggtacattttttatataacattcacttccttgtgtatttgatagtcttttcatggtttataacattttctcctgtaaagataggctaatttctgaaataataattaaatttatagaaagccgagaggaaattgctagtttattcctggtagaggaatttctgtatttgaaaattctccagaaggaataatataaactgtggactttgggtgataatgatatgtaggttcgtcagttgttaacaaatgtatccctctgttgggggctattgataatggggaaggctgtgcatgtgtgggagtaggaggtgtatgggacatctctgtaccttctaatcaattttgctatgaacttaaaactgctctaaaaataaagtttattaaaaaaaagttaat

SEQ ID NO: 343459 - DNA, 802 bp, Homo sapiens
agagatgccggaatctcgcgagagctcccgggggccgttgggtagcgtcttcgctgttgcccttagggacggctgtgggcctgctgggggtgggggcccgaagcgccagagatggctgctcagcgagggatgcccagctccgccgtgagggtcctggaagaggcgttgggcatgggtttgacggcagccggggacgcgagggacacggcggacgcggtggcggctgagggcgcctactacctggaacaggtcaccataactgaagcatctgaagatgactatgaatatgaagagataccagatgacaattttagcatcccagaaggtgaagaagatctggcaaaagcaattcagatggcccaagaacaggctacagatactgaaattttgcaaagctagagaagatttgctgaaaattcagaaagaacgtgattttcatcgaatgcatcataagcgaatagtccaggaaaaaaacaaattaattaatgacctcaaagggttgaagttacattatgcatcttatgaaccgactataagggtgttacatgagaaacaccacactttactgaaggagaaaatgctgacctccttggaaagagacaaagtagttgggcagatttctggacttcaagaaacattgaagaaactgcaaagaggacatagttaccatggtcctcaaattaaagttgcttcaaagagaataaaatacctaagaatccaacttacaaaggatgtgaaggacgtcttcaaggagaactacaaaccactgctcaatgaagtaaaagaggacacaaacaaatgg

SEQ ID NO: 343460 - DNA, 1035 bp, Homo sapiens
agagatgccggaatctcgcgagagctcccgggggccgttgggtagcgtcttcgctgttgcccttagggacggctgtgggcctgctgggggtgggggcccgaagcgccagagatggctgctcagcgagggatgcccagctccgccgtgagggtcctggaagaggcgttgggcatgggtttgacggcagccggggacgcgagggacacggcggacgcggtggcggctgagggcgcctactacctggaaccttatctatatccagtgcccttgctactgaatgattaaaacttgacaagatattcagaggtcaccataactgaagcatctgaagatgactatgaatatgaagagataaaagcagttgcccacaaactaatcctgaatttattagaagtgacgtttattgacatttacaaggaagtcagaagaaagcagttattcatttttcatggatcttcagaatgacatgataccagatgacaattttagcatcccagaaggtgaagaagatctggcaaaagcaattcagatggcccaagaacaggctacagatactgaaattttggaacggaaaacagttcttccttcaaagcatgcagtacctgaagtaatagaagactttctctgcaatttcttgatcaaaatgggaatgaccagaactcttgattgctttcagtctgaatggtatgagttaatacagaaaggagtgactgaacttagaactgttgggaatgttccagatgtctacacccagattatgcttttggaaaatgagaacaaaaatttaaagaaagatttgaagcactacaaacaagcagctgacaaagctagagaagatttgctgaaaattcagaaagaacgtgattttcatcgaatgcatcataagcgaatagtccaggaaaaaaacaaattaattaatgacctcaaaggatttctggacttcaagaaacattgaagaaactgcaaagaggacatagttaccatggtcctcaaattaaagagtccagcctgggcgacagagcgaggctccgtctc

SEQ ID NO: 343461 - DNA, 252 bp, Homo sapiens
gaggaggtgatgtaaaaaccgaagcagaacttagagtaatgtggccataaagccaagagatgctggcagcctctagagaaggaaggatccacccctgcaggctacagagggaacgtaggcctacggacaccatgattttggacttctggactgtagaacaggaagagtgtaagtttctgctgtttaaacaaccaaacgtgtgataatatgttatggcagccactacaagaaacaagctccttaatcagagat

SEQ ID NO: 343462 - DNA, 727 bp, Homo sapiens
ccttcacctgacagctttgtttccagtcagggacttcttccatgctgcctacatggctagaatgcctccttgccctcagggcaaccgactggtcatcttcctctcaccatttaaacttcactctccaagaagtcttgtcagatactctgttaggagatactacttttactaaaataatggatcacaaccctggctataccctggaatcactaatgtgtgacaagttaagcttcatcagtatgttaggtgccttaaagtaaaatactgatacctagactacataccagacagaatctctaggcaaaggaaccagatattggctgtggtgggttgcttttttttttttttttttttttggtctgtttttttccacagccccacaggtgatctattgagcagccagagttataaaccaccacaggctgagcattctttaatccaaaatgctccaaaatctgaaactttttgagcaccaacatgacaccatagtggaaaattccacacacgaccctgtgatgggttgcggtcaaaatgcgggcataaggccgggtgtagtggctcacacctataatcccaacactttgggaggccaaagagggagaattgcttgaggccaggagttcaagaccagcctagtcaacatagcaagaccccatctctacaaacaatacaaaaattagctaggcatggttgtgcatacctgtagtcctagctacttgggaagtta

SEQ ID NO: 343463 - DNA, 418 bp, Homo sapiens
ctctgagcatccctcccccttgcttagtcagctccagccaagtgtccttcctgaagacccttcactgtgccaggcacgtcctcaccttagggcattggcacaggttgttccctctgcccagagctccacatggttcattctcacctcctgcaagtctctgctcagatctcatcttcccagtaagaacctattcagctctgcagcctgacctactaccctgagagccccaacactccattatccccaggctctactttttccttttctccctaacatcgatcactttctagcctactatgcgatttgcttattattatgcttattattcactgcctgtctgcatcctgttacaatgtgggctccaggacagcagacagccttgtctgttttgtcctcagctgaattcccagtgcctggc

SEQ ID NO: 343464 - DNA, 468 bp, Homo sapiens
tatctttattaatgcaaccgaagagacctaagagtgcattcacttatcccactttctgttcctgtggtcttctttctcccatgaagcagaaactggataaagctcaagattttccatagacaaaccaaagcccactcatcccctcctaccccaatccaacctctgctggctcctgcatctcacttggaggtcaaacctcctcctgaggccaatgcattcccaacttccagttctttcctttaccctggagagttagtaaggtaagaaccattctttctctccaaaaccactcctccttggctggcaagttggtgtcctaactccgttctcttcctagctcatggcctctctagataataaagttgtctcctcctttctggatctcttcctcctaacacccctcccctgaaaccctggactctgccctctctccaagaaatggcttttcggggatcctcgagaacacta

SEQ ID NO: 343465 - DNA, 1930 bp, Homo sapiens
tatctttattaatgcaaccgaagagacctaagagtgcattcacttatcccactttctgttcctgtggtcttctttctcccatgaagcagaaactggataaagctcaagattttccatagacaaaccaaagcccactcatcccctcctaccccaatccaacctctgctggctcctgcatctcacttggaggtcaaacctcctcctgaggccaatgcattcccaacttccagttctttcctttaccctggagagttagtaaggtaagaaccattctttctctccaaaaccactcctccttggctggcaagttggtgtcctaactccgttctcttcctagctcatggcctctctagataataaagttgtctcctcctttctggatctcttcctcctaacacccctcccctgaaaccctggactctgccctctctccaagaaaatccatctattcaactattcttgcattcaattactctaaatgagagcgtgttggagctatggcaaattccctgttgtcaccttgctattttgcagacaacataatatttaacctctcataaccagagaggttaaataatttgtcaaatgcaatacagtaagacagaggcaaggacaaggtttgacttccagcccagcctcttttccacaacctgctaaatcttgatccatctgaaaacttttctaattagtgaagatgactaataaaaattttccctatctccaaggtaggagctttctggaagtttctagaaattttcaataaccaccagccaaggttacctccaggtaaccttgcagcaccaggctggaagtcagatcggcttcactatcttccaactctacagcctgtatctctccatccccagctttgacctttcctgctcaagtaacctacgggcacatccagcgtcactaaaaactcagggcttttcttcccggttactcctccaagcgttccctggtatcctcaacctcagatcccaggttcagatttctgcagtcaatctatgacccctctcttcttgcatccttcatatgccaccagacaccatgcccagtccagcctgattttgaaacaactttcatgccggtcttctcttccctgacatgttactgtccaggctcaagtcctcagcttctcatatctgcatctttgcaaccaacttcctcccttgcctctctgcttttccatcccacttttcatgtgtcctccataccatctataacagtgatctccctggaacactcaagaagacacaacataccatattatttaaagaccagggtactggacagtggctcacacctgtattcccgaatttgagagtctgaagcgggaggatcacttgaggccaggagttaagagaccagcctgggcaacacagcaagaccctgtctctaaaaaaaaaaattaattaactgggtatggtggcacatgcctgtagtcccagctactcaggaggctgaggtgggaggatgacttgagcccaggagtttgaggctgcaaggagctatgatcatgccagtgcatcccagctctaggtgagacagtgagatccggtctccaaaataaatcaatcaatcaaataaagaccaaagtcaaaccgcacatcaggatctctcacacccttccaattttgccatctaccagcacttagctaaacccatctcccatctcttccaccatgaattcactctttcaaaaaggctaatgtcttcttactcacccttgcctctaagcctttgctatcaccatttcccccaagctggagggccctccctctccctttacccctcttccactacctcccacccctactttttccagatagccatttcctctcttttttctgattgatccttccctctcacccaggattagatgctggaaatgaccacttctggagggcagggaacaagcccttaatct

SEQ ID NO: 343466 - DNA, 1834 bp, Homo sapiens
  misc_feature (1817)..(1818): n is a, c, g, or t
tatctttattaatgcaaccgaagagacctaagagtgcattcacttatcccactttctgttcctgtggtcttctttctcccatgaagcagaaactggataaagctcaagattttccatagacaaaccaaagcccactcatcccctcctaccccaatccaacctctgctggctcctgcatctcacttggaggtcaaacctcctcctgaggccaatgcattcccaacttccagttctttcctttaccctggagagttagtaaggtaagaaccattctttctctccaaaaccactcctccttggctggcaagttggtgtcctaactccgttctcttcctagctcatggcctctctagataataaagttgtctcctcctttctggatctcttcctcctaacacccctcccctgaaaccctggactctgccctctctccaagaaaatccatctattcaactattcttgcattcaattactctaaatgagagcgtgttggagctatggcaaattccctgttgtcaccttgctattttgcagacaacataatatttaacctctcataaccagagaggttaaataatttgtcaaatgcaatacagtaagacagaggcaaggacaaggtttgacttccagcccagcctcttttccacaacctgctaaatcttgatccatctgaaaacttttctaattagtgaagatgactaataaaaattttccctatctccaaggtaggagctttctggaagtttctagaaattttcaataaccaccagccaaggttacctccaggtaaccttgcagcaccaggctggaagtcagatcggcttcactatcttccaactctacagcctgtatctctccatccccagctttgacctttcctgctcaagtaacctacgggcacatccagcgtcactaaaaactcagggcttttcttcccggttactcctccaagcgttccctggtatcctcaacctcagatcccaggttcagatttctgcagtcaatctatgacccctctcttcttgcatccttcatatgccaccagacaccatgcccagtccagcctgattttgaaacaactttcatgccggtcttctcttccctgacatgttactgtccaggctcaagtcctcagcttctcatatctgcatctttgcaaccaacttcctcccttgcctctctgcttttccatcccacttttcatgtgtcctccataccatctataacagtgatctccctggaacactcaagaagacacaacataccatattatttaaagaccagggtactggacagtggctcacacctgtattcccgaatttgagagtctgaagcgggaggatcacttgaggccaggagttaagagaccagcctgggcaacacagcaagaccctgtctctaaaaaaaaaaattaattaactgggtatggtggcacatgcctgtagtcccagctactcaggaggctgaggtgggaggatgacttgagcccaggagtttgaggctgcaaggagctatgatcatgccagtgcatcccagctctaggtgagacagtgagatccggtctccaaaataaatcaatcaatcaaataaagaccaaagtcaaaccgcacatcaggatctctcacacccttccaattttgccatctaccagcacttagctaaacccatctcccatctcttccaccatgaattcactctttcaaaaaggctaatgtcttcttactcacccttgcctctaagcctttgctatcaccatttcccccaagctggagggccctccctctccctttacccctcttccactacctccctaaacnnggatcctctagatcat

SEQ ID NO: 343467 - DNA, 1791 bp, Homo sapiens
tatctttattaatgcaaccgaagagacctaagagtgcattcacttatcccactttctgttcctgtggtcttctttctcccatgaagcagaaactggataaagctcaagattttccatagacaaaccaaagcccactcatcccctcctaccccaatccaacctctgctggctcctgcatctcacttggaggtcaaacctcctcctgaggccaatgcattcccaacttccagttctttcctttaccctggagagttagtaaggtaagaaccattctttctctccaaaaccactcctccttggctggcaagttggtgtcctaactccgttctcttcctagctcatggcctctctagataataaagttgtctcctcctttctggatctcttcctcctaacacccctcccctgaaaccctggactctgccctctctccaagaaaatccatctattcaactattcttgcattcaattactctaaatgagagcgtgttggagctatggcaaattccctgttgtcaccttgctattttgcagacaacataatatttaacctctcataaccagagaggttaaataatttgtcaaatgcaatacagtaagacagaggcaaggacaaggtttgacttccagcccagcctcttttccacaacctgctaaatcttgatccatctgaaaacttttctaattagtgaagatgactaataaaaattttccctatctccaaggtaggagctttctggaagtttctagaaattttcaataaccaccagccaaggttacctccaggtaaccttgcagcaccaggctggaagtcagatcggcttcactatcttccaactctacagcctgtatctctccatccccagctttgacctttcctgctcaagtaacctacgggcacatccagcgtcactaaaaactcagggcttttcttcccggttactcctccaagcgttccctggtatcctcaacctcagatcccaggttcagatttctgcagtcaatctatgacccctctcttcttgcatccttcatatgccaccagacaccatgcccagtccagcctgattttgaaacaactttcatgccggtcttctcttccctgacatgttactgtccaggctcaagtcctcagcttctcatatctgcatctttgcaaccaacttcctcccttgcctctctgcttttccatcccacttttcatgtgtcctccataccatctataacagtgatctccctggaacactcaagaagacacaacataccatattatttaaagaccagggtactggacagtggctcacacctgtattcccgaatttgagagtctgaagcgggaggatcacttgaggccaggagttaagagaccagcctgggcaacacagcaagaccctgtctctaaaaaaaaaaattaattaactgggtatggtggcacatgcctgtagtcccagctactcaggaggctgaggtgggaggatgacttgagcccaggagtttgaggctgcaaggagctatgatcatgccagtgcatcccagctctaggtgagacagtgagatccggtctccaaaataaatcaatcaatcaaataaagaccaaagtcaaaccgcacatcaggatctctcacacccttccaattttgccatctaccagcacttagctaaacccatctcccatctcttccaccatgaattcactctttcaaaaaggctaatgtcttcttactcacccttgcctctaagcctttgctatcaccatttcccccagtgcgtcagagtactcggggagtcctc

SEQ ID NO: 343468 - DNA, 952 bp, Homo sapiens
tatctttattaatgcaaccgaagagacctaagagtgcattcacttatcccactttctgttcctgtggtcttctttctcccatgaagcagaaactggataaagctcaagattttccatagacaaaccaaagcccactcatcccctcctaccccaatccaacctctgctggctcctgcatctcacttggaggtcaaacctcctcctgaggccaatgcattcccaacttccagttctttcctttaccctggagagttagtaaggtaagaaccattctttctctccaaaaccactcctccttggctggcaagttggtgtcctaactccgttctcttcctagctcatggcctctctagataataaagttgtctcctcctttctggatctcttcctcctaacacccctcccctgaaaccctggactctgccctctctccaagaaaatccatctattcaactattcttgcattcaattactctaaatgagagcgtgttggagctatggcaaattccctgttgtcaccttgctattttgcagacaacataatatttaacctctcataaccagagaggttaaataatttgtcaaatgcaatacagtaagacagaggcaaggacaaggtttgacttccagcccagcctcttttccacaacctgctaaatcttgatccatctgaaaacttttctaattagtgaagatgactaataaaaattttccctatctccaaggtaggagctttctggaagtttctagaaattttcaataaccaccagccaaggttacctccaggtaaccttgcagcaccaggctggaagtcagatcggcttcactatcttccaactctacagcctgtatctctccatccccagctttgacctttcctgctcaagtaacctacgggcacatccagcgtcactaaaacccatctatgaaagcaacacaggccttatctgcg

SEQ ID NO: 343469 - DNA, 482 bp, Homo sapiens
tatcgagacggtgaccgtgagaggcataccttaaggctcctaggtttggtgctgaaactgcaactatgatcatgccagtgcatcccagctctaggtgagacagtgagatccggtctccaaaataaatcaatcaatcaaataaagaccaaagtcaaaccgcacatcaggatctctcacacccttccaattttgccatctaccagcacttagctaaacccatctcccatctcttccaccatgaattcactctttcaaaaaggctaatgtcttcttactcacccttgcctctaagcctttgctatcaccatttcccccaagctggagggccctccctctccctttacccctcttccactacctcccacccctactttttccagatagccatttcctctcttttttctgattgatccttccctctcacccaggattagatgctggaaatgaccacttctggagggcagggaacaagcccttaatct

SEQ ID NO: 343470 - DNA, 862 bp, Homo sapiens
ctctcaacccctgccattgcctcttcatggtaccctagtttgagtcctggtaatgggttacaatggaataaggaatgggagcattcctgttctaagtccctctctgtgctttgcacactaaagcccactcaaacaccaggagcctaggtatgcctctgagattaaagggagttttcagaccccaggtccccagtccagagaacaccattatcatcatagcatgccttgaaatgggggcaagggccagtctatattagagtgaactgcatcgattttggtgctaccctttcccacttgtatggccttgggccagtcatctcatatctctatttcctcatctgatcaatggagtttatactcgctgtcttgtaaaaatgttgcattacagtattaaaaacaacagatttgaaagtaacacaatatgtagtagctgaacaagaaatactatttccccttttccaacagagtctaagttaccaaaaagaagaaaaatgtaaaagagagctttttattctccctcatttttttaagtagttaaaactttacaaaatctaaattacctcaaagatctagataaataggtagggggagaaggtgtgtgctggtactctgttctccaggagtctgggaaaagggaaagacccaagctgaaagaaacatgaagacagtggaaaggagaggtatcaaggccaaccctcagctttcttagacaaaacaggtacgttctgtgaaggattactcagaatgtgatgtcaggcagcctcccctctgtgtctctttctccagctctccctcttgagactccatttcccctttgacaaccctgccttatcttcataactgtggactgtctttttctgta

SEQ ID NO: 343471 - DNA, 7281 bp, Homo sapiens
  misc_feature (2618)..(2618): n is a, c, g, or t
  misc_feature (2620)..(2620): n is a, c, g, or t
  misc_feature (2625)..(2626): n is a, c, g, or t
  misc_feature (2629)..(2630): n is a, c, g, or t
  misc_feature (2635)..(2635): n is a, c, g, or t
  misc_feature (2637)..(2637): n is a, c, g, or t
  misc_feature (2705)..(2705): n is a, c, g, or t
  misc_feature (3991)..(3991): n is a, c, g, or t
  misc_feature (4107)..(4107): n is a, c, g, or t
  misc_feature (4315)..(4315): n is a, c, g, or t
acgatctaaaacagacagagatgataaatattttagctattcaaaacttgaatgagatactcggtatgtatcttcccgatgtagatcagaaagagagcgacggcggagcagatctcactctaggtctgagagaggctctagaactaatttatcctattccagatcagaacgatctcattattatgactctgatcgtcgctaccataggagctccccttatcgagagaggacgcgctattctcggccatacacagataacagagcacgagagagttctgactcagaagaagagtataagaagacatactcaaggcgtacctcatctcattcctcttcttacagggacctaaggacatcatcctattctaaatctgatcgggactgtaaaactgagacctcttacttagagatggaaagaagaggcaagtattcttcaaaactagaaagagaatctaaaaggacttcagaaaatgaagcaattaaaagatgttgttctccccctaatgaactgggattccgacgagggtcatcatattctaagcatgacagtagtgcttcccgttataaatctaccctttcaaaacctatacccaagtctgataaatttaaaaattctttctgttgtacagaattaaatgaagaaatcaaacaatctcattcttttagtttacagacaccttgttcaaaaggtagtgaattaagaatgattaataaaaatcctgaaagagaaaaggctgggtctccagctccatcaaatcgattaaatgattcacctactttaaaaaagctagatgaattgcctatttttaagtccgaatttataacacatgatagccatgatagtattaaggaattagactctttatctaaagtgaagaatgatcaattaagaagtttttgtcccatagaattaaatataaatggatctcctggggcagaatctgatttggcaacattttgcacttctaaaactgatgctgttttaatgacttctgatgatagtgtgactggatcggaattatcccctttggtcaaagcatgcatgctttcatcaaatggatttcagaatattagtaggtgcaaagaaaaagacttggatgatacctgcatgctgcataagaagtcagaaagcccatttagagaaacagaacctctggtgtcaccacaccaagataaactcatgtctatgccagttatgactgtggattattccaaaacagtagttaaagaaccagttgatacgagggtttcttgctgcaaaaccaaagattcagacatatactgtactttgaacgatagcaacccttctttgtgtaactctgaagctgaaaatattgagccttcagttatgaagatttcttcaaatagctttatgaatgtgcatttggaatcaaaaccagttatatgtgatagtagaaatttgacagatcactcaaaatttgcatgtgaagaatataagcagagcatcggtagcactagttcagcttctgttaatcattttgatgatttatatcaacctattgggagttcaggtattgcttcatctcttcagagtcttccaccaggaataaaggtggacagtctaactctcttgaaatgcggagagaacacatctccagttctggatgcagtgctaaagagtaaaaaaagttcagagtttttaaagcatgcagggaaagaaacaatagtagaagtaggtagtgaccttcctgattcaggaaagggatttgcttccagggagaacaggcgtaataatgggttatctgggaaatgtttgcaagaggctcaaaaagaagggaattccatattgcctgaaagaagaggaagaccagaaatctctttagatgaaagaggagaaggaggacatgtgcatacttctgatgactcagaagttgtattttcttcttgtgatttgaatttaaccatggaagacagtgatggtgtaacttatgcattaaagtgtgacagtagtggtcatgccccagaaattgtgtctacagttcatgaagattattctggctcttctgaaagttcaaatgatgaaagtgattcagaagatacggattcggatgatagcagtattccaagaaaccgtctccagtctgttgtggttgtgccaaagaattctactttgcccatggaagaaacaagtccttgttcttctcggagcagtcaaagttatagacactattctgaccattgggaagatgagagattggagtcaaggagacatttgtatgaggaaaaatttgaaagtatagcaagtaaagcctgtcctcaaactgataagtttttccttcataaaggaacagagaagaatccggaaatttcttttacacagtccagtagaaaacaaatagataaccgcctgcctgaactttctcatcctcagagtgatggggttgatagtacaagtcatacagatgtgaaatctgaccctctgggtcacccaaattcagaggaaaccgtgaaagccaaaataccttctaggcagcaagaagagctgccaatttattcttctgattttgaagatgtcccaaataagtcttggcaacagaccactttccaaaacaggccagatagtagactgggaaaaacagaattgagtttttcttccncntgtgnnatnncacangnggatggcttgcactcatcagaagagctcagaaacttaggttgggacttctctcaagaaaagccttctnccacgtatcagcaacctgacagtagctatggagcttgtggtggacacaagtatcagcaaaatgcagaacagtatggtgggacacgtgattactggcaaggcaatggttactgggatccaagatcaggtagacctcctggaactggggttgtgtatgatcgaactcaaggacaagtaccagattccctaacagatgatcgtgaagaagaggagaattgggatcaacaggatggatcccatttttcagaccagtccgataaatttcttctatcccttcagaaagacaaggggtcagtgcaagcacctgaaataagcagcaattccattaaggacactttagctgtgaatgaaaagaaagatttttcaaaaaacttagaaaaaaatgatatcaaagatagagggcctcttaaaaaaaggaggcaggaaatagagagtgattctgaaagtgatggtgagcttcaggacagaaagaaagttagagtggaggtagagcagggagagacatcagtgcccccaggttcagcactggttgggccctcctgtgtcatggatgacttcagggacccacagcgatggaaggaatgtgccaagcaagggaaaatgccatgttactttgatcttattgaagaaaatgtttatttaacagaaagaaagaagaataaatctcatcgagatattaagcgaatgcagtgtgagtgtacacctctttctaaagatgaaagagctcaaggtgaaatagcatgtggggaagattgtcttaatcgtcttctcatgattgaatgttcttctcggtgtccaaatggggattattgttccaatagacggtttcagagaaaacagcatgcagatgtggaagtcatactcacagaaaagaaaggctggggcttgagagctgccaaagaccttccttcgaacacctttgtcctagaatattgtggagaggtactcgatcataaagagtttaaagctcgagtgaaggagtatgcacgaaacaaaaacatccattactatttcatggccctgaagaatgatgagataatagatgccactcaaaaaggaaattgctctcgtttcatgaatcacagctgtgaaccaaattgtgaaacccaaaaatggactgtgaacggacaactgagggttgggttttttaccaccaaactggttccttcaggctcagagttaacgtttgactatcagttccagagatatggaaaagaagcccagaaatgtttctgcggatcagccaattgccggggttacctgggaggagaaaacagagtcagcatnagagcagcaggagggaaaatgaagaaggaacgatctcgtaagaaggattcagtggatggagagctagaagctctgatggaaaatggtgagggtctctctgataaaaaccaggtgcncagcttatcccggctaatggttagaattgaaactttggagcagaaacttacctgtctggaactcatacagaacacacactcacagtcctgcctgaagtcctttctggaacgtcatgggctgtctttgttgtggatctggatggcagagctaggtgacggccgggaaagtaaccagaagcttcaggaagagattataaagactttggancacttgcccattcctactaaaaatatgttggaggaaagcaaagtacttccaattattcaacgctggtctcagactaagactgctgtccctccgttgagtgaaggagatgggtattctagtgagaatacatcgcgtgctcatacaccactcaacacacctgatccttccaccaagctgagcacagaagctgacacagacactcccaagaaactaatgtttcgcagactgaaaattataagtgaaaatagcatggacagtgcaatctctgatgcaaccagtgagctagaaggcaaggatggcaaagaggatcttgatcaattagaaaatgtccctgtagaggaagaggaagaattgcagtcacaacagctactcccacaacagctgcctgaatgcaaagttgatagtgaaaccaacatagaagctagtaagctacctacatctgaaccagaagctgacgctgaaatagagcccaaagagagcaacggcacaaaactagaagaacctattaatgaagaaacaccatcccaagatgaagaggagggtgtgtctgatgtggagagtgaaaggagccaagaacagccagataaaacagtggatataagtgatttggccaccaaactcctggacagttggaaagacctaaaggaggtatatcgaattccaaagaaaagtcaaactgaaaaggaaaacacaacaactgaacgaggaagggatgctgttggcttcagagatcaaacacctgccccgaagactcctaataggtcaagagagagagacccagacaagcaaactcaaaataaagagaaaaggaaacgaagaagctccctctcaccaccctcttctgcctatgagcggggaacaaaaaggccagatgacagatatgatacaccaacttctaaaaagaaagtacgaattaaagaccgcaataaactttctacagaggaacgccggaagttgtttgagcaagaggtggctcaacgggaggctcagaaacaacagcaacagatgcagaacctgggaatgacatcaccactgccctatgactctcttggttataatgccccgcatcatccctttgctggttacccaccaggttatcccatgcaggcctatgtggatcccagcaaccctaatgctggaaaggtgctcctgcccacacccagcatggacccagtgtgttctcctgctccttatgatcatgctcagcccttggtgggacattctacagaacccctttctgcccctccaccagtaccagtggtgccacatgtggcagctcctgtggaagtttccagttcccagtatgtggcccagagtgatggtgtagtacaccaagactccagcgttgctgtcttgccagtgccggcccccggcccagttcagggacagaattatagtgtttgggattcaaaccaacagtctgtcagtgtacagcagcagtactctcctgcacagtctcaagcaaccatatattatcaaggacagacatgtccaacagtctatggtgtgacatcaccttattcacagacaactccaccaattgtacagagttatgcccagccaagtcttcagtatatccaggggcaacagattttcacagctcatccacaaggagtggtggtacagccagccgcagcagtgactacaatagttgcaccagggcagcctcagcccttgcagccatctgaaatggttgtgacaaataatctcttggatctgccgcccccctctcctcccaaaccaaaaaccattgtcttacctcccaactggaagacagctcgagatccagaagggaagatttattactaccatgtgatcacaaggcagactcagtgggatcctcctacttgggaaagcccaggagatgatgccagccttgagcatgaagctgagatggacctgggaactccaacatatgatgaaaaccccatgaaggcctcgaaaaagcccaagacagcagaagcagacacctccagtgaactagcaaagaaaagcaaagaagtattcagaaaagagatgtcccagttcatcgtccagtgcctgaacccttaccggaaacctgactgcaaagtgggaagaattaccacaactgaagactttaaacatctggctcgcaagctgactcacggtgttatgaataaggagctgaagtactgtaagaatcctgaggacctggagtgcaatgagaatgtgaaacacaaaaccaaggagtacattaagaagtacatgcagaagtttggggctgtttacaaacccaaagaggacactgaattagagtgactgttgggccagggtgggaggatgggtggtcaggtaagacagactctagggagaggaaatcctgtgggcctttctgtcccacccctgtcagcactgtgctactgatgatacatcaccctggggaattcaaccctgcagatgtcaactgaaggccacaaaaatgaactccatctacaagtgattacctagttgtgagctgttggcatgtggttagaagccatcagaggtgcaagggcttagaaaagaccctggccagacctgactccactcttaaacctgggtcttctccttggcggtgctgtcagcgcacagacccatgcgcatccccacccacaaccctttaccctgatgatctgtattatattttaatgtatatgtgaatatattgaaaataatttgttttttcctggtttttgtttggttttcgttttgcttttagcctctacatgctaggatcacaggaagactttgtaaggacagtttaagttctcctgcaaggtttaatttgttatcatgtaaatattccaaagcaggctgccttgtggttttggccagccttgtgctatgttgataagattgatttactgcttaaaatcactttactttatccaatttttactgaactttttatgtaaaaaaataaaatcaattaaagaacttggcatgtgtgttccctaaaagttaat

SEQ ID NO: 343472 - DNA, 7514 bp, Homo sapiens
  misc_feature (2618)..(2618): n is a, c, g, or t
  misc_feature (2620)..(2620): n is a, c, g, or t
  misc_feature (2625)..(2626): n is a, c, g, or t
  misc_feature (2629)..(2630): n is a, c, g, or t
  misc_feature (2635)..(2635): n is a, c, g, or t
  misc_feature (2637)..(2637): n is a, c, g, or t
  misc_feature (2705)..(2705): n is a, c, g, or t
  misc_feature (3991)..(3991): n is a, c, g, or t
  misc_feature (4107)..(4107): n is a, c, g, or t
  misc_feature (4315)..(4315): n is a, c, g, or t
acgatctaaaacagacagagatgataaatattttagctattcaaaacttgaatgagatactcggtatgtatcttcccgatgtagatcagaaagagagcgacggcggagcagatctcactctaggtctgagagaggctctagaactaatttatcctattccagatcagaacgatctcattattatgactctgatcgtcgctaccataggagctccccttatcgagagaggacgcgctattctcggccatacacagataacagagcacgagagagttctgactcagaagaagagtataagaagacatactcaaggcgtacctcatctcattcctcttcttacagggacctaaggacatcatcctattctaaatctgatcgggactgtaaaactgagacctcttacttagagatggaaagaagaggcaagtattcttcaaaactagaaagagaatctaaaaggacttcagaaaatgaagcaattaaaagatgttgttctccccctaatgaactgggattccgacgagggtcatcatattctaagcatgacagtagtgcttcccgttataaatctaccctttcaaaacctatacccaagtctgataaatttaaaaattctttctgttgtacagaattaaatgaagaaatcaaacaatctcattcttttagtttacagacaccttgttcaaaaggtagtgaattaagaatgattaataaaaatcctgaaagagaaaaggctgggtctccagctccatcaaatcgattaaatgattcacctactttaaaaaagctagatgaattgcctatttttaagtccgaatttataacacatgatagccatgatagtattaaggaattagactctttatctaaagtgaagaatgatcaattaagaagtttttgtcccatagaattaaatataaatggatctcctggggcagaatctgatttggcaacattttgcacttctaaaactgatgctgttttaatgacttctgatgatagtgtgactggatcggaattatcccctttggtcaaagcatgcatgctttcatcaaatggatttcagaatattagtaggtgcaaagaaaaagacttggatgatacctgcatgctgcataagaagtcagaaagcccatttagagaaacagaacctctggtgtcaccacaccaagataaactcatgtctatgccagttatgactgtggattattccaaaacagtagttaaagaaccagttgatacgagggtttcttgctgcaaaaccaaagattcagacatatactgtactttgaacgatagcaacccttctttgtgtaactctgaagctgaaaatattgagccttcagttatgaagatttcttcaaatagctttatgaatgtgcatttggaatcaaaaccagttatatgtgatagtagaaatttgacagatcactcaaaatttgcatgtgaagaatataagcagagcatcggtagcactagttcagcttctgttaatcattttgatgatttatatcaacctattgggagttcaggtattgcttcatctcttcagagtcttccaccaggaataaaggtggacagtctaactctcttgaaatgcggagagaacacatctccagttctggatgcagtgctaaagagtaaaaaaagttcagagtttttaaagcatgcagggaaagaaacaatagtagaagtaggtagtgaccttcctgattcaggaaagggatttgcttccagggagaacaggcgtaataatgggttatctgggaaatgtttgcaagaggctcaaaaagaagggaattccatattgcctgaaagaagaggaagaccagaaatctctttagatgaaagaggagaaggaggacatgtgcatacttctgatgactcagaagttgtattttcttcttgtgatttgaatttaaccatggaagacagtgatggtgtaacttatgcattaaagtgtgacagtagtggtcatgccccagaaattgtgtctacagttcatgaagattattctggctcttctgaaagttcaaatgatgaaagtgattcagaagatacggattcggatgatagcagtattccaagaaaccgtctccagtctgttgtggttgtgccaaagaattctactttgcccatggaagaaacaagtccttgttcttctcggagcagtcaaagttatagacactattctgaccattgggaagatgagagattggagtcaaggagacatttgtatgaggaaaaatttgaaagtatagcaagtaaagcctgtcctcaaactgataagtttttccttcataaaggaacagagaagaatccggaaatttcttttacacagtccagtagaaaacaaatagataaccgcctgcctgaactttctcatcctcagagtgatggggttgatagtacaagtcatacagatgtgaaatctgaccctctgggtcacccaaattcagaggaaaccgtgaaagccaaaataccttctaggcagcaagaagagctgccaatttattcttctgattttgaagatgtcccaaataagtcttggcaacagaccactttccaaaacaggccagatagtagactgggaaaaacagaattgagtttttcttccncntgtgnnatnncacangnggatggcttgcactcatcagaagagctcagaaacttaggttgggacttctctcaagaaaagccttctnccacgtatcagcaacctgacagtagctatggagcttgtggtggacacaagtatcagcaaaatgcagaacagtatggtgggacacgtgattactggcaaggcaatggttactgggatccaagatcaggtagacctcctggaactggggttgtgtatgatcgaactcaaggacaagtaccagattccctaacagatgatcgtgaagaagaggagaattgggatcaacaggatggatcccatttttcagaccagtccgataaatttcttctatcccttcagaaagacaaggggtcagtgcaagcacctgaaataagcagcaattccattaaggacactttagctgtgaatgaaaagaaagatttttcaaaaaacttagaaaaaaatgatatcaaagatagagggcctcttaaaaaaaggaggcaggaaatagagagtgattctgaaagtgatggtgagcttcaggacagaaagaaagttagagtggaggtagagcagggagagacatcagtgcccccaggttcagcactggttgggccctcctgtgtcatggatgacttcagggacccacagcgatggaaggaatgtgccaagcaagggaaaatgccatgttactttgatcttattgaagaaaatgtttatttaacagaaagaaagaagaataaatctcatcgagatattaagcgaatgcagtgtgagtgtacacctctttctaaagatgaaagagctcaaggtgaaatagcatgtggggaagattgtcttaatcgtcttctcatgattgaatgttcttctcggtgtccaaatggggattattgttccaatagacggtttcagagaaaacagcatgcagatgtggaagtcatactcacagaaaagaaaggctggggcttgagagctgccaaagaccttccttcgaacacctttgtcctagaatattgtggagaggtactcgatcataaagagtttaaagctcgagtgaaggagtatgcacgaaacaaaaacatccattactatttcatggccctgaagaatgatgagataatagatgccactcaaaaaggaaattgctctcgtttcatgaatcacagctgtgaaccaaattgtgaaacccaaaaatggactgtgaacggacaactgagggttgggttttttaccaccaaactggttccttcaggctcagagttaacgtttgactatcagttccagagatatggaaaagaagcccagaaatgtttctgcggatcagccaattgccggggttacctgggaggagaaaacagagtcagcatnagagcagcaggagggaaaatgaagaaggaacgatctcgtaagaaggattcagtggatggagagctagaagctctgatggaaaatggtgagggtctctctgataaaaaccaggtgcncagcttatcccggctaatggttagaattgaaactttggagcagaaacttacctgtctggaactcatacagaacacacactcacagtcctgcctgaagtcctttctggaacgtcatgggctgtctttgttgtggatctggatggcagagctaggtgacggccgggaaagtaaccagaagcttcaggaagagattataaagactttggancacttgcccattcctactaaaaatatgttggaggaaagcaaagtacttccaattattcaacgctggtctcagactaagactgctgtccctccgttgagtgaaggagatgggtattctagtgagaatacatcgcgtgctcatacaccactcaacacacctgatccttccaccaagctgagcacagaagctgacacagacactcccaagaaactaatgtttcgcagactgaaaattataagtgaaaatagcatggacagtgcaatctctgatgcaaccagtgagctagaaggcaaggatggcaaagaggatcttgatcaattagaaaatgtccctgtagaggaagaggaagaattgcagtcacaacagctactcccacaacagctgcctgaatgcaaagttgatagtgaaaccaacatagaagctagtaagctacctacatctgaaccagaagctgacgctgaaatagagcccaaagagagcaacggcacaaaactagaagaacctattaatgaagaaacaccatcccaagatgaagaggagggtgtgtctgatgtggagagtgaaaggagccaagaacagccagataaaacagtggatataagtgatttggccaccaaactcctggacagttggaaagacctaaaggaggtatatcgaattccaaagaaaagtcaaactgaaaaggaaaacacaacaactgaacgaggaagggatgctgttggcttcagagatcaaacacctgccccgaagactcctaataggtcaagagagagagtgtgtctgatgtggagagtgaaaggagccaagaacagccagataaaacagtggatataagtgatttggccaccaaactcctggacagttggaaagacctaaaggaggtatatcgaattccaaagaaaagtcaaactgaaaaggaaaacacaacaactgaacgaggaagggatgctgttggcttcagagatcaaacacctgccccgaagactcctaataggtcaagagagagagacccagacaagcaaactcaaaataaagagaaaaggaaacgaagaagctccctctcaccaccctcttctgcctatgagcggggaacaaaaaggccagatgacagatatgatacaccaacttctaaaaagaaagtacgaattaaagaccgcaataaactttctacagaggaacgccggaagttgtttgagcaagaggtggctcaacgggaggctcagaaacaacagcaacagatgcagaacctgggaatgacatcaccactgccctatgactctcttggttataatgccccgcatcatccctttgctggttacccaccaggttatcccatgcaggcctatgtggatcccagcaaccctaatgctggaaaggtgctcctgcccacacccagcatggacccagtgtgttctcctgctccttatgatcatgctcagcccttggtgggacattctacagaacccctttctgcccctccaccagtaccagtggtgccacatgtggcagctcctgtggaagtttccagttcccagtatgtggcccagagtgatggtgtagtacaccaagactccagcgttgctgtcttgccagtgccggcccccggcccagttcagggacagaattatagtgtttgggattcaaaccaacagtctgtcagtgtacagcagcagtactctcctgcacagtctcaagcaaccatatattatcaaggacagacatgtccaacagtctatggtgtgacatcaccttattcacagacaactccaccaattgtacagagttatgcccagccaagtcttcagtatatccaggggcaacagattttcacagctcatccacaaggagtggtggtacagccagccgcagcagtgactacaatagttgcaccagggcagcctcagcccttgcagccatctgaaatggttgtgacaaataatctcttggatctgccgcccccctctcctcccaaaccaaaaaccattgtcttacctcccaactggaagacagctcgagatccagaagggaagatttattactaccatgtgatcacaaggcagactcagtgggatcctcctacttgggaaagcccaggagatgatgccagccttgagcatgaagctgagatggacctgggaactccaacatatgatgaaaaccccatgaaggcctcgaaaaagcccaagacagcagaagcagacacctccagtgaactagcaaagaaaagcaaagaagtattcagaaaagagatgtcccagttcatcgtccagtgcctgaacccttaccggaaacctgactgcaaagtgggaagaattaccacaactgaagactttaaacatctggctcgcaagctgactcacggtgttatgaataaggagctgaagtactgtaagaatcctgaggacctggagtgcaatgagaatgtgaaacacaaaaccaaggagtacattaagaagtacatgcagaagtttggggctgtttacaaacccaaagaggacactgaattagagtgactgttgggccagggtgggaggatgggtggtcaggtaagacagactctagggagaggaaatcctgtgggcctttctgtcccacccctgtcagcactgtgctactgatgatacatcaccctggggaattcaaccctgcagatgtcaactgaaggccacaaaaatgaactccatctacaagtgattacctagttgtgagctgttggcatgtggttagaagccatcagaggtgcaagggcttagaaaagaccctggccagacctgactccactcttaaacctgggtcttctccttggcggtgctgtcagcgcacagacccatgcgcatccccacccacaaccctttaccctgatgatctgtattatattttaatgtatatgtgaatatattgaaaataatttgttttttcctggtttttgtttggttttcgttttgcttttagcctctacatgctaggatcacaggaagactttgtaaggacagtttaagttctcctgcaaggtttaatttgttatcatgtaaatattccaaagcaggctgccttgtggttttggccagccttgtgctatgttgataagattgatttactgcttaaaatcactttactttatccaatttttactgaactttttatgtaaaaaaataaaatcaattaaagaacttggcatgtgtgttccctaaaagttaat

SEQ ID NO: 343473 - DNA, 2269 bp, Homo sapiens
  misc_feature (843)..(843): n is a, c, g, or t
gggatagactgaaggaagagagtttggaggccaggaaaccccagaaaaaccttgagttaaaaggcttatgcagggataaaatttagtttcttatggtccctttgtgaacatactggtatttcagctcattgaaccagcagctgtttatttagtgcctaccttgtgatatagccttgttctttgaacacctgaaggctcactgaattttagtgatgggtagactttgttcaaagtgctctctgatgaaatggctatgactggcctctttattctctttgtcccctatgatcttagcaccacaaatacctctgaaggtcctattcctagagtgtttgggagcacctgggtaggacagaccatacttagacagcccagggaggacatagtaagtggtggaaggaaaaggattctgcttaggttttcctttgctggctgtcatatcatgcttccatctgcttcacatgctgtggtatgaccacttaaagaatctaagtacccttcaatgacaaaattcctgtggttcctgggattgctaagcctcatagaagctctggaacacctgctgtgctctgccttgcctccagggcccagagaacccagctactgtctttatgccaaggacacaaaattcattgactgaaacctggggctgctgaaggactcagcattgaagtcatgctgttgagtccctccagcctcctttaaggcttgcttagtccatccaggggagctctttccctctcaggctgagcccgtatccttttctcagatcttactggcttactagtattccactgtccaaaccagttaacctgagggaggaaaaggagaaggattggctgnctttactcactaccttttctagttatttcctcagtacaactccttgccctctctggactgttgagcaacgtgttctcttttctctgcctgcagatgtcccagttcatcgtccagtgcctgaacccttaccggaaacctgactgcaaagtgggaagaattaccacaactgaagactttaaacatctggctcgcaaggtactccccttgcttttggtagcccaccaggcaatgttctgggcaaactgtgtaccttctaagaagcccttttcatcatagaaagtatttttttttttcttgtcagatgtcagagctggggacccaggaacggggagggaaggtttggggagggatgcgtaccttacatgacagcagtagttctctaagaaattttcagagctcagcttgtcctttctggtgatcatagcaccagcctgccccaacatctacccccttattaacttcctgtcttggtgagaagggccctgaagcagcaggctggattaccacccctgtcctccccctcatataatttctgctctgattggtggctgtggtctctcttcctgtgccctggacagctgactcacggtgttatgaataaggagctgaagtactgtaagaatcctgaggacctggagtgcaatgagaatgtgaaacacaaaaccaaggagtacattaagaagtacatgcagaagtttggggctgtttacaaacccaaagaggacactgaattagagtgactgttgggccagggtgggaggatgggtggtcaggtaagacagactctagggagaggaaatcctgtgggcctttctgtcccacccctgtcagcactgtgctactgatgatacatcaccctggggaattcaaccctgcagatgtcaactgaaggccacaaaaatgaactccatctacaagtgattacctagttgtgagctgttggcatgtggttagaagccatcagaggtgcaagggcttagaaaagaccctggccagacctgactccactcttaaacctgggtcttctccttggcggtgctgtcagcgcacagacccatgcgcatccccacccacaaccctttaccctgatgatctgtattatattttaatgtatatgtgaatatattgaaaataatttgttttttcctggtttttgtttggttttcgttttgcttttagcctctacatgctaggatcacaggaagactttgtaaggacagtttaagttctcctgcaaggtttaatttgttatcatgtaaatattccaaagcaggctgccttgtggttttggccagccttgtgctatgttgataagattgatttactgcttaaaatcactttactttatccaatttttactgaactttttatgtaaaaaaataaaatcaattaaagaacttggcatgtgtgttccctaaaagttaat

SEQ ID NO: 343474 - DNA, 463 bp, Homo sapiens
ctcgtgcgaattcggcagagggaccctggccagacctgactccactcttaaacctgggtcttctccttggcggtgctgtcagcgcacagacccatgcgcatccccacccacaaccctttaccctgatgatctgtattatattttaatgtatatgtgaatatattgaaaataatttgttttttcctggtttttgtttggttttcgttttgcttttagcctctacatgctaggatcacaggaagactttgtaaggacagtttaagttctcctgcaaggtttaatttgttatcatgtaaatattccaaagcaggctgccttgtggttttggccagccttgtgctatgttgataagattgatttactgcttaaaatcactttactttatccaatttttactgaactttttatgtaaaaaaataaaatcaattaaagaacttggcatgtgtgttccctaaaagttaat

SEQ ID NO: 343475 - DNA, 983 bp, Homo sapiens
gcgacctcagtgaccacagaagttcagaaagagatgtcccagttcatcgtccagtgcctgaacccttaccggaaacctgactgcaaagtgggaagaattaccacaactgaagactttaaacatctggctcgcaagctgactcacggtgttatgaataaggagctgaagtactgtaagaatcctgaggacctggagtgcaatgagaatgtgaaacacaaaaccaaggagtacattaagaagtacatgcagaagtttggggctgtttacaaacccaaagaggacactgaattagagtgactgttgggccagggtgggaggatgggtggtcaggtaagacagactctagggagaggaaatcctgtgggcctttctgtcccacccctgtcagcactgtgctactgatgatacatcaccctggggaattcaaccctgcagatgtcaactgaaggccacaaaaatgaactccatctacaagtgattacctagttgtgagctgttggcatgtggttagaagccatcagaggtgcaagggcttagaaaagaccctggccagacctgactccactcttaaacctgggtcttctccttggcggtgctgtcagcgcacagacccatgcgcatccccacccacaaccctttaccctgatgatctgtattatattttaatgtatatgtgaatatattgaaaataatttgttttttcctggtttttgtttggttttcgttttgcttttagcctctacatgctaggatcacaggaagactttgtaaggacagtttaagttctcctgcaaggtttaatttgttatcatgtaaatattccaaagcaggctgccttgtggttttggccagccttgtgctatgttgataagattgatttactgcttaaaatcactttactttatccaatttttactgaactttttatgtaaaaaaataaaatcaattaaagaacttggcatgtgtgttccctaaaagttaat

SEQ ID NO: 343476 - DNA, 359 bp, Homo sapiens
tcttttgtcatcgggggtttcaagtcaaccataaattccttatcaccccctcccccaagaggtttgggtcagtttttgttttcttttaaacccaaattaccaaaactaagatcctctacatgctaggatcacaggaagactttgtaaggacagtttaagttctcctgcaaggtttaatttgttatcatgtaaatattccaaagcaggctgccttgtggttttggccagccttgtgctatgttgataagattgatttactgcttaaaatcactttactttatccaatttttactgaactttttatgtaaaaaaataaaatcaattaaagaacttggcatgtgtgttccctaaaagttaat

SEQ ID NO: 343477 - DNA, 6999 bp, Homo sapiens
  misc_feature (2618)..(2618): n is a, c, g, or t
  misc_feature (2620)..(2620): n is a, c, g, or t
  misc_feature (2625)..(2626): n is a, c, g, or t
  misc_feature (2629)..(2630): n is a, c, g, or t
  misc_feature (2635)..(2635): n is a, c, g, or t
  misc_feature (2637)..(2637): n is a, c, g, or t
  misc_feature (2705)..(2705): n is a, c, g, or t
  misc_feature (3991)..(3991): n is a, c, g, or t
  misc_feature (4107)..(4107): n is a, c, g, or t
  misc_feature (4315)..(4315): n is a, c, g, or t
acgatctaaaacagacagagatgataaatattttagctattcaaaacttgaatgagatactcggtatgtatcttcccgatgtagatcagaaagagagcgacggcggagcagatctcactctaggtctgagagaggctctagaactaatttatcctattccagatcagaacgatctcattattatgactctgatcgtcgctaccataggagctccccttatcgagagaggacgcgctattctcggccatacacagataacagagcacgagagagttctgactcagaagaagagtataagaagacatactcaaggcgtacctcatctcattcctcttcttacagggacctaaggacatcatcctattctaaatctgatcgggactgtaaaactgagacctcttacttagagatggaaagaagaggcaagtattcttcaaaactagaaagagaatctaaaaggacttcagaaaatgaagcaattaaaagatgttgttctccccctaatgaactgggattccgacgagggtcatcatattctaagcatgacagtagtgcttcccgttataaatctaccctttcaaaacctatacccaagtctgataaatttaaaaattctttctgttgtacagaattaaatgaagaaatcaaacaatctcattcttttagtttacagacaccttgttcaaaaggtagtgaattaagaatgattaataaaaatcctgaaagagaaaaggctgggtctccagctccatcaaatcgattaaatgattcacctactttaaaaaagctagatgaattgcctatttttaagtccgaatttataacacatgatagccatgatagtattaaggaattagactctttatctaaagtgaagaatgatcaattaagaagtttttgtcccatagaattaaatataaatggatctcctggggcagaatctgatttggcaacattttgcacttctaaaactgatgctgttttaatgacttctgatgatagtgtgactggatcggaattatcccctttggtcaaagcatgcatgctttcatcaaatggatttcagaatattagtaggtgcaaagaaaaagacttggatgatacctgcatgctgcataagaagtcagaaagcccatttagagaaacagaacctctggtgtcaccacaccaagataaactcatgtctatgccagttatgactgtggattattccaaaacagtagttaaagaaccagttgatacgagggtttcttgctgcaaaaccaaagattcagacatatactgtactttgaacgatagcaacccttctttgtgtaactctgaagctgaaaatattgagccttcagttatgaagatttcttcaaatagctttatgaatgtgcatttggaatcaaaaccagttatatgtgatagtagaaatttgacagatcactcaaaatttgcatgtgaagaatataagcagagcatcggtagcactagttcagcttctgttaatcattttgatgatttatatcaacctattgggagttcaggtattgcttcatctcttcagagtcttccaccaggaataaaggtggacagtctaactctcttgaaatgcggagagaacacatctccagttctggatgcagtgctaaagagtaaaaaaagttcagagtttttaaagcatgcagggaaagaaacaatagtagaagtaggtagtgaccttcctgattcaggaaagggatttgcttccagggagaacaggcgtaataatgggttatctgggaaatgtttgcaagaggctcaaaaagaagggaattccatattgcctgaaagaagaggaagaccagaaatctctttagatgaaagaggagaaggaggacatgtgcatacttctgatgactcagaagttgtattttcttcttgtgatttgaatttaaccatggaagacagtgatggtgtaacttatgcattaaagtgtgacagtagtggtcatgccccagaaattgtgtctacagttcatgaagattattctggctcttctgaaagttcaaatgatgaaagtgattcagaagatacggattcggatgatagcagtattccaagaaaccgtctccagtctgttgtggttgtgccaaagaattctactttgcccatggaagaaacaagtccttgttcttctcggagcagtcaaagttatagacactattctgaccattgggaagatgagagattggagtcaaggagacatttgtatgaggaaaaatttgaaagtatagcaagtaaagcctgtcctcaaactgataagtttttccttcataaaggaacagagaagaatccggaaatttcttttacacagtccagtagaaaacaaatagataaccgcctgcctgaactttctcatcctcagagtgatggggttgatagtacaagtcatacagatgtgaaatctgaccctctgggtcacccaaattcagaggaaaccgtgaaagccaaaataccttctaggcagcaagaagagctgccaatttattcttctgattttgaagatgtcccaaataagtcttggcaacagaccactttccaaaacaggccagatagtagactgggaaaaacagaattgagtttttcttccncntgtgnnatnncacangnggatggcttgcactcatcagaagagctcagaaacttaggttgggacttctctcaagaaaagccttctnccacgtatcagcaacctgacagtagctatggagcttgtggtggacacaagtatcagcaaaatgcagaacagtatggtgggacacgtgattactggcaaggcaatggttactgggatccaagatcaggtagacctcctggaactggggttgtgtatgatcgaactcaaggacaagtaccagattccctaacagatgatcgtgaagaagaggagaattgggatcaacaggatggatcccatttttcagaccagtccgataaatttcttctatcccttcagaaagacaaggggtcagtgcaagcacctgaaataagcagcaattccattaaggacactttagctgtgaatgaaaagaaagatttttcaaaaaacttagaaaaaaatgatatcaaagatagagggcctcttaaaaaaaggaggcaggaaatagagagtgattctgaaagtgatggtgagcttcaggacagaaagaaagttagagtggaggtagagcagggagagacatcagtgcccccaggttcagcactggttgggccctcctgtgtcatggatgacttcagggacccacagcgatggaaggaatgtgccaagcaagggaaaatgccatgttactttgatcttattgaagaaaatgtttatttaacagaaagaaagaagaataaatctcatcgagatattaagcgaatgcagtgtgagtgtacacctctttctaaagatgaaagagctcaaggtgaaatagcatgtggggaagattgtcttaatcgtcttctcatgattgaatgttcttctcggtgtccaaatggggattattgttccaatagacggtttcagagaaaacagcatgcagatgtggaagtcatactcacagaaaagaaaggctggggcttgagagctgccaaagaccttccttcgaacacctttgtcctagaatattgtggagaggtactcgatcataaagagtttaaagctcgagtgaaggagtatgcacgaaacaaaaacatccattactatttcatggccctgaagaatgatgagataatagatgccactcaaaaaggaaattgctctcgtttcatgaatcacagctgtgaaccaaattgtgaaacccaaaaatggactgtgaacggacaactgagggttgggttttttaccaccaaactggttccttcaggctcagagttaacgtttgactatcagttccagagatatggaaaagaagcccagaaatgtttctgcggatcagccaattgccggggttacctgggaggagaaaacagagtcagcatnagagcagcaggagggaaaatgaagaaggaacgatctcgtaagaaggattcagtggatggagagctagaagctctgatggaaaatggtgagggtctctctgataaaaaccaggtgcncagcttatcccggctaatggttagaattgaaactttggagcagaaacttacctgtctggaactcatacagaacacacactcacagtcctgcctgaagtcctttctggaacgtcatgggctgtctttgttgtggatctggatggcagagctaggtgacggccgggaaagtaaccagaagcttcaggaagagattataaagactttggancacttgcccattcctactaaaaatatgttggaggaaagcaaagtacttccaattattcaacgctggtctcagactaagactgctgtccctccgttgagtgaaggagatgggtattctagtgagaatacatcgcgtgctcatacaccactcaacacacctgatccttccaccaagctgagcacagaagctgacacagacactcccaagaaactaatgtttcgcagactgaaaattataagtgaaaatagcatggacagtgcaatctctgatgcaaccagtgagctagaaggcaaggatggcaaagaggatcttgatcaattagaaaatgtccctgtagaggaagaggaagaattgcagtcacaacagctactcccacaacagctgcctgaatgcaaagttgatagtgaaaccaacatagaagctagtaagctacctacatctgaaccagaagctgacgctgaaatagagcccaaagagagcaacggcacaaaactagaagaacctattaatgaagaaacaccatcccaagatgaagaggagggtgtgtctgatgtggagagtgaaaggagccaagaacagccagataaaacagtggatataagtgatttggccaccaaactcctggacagttggaaagacctaaaggaggtatatcgaattccaaagaaaagtcaaactgaaaaggaaaacacaacaactgaacgaggaagggatgctgttggcttcagagatcaaacacctgccccgaagactcctaataggtcaagagagagagacccagacaagcaaactcaaaataaagagaaaaggaaacgaagaagctccctctcaccaccctcttctgcctatgagcggggaacaaaaaggccagatgacagatatgatacaccaacttctaaaaagaaagtacgaattaaagaccgcaataaactttctacagaggaacgccggaagttgtttgagcaagaggtggctcaacgggaggctcagaaacaacagcaacagatgcagaacctgggaatgacatcaccactgccctatgactctcttggttataatgccccgcatcatccctttgctggttacccaccaggttatcccatgcaggcctatgtggatcccagcaaccctaatgctggaaaggtgctcctgcccacacccagcatggacccagtgtgttctcctgctccttatgatcatgctcagcccttggtgggacattctacagaacccctttctgcccctccaccagtaccagtggtgccacatgtggcagctcctgtggaagtttccagttcccagtatgtggcccagagtgatggtgtagtacaccaagactccagcgttgctgtcttgccagtgccggcccccggcccagttcagggacagaattatagtgtttgggattcaaaccaacagtctgtcagtgtacagcagcagtactctcctgcacagtctcaagcaaccatatattatcaaggacagacatgtccaacagtctatggtgtgacatcaccttattcacagacaactccaccaattgtacagagttatgcccagccaagtcttcagtatatccaggggcaacagattttcacagctcatccacaaggagtggtggtacagccagccgcagcagtgactacaatagttgcaccagggcagcctcagcccttgcagccatctgaaatggttgtgacaaataatctcttggatctgccgcccccctctcctcccaaaccaaaaaccattgtcttacctcccaactggaagacagctcgagatccagaagggaagatttattactaccatgtgatcacaaggcagactcagtgggatcctcctacttgggaaagcccaggagatgatgccagccttgagcatgaagctgagatggacctgggaactccaacatatgatgaaaaccccatgaaggcctcgaaaaagcccaagacagcagaagcagacacctccagtgaactagcaaagaaaagcaaagaagtattcagaaaagagatgtcccagttcatcgtccagtgcctgaacccttaccggaaacctgactgcaaagtgggaagaattaccacaactgaagactttaaacatctggctcgcaagctgactcacggtgttatgaataaggagctgaagtactgtaagaatcctgaggacctggagtgcaatgagaatgtgaaacacaaaaccaaggagtacattaagaagtacatgcagaagtttggggctgtttacaaacccaaagaggacactgaattagagtgactgttgggccagggtgggaggatgggtggtcaggtaagacagactctagggagaggaaatcctgtgggcctttctgtcccacccctgtcagcactgtgctactgatgatacatcaccctggggaattcaaccctgcagatgtcaactgaaggccacaaaaatgaactccatctacaagtgattacctagttgtgagctgttggcatgtggttagaagccatcagaggtgcaagggcttagaaaagaccctggccagacctgactccactcttaaacctgggtcttctccttggcggtgctgtcagcgcacagacccatgcgcatccccacccacaaccctttaccctgatgatctgtattatattttaatgtatatgtgaatatattgaaaataatttgttttt

SEQ ID NO: 343478 - DNA, 7788 bp, Homo sapiens
  misc_feature (2618)..(2618): n is a, c, g, or t
  misc_feature (2620)..(2620): n is a, c, g, or t
  misc_feature (2625)..(2626): n is a, c, g, or t
  misc_feature (2629)..(2630): n is a, c, g, or t
  misc_feature (2635)..(2635): n is a, c, g, or t
  misc_feature (2637)..(2637): n is a, c, g, or t
  misc_feature (2705)..(2705): n is a, c, g, or t
  misc_feature (3991)..(3991): n is a, c, g, or t
  misc_feature (4107)..(4107): n is a, c, g, or t
  misc_feature (4315)..(4315): n is a, c, g, or t
acgatctaaaacagacagagatgataaatattttagctattcaaaacttgaatgagatactcggtatgtatcttcccgatgtagatcagaaagagagcgacggcggagcagatctcactctaggtctgagagaggctctagaactaatttatcctattccagatcagaacgatctcattattatgactctgatcgtcgctaccataggagctccccttatcgagagaggacgcgctattctcggccatacacagataacagagcacgagagagttctgactcagaagaagagtataagaagacatactcaaggcgtacctcatctcattcctcttcttacagggacctaaggacatcatcctattctaaatctgatcgggactgtaaaactgagacctcttacttagagatggaaagaagaggcaagtattcttcaaaactagaaagagaatctaaaaggacttcagaaaatgaagcaattaaaagatgttgttctccccctaatgaactgggattccgacgagggtcatcatattctaagcatgacagtagtgcttcccgttataaatctaccctttcaaaacctatacccaagtctgataaatttaaaaattctttctgttgtacagaattaaatgaagaaatcaaacaatctcattcttttagtttacagacaccttgttcaaaaggtagtgaattaagaatgattaataaaaatcctgaaagagaaaaggctgggtctccagctccatcaaatcgattaaatgattcacctactttaaaaaagctagatgaattgcctatttttaagtccgaatttataacacatgatagccatgatagtattaaggaattagactctttatctaaagtgaagaatgatcaattaagaagtttttgtcccatagaattaaatataaatggatctcctggggcagaatctgatttggcaacattttgcacttctaaaactgatgctgttttaatgacttctgatgatagtgtgactggatcggaattatcccctttggtcaaagcatgcatgctttcatcaaatggatttcagaatattagtaggtgcaaagaaaaagacttggatgatacctgcatgctgcataagaagtcagaaagcccatttagagaaacagaacctctggtgtcaccacaccaagataaactcatgtctatgccagttatgactgtggattattccaaaacagtagttaaagaaccagttgatacgagggtttcttgctgcaaaaccaaagattcagacatatactgtactttgaacgatagcaacccttctttgtgtaactctgaagctgaaaatattgagccttcagttatgaagatttcttcaaatagctttatgaatgtgcatttggaatcaaaaccagttatatgtgatagtagaaatttgacagatcactcaaaatttgcatgtgaagaatataagcagagcatcggtagcactagttcagcttctgttaatcattttgatgatttatatcaacctattgggagttcaggtattgcttcatctcttcagagtcttccaccaggaataaaggtggacagtctaactctcttgaaatgcggagagaacacatctccagttctggatgcagtgctaaagagtaaaaaaagttcagagtttttaaagcatgcagggaaagaaacaatagtagaagtaggtagtgaccttcctgattcaggaaagggatttgcttccagggagaacaggcgtaataatgggttatctgggaaatgtttgcaagaggctcaaaaagaagggaattccatattgcctgaaagaagaggaagaccagaaatctctttagatgaaagaggagaaggaggacatgtgcatacttctgatgactcagaagttgtattttcttcttgtgatttgaatttaaccatggaagacagtgatggtgtaacttatgcattaaagtgtgacagtagtggtcatgccccagaaattgtgtctacagttcatgaagattattctggctcttctgaaagttcaaatgatgaaagtgattcagaagatacggattcggatgatagcagtattccaagaaaccgtctccagtctgttgtggttgtgccaaagaattctactttgcccatggaagaaacaagtccttgttcttctcggagcagtcaaagttatagacactattctgaccattgggaagatgagagattggagtcaaggagacatttgtatgaggaaaaatttgaaagtatagcaagtaaagcctgtcctcaaactgataagtttttccttcataaaggaacagagaagaatccggaaatttcttttacacagtccagtagaaaacaaatagataaccgcctgcctgaactttctcatcctcagagtgatggggttgatagtacaagtcatacagatgtgaaatctgaccctctgggtcacccaaattcagaggaaaccgtgaaagccaaaataccttctaggcagcaagaagagctgccaatttattcttctgattttgaagatgtcccaaataagtcttggcaacagaccactttccaaaacaggccagatagtagactgggaaaaacagaattgagtttttcttccncntgtgnnatnncacangnggatggcttgcactcatcagaagagctcagaaacttaggttgggacttctctcaagaaaagccttctnccacgtatcagcaacctgacagtagctatggagcttgtggtggacacaagtatcagcaaaatgcagaacagtatggtgggacacgtgattactggcaaggcaatggttactgggatccaagatcaggtagacctcctggaactggggttgtgtatgatcgaactcaaggacaagtaccagattccctaacagatgatcgtgaagaagaggagaattgggatcaacaggatggatcccatttttcagaccagtccgataaatttcttctatcccttcagaaagacaaggggtcagtgcaagcacctgaaataagcagcaattccattaaggacactttagctgtgaatgaaaagaaagatttttcaaaaaacttagaaaaaaatgatatcaaagatagagggcctcttaaaaaaaggaggcaggaaatagagagtgattctgaaagtgatggtgagcttcaggacagaaagaaagttagagtggaggtagagcagggagagacatcagtgcccccaggttcagcactggttgggccctcctgtgtcatggatgacttcagggacccacagcgatggaaggaatgtgccaagcaagggaaaatgccatgttactttgatcttattgaagaaaatgtttatttaacagaaagaaagaagaataaatctcatcgagatattaagcgaatgcagtgtgagtgtacacctctttctaaagatgaaagagctcaaggtgaaatagcatgtggggaagattgtcttaatcgtcttctcatgattgaatgttcttctcggtgtccaaatggggattattgttccaatagacggtttcagagaaaacagcatgcagatgtggaagtcatactcacagaaaagaaaggctggggcttgagagctgccaaagaccttccttcgaacacctttgtcctagaatattgtggagaggtactcgatcataaagagtttaaagctcgagtgaaggagtatgcacgaaacaaaaacatccattactatttcatggccctgaagaatgatgagataatagatgccactcaaaaaggaaattgctctcgtttcatgaatcacagctgtgaaccaaattgtgaaacccaaaaatggactgtgaacggacaactgagggttgggttttttaccaccaaactggttccttcaggctcagagttaacgtttgactatcagttccagagatatggaaaagaagcccagaaatgtttctgcggatcagccaattgccggggttacctgggaggagaaaacagagtcagcatnagagcagcaggagggaaaatgaagaaggaacgatctcgtaagaaggattcagtggatggagagctagaagctctgatggaaaatggtgagggtctctctgataaaaaccaggtgcncagcttatcccggctaatggttagaattgaaactttggagcagaaacttacctgtctggaactcatacagaacacacactcacagtcctgcctgaagtcctttctggaacgtcatgggctgtctttgttgtggatctggatggcagagctaggtgacggccgggaaagtaaccagaagcttcaggaagagattataaagactttggancacttgcccattcctactaaaaatatgttggaggaaagcaaagtacttccaattattcaacgctggtctcagactaagactgctgtccctccgttgagtgaaggagatgggtattctagtgagaatacatcgcgtgctcatacaccactcaacacacctgatccttccaccaagctgagcacagaagctgacacagacactcccaagaaactaatgtttcgcagactgaaaattataagtgaaaatagcatggacagtgcaatctctgatgcaaccagtgagctagaaggcaaggatggcaaagaggatcttgatcaattagaaaatgtccctgtagaggaagaggaagaattgcagtcacaacagctactcccacaacagctgcctgaatgcaaagttgatagtgaaaccaacatagaagctagtaagctacctacatctgaaccagaagctgacgctgaaatagagcccaaagagagcaacggcacaaaactagaagaacctattaatgaagaaacaccatcccaagatgaagaggagggtgtgtctgatgtggagagtgaaaggagccaagaacagccagataaaacagtggatataagtgatttggccaccaaactcctggacagttggaaagacctaaaggaggtatatcgaattccaaagaaaagtcaaactgaaaaggaaaacacaacaactgaacgaggaagggatgctgttggcttcagagatcaaacacctgccccgaagactcctaataggtcaagagagagagacccagacaagcaaactcaaaataaagagaaaaggaaacgaagaagctccctctcaccaccctcttctgcctatgagcggggaacaaaaaggccagatgacagatatgatacaccaacttctaaaaagaaagtacgaattaaagaccgcaataaactttctacagaggaacgccggaagttgtttgagcaagaggtggctcaacgggaggctcagaaacaacagcaacagatgcagaacctgggaatgacatcaccactgccctatgactctcttggttataatgccccgcatcatccctttgctggttacccaccaggttatcccatgcaggcctatgtggatcccagcaaccctaatgctggaaaggtgctcctgcccacacccagcatggacccagtgtgttctcctgctccttatgatcatgctcagcccttggtgggacattctacagaacccctttctgcccctccaccagtaccagtggtgccacatgtggcagctcctgtggaagtttccagttcccagtatgtggcccagagtgatggtgtagtacaccaagactccagcgttgctgtcttgccagtgccggcccccggcccagttcagggacagaattatagtgtttgggattcaaaccaacagtctgtcagtgtacagcagcagtactctcctgcacagtctcaagcaaccatatattatcaaggacagacatgtccaacagtctatggtgtgacatcaccttattcacagacaactccaccaattgtacagagttatgcccagccaagtcttcagtatatccaggggcaacagattttcacagctcatccacaaggagtggtggtacagccagccgcagcagtgactacaatagttgcaccagggcagcctcagcccttgcagccatctgaaatggttgtgacaaataatctcttggatctgccgcccccctctcctcccaaaccaaaaaccattgtcttacctcccaactggaagacagctcgagatccagaagggaagatttattactaccatgtgatcacaagagacagagtctttctttgttgcccagactgatctgcacgaactcctggcttcaagcgatcctcccacctaagcctcccaaaatgctgggatgacaggcgtgaggcaccacacccagctacaactgcagactcagtgggatcctcctacttgggaaagcccaggagatgatgccagccttgagcatgaagctgagatggacctgggaactccaacatatgatgaaaaccccatgaaggcctcgaaaaagcccaagacagcagaagcagacacctccagtgaactagcaaagaaaagcaaagaagtattcagaaaagagatgtcccagttcatcgtccagtgcctgaacccttaccggaaacctgactgcaaagtgggaagaattaccacaactgaagactttaaacatctggctcgcaaggtactccccttgcttttggtagcccaccaggcaatgttctgggcaaactgtgtaccttctaagaagcccttttcatcatagaaagtatttttttttttcttgtcagatgtcagagctggggacccaggaacggggagggaaggtttggggagggatgcgtaccttacatgacagcagtagttctctaagaaattttcagagctcagcttgtcctttctggtgatcatagcaccagcctgccccaacatctacccccttattaacttcctgtcttggtgagaagggccctgaagcagcaggctggattaccacccctgtcctccccctcatataatttctgctctgattggtggctgtggtctctcttcctgtgccctggacagctgactcacggtgttatgaataaggagctgaagtactgtaagaatcctgaggacctggagtgcaatgagaatgtgaaacacaaaaccaaggagtacattaagaagtacatgcagaagtttggggctgtttacaaacccaaagaggacactgaattagagtgactgttgggccagggtgggaggatgggtggtcaggtaagacagactctagggagaggaaatcctgtgggcctttctgtcccacccctgtcagcactgtgctactgatgatacatcaccctggggaattcaaccctgcagatgtcaactgaaggccacaaaaatgaactccatctacaagtgattacctagttgtgagctgttggcatgtggttagaagccatcagaggtgcaagggcttagaaaagaccctggccagacctgactccactcttaaacctgggtcttctccttggcggtgctgtcagcgcacagacccatgcgcatccccacccacaaccctttaccctgatgatctgtattatattttaatgtatatgtgaatatattgaaaataatttgttttttcctggtttttgtttggttttcgttttgcttttagcctctacatgctaggatcacaggaagactttgtaaggacagtttaagttctcctgcaaggtttaatttgttatcatgtaaatattccaaagcaggctgccttgtggttttggccagccttgtgctatgttgataagattgatttactgcttaaaatcactttactttatccaatttttactgaactttttatgtaaaaaaataaaatcaattaaagaacttggcatgtgtgttccctaaaagttaat

SEQ ID NO: 343479 - DNA, 6690 bp, Homo sapiens
  misc_feature (2618)..(2618): n is a, c, g, or t
  misc_feature (2620)..(2620): n is a, c, g, or t
  misc_feature (2625)..(2626): n is a, c, g, or t
  misc_feature (2629)..(2630): n is a, c, g, or t
  misc_feature (2635)..(2635): n is a, c, g, or t
  misc_feature (2637)..(2637): n is a, c, g, or t
  misc_feature (2705)..(2705): n is a, c, g, or t
  misc_feature (3991)..(3991): n is a, c, g, or t
  misc_feature (4107)..(4107): n is a, c, g, or t
  misc_feature (4315)..(4315): n is a, c, g, or t
acgatctaaaacagacagagatgataaatattttagctattcaaaacttgaatgagatactcggtatgtatcttcccgatgtagatcagaaagagagcgacggcggagcagatctcactctaggtctgagagaggctctagaactaatttatcctattccagatcagaacgatctcattattatgactctgatcgtcgctaccataggagctccccttatcgagagaggacgcgctattctcggccatacacagataacagagcacgagagagttctgactcagaagaagagtataagaagacatactcaaggcgtacctcatctcattcctcttcttacagggacctaaggacatcatcctattctaaatctgatcgggactgtaaaactgagacctcttacttagagatggaaagaagaggcaagtattcttcaaaactagaaagagaatctaaaaggacttcagaaaatgaagcaattaaaagatgttgttctccccctaatgaactgggattccgacgagggtcatcatattctaagcatgacagtagtgcttcccgttataaatctaccctttcaaaacctatacccaagtctgataaatttaaaaattctttctgttgtacagaattaaatgaagaaatcaaacaatctcattcttttagtttacagacaccttgttcaaaaggtagtgaattaagaatgattaataaaaatcctgaaagagaaaaggctgggtctccagctccatcaaatcgattaaatgattcacctactttaaaaaagctagatgaattgcctatttttaagtccgaatttataacacatgatagccatgatagtattaaggaattagactctttatctaaagtgaagaatgatcaattaagaagtttttgtcccatagaattaaatataaatggatctcctggggcagaatctgatttggcaacattttgcacttctaaaactgatgctgttttaatgacttctgatgatagtgtgactggatcggaattatcccctttggtcaaagcatgcatgctttcatcaaatggatttcagaatattagtaggtgcaaagaaaaagacttggatgatacctgcatgctgcataagaagtcagaaagcccatttagagaaacagaacctctggtgtcaccacaccaagataaactcatgtctatgccagttatgactgtggattattccaaaacagtagttaaagaaccagttgatacgagggtttcttgctgcaaaaccaaagattcagacatatactgtactttgaacgatagcaacccttctttgtgtaactctgaagctgaaaatattgagccttcagttatgaagatttcttcaaatagctttatgaatgtgcatttggaatcaaaaccagttatatgtgatagtagaaatttgacagatcactcaaaatttgcatgtgaagaatataagcagagcatcggtagcactagttcagcttctgttaatcattttgatgatttatatcaacctattgggagttcaggtattgcttcatctcttcagagtcttccaccaggaataaaggtggacagtctaactctcttgaaatgcggagagaacacatctccagttctggatgcagtgctaaagagtaaaaaaagttcagagtttttaaagcatgcagggaaagaaacaatagtagaagtaggtagtgaccttcctgattcaggaaagggatttgcttccagggagaacaggcgtaataatgggttatctgggaaatgtttgcaagaggctcaaaaagaagggaattccatattgcctgaaagaagaggaagaccagaaatctctttagatgaaagaggagaaggaggacatgtgcatacttctgatgactcagaagttgtattttcttcttgtgatttgaatttaaccatggaagacagtgatggtgtaacttatgcattaaagtgtgacagtagtggtcatgccccagaaattgtgtctacagttcatgaagattattctggctcttctgaaagttcaaatgatgaaagtgattcagaagatacggattcggatgatagcagtattccaagaaaccgtctccagtctgttgtggttgtgccaaagaattctactttgcccatggaagaaacaagtccttgttcttctcggagcagtcaaagttatagacactattctgaccattgggaagatgagagattggagtcaaggagacatttgtatgaggaaaaatttgaaagtatagcaagtaaagcctgtcctcaaactgataagtttttccttcataaaggaacagagaagaatccggaaatttcttttacacagtccagtagaaaacaaatagataaccgcctgcctgaactttctcatcctcagagtgatggggttgatagtacaagtcatacagatgtgaaatctgaccctctgggtcacccaaattcagaggaaaccgtgaaagccaaaataccttctaggcagcaagaagagctgccaatttattcttctgattttgaagatgtcccaaataagtcttggcaacagaccactttccaaaacaggccagatagtagactgggaaaaacagaattgagtttttcttccncntgtgnnatnncacangnggatggcttgcactcatcagaagagctcagaaacttaggttgggacttctctcaagaaaagccttctnccacgtatcagcaacctgacagtagctatggagcttgtggtggacacaagtatcagcaaaatgcagaacagtatggtgggacacgtgattactggcaaggcaatggttactgggatccaagatcaggtagacctcctggaactggggttgtgtatgatcgaactcaaggacaagtaccagattccctaacagatgatcgtgaagaagaggagaattgggatcaacaggatggatcccatttttcagaccagtccgataaatttcttctatcccttcagaaagacaaggggtcagtgcaagcacctgaaataagcagcaattccattaaggacactttagctgtgaatgaaaagaaagatttttcaaaaaacttagaaaaaaatgatatcaaagatagagggcctcttaaaaaaaggaggcaggaaatagagagtgattctgaaagtgatggtgagcttcaggacagaaagaaagttagagtggaggtagagcagggagagacatcagtgcccccaggttcagcactggttgggccctcctgtgtcatggatgacttcagggacccacagcgatggaaggaatgtgccaagcaagggaaaatgccatgttactttgatcttattgaagaaaatgtttatttaacagaaagaaagaagaataaatctcatcgagatattaagcgaatgcagtgtgagtgtacacctctttctaaagatgaaagagctcaaggtgaaatagcatgtggggaagattgtcttaatcgtcttctcatgattgaatgttcttctcggtgtccaaatggggattattgttccaatagacggtttcagagaaaacagcatgcagatgtggaagtcatactcacagaaaagaaaggctggggcttgagagctgccaaagaccttccttcgaacacctttgtcctagaatattgtggagaggtactcgatcataaagagtttaaagctcgagtgaaggagtatgcacgaaacaaaaacatccattactatttcatggccctgaagaatgatgagataatagatgccactcaaaaaggaaattgctctcgtttcatgaatcacagctgtgaaccaaattgtgaaacccaaaaatggactgtgaacggacaactgagggttgggttttttaccaccaaactggttccttcaggctcagagttaacgtttgactatcagttccagagatatggaaaagaagcccagaaatgtttctgcggatcagccaattgccggggttacctgggaggagaaaacagagtcagcatnagagcagcaggagggaaaatgaagaaggaacgatctcgtaagaaggattcagtggatggagagctagaagctctgatggaaaatggtgagggtctctctgataaaaaccaggtgcncagcttatcccggctaatggttagaattgaaactttggagcagaaacttacctgtctggaactcatacagaacacacactcacagtcctgcctgaagtcctttctggaacgtcatgggctgtctttgttgtggatctggatggcagagctaggtgacggccgggaaagtaaccagaagcttcaggaagagattataaagactttggancacttgcccattcctactaaaaatatgttggaggaaagcaaagtacttccaattattcaacgctggtctcagactaagactgctgtccctccgttgagtgaaggagatgggtattctagtgagaatacatcgcgtgctcatacaccactcaacacacctgatccttccaccaagctgagcacagaagctgacacagacactcccaagaaactaatgtttcgcagactgaaaattataagtgaaaatagcatggacagtgcaatctctgatgcaaccagtgagctagaaggcaaggatggcaaagaggatcttgatcaattagaaaatgtccctgtagaggaagaggaagaattgcagtcacaacagctactcccacaacagctgcctgaatgcaaagttgatagtgaaaccaacatagaagctagtaagctacctacatctgaaccagaagctgacgctgaaatagagcccaaagagagcaacggcacaaaactagaagaacctattaatgaagaaacaccatcccaagatgaagaggagggtgtgtctgatgtggagagtgaaaggagccaagaacagccagataaaacagtggatataagtgatttggccaccaaactcctggacagttggaaagacctaaaggaggtatatcgaattccaaagaaaagtcaaactgaaaaggaaaacacaacaactgaacgaggaagggatgctgttggcttcagagatcaaacacctgccccgaagactcctaataggtcaagagagagagacccagacaagcaaactcaaaataaagagaaaaggaaacgaagaagctccctctcaccaccctcttctgcctatgagcggggaacaaaaaggccagatgacagatatgatacaccaacttctaaaaagaaagtacgaattaaagaccgcaataaactttctacagaggaacgccggaagttgtttgagcaagaggtggctcaacgggaggctcagaaacaacagcaacagatgcagaacctgggaatgacatcaccactgccctatgactctcttggttataatgccccgcatcatccctttgctggttacccaccaggttatcccatgcaggcctatgtggatcccagcaaccctaatgctggaaaggtgctcctgcccacacccagcatggacccagtgtgttctcctgctccttatgatcatgctcagcccttggtgggacattctacagaacccctttctgcccctccaccagtaccagtggtgccacatgtggcagctcctgtggaagtttccagttcccagtatgtggcccagagtgatggtgtagtacaccaagactccagcgttgctgtcttgccagtgccggcccccggcccagttcagggacagaattatagtgtttgggattcaaaccaacagtctgtcagtgtacagcagcagtactctcctgcacagtctcaagcaaccatatattatcaaggacagacatgtccaacagtctatggtgtgacatcaccttattcacagacaactccaccaattgtacagagttatgcccagccaagtcttcagtatatccaggggcaacagattttcacagctcatccacaaggagtggtggtacagccagccgcagcagtgactacaatagttgcaccagggcagcctcagcccttgcagccatctgaaatggttgtgacaaataatctcttggatctgccgcccccctctcctcccaaaccaaaaaccattgtcttacctcccaactggaagacagctcgagatccagaagggaagatttattactaccatgtgatcacaaggcagactcagtgggatcctcctacttgggaaagcccaggagatgatgccagccttgagcatgaagctgagatggacctgggaactccaacatatgatgaaaaccccatgaaggcctcgaaaaagcccaagacagcagaagcagacacctccagtgaactagcaaagaaaagcaaagaagtattcagaaaagagatgtcccagttcatcgtccagtgcctgaacccttaccggaaacatccaggggcaacagattttcacagctcatccacaaggagtggtggtacagccagccgcagcagtgactgattacctagttgtgagctgttggcatgtggttagaagccatcagaggtgcaagggcttagaaaagaccctggccagacctgactccactcttaaacctgggtcttctccttggcggtgctgtcagcgcacagacccatgcgcatccccacccacaaccctttgcaatgagaatgtgaaacccaaaaccaaggagtattctaaagatttttttccataaaaaaataaaatcaattaaagaacttgga

SEQ ID NO: 343480 - DNA, 1156 bp, Homo sapiens
gaactcattgttattttttacaaataactagaaacaatactgttgctagaattcctgttctactgtaatttaatcatcactgtttctttttagccttcagtaaggaggatactagttctttggcattattgggaataaaactttgtcaatttcagctttattgaaagttctcccaaatatattgtttttgtttacacaaaggaaaaggaacaaaaacaataaataaatacctttgtttttttttcttttttgagacggagtctcgctctgttgcccaggctggagtgcagtggtgcgatctcggctcactgcaacctccgcctcccaggttcaagcgattcttcttcctcagcctcccgagtagctggaactataggcacgcaccaccacacccagctaatttttgtatttttagtagagatggggtttcatcatgttggcaaggctggtttcgaactcctgacctcgtgatctgcctacctcagcctcccaaagtgctgggattacaggtatgggccactgggcccagcctatttttatttctttgatgtaggtgatctaaatagtagatgaggacaggaaatggggtgaaggtaataatagtattattagaaaagtcttcactgaaaattgaaggaaatacatattaatcgtggaaaaagatagtgtgaaaaatgtgtaatttcgttaacatttatttgtacaggcacattcttgatgttgtgagtcagatacttgataaatgtccattttttgtagtaattgatgtaaaaatgggccatgtgaagaattttcataatgtaatttgtgtctttgtatattttgaactacatatagatttgtggcacttaaattattaatttttgatttcttaagagtgaagtctgtaaatgatttctctctgctgtacttctgtgtttgtatggttggacattttgaaaactggtgagattgcacagtcccaaacctggatgtcttaaatacaaggaattacaaactgtgatttttgtcttgaagacctggaagaattcattgtgcttcagtatgtatttgtactgcacttgattaattagttaagtattggtctggtgcaattgacattaactgtcatcaactcctctattttgtgctaaataaagtcatttagtcagaatgg

SEQ ID NO: 343481 - DNA, 3039 bp, Homo sapiens
tccatctccctcacccatgcccccacccaatctaaagagacagtgctgtacattctcatagagatagagaagatctaaaaagttgagactactcaatccagttaacaacagcaggagcactagagtttgttcatttattctctctgtaaaacaagctgtgctttttttcttctgcctttaaaatgccacccgtgtattcaaaccatggccacttgatacttatgtagaatccatcgtgggctgatgcaagccctttatttaggcttagtgttgtgggcaccaatgtcgagcatcgttgtgacttgtgctgtatgattctcactgaagaatttcctttcagccaagaagcagtgaggtctgggaatattccaaagtcatgtctctgaatatgtgtccttgacatgcaagctttgtaaaaccccatccccgcttaggtgcgaggcatcaccttctcacaagtgtttagtttcttttaaccacaagtatcattcttgggtgataatatagtttcattctacttagggattgtttagaaaacaaagaaagagccaattaaattttttagtttttgaaatttttatttatatgtatacttagatgagtattttaagctgtcgacctttagtttgccatacgggtaggactgtatttcatgttaacaactggtggtaatgataagccttcttctagcgtattttctcttctttcctgtcactttccttttttaagtttttttttttaaagactggaattttttttggctttatcttgtcttaccgtagagatttgttcaaaactctaagccctaccacctcccctttaataagctctttaaatagttgaatcattaacaacctggtgggaggcaagtcatttaattgaaccactaggaagtgtattttcttttctttttctgccaactttttggtggcatttgtaaaagctgatataaaaggctctgagatgttattttcagttattccataggcaagcctttttacagagcatatgtctccagttggcagcttgagatatttccgagcatccggttctagctaccagtgcctcccaatgcttagtgcacagtactgtagactggccatcacccctctccttggaaaatgccactgtgctgtttgaaaaaaagcagccttttagggctagagtattttatataaacagaagagctaagttcctgaagactaagctagatagctgcagctatatgtaaattgtatatttttatgaacttttgaagcacacactcctgtttccctctgtgtagctttgtggggatttcatgtatatatgctgtctgaaagaatccagaggttggagtgccaatagaaaatgaaaacaaatgccttgtactacaggcagcctctgaaggtgaccacataactgtcttcactgtgaccaatcggagtccctgcttgcttgtgaagaaggggcttttgtaccttgttggagatgccacctcagaagttcacactgtgcaggaaaaaggttttattctctcctggcatacattagaatgtcagatgcttgcatccatgtggaccacgatgggcctctaaaaattggtgggcagggggtttgcttatgagttttctctggaaaccgattttactcctggatgtattgaatgccccttgagctttatgagatacgagtccacatggataaaatgttagagagtggagttctacagaggattccaggaagaggccatgtctgtgcagtcctagttccagacaggtgagaagctccaggaactactggctaccttgacaagctgggtaaatagttatcattctgggtaactggttgaaactctgacttttggacaagtaattcctggggttctgtctttggtagcatcaccagggatatttgggtgggacagacagaagacacacagctgcctgttctctcctgcccatcatgtttggcccactagatgaagctgtactcagcaatttagggaatgtaacccttctcagaactggccattttcaggggaagcttgggagagcaatagtatggtgagccccttagagatgagcgcctactccttcttggcgaatgctgccttcagatgcttaccaagtggtcactgcatctagtaagattatatttccagtacacttccttagggcagaaacaccatcctatcaggtttggtcagtcccttcttcatgaagggagtcatggggaattcctgaaaattttcttccttctgcagacagttggatgagtcccttagagaaggcatccagagacataactaaactgaatatcatcccatattgattttaggaattgactctaaaactctgtgcagaatcttgtgttgggattgtatcttgacattcctgttgtgttatttttcttaactggagtgtgtgctgcctttcaggtacaatttttgtgtaataaaagccagtgcattaagtttatatagactactttctatgcaagactgagatatggaatagataggaagagatatgtactgctgggtacatggacagtaagtgtgttttcagatggagtaccagcaccgaaaatgggttgagggaggatgggttgtatgtatgtttctgcccactaattttgagcagccatattatgaattaaatcgtcacagccaagtaataacccaagaatggtatgagtttcatgtgtaatagctcaaatggaataagcatgaatgctggagtggaccattatcctcaaatattctatgtcacttctcatttaaagactcttgttatgaactattagaaactttaggcaaaatcaaaagtatttgcggcaaaataaaggcctattctactcttatttaaagtgaaacactgtatacttgtttctctccaaagcgaaattaagtatttataatttcaattgcctcgataagtttccaagtcactgaaatctgctgaaggttttactgtattgttgcacaactttaagataatttttgtctcaatgtcaacttttttcactgaataaaaatttaactgggtcaagaaaaca

SEQ ID NO: 343482 - DNA, 376 bp, Homo sapiens
gtcgaccttggattgcttccacattttagctgttgtgaataatgctgctatctgtgaaaggtttttaaggacactgtttcttcgttgaaaagtgctgagtaatcatcctttggtttttaccattacctagaggctagtcttgagtgaaatataatttttggtaatccataaatggaaggcaagtcctactcatttttccttccagttgctattgagagaacacataggtacacagttgtctttcctttcttgcccttgtttgcttttggagcaactgagctggctttggcagtctcagtgcctgccttcacagacagcgtgtcatggaaggtgggatttcagcgggtgtttgatggtgatgccattcaggttgtat

SEQ ID NO: 343483 - DNA, 7816 bp, Homo sapiens
ttgctgcgtcaactgtgttccctttggcctggctgagtttgatactgtggggattcagtttaggcgctggcccgaggatatcccagcggtggtacttcggagacacctgtctgcatctgactgagccggctctcctggcctcgcgctgcacattctctcctggcggcggcgccacctgcagtagcgttcgcccgaacatggcgacacggagcagcaggagggagtcgcgactcccgttcctattcaccctggtcgcactgctgccgcccggagctctctgcgaagtctggacgcagaggctgcacggcggcagcgcgcccttgccccaggaccggggcttcctcgtggtgcagggcgacccgcgcgagctgcggctgtgggcgcgcggggatgccaggggggcgagccgcgcggacgagaagccgctccggaggaaacggagcgctgccctgcagcccgagcccatcaaggtgtacggacaggttagtctgaatgattcccacaatcagatggtggtgcactgggctggagagaaaagcaacgtgatcgtggccttggcccgagatagcctggcattggcgaggcccaagagcagtgatgtgtacgtgtcttacgactatggaaaatcattcaagaaaatttcagacaagttaaactttggcttgggaaataggagtgaagctgttatcgcccagttctaccacagccctgcggacaacaagcggtacatctttgcagacgcttatgcccagtacctctggatcacgtttgacttctgcaacactcttcaaggcttttccatcccatttcgggcagctgatctcctcctacacagtaaggcctccaaccttctcttgggctttgacaggtcccaccccaacaagcagctgtggaagtcagatgactttggccagacctggatcatgattcaggaacatgtcaagtccttttcttggggaattgatccctatgacaaaccaaataccatctacattgaacgacacgaaccctctggctactccactgtcttccgaagtacagatttcttccagtcccgggaaaaccaggaagtgatccttgaggaagtgagagattttcagcttcgggacaagtacatgtttgctacaaaggtggtgcatctcttgggcagtgaacagcagtcttctgtccagctctgggtctcctttggccggaagcccatgagagcagcccagtttgtcacaagacatcctattaatgaatattacatcgcagatgcctccgaggaccaggtgtttgtgtgtgtcagccacagtaacaaccgcaccaatttatacatctcagaggcagaggggctgaagttctccctgtccttggagaacgtgctctattacagcccaggaggggccggcagtgacaccttggtgaggtattttgcaaatgaaccatttgctgacttccaccgagtggaaggattgcaaggagtctacattgctactctgattaatggttctatgaatgaggagaacatgagatcggtcatcacctttgacaaagggggaacctgggagtttcttcaggctccagccttcacgggatatggagagaaaatcaattgtgagctttcccagggctgttcccttcatctggctcagcgcctcagtcagctcctcaacctccagctccggagaatgcccatcctgtccaaggagtcggctccaggcctcatcatcgccactggctcagtgggaaagaacttggctagcaagacaaacgtgtacatctctagcagtgctggagccaggtggcgagaggcacttcctggacctcactactacacatggggagaccacggcggaatcatcacggccattgcccagggcatggaaaccaacgagctaaaatacagtaccaatgaaggggagacctggaaaacattcatcttctctgagaagccagtgtttgtgtatggcctcctcacagaacctggggagaagagcactgtcttcaccatctttggctcgaacaaagagaatgtccacagctggctgatcctccaggtcaatgccacggatgccttgggagttccctgcacagagaatgactacaagctgtggtcaccatctgatgagcgggggaatgagtgtttgctgggacacaagactgttttcaaacggcggaccccccatgccacatgcttcaatggagaggactttgacaggccggtggtcgtgtccaactgctcctgcacccgggaggactatgagtgtgacttcggtttcaagatgagtgaagatttgtcattagaggtttgtgttccagatccggaattttctggaaagtcatactcccctcctgtgccttgccctgtgggttctacttacaggagaacgagaggctaccggaagatttctggggacacttgtagcggaggagatgttgaagcgcgactggaaggagagctggtcccctgtcccctggcagaagagaacgagttcattctgtatgctgtgaggaaatccatctaccgctatgacctggcctcgggagccaccgagcagttgcctctcaccgggctacgggcagcagtggccctggactttgactatgagcacaactgtttgtattggtccgacctggccttggacgtcatccagcgcctctgtttgaatggaagcacagggcaagaggtgatcatcaattctggcctggagacagtagaagctttggcttttgaacccctcagccagctgctttactgggtagatgcaggcttcaaaaagattgaggtagctaatccagatggcgacttccgactcacaatcgtcaattcctctgtgcttgatcgtcccagggctctggtcctcgtgccccaagagggggtgatgttctggacagactggggagacctgaagcctgggatttatcggagcaatatggatggttctgctgcctatcacctggtgtctgaggatgtgaagtggcccaatggcatctctgtggacgaccagtggatttactggacggatgcctacctggagtgcatagagcggatcacgttcagtggccagcagcgctctgtcattctggacaacctcccgcacccctatgccattgctgtctttaagaatgaaatctactgggatgactggtcacagctcagcatattccgagcttccaaatacagtgggtcccagatggagattctggcaaaccagctcacggggctcatggacatgaagattttctacaaggggaagaacactggaagcaatgcctgtgtgcccaggccatgcagcctgctgtgcctgcccaaggccaacaacagtagaagctgcaggtgtccagaggatgtgtccagcagtgtgcttccatcaggggacctgatgtgtgactgccctcagggctatcagctcaagaacaatacctgtgtcaaagaagagaacacctgtcttcgcaaccagtatcgctgcagcaacgggaactgtatcaacagcatttggtggtgtgactttgacaacgactgtggagacatgagcgatgagagaaactgccctaccaccatctgtgacctggacacccagtttcgttgccaggagtctgggacttgtatcccactgtcctataaatgtgaccttgaggatgactgtggagacaacagtgatgaaagtcattgtgaaatgcaccagtgccggagtgacgagtacaactgcagttccggcatgtgcatccgctcctcctgggtatgtgacggggacaacgactgcagggactggtctgatgaagccaactgtaccgccatctatcacacctgtgaggcctccaacttccagtgccgaaacgggcactgcatcccccagcggtgggcgtgtgacggggatacggactgccaggatggttccgatgaggatccagtcaactgtgagaagaagtgcaatggattccgctgcccaaacggcacttgcatcccatccagcaaacattgtgatggtctgcgtgattgctctgatggctccgatgaacagcactgcgagcccctctgtacgcacttcatggactttgtgtgtaagaaccgccagcagtgcctgttccactccatggtctgtgacggaatcatccagtgccgcgacgggtccgatgaggatgcggcgtttgcaggatgctcccaagatcctgagttccacaaggtatgtgatgagttcggtttccagtgtcagaatggagtgtgcatcagtttgatttggaagtgcgacgggatggatgattgcggcgattattctgatgaagccaactgcgaaaaccccacagaagccccaaactgctcccgctacttccagtttcggtgtgagaatggccactgcatccccaacagatggaaatgtgacagggagaacgactgtggggactggtctgatgagaaggattgtggagattcacatattcttcccttctcgactcctgggccctccacgtgtctgcccaattactaccgctgcagcagtgggacctgcgtgatggacacctgggtgtgcgacgggtaccgagattgtgcagatggctctgacgaggaagcctgccccttgcttgcaaacgtcactgctgcctccactcccacccaacttgggcgatgtgaccgatttgagttcgaatgccaccaaccgaagacgtgtattcccaactggaagcgctgtgacggccaccaagattgccaggatggccgggacgaggccaattgccccacacacagcaccttgacttgcatgagcagggagttccagtgcgaggacggggaggcctgcattgtgctctcggagcgctgcgacggcttcctggactgctcggacgagagcgatgaaaaggcctgcagtgatgagttgactgtgtacaaagtacagaatcttcagtggacagctgacttctctggggatgtgactttgacctggatgaggcccaaaaaaatgccctctgcttcttgtgtatataatgtctactacagggtggttggagagagcatatggaagactctggagacccacagcaataagacaaacactgtattaaaagtcttgaaaccagataccacgtatcaggttaaagtacaggttcagtgtctcagcaaggcacacaacaccaatgactttgtgaccctgaggaccccagagggattgccagatgcccctcgaaatctccagctgtcactccccagggaagcagaaggtgtgattgtaggccactgggctcctcccatccacacccatggcctcatccgtgagtacattgtagaatacagcaggagtggttccaagatgtgggcctcccagagggctgctagtaactttacagaaatcaagaacttattggtcaacactctatacaccgtcagagtggctgcggtgactagtcgtggaataggaaactggagcgattctaaatccattaccaccataaaaggaaaagtgatcccaccaccagatatccacattgacagctatggtgaaaattatctaagcttcaccctgaccatggagagtgatatcaaggtgaatggctatgtggtgaaccttttctgggcatttgacacccacaagcaagagaggagaactttgaacttccgaggaagcatattgtcacacaaagttggcaatctgacagctcatacatcctatgagatttctgcctgggccaagactgacttgggggatagccctctggcatttgagcatgttatgaccagaggggttcgcccacctgcacctagcctcaaggccaaagccatcaaccagactgcagtggaatgtacctggaccggcccccggaatgtggtttatggtattttctatgccacgtcctttcttgacctctatcgcaacccgaagagcttgactacttcactccacaacaagacggtcattgtcagtaaggatgagcagtatttgtttctggtccgtgtagtggtaccctaccaggggccatcctctgactacgttgtagtgaagatgatcccggacagcaggcttccaccccgtcacctgcatgtggttcatacgggcaaaacctccgtggtcatcaagtgggaatcaccgtatgactctcctgaccaggacttgttgtatgcaattgcagtcaaagatctcataagaaagactgacaggagctacaaagtaaaatcccgtaacagcactgtggaatacacccttaacaagttggagcctggcgggaaataccacatcattgtccaactggggaacatgagcaaagattccagcataaaaattaccacagtttcattatcagcacctgatgccttaaaaatcataacagaaaatgatcatgttcttctgttttggaaaagcctggctttaaaggaaaagcattttaatgaaagcaggggctatgagatacacatgtttgatagtgccatgaatatcacagcttaccttgggaatactactgacaatttctttaaaatttccaacctgaagatgggtcataattacacgttcaccgtccaagcaagatgcctttttggcaaccagatctgtggggagcctgccatcctgctgtacgatgagctggggtctggtgcagatgcatctgcaacgcaggctgccagatctacggatgttgctgctgtggtggtgcccatcttattcctgatactgctgagcctgggggtggggtttgccatcctgtacacgaagcaccggaggctgcagagcagcttcaccgccttcgccaacagccactacagctccaggctggggtccgcaatcttctcctctggggatgacctgggggaagatgatgaagatgcccctatgataactggattttcagatgacgtccccatggtgatagcctgaaagagctttcctcactagaaaccaaatggtgtaaatattttatttgataaagatagttgatggtttattttaaaagatgcactttgagttgcaatatgttatttttatatgggccaaaaacaaaaaacaaaaaaaaaaaaaaggaaagaaaggaatgaataaactttgtagtaatcaactgtgaacttcaaaccaggttgattttagtaacccaattgctttgatttgacattaatgtagtcttacagggctgtgcttgctgggcatgcttttacgtctgtgagataatttcggttcagtaaattggccaatctttttatttttctaagacacagaaatgtatttaatatattccattttgtttggatatagtttataggaaagtgtgtggatgtattatggcggaaggtttctttatgttattttgttaatttattgggactctgtgtaaggccaggctttagtggtcattagacaccacatgtgttatgagccccttacccatagggttgggggtgggaagagaagcatatttttttgccattccggaagcaatccatttttattcacttgtgtgtcatgtaatggtctttggcaggagagagcactgagtcattgctggagttcagttcaacagagctgcagcttgggaagccctgtaagcccacagcttcctctcttatattaattgatggaattttactgtatgtgcctctgtacaagatgtagctttgagagctacaaaatgataacactgctttattacacactggtttcattgtcattgcaaaaacttaccctggttgtgggggagagttctagatctgtgccatgatccatacactggctaatagagtacataatttttccattttccattttttgtttttacttactactgaaggatctcagatgtaaaattatgtatttggtttgagatggccacttattgtccttaaaaatccatactgata

SEQ ID NO: 343484 - DNA, 7858 bp, Homo sapiens
ttgctgcgtcaactgtgttccctttggcctggctgagtttgatactgtggggattcagtttaggcgctggcccgaggatatcccagcggtggtacttcggagacacctgtctgcatctgactgagccggctctcctggcctcgcgctgcacattctctcctggcggcggcgccacctgcagtagcgttcgcccgaacatggcgacacggagcagcaggagggagtcgcgactcccgttcctattcaccctggtcgcactgctgccgcccggagctctctgcgaagtctggacgcagaggctgcacggcggcagcgcgcccttgccccaggaccggggcttcctcgtggtgcagggcgacccgcgcgagctgcggctgtgggcgcgcggggatgccaggggggcgagccgcgcggacgagaagccgctccggaggaaacggagcgctgccctgcagcccgagcccatcaaggtgtacggacaggttagtctgaatgattcccacaatcagatggtggtgcactgggctggagagaaaagcaacgtgatcgtggccttggcccgagatagcctggcattggcgaggcccaagagcagtgatgtgtacgtgtcttacgactatggaaaatcattcaagaaaatttcagacaagttaaactttggcttgggaaataggagtgaagctgttatcgcccagttctaccacagccctgcggacaacaagcggtacatctttgcagacgcttatgcccagtacctctggatcacgtttgacttctgcaacactcttcaaggcttttccatcccatttcgggcagctgatctcctcctacacagtaaggcctccaaccttctcttgggctttgacaggtcccaccccaacaagcagctgtggaagtcagatgactttggccagacctggatcatgattcaggaacatgtcaagtccttttcttggggaattgatccctatgacaaaccaaataccatctacattgaacgacacgaaccctctggctactccactgtcttccgaagtacagatttcttccagtcccgggaaaaccaggaagtgatccttgaggaagtgagagattttcagcttcgggacaagtacatgtttgctacaaaggtggtgcatctcttgggcagtgaacagcagtcttctgtccagctctgggtctcctttggccggaagcccatgagagcagcccagtttgtcacaagacatcctattaatgaatattacatcgcagatgcctccgaggaccaggtgtttgtgtgtgtcagccacagtaacaaccgcaccaatttatacatctcagaggcagaggggctgaagttctccctgtccttggagaacgtgctctattacagcccaggaggggccggcagtgacaccttggtgaggtattttgcaaatgaaccatttgctgacttccaccgagtggaaggattgcaaggagtctacattgctactctgattaatggttctatgaatgaggagaacatgagatcggtcatcacctttgacaaagggggaacctgggagtttcttcaggctccagccttcacgggatatggagagaaaatcaattgtgagctttcccagggctgttcccttcatctggctcagcgcctcagtcagctcctcaacctccagctccggagaatgcccatcctgtccaaggagtcggctccaggcctcatcatcgccactggctcagtgggaaagaacttggctagcaagacaaacgtgtacatctctagcagtgctggagccaggtggcgagaggcacttcctggacctcactactacacatggggagaccacggcggaatcatcacggccattgcccagggcatggaaaccaacgagctaaaatacagtaccaatgaaggggagacctggaaaacattcatcttctctgagaagccagtgtttgtgtatggcctcctcacagaacctggggagaagagcactgtcttcaccatctttggctcgaacaaagagaatgtccacagctggctgatcctccaggtcaatgccacggatgccttgggagttccctgcacagagaatgactacaagctgtggtcaccatctgatgagcgggggaatgagtgtttgctgggacacaagactgttttcaaacggcggaccccccatgccacatgcttcaatggagaggactttgacaggccggtggtcgtgtccaactgctcctgcacccgggaggactatgagtgtgacttcggtttcaagatgagtgaagatttgtcattagaggtttgtgttccagatccggaattttctggaaagtcatactcccctcctgtgccttgccctgtgggttctacttacaggagaacgagaggctaccggaagatttctggggacacttgtagcggaggagatgttgaagcgcgactggaaggagagctggtcccctgtcccctggcagaagagaacgagttcattctgtatgctgtgaggaaatccatctaccgctatgacctggcctcgggagccaccgagcagttgcctctcaccgggctacgggcagcagtggccctggactttgactatgagcacaactgtttgtattggtccgacctggccttggacgtcatccagcgcctctgtttgaatggaagcacagggcaagaggtgatcatcaattctggcctggagacagtagaagctttggcttttgaacccctcagccagctgctttactgggtagatgcaggcttcaaaaagattgaggtagctaatccagatggcgacttccgactcacaatcgtcaattcctctgtgcttgatcgtcccagggctctggtcctcgtgccccaagagggggtgatgttctggacagactggggagacctgaagcctgggatttatcggagcaatatggatggttctgctgcctatcacctggtgtctgaggatgtgaagtggcccaatggcatctctgtggacgaccagtggatttactggacggatgcctacctggagtgcatagagcggatcacgttcagtggccagcagcgctctgtcattctggacaacctcccgcacccctatgccattgctgtctttaagaatgaaatctactgggatgactggtcacagctcagcatattccgagcttccaaatacagtgggtcccagatggagattctggcaaaccagctcacggggctcatggacatgaagattttctacaaggggaagaacactggaagcaatgcctgtgtgcccaggccatgcagcctgctgtgcctgcccaaggccaacaacagtagaagctgcaggtgtccagaggatgtgtccagcagtgtgcttccatcaggggacctgatgtgtgactgccctcagggctatcagctcaagaacaatacctgtgtcaaagaagagaacacctgtcttcgcaaccagtatcgctgcagcaacgggaactgtatcaacagcatttggtggtgtgactttgacaacgactgtggagacatgagcgatgagagaaactgccctaccaccatctgtgacctggacacccagtttcgttgccaggagtctgggacttgtatcccactgtcctataaatgtgaccttgaggatgactgtggagacaacagtgatgaaagtcattgtgaaatgcaccagtgccggagtgacgagtacaactgcagttccggcatgtgcatccgctcctcctgggtatgtgacggggacaacgactgcagggactggtctgatgaagccaactgtaccgccatctatcacacctgtgaggcctccaacttccagtgccgaaacgggcactgcatcccccagcggtgggcgtgtgacggggatacggactgccaggatggttccgatgaggatccagtcaactgtgagaagaagtgcaatggattccgctgcccaaacggcacttgcatcccatccagcaaacattgtgatggtctgcgtgattgctctgatggctccgatgaacagcactgcgagcccctctgtacgcacttcatggactttgtgtgtaagaaccgccagcagtgcctgttccactccatggtctgtgacggaatcatccagtgccgcgacgggtccgatgaggatgcggcgtttgcaggatgctcccaagatcctgagttccacaaggtatgtgatgagttcggtttccagtgtcagaatggagtgtgcatcagtttgatttggaagtgcgacgggatggatgattgcggcgattattctgatgaagccaactgcgaaaaccccacagaagccccaaactgctcccgctacttccagtttcggtgtgagaatggccactgcatccccaacagatggaaatgtgacagggagaacgactgtggggactggtctgatgagaaggattgtggagattcacatattcttcccttctcgactcctgggccctccacgtgtctgcccaattactaccgctgcagcagtgggacctgcgtgatggacacctgggtgtgcgacgggtaccgagattgtgcagatggctctgacgaggaagcctgccccttgcttgcaaacgtcactgctgcctccactcccacccaacttgggcgatgtgaccgatttgagttcgaatgccaccaaccgaagacgtgtattcccaactggaagcgctgtgacggccaccaagattgccaggatggccgggacgaggccaattgccccacacacagcaccttgacttgcatgagcagggagttccagtgcgaggacggggaggcctgcattgtgctctcggagcgctgcgacggcttcctggactgctcggacgagagcgatgaaaaggcctgcagtgatgagttgactgtgtacaaagtacagaatcttcagtggacagctgacttctctggggatgtgactttgacctggatgaggcccaaaaaaatgccctctgcttcttgtgtatataatgtctactacagggtggttggagagagcatatggaagactctggagacccacagcaataagacaaacactgtattaaaagtcttgaaaccagataccacgtatcaggttaaagtacaggttcagtgtctcagcaaggcacacaacaccaatgactttgtgaccctgaggaccccagagggattgccagatgcccctcgaaatctccagctgtcactccccagggaagcagaaggtgtgattgtaggccactgggctcctcccatccacacccatggcctcatccgtgagtacattgtagaatacagcaggagtggttccaagatgtgggcctcccagagggctgctagtaactttacagaaatcaagaacttattggtcaacactctatacaccgtcagagtggctgcggtgactagtcgtggaataggaaactggagcgattctaaatccattaccaccataaaaggaaaagtgatcccaccaccagatatccacattgacagctatggtgaaaattatctaagcttcaccctgaccatggagagtgatatcaaggtgaatggctatgtggtgaaccttttctgggcatttgacacccacaagcaagagaggagaactttgaacttccgaggaagcatattgtcacacaaagttggcaatctgacagctcatacatcctatgagatttctgcctgggccaagactgacttgggggatagccctctggcatttgagcatgttatgaccagaggggttcgcccacctgcacctagcctcaaggccaaagccatcaaccagactgcagtggaatgtacctggaccggcccccggaatgtggtttatggtattttctatgccacgtcctttcttgacctctatcgcaacccgaagagcttgactacttcactccacaacaagacggtcattgtcagtaaggatgagcagtatttgtttctggtccgtgtagtggtaccctaccaggggccatcctctgactacgttgtagtgaagatgatcccggacagcaggcttccaccccgtcacctgcatgtggttcatacgggcaaaacctccgtggtcatcaagtgggaatcaccgtatgactctcctgaccaggacttgttgtatgcaattgcagtcaaagatctcataagaaagactgacaggagctacaaagtaaaatcccgtaacagcactgtggaatacacccttaacaagttggagcctggcgggaaataccacatcattgtccaactggggaacatgagcaaagattccagcataaaaattaccacagtttcattatcagcacctgatgccttaaaaatcataacagaaaatgatcatgttcttctgttttggaaaagcctggctttaaaggaaaagcattttaatgaaagcaggggctatgagatacacatgtttgatagtgccatgaatatcacagcttaccttgggaatactactgacaatttctttaaaatttccaacctgaagatgggtcataattacacgttcaccgtccaagcaagatgcctttttggcaaccagatctgtggggagcctgccatcctgctgtacgatgagctggggtctggtgcagatgcatctgcaacgcaggctgccagatctacggatgttgctgctgtggtggtgcccatcttattcctgatactgctgagcctgggggtggggtttgccatcctgtacacgaagcaccggaggctgcagagcagcttcaccgccttcgccaacagccactacagctccaggctggggtccgcaatcttctcctctggggatgacctgggggaagatgatgaagatgcccctatgataactggattttcagatgacgtccccatggtgatagcctgaaagagctttcctcactagaaaccaaatggtgtaaatattttatttgataaagatagttgatggtttattttaaaagatgcactttgagttgcaatatgttatttttatatgggccaaaaacaaaaaacaaaaaaaaaaaaaaggaaagaaaggaatgaataaactttgtagtaatcaactgtgaacttcaaaccaggttgattttagtaacccaattgctttgatttgacattaatgtagtcttacagggctgtgcttgctgggcatgcttttacgtctgtgagataatttcggttcagtaaattggccaatctttttatttttctaagacacagaaatgtatttaataaaaacctcgagagagtgaaaaaaaaaaaaaaaaaaaaaaaaaacaaaaaataaaaaaaaaaaaaaaaaaaaaaaaaaaaaaaaaaaaaaaaaaaaaaaaaaaacaaaaaaaaaaaacgaggggcggggcccacaacacaccacacgagggggcgcgacaacaaacagcgcgcgcaccccccactatgtgagaaaaaagaggggagaaacaataagaggggaaatataaataaaaaagagagacgcggaggcggcgtcacaaaaaacggatcgtgaggaggagtggtagaaagcatctcgtgaccctgtctaccgagacacttaggagagaagacaagaaacccctactctttgtcggtggcgggagtccgaccatatcgtgggcgacgacccactcctccaccaacaaaaagttataattgaccccccgccattgagacgagttgacataaaataacaaaaaacatgcctagacgtgtgaaaaaacatgtgtgtgtattcacaaacaagcgggaggacaactcattgatgcgcggcgggccaagcagtgaaatcagtatgtctagggcacacaaggataagaggagaataagagcaagtgccacatctcattatccacacgcgaggtggtcttaatggaactaaagaaagagaaagccggacccaga

SEQ ID NO: 343485 - DNA, 2985 bp, Homo sapiens
tccatctccctcacccatgcccccacccaatctaaagagacagtgctgtacattctcatagagatagagaagatctaaaaagttgagactactcaatccagttaacaacagcaggagcactagagtttgttcatttattctctctgtaaaacaagctgtgctttttttcttctgcctttaaaatgccacccgtgtattcaaaccatggccacttgatacttatgtagaatccatcgtgggctgatgcaagccctttatttaggcttagtgttgtgggcaccaatgtcgagcatcgttgtgacttgtgctgtatgattctcactgaagaatttcctttcagccaagaagcagtgaggtctgggaatattccaaagtcatgtctctgaatatgtgtccttgacatgcaagctttgtaaaaccccatccccgcttaggtgcgaggcatcaccttctcacaagtgtttagtttcttttaaccacaagtatcattcttgggtgataatatagtttcattctacttagggattgtttaggtatacttagatgagtattttaagctgtcgacctttagtttgccatacgggtaggactgtatttcatgttaacaactggtggtaatgataagccttcttctagcgtattttctcttctttcctgtcactttccttttttaagtttttttttttaaagactggaattttttttggctttatcttgtcttaccgtagagatttgttcaaaactctaagccctaccacctcccctttaataagctctttaaatagttgaatcattaacaacctggtgggaggcaagtcatttaattgaaccactaggaagtgtattttcttttctttttctgccaactttttggtggcatttgtaaaagctgatataaaaggctctgagatgttattttcagttattccataggcaagcctttttacagagcatatgtctccagttggcagcttgagatatttccgagcatccggttctagctaccagtgcctcccaatgcttagtgcacagtactgtagactggccatcacccctctccttggaaaatgccactgtgctgtttgaaaaaaagcagccttttagggctagagtattttatataaacagaagagctaagttcctgaagactaagctagatagctgcagctatatgtaaattgtatatttttatgaacttttgaagcacacactcctgtttccctctgtgtagctttgtggggatttcatgtatatatgctgtctgaaagaatccagaggttggagtgccaatagaaaatgaaaacaaatgccttgtactacaggcagcctctgaaggtgaccacataactgtcttcactgtgaccaatcggagtccctgcttgcttgtgaagaaggggcttttgtaccttgttggagatgccacctcagaagttcacactgtgcaggaaaaaggttttattctctcctggcatacattagaatgtcagatgcttgcatccatgtggaccacgatgggcctctaaaaattggtgggcagggggtttgcttatgagttttctctggaaaccgattttactcctggatgtattgaatgccccttgagctttatgagatacgagtccacatggataaaatgttagagagtggagttctacagaggattccaggaagaggccatgtctgtgcagtcctagttccagacaggtgagaagctccaggaactactggctaccttgacaagctgggtaaatagttatcattctgggtaactggttgaaactctgacttttggacaagtaattcctggggttctgtctttggtagcatcaccagggatatttgggtgggacagacagaagacacacagctgcctgttctctcctgcccatcatgtttggcccactagatgaagctgtactcagcaatttagggaatgtaacccttctcagaactggccattttcaggggaagcttgggagagcaatagtatggtgagccccttagagatgagcgcctactccttcttggcgaatgctgccttcagatgcttaccaagtggtcactgcatctagtaagattatatttccagtacacttccttagggcagaaacaccatcctatcaggtttggtcagtcccttcttcatgaagggagtcatggggaattcctgaaaattttcttccttctgcagacagttggatgagtcccttagagaaggcatccagagacataactaaactgaatatcatcccatattgattttaggaattgactctaaaactctgtgcagaatcttgtgttgggattgtatcttgacattcctgttgtgttatttttcttaactggagtgtgtgctgcctttcaggtacaatttttgtgtaataaaagccagtgcattaagtttatatagactactttctatgcaagactgagatatggaatagataggaagagatatgtactgctgggtacatggacagtaagtgtgttttcagatggagtaccagcaccgaaaatgggttgagggaggatgggttgtatgtatgtttctgcccactaattttgagcagccatattatgaattaaatcgtcacagccaagtaataacccaagaatggtatgagtttcatgtgtaatagctcaaatggaataagcatgaatgctggagtggaccattatcctcaaatattctatgtcacttctcatttaaagactcttgttatgaactattagaaactttaggcaaaatcaaaagtatttgcggcaaaataaaggcctattctactcttatttaaagtgaaacactgtatacttgtttctctccaaagcgaaattaagtatttataatttcaattgcctcgataagtttccaagtcactgaaatctgctgaaggttttactgtattgttgcacaactttaagataatttttgtctcaatgtcaacttttttcactgaataaaaatttaactgggtcaagaaaaca

SEQ ID NO: 343486 - DNA, 3123 bp, Homo sapiens
tccatctccctcacccatgcccccacccaatctaaagagacagtgctgtacattctcatagagatagagaagatctaaaaagttgagactactcaatccagttaacaacagcaggagcactagagtttgttcatttattctctctgtaaaacaagctgtgctttttttcttctgcctttaaaatgccacccgtgtattcaaaccatggccacttgatacttatgtagaatccatcgtgggctgatgcaagccctttatttaggcttagtgttgtgggcaccaatgtcgagcatcgttgtgacttgtgctgtatgattctcactgaagaatttcctttcagccaagaagcagtgaggtctgggaatattccaaagtcatgtctctgaatatgtgtccttgacatgcaagctttgtaaaaccccatccccgcttaggtgcgaggcatcaccttctcacaagtgtttagtttcttttaaccacaagtatcattcttgggtgataatatagtttcattctacttagggattgtttagaaaacaaagaaagagccaattaaattttttagtttttgaaatttttatttatatgtatacttagatgagtattttaagctgtcgacctttagtttgccatacgggtaggactgtatttcatgttaacaactggtggtaatgataagccttcttctagcgtattttctcttctttcctgtcactttccttttttaagtttttttttttaaagactggaattttttttggctttatcttgtcttaccgtagagatttgttcaaaactctaagccctaccacctcccctttaataagctctttaaatagttgaatcattaacaacctggtgggaggcaagtcatttaattgaaccactaggaagtgtattttcttttctttttctgccaactttttggtggcatttgtaaaagctgatataaaaggctctgagatgttattttcagttattccataggcaagcctttttacagagcatatgtctccagttggcagcttgagatatttccgagcatccggttctagctaccagtgcctcccaatgcttagtgcacagtactgtagactggccatcacccctctccttggaaaatgccactgtgctgtttgaaaaaaagcagccttttagggctagagtattttatataaacagaagagctaagttcctgaagactaagctagatagctgcagctatatgtaaattgtatatttttatgaacttttgaagcacacactcctgtttccctctgtgtagctttgtggggatttcatgtatatatgctgtctgaaagaatccagaggttggagtgccaatagaaaatgaaaacaaatgccttgtactacaggcagcctctgaaggtgaccacataactgtcttcactgtgaccaatcggagtccctgcttgcttgtgaagaaggggcttttgtaccttgttggagatgccacctcagaagttcacactgtgcaggaaaaaggttttattctctcctggcatacattagaatgtcagatgcttgcatccatgtggaccacgatgggcctctaaaaattggtgggcagggggtttgcttatgagttttctctggaaaccgattttactcctggatgtattgaatgccccttgagctttatgagatacgagtccacatggataaaatgttagagagtggagttctacagaggattccaggaagaggccatgtctgtgcagtcctagttccagacaggtgagaagctccaggaactactggctaccttgacaagctgggtaaatagttatcattctgggtaactggttgaaactctgacttttggacaagtaattcctggggttctgtctttggtagcatcaccagggatatttgggtgggacagacagaagacacacagctgcctgttctctcctgcccatcatgtttggcccactagatgaagctgtactcagcaatttagggaatgtaacccttctcagaactggccattttcaggggaagcttgggagagcaatagtatggtgagccccttagagatgagcgcctactccttcttggcgaatgctgccttcagatgcttaccaagtggtcactgcatctagtaagattatatttccagtacacttccttagggcagaaacaccatcctatcaggtttggtcagtcccttcttcatgaagggagtcatggggaattcctgaaaattttcttccttctgcagacagttggatgagtcccttagagaaggcatccagagacataactaaactgaatatcatcccatattgattttaggaattgactctaaaactctgtgcagaatcttgtgttgggattgtatcttgacattcctgttgtgttatttttcttaactggagtgtgtgctgcctttcaggtacaatttttgtgtaataaaagccagtgcattaagtttatatagactactttctatgcaagactgagatatggaatagataggaagagatatgtactgctgggtacatggacagtaagtgtgttttcagatggagtaccagcaccgaaaatgggttgagggaggatgggttgtatgtatgtttctgcccactaattttgagcagccatattatgaattaaatcgtcacagccaagtaataacccaagaatggtatgagtttcatgtgtaatagctcaaatggaataagcatgaatgctggagtggaccattatcctcaaatattctatgtcacttctcatttaaagactcttgttatgaactattagaaactttaggcaaaatcaaaagtatttgcggcaaaataaaggcctattctactcttatttaaagtgaaacactgtatacttgtttctctccaaagcgaaattaagtatttataatttcaattgcctcgataagtttccaagtcactgaaatctgctgaaggttttactgtattgttgcacaactttaagataatttttgtctcaatgtcaacttttttcactgaataaaaatttaactgggtcaagaaaacacctctttgaaaatccactgtctctgtgtgtctcgagctgttctttagagcgcaataaagatggctgacgcagtctccaaacccc

SEQ ID NO: 343487 - DNA, 2981 bp, Homo sapiens
tccatctccctcacccatgcccccacccaatctaaagagacagtgctgtacattctcatagagatagagaagatctaaaaagttgagactactcaatccagttaacaacagcaggagcactagagtttgttcatttattctctctgtaaaacaagctgtgctttttttcttctgcctttaaaatgccacccgtgtattcaaaccatggccacttgatacttatgtagaatccatcgtgggctgatgcaagccctttatttaggcttagtgttgtgggcaccaatgtcgagcatcgttgtgacttgtgctgtatgattctcactgaagaatttcctttcagccaagaagcagtgaggtctgggaatattccaaagtcatgtctctgaatatgtgtccttgacatgcaagctttgtaaaaccccatccccgcttaggtgcgaggcatcaccttctcacaagtgtttagtttcttttaaccacaagtatcattcttgggtgataatatagtttcattctacttagggattgtttagaaaacaaagaaagagccaattaaattttttagtttttgaaatttttatttatatgtatacttagatgagtattttaagctgtcgacctttagtttgccatacgggtaggactgtatttcatgttaacaactggtggtaatgataagccttcttctagcgtattttctcttctttcctgtcactttccttttttaagtttttttttttaaagactggaattttttttggctttatcttgtcttaccgtagagatttgttcaaaactctaagccctaccacctcccctttaataagctctttaaatagttgaatcattaacaacctggtgggaggcaagtcatttaattgaaccactaggaagtgtattttcttttctttttctgccaactttttggtggcatttgtaaaagctgatataaaaggctctgagatgttattttcagttattccataggcaagcctttttacagagcatatgtctccagttggcagcttgagatatttccgagcatccggttctagctaccagtgcctcccaatgcttagtgcacagtactgtagactggccatcacccctctccttggaaaatgccactgtgctgtttgaaaaaaagcagccttttagggctagagtattttatataaacagaagagctaagttcctgaagactaagctagatagctgcagctatatgtaaattgtatatttttatgaacttttgaagcacacactcctgtttccctctgtgtagctttgtggggatttcatgtatatatgctgtctgaaagaatccagaggttggagtgccaatagaaaatgaaaacaaatgccttgtactacaggcagcctctgaaggtgaccacataactgtcttcactgtgaccaatcggagtccctgcttgcttgtgaagaaggggcttttgtaccttgttggagatgccacctcagaagttcacactgtgcaggaaaaaggttttattctctcctggcatacattagaatgtcagatgcttgcatccatgtggaccacgatgggcctctaaaaattggtgggcagggggtttgcttatgagttttctctggaaaccgattttactcctggatgtattgaatgccccttgagctttatgagatacgagtccacatggataaaatgttagagagtggagttctacagaggattccaggaagaggccatgtctgtgcagtcctagttccagacaggtgagaagctccaggaactactggctaccttgacaagctgggtaaatagttatcattctgggtaactggttgaaactctgacttttggacaagtaattcctggggttctgtctttggtagcatcaccagggatatttgggtgggacagacagaagacacacagctgcctgttctctcctgcccatcatgtttggcccactagatgaagctgtactcagcaatttagggaatgtaacccttctcagaactggccattttcaggggaagcttgggagagcaatagtatggtgagccccttagagatgagcgcctactccttcttggcgaatgctgccttcagatgcttaccaagtggtcactgcatctagtaagattatatttccagtacacttccttagggcagaaacaccatcctatcaggtttggtcagtcccttcttcatgaagggagtcatggggaattcctgaaaattttcttccttctgcagacagttggatgagtcccttagagaaggcatccagagacataactaaactgaatatcatcccatattgattttaggaattgactctaaaactctgtgcagaatcttgtgttgggattgtatcttgacattcctgttgtgttatttttcttaactggagtgtgtgctgcctttcaggtacaatttttgttggaatagataggaagagatatgtactgctgggtacatggacagtaagtgtgttttcagatggagtaccagcaccgaaaatgggttgagggaggatgggttgtatgtatgtttctgcccactaattttgagcagccatattatgaattaaatcgtcacagccaagtaataacccaagaatggtatgagtttcatgtgtaatagctcaaatggaataagcatgaatgctggagtggaccattatcctcaaatattctatgtcacttctcatttaaagactcttgttatgaactattagaaactttaggcaaaatcaaaagtatttgcggcaaaataaaggcctattctactcttatttaaagtgaaacactgtatacttgtttctctccaaagcgaaattaagtatttataatttcaattgcctcgataagtttccaagtcactgaaatctgctgaaggttttactgtattgttgcacaactttaagataatttttgtctcaatgtcaacttttttcactgaataaaaatttaactgggtcaagaaaaca

SEQ ID NO: 343488 - DNA, 2985 bp, Homo sapiens
tccatctccctcacccatgcccccacccaatctaaagagacagtgctgtacattctcatagagatagagaagatctaaaaagttgagactactcaatccagttaacaacagcaggagcactagagtttgttcatttattctctctgtaaaacaagctgtgctttttttcttctgcctttaaaatgccacccgtgtattcaaaccatggccacttgatacttatgtagaatccatcgtgggctgatgcaagccctttatttaggcttagtgttgtgggcaccaatgtcgagcatcgttgtgacttgtgctgtatgattctcactgaagaatttcctttcagccaagaagcagtgaggtctgggaatattccaaagtcatgtctctgaatatgtgtccttgacatgcaagctttgtaaaaccccatccccgcttaggtgcgaggcatcaccttctcacaagtgtttagtttcttttaaccacaagtatcattcttgggtgataatatagtttcattctacttagggattgtttagaaaacaaagaaagagccaattaaattttttagtttttgaaatttttatttatatgtatacttagatgagtattttaagctgtcgacctttagtttgccatacgggtaggactgtatttcatgttaacaactggtggtaatgataagccttcttctagcgtattttctcttctttcctgtcactttccttttttaagtttttttttttaaagactggaattttttttggctttatcttgtcttaccgtagagatttgttcaaaactctaagccctaccacctcccctttaataagctctttaaatagttgaatcattaacaacctggtgggaggcaagtcatttaattgaaccactaggaagtgtattttcttttctttttctgccaactttttggtggcatttgtaaaagctgatataaaaggctctgagatgttattttcagttattccataggcaagcctttttacagagcatatgtctccagttggcagcttgagatatttccgagcatccggttctagctaccagtgcctcccaatgcttagtgcacagtactgtagactggccatcacccctctccttggaaaatgccactgtgctgtttgaaaaaaagcagccttttagggctagagtattttatataaacagaagagctaagttcctgaagactaagctagatagctgcagctatatgtaaattgtatatttttatgaacttttgaagcacacactcctgtttccctctgtgtagctttgtggggatttcatgtatatatgctgtctgaaagaatccagaggttggagtgccaatagaaaatgaaaacaaatgccttgtactacaggcagcctctgaaggtgaccacataactgtcttcactgtgaccaatcggagtccctgcttgcttgtgaagaaggggcttttgtaccttgttggagatgccacctcagaagttcacactgtgcaggaaaaaggttttattctctcctggcatacattagaatgtcagatgcttgcatccatgtggaccacgatgggcctctaaaaattggtgggcagggggtttgcttatgagttttctctggaaaccgattttactcctggatgtattgaatgccccttgagctttatgagatacgagtccacatggataaaatgttagagagtggagttctacagaggattccaggaagaggccatgtctgtgcagtcctagttccagacaggtgagaagctccaggaactactggctaccttgacaagctgggtaaatagttatcattctgggtaactggttgaaactctgacttttggacaagtaattcctggggttctgtctttggtagcatcaccagggatatttgggtgggacagacagaagacacacagctgcctgttctctcctgcccatcatgtttggcccactagatgaagctgtactcagcaatttagggaatgtaacccttctcagaactggccattttcaggggaagcttgggagagcaatagtatggtgagccccttagagatgagcgcctactccttcttggcgaatgctgccttcagatgcttaccaagtggtcactgcatctagtaagattatatttccagtacacttccttagggcagaaacaccatcctatcaggtttggtcagtcccttcttcatgaagggagtcatggggaattcctgaaaattttcttccttctgcagacagttggatgagtcccttagagaaggcatccagagacataactaaactgaatatcatcccatattgattttaggaattgactgttatttttcttaactggagtgtgtgctgcctttcaggtacaatttttgtgtaataaaagccagtgcattaagtttatatagactactttctatgcaagactgagatatggaatagataggaagagatatgtactgctgggtacatggacagtaagtgtgttttcagatggagtaccagcaccgaaaatgggttgagggaggatgggttgtatgtatgtttctgcccactaattttgagcagccatattatgaattaaatcgtcacagccaagtaataacccaagaatggtatgagtttcatgtgtaatagctcaaatggaataagcatgaatgctggagtggaccattatcctcaaatattctatgtcacttctcatttaaagactcttgttatgaactattagaaactttaggcaaaatcaaaagtatttgcggcaaaataaaggcctattctactcttatttaaagtgaaacactgtatacttgtttctctccaaagcgaaattaagtatttataatttcaattgcctcgataagtttccaagtcactgaaatctgctgaaggttttactgtattgttgcacaactttaagataatttttgtctcaatgtcaacttttttcactgaataaaaatttaactgggtcaagaaaaca

SEQ ID NO: 343489 - DNA, 3068 bp, Homo sapiens
tccatctccctcacccatgcccccacccaatctaaagagacagtgctgtacattctcatagagatagagaagatctaaaaagttgagactactcaatccagttaacaacagcaggagcactagagtttgttcatttattctctctgtaaaacaagctgtgctttttttcttctgcctttaaaatgccacccgtgtattcaaaccatggccacttgatacttatgtagaatccatcgtgggctgatgcaagccctttatttaggcttagtgttgtgggcaccaatgtcgagcatcgttgtgacttgtgctgtatgattctcactgaagaatttcctttcagccaagaagcagtgaggtctgggaatattccaaagtcatgtctctgaatatgtgtccttgacatgcaagctttgtaaaaccccatccccgcttaggtgcgaggcatcaccttctcacaagtgtttagtttcttttaaccacaagtatcattcttgggtgataatatagtttcattctacttagggattgtttagaaaacaaagaaagagccaattaaattttttagtttttgaaatttttatttatatgtatacttagatgagtattttaagctgtcgacctttagtttgccatacgggtaggactgtatttcatgttaacaactggtggtaatgataagccttcttctagcgtattttctcttctttcctgtcactttccttttttaagtttttttttttaaagactggaattttttttggctttatcttgtcttaccgtagagatttgttcaaaactctaagccctaccacctcccctttaataagctctttaaatagttgaatcattaacaacctggtgggaggcaagtcatttaattgaaccactaggaagtgtattttcttttctttttctgccaactttttggtggcatttgtaaaagctgatataaaaggctctgagatgttattttcagttattccataggcaagcctttttacagagcatatgtctccagttggcagcttgagatatttccgagcatccggttctagctaccagtgcctcccaatgcttagtgcacagtactgtagactggccatcacccctctccttggaaaatgccactgtgctgtttgaaaaaaagcagccttttagggctagagtattttatataaacagaagagctaagttcctgaagactaagctagatagctgcagctatatgtaaattgtatatttttatgaacttttgaagcacacactcctgtttccctctgtgtagctttgtggggatttcatgtatatatgctgtctgaaagaatccagaggttggagtgccaatagaaaatgaaaacaaatgccttgtactacaggcagcctctgaaggtgaccacataactgtcttcactgtgaccaatcggagtccctgcttgcttgtgaagaaggggcttttgtaccttgttggagatgccacctcagaagttcacactgtgcaggaaaaaggttttattctctcctggcatacattagaatgtcagatgcttgcatccatgtggaccacgatgggcctctaaaaattggtgggcagggggtttgcttatgagttttctctggaaaccgattttactcctggatgtattgaatgccccttgagctttatgagatacgagtccacatggataaaatgttagagagtggagttctacagaggattccaggaagaggccatgtctgtgcagtcctagttccagacaggtgagaagctccaggaactactggctaccttgacaagctgggtaaatagttatcattctgggtaactggttgaaactctgacttttggacaagtaattcctggggttctgtctttggtagcatcaccagggatatttgggtgggacagacagaagacacacagctgcctgttctctcctgcccatcatgtttggcccactagatgaagctgtactcagcaatttagggaatgtaacccttctcagaactggccattttcaggggaagcttgggagagcaatagtatggtgagccccttagagatgagcgcctactccttcttggcgaatgctgccttcagatgcttaccaagtggtcactgcatctagtaagattatatttccagtacacttccttagggcagaaacaccatcctatcaggtttggtcagtcccttcttcatgaagggagtcatggggaattcctgaaaattttcttccttctgcagacagttggatgagtcccttagagaaggcatccagagacataactaaactgaatatcatcccatattgattttaggaattgactctaaaactctgtgcagaatcttgtgttgggattgtatcttgacattcctgttgtgttatttttcttaactggagtgtgtgctgcctttcaggtacaatttttgtgtaataaaagccagtgcattaagtttatatagactactttctatgcaagactgagatatggaatagataggaagagatatgtactgctgggtacatggacagtaagtgtgttttcagatggagtaccagcaccgaaaatgggttgagggaggatgggttgtatgtatgtttctgcccactaattttgagcagccatattatgaattaaatcgtcacagccaagtaataacccaagaatggtatgagtttcatgtgtaatagctcaaatggaataagcatgaatgctggagtggaccattatcctcaaatattctatgtcacttctcatttaaagactcttgttatgaactattagaaactttaggcaaaatcaaaagtatttgcggcctccaaagcgaaattaagtatttataatttcaattgcctcgataagtttccaagtcactgaaatctgctgaaggttttactgtattgttgcacaactttaagataatttttgtctcaatgtcaacttttttcactgaataaaaatttaactgggtcaagaaaacacctctttgaaaatccactgtctctgtgtgtctcgagctgttctttagagcgcaataaagatggctgacgcagtctccaaacccc

SEQ ID NO: 343490 - DNA, 5395 bp, Homo sapiens
atgaaaacctggcttcatgtgtctggaaagtttactaacgtaaaacatctcatcccttgccagtcctgccagttgaataaagggttacccttcatgggactgacttggcagggggtcgtttgaacagttcctagcatttattattacttttctctcttaagcgcctctgtttgaatggaagcacagggcaagaggtgatcatcaattctggcctggagacagtagaagctttggcttttgaacccctcagccagctgctttactgggtagatgcaggcttcaaaaagattgaggtagctaatccagatggcgacttccgactcacaatcgtcaattcctctgtgcttgatcgtcccagggctctggtcctcgtgccccaagagggggtgatgttctggacagactggggagacctgaagcctgggatttatcggagcaatatggatggttctgctgcctatcacctggtgtctgaggatgtgaagtggcccaatggcatctctgtggacgaccagtggatttactggacggatgcctacctggagtgcatagagcggatcacgttcagtggccagcagcgctctgtcattctggacaacctcccgcacccctatgccattgctgtctttaagaatgaaatctactgggatgactggtcacagctcagcatattccgagcttccaaatacagtgggtcccagatggagattctggcaaaccagctcacggggctcatggacatgaagattttctacaaggggaagaacactggaagcaatgcctgtgtgcccaggccatgcagcctgctgtgcctgcccaaggccaacaacagtagaagctgcaggtgtccagaggatgtgtccagcagtgtgcttccatcaggggacctgatgtgtgactgccctcagggctatcagctcaagaacaatacctgtgtcaaagaagagaacacctgtcttcgcaaccagtatcgctgcagcaacgggaactgtatcaacagcatttggtggtgtgactttgacaacgactgtggagacatgagcgatgagagaaactgccctaccaccatctgtgacctggacacccagtttcgttgccaggagtctgggacttgtatcccactgtcctataaatgtgaccttgaggatgactgtggagacaacagtgatgaaagtcattgtgaaatgcaccagtgccggagtgacgagtacaactgcagttccggcatgtgcatccgctcctcctgggtatgtgacggggacaacgactgcagggactggtctgatgaagccaactgtaccgccatctatcacacctgtgaggcctccaacttccagtgccgaaacgggcactgcatcccccagcggtgggcgtgtgacggggatacggactgccaggatggttccgatgaggatccagtcaactgtgagaagaagtgcaatggattccgctgcccaaacggcacttgcatcccatccagcaaacattgtgatggtctgcgtgattgctctgatggctccgatgaacagcactgcgagcccctctgtacgcacttcatggactttgtgtgtaagaaccgccagcagtgcctgttccactccatggtctgtgacggaatcatccagtgccgcgacgggtccgatgaggatgcggcgtttgcaggatgctcccaagatcctgagttccacaaggtatgtgatgagttcggtttccagtgtcagaatggagtgtgcatcagtttgatttggaagtgcgacgggatggatgattgcggcgattattctgatgaagccaactgcgaaaaccccacagaagccccaaactgctcccgctacttccagtttcggtgtgagaatggccactgcatccccaacagatggaaatgtgacagggagaacgactgtggggactggtctgatgagaaggattgtggagattcacatattcttcccttctcgactcctgggccctccacgtgtctgcccaattactaccgctgcagcagtgggacctgcgtgatggacacctgggtgtgcgacgggtaccgagattgtgcagatggctctgacgaggaagcctgccccttgcttgcaaacgtcactgctgcctccactcccacccaacttgggcgatgtgaccgatttgagttcgaatgccaccaaccgaagacgtgtattcccaactggaagcgctgtgacggccaccaagattgccaggatggccgggacgaggccaattgccccacacacagcaccttgacttgcatgagcagggagttccagtgcgaggacggggaggcctgcattgtgctctcggagcgctgcgacggcttcctggactgctcggacgagagcgatgaaaaggcctgcagtgatgagttgactgtgtacaaagtacagaatcttcagtggacagctgacttctctggggatgtgactttgacctggatgaggcccaaaaaaatgccctctgcttcttgtgtatataatgtctactacagggtggttggagagagcatatggaagactctggagacccacagcaataagacaaacactgtattaaaagtcttgaaaccagataccacgtatcaggttaaagtacaggttcagtgtctcagcaaggcacacaacaccaatgactttgtgaccctgaggaccccagagggattgccagatgcccctcgaaatctccagctgtcactccccagggaagcagaaggtgtgattgtaggccactgggctcctcccatccacacccatggcctcatccgtgagtacattgtagaatacagcaggagtggttccaagatgtgggcctcccagagggctgctagtaactttacagaaatcaagaacttattggtcaacactctatacaccgtcagagtggctgcggtgactagtcgtggaataggaaactggagcgattctaaatccattaccaccataaaaggaaaagtgatcccaccaccagatatccacattgacagctatggtgaaaattatctaagcttcaccctgaccatggagagtgatatcaaggtgaatggctatgtggtgaaccttttctgggcatttgacacccacaagcaagagaggagaactttgaacttccgaggaagcatattgtcacacaaagttggcaatctgacagctcatacatcctatgagatttctgcctgggccaagactgacttgggggatagccctctggcatttgagcatgttatgaccagaggggttcgcccacctgcacctagcctcaaggccaaagccatcaaccagactgcagtggaatgtacctggaccggcccccggaatgtggtttatggtattttctatgccacgtcctttcttgacctctatcgcaacccgaagagcttgactacttcactccacaacaagacggtcattgtcagtaaggatgagcagtatttgtttctggtccgtgtagtggtaccctaccaggggccatcctctgactacgttgtagtgaagatgatcccggacagcaggcttccaccccgtcacctgcatgtggttcatacgggcaaaacctccgtggtcatcaagtgggaatcaccgtatgactctcctgaccaggacttgttgtatgcaattgcagtcaaagatctcataagaaagactgacaggagctacaaagtaaaatcccgtaacagcactgtggaatacacccttaacaagttggagcctggcgggaaataccacatcattgtccaactggggaacatgagcaaagattccagcataaaaattaccacagtttcattatcagcacctgatgccttaaaaatcataacagaaaatgatcatgttcttctgttttggaaaagcctggctttaaaggaaaagcattttaatgaaagcaggggctatgagatacacatgtttgatagtgccatgaatatcacagcttaccttgggaatactactgacaatttctttaaaatttccaacctgaagatgggtcataattacacgttcaccgtccaagcaagatgcctttttggcaaccagatctgtggggagcctgccatcctgctgtacgatgagctggggtctggtgcagatgcatctgcaacgcaggctgccagatctacggatgttgctgctgtggtggtgcccatcttattcctgatactgctgagcctgggggtggggtttgccatcctgtacacgaagcaccggaggctgcagagcagcttcaccgccttcgccaacagccactacagctccaggctggggtccgcaatcttctcctctggggatgacctgggggaagatgatgaagatgcccctatgataactggattttcagatgacgtccccatggtgatagcctgaaagagctttcctcactagaaaccaaatggtgtaaatattttatttgataaagatagttgatggtttattttaaaagatgcactttgagttgcaatatgttatttttatatgggccaaaaacaaaaaacaaaaaaaaaaaaaaggaaagaaaggaatgaataaactttgtagtaatcaactgtgaacttcaaaccaggttgattttagtaacccaattgctttgatttgacattaatgtagtcttacagggctgtgcttgctgggcatgcttttacgtctgtgagataatttcggttcagtaaattggccaatctttttatttttctaagacacagaaatgtatttaataaaaacctcgagagagtgatgggtggaaccccttctccttgaaagtgtgtacagatattccattttgtttggatatagtttataggaaagtgtgtggatgtattatggcggaaggtttctttatgttattttgttaatttattgggactctgtgtaaggccaggctttagtggtcattagacaccacatgtgttatgagccccttacccatagggttgggggtgggaagagaagcatatttttttgccattccggaagcaatccatttttattcacttgtgtgtcatgtaatggtctttggcaggagagagcactgagtcattgctggagttcagttcaacagagctgcagcttgggaagccctgtaagcccacagcttcctctcttatattaattgatggaattttactgtatgtgcctctgtacaagatgtagctttgagagctacaaaatgataacactgctttattacacactggtttcattgtcattgcaaaaacttaccctggttgtgggggagagttctagatctgtgccatgatccatacactggctaatagagtacataatttttccattttccattttttgtttttacttactactgaaggatctcagatgtaaaattatgtatttggtttgagatggccacttattgtccttaaaaatccatactgata

SEQ ID NO: 343491 - DNA, 2615 bp, Homo sapiens
tccatctccctcacccatgcccccacccaatctaaagagacagtgctgtacattctcatagagatagagaagatctaaaaagttgagactactcaatccagttaacaacagcaggagcactagagtttgttcatttattctctctgtaaaacaagctgtgctttttttcttctgcctttaaaatgccacccgtgtattcaaaccatggccacttgatacttatgtagaatccatcgtgggctgatgcaagccctttatttaggcttagtgttgtgggcaccaatgtcgagcatcgttgtgacttgtgctgtatgattctcactgaagaatttcctttcagccaagaagcagtgaggtctgggaatattccaaagtcatgtctctgaatatgtgtccttgacatgcaagctttgtaaaaccccatccccgcttaggtgcgaggcatcaccttctcacaagtgtttagtttcttttaaccacaagtatcattcttgggtgataatatagtttcattctacttagggattgtttagaaaacaaagaaagagccaattaaattttttagtttttgaaatttttatttatatgtatacttagatgagtattttaagctgtcgacctttagtttgccatacgggtaggactgtatttcatgttaacaactggtggtaatgataagccttcttctagcgtattttctcttctttcctgtcactttccttttttaagtttttttttttaaagactggaattttttttggctttatcttgtcttaccgtagagatttgttcaaaactctaagccctaccacctcccctttaataagctctttaaatagttgaatcattaacaacctggtgggaggcaagtcatttaattgaaccactaggaagtgtattttcttttctttttctgccaactttttggtggcatttgtaaaagctgatataaaaggctctgagatgttattttcagttattccataggcaagcctttttacagagcatatgtctccagttggcagcttgagatatttccgagcatccggttctagctaccagtgcctcccaatgcttagtgcacagtactgtagactggccatcacccctctccttggaaaatgccactgtgctgtttgaaaaaaagcagccttttagggctagagtattttatataaacagaagagctaagttcctgaagactaagctagatagctgcagctatatgtaaattgtatatttttatgaacttttgaagcacacactcctgtttccctctgtgtagctttgtggggatttcatgtatatatgctgtctgaaagaatccagaggttggagtgccaatagaaaatgaaaacaaatgccttgtactacaggcagcctctgaaggtgaccacataactgtcttcactgtgaccaatcggagtccctgcttgcttgtgaagaaggggcttttgtaccttgttggagatgccacctcagaagttcacactgtgcaggaaaaaggttttattctctcctggcatacattagaatgtcagatgcttgcatccatgtggaccacgatgggcctctaaaaattggtgggcagggggtttgcttatgagttttctctggaaaccgattttactcctggatgtattgaatgccccttgagctttatgagatacgagtccacatggataaaatgttagagagtggagttctacagaggattccaggaagaggccatgtctgtgcagtcctagttccagacaggtgagaagctccaggaactactggctaccttgacaagctgggtaaatagttatcattctgggtaactggttgaaactctgacttttggacaagtaattcctggggttctgtctttggtagcatcaccagggatatttgggtgggacagacagaagacacacagctgcctgttctctcctgcccatcatgtttggcccactagatgaagctgtactcagcaatttagggaatgtaacccttctcagaactggccattttcaggggaagcttgggagagcaatagtatggtgagccccttagagatgagcgcctactccttcttggcgaatgctgccttcagatgcttaccaagtggtcactgcatctagtaagattatatttccagtacacttccttagggcagaaacaccatcctatcaggtttggtcagtcccttcttcatgaagggagtcatggggaattcctgaaaattttcttccttctgcagacagttggatgagtcccttagagaaggcatccagagacataactaaactgaatatcatcccatattgattttaggaattgactctaaaactctgtgcagaatcttgtgttgggattgtatcttgacattcctgttgtgttatttttcttaactggagtgtgtgctgcctttcaggtacaatttttgtgtaataaaagccagtgcattaagtttatatagactactttctatgcaagactgagatatggaatagataggaagagatatgtactgctgggtacatggacagtaagtgtgttttcagatggagtaccagcacccggccgccctattatgaattaaatcggcccacccagttattacccagaag

SEQ ID NO: 343492 - DNA, 2553 bp, Homo sapiens
tccatctccctcacccatgcccccacccaatctaaagagacagtgctgtacattctcatagagatagagaagatctaaaaagttgagactactcaatccagttaacaacagcaggagcactagagtttgttcatttattctctctgtaaaacaagctgtgctttttttcttctgcctttaaaatgccacccgtgtattcaaaccatggccacttgatacttatgtagaatccatcgtgggctgatgcaagccctttatttaggcttagtgttgtgggcaccaatgtcgagcatcgttgtgacttgtgctgtatgattctcactgaagaatttcctttcagccaagaagcagtgaggtctgggaatattccaaagtcatgtctctgaatatgtgtccttgacatgcaagctttgtaaaaccccatccccgcttaggtgcgaggcatcaccttctcacaagtgtttagtttcttttaaccacaagtatcattcttgggtgataatatagtttcattctacttagggattgtttagaaaacaaagaaagagccaattaaattttttagtttttgaaatttttatttatatgtatacttagatgagtattttaagctgtcgacctttagtttgccatacgggtaggactgtatttcatgttaacaactggtggtaatgataagccttcttctagcgtattttctcttctttcctgtcactttccttttttaagtttttttttttaaagactggaattttttttggctttatcttgtcttaccgtagagatttgttcaaaactctaagccctaccacctcccctttaataagctctttaaatagttgaatcattaacaacctggtgggaggcaagtcatttaattgaaccactaggaagtgtattttcttttctttttctgccaactttttggtggcatttgtaaaagctgatataaaaggctctgagatgttattttcagttattccataggcaagcctttttacagagcatatgtctccagttggcagcttgagatatttccgagcatccggttctagctaccagtgcctcccaatgcttagtgcacagtactgtagactggccatcacccctctccttggaaaatgccactgtgctgtttgaaaaaaagcagccttttagggctagagtattttatataaacagaagagctaagttcctgaagactaagctagatagctgcagctatatgtaaattgtatatttttatgaacttttgaagcacacactcctgtttccctctgtgtagctttgtggggatttcatgtatatatgctgtctgaaagaatccagaggttggagtgccaatagaaaatgaaaacaaatgccttgtactacaggcagcctctgaaggtgaccacataactgtcttcactgtgaccaatcggagtccctgcttgcttgtgaagaaggggcttttgtaccttgttggagatgccacctcagaagttcacactgtgcaggaaaaaggttttattctctcctggcatacattagaatgtcagatgcttgcatccatgtggaccacgatgggcctctaaaaattggtgggcagggggtttgcttatgagttttctctggaaaccgattttactcctggatgtattgaatgccccttgagctttatgagatacgagtccacatggataaaatgttagagagtggagttctacagaggattccaggaagaggccatgtctgtgcagtcctagttccagacaggtgagaagctccaggaactactggctaccttgacaagctgggtaaatagttatcattctgggtaactggttgaaactctgacttttggacaagtaattcctggggttctgtctttggtagcatcaccagggatatttgggtgggacagacagaagacacacagctgcctgttctctcctgcccatcatgtttggcccactagatgaagctgtactcagcaatttagggaatgtaacccttctcagaactggccattttcaggggaagcttgggagagcaatagtatggtgagccccttagagatgagcgcctactccttcttggcgaatgctgccttcagatgcttaccaagtggtcactgcatctagtaagattatatttccagtacacttccttagggcagaaacaccatcctatcaggtttggtcagtcccttcttcatgaagggagtcatggggaattcctgaaaattttcttccttctgcagacagttggatgagtcccttagagaaggcatccagagacataactaaactgaatatcatcccatattgattttaggaattgactctaaaactctgtgcagaatcttgtgttgggattgtatcttgacattcctgttgtgttatttttcttaactggagtgtgtgctgcctttcaggtacaatttttgtgtaataaaagccagtgcattaagtttatatagactactttctatgcaagactgagataataatttttgtctcaatgtcaacttttttcactgaataaaaatttaactgggtcaagaaaaca

SEQ ID NO: 343493 - DNA, 2755 bp, Homo sapiens
  misc_feature (56)..(56): n is a, c, g, or t
  misc_feature (59)..(59): n is a, c, g, or t
  misc_feature (62)..(62): n is a, c, g, or t
  misc_feature (69)..(69): n is a, c, g, or t
  misc_feature (71)..(71): n is a, c, g, or t
  misc_feature (96)..(96): n is a, c, g, or t
tcaatcttggcccaggcaagaaatctcaaaaggattgtattgagctgtcaagattnccnacnttgtgtngncaatatgcttccctcggaagttccnaagttcctcctcccatccacacccatggcctcatccgtgagtacattgtagaatacagcaggagtggttccaagatgtgggcctcccagagggctgctagtaactttacagaaatcaagaacttattggtcaacactctatacaccgtcagagtggctgcggtgactagtcgtggaataggaaactggagcgattctaaatccattaccaccataaaaggaaaagtgatcccaccaccagatatccacattgacagctatggtgaaaattatctaagcttcaccctgaccatggagagtgatatcaaggtgaatggctatgtggtgaaccttttctgggcatttgacacccacaagcaagagaggagaactttgaacttccgaggaagcatattgtcacacaaagttggcaatctgacagctcatacatcctatgagatttctgcctgggccaagactgacttgggggatagccctctggcatttgagcatgttatgaccagaggggttcgcccacctgcacctagcctcaaggccaaagccatcaaccagactgcagtggaatgtacctggaccggcccccggaatgtggtttatggtattttctatgccacgtcctttcttgacctctatcgcaacccgaagagcttgactacttcactccacaacaagacggtcattgtcagtaaggatgagcagtatttgtttctggtccgtgtagtggtaccctaccaggggccatcctctgactacgttgtagtgaagatgatcccggacagcaggcttccaccccgtcacctgcatgtggttcatacgggcaaaacctccgtggtcatcaagtgggaatcaccgtatgactctcctgaccaggacttgttgtatgcaattgcagtcaaagatctcataagaaagactgacaggagctacaaagtaaaatcccgtaacagcactgtggaatacacccttaacaagttggagcctggcgggaaataccacatcattgtccaactggggaacatgagcaaagattccagcataaaaattaccacagtttcattatcagcacctgatgccttaaaaatcataacagaaaatgatcatgttcttctgttttggaaaagcctggctttaaaggaaaagcattttaatgaaagcaggggctatgagatacacatgtttgatagtgccatgaatatcacagcttaccttgggaatactactgacaatttctttaaaatttccaacctgaagatgggtcataattacacgttcaccgtccaagcaagatgcctttttggcaaccagatctgtggggagcctgccatcctgctgtacgatgagctggggtctggtgcagatgcatctgcaacgcaggctgccagatctacggatgttgctgctgtggtggtgcccatcttattcctgatactgctgagcctgggggtggggtttgccatcctgtacacgaagcaccggaggctgcagagcagcttcaccgccttcgccaacagccactacagctccaggctggggtccgcaatcttctcctctggggatgacctgggggaagatgatgaagatgcccctatgataactggattttcagatgacgtccccatggtgatagcctgaaagagctttcctcactagaaaccaaatggtgtaaatattttatttgataaagatagttgatggtttattttaaaagatgcactttgagttgcaatatgttatttttatatgggccaaaaacaaaaaacaaaaaaaaaaaaaaggaaagaaaggaatgaataaactttgtagtaatcaactgtgaacttcaaaccaggttgattttagtaacccaattgctttgatttgacattaatgtagtcttacagggctgtgcttgctgggcatgcttttacgtctgtgagataatttcggttcagtaaattggccaatctttttatttttctaagacacagaaatgtatttaataaaaacctcgagagagtgatgggtggaaccccttctccttgaaagtgtgtacagatattccattttgtttggatatagtttataggaaagtgtgtggatgtattatggcggaaggtttctttatgttattttgttaatttattgggactctgtgtaaggccaggctttagtggtcattagacaccacatgtgttatgagccccttacccatagggttgggggtgggaagagaagcatatttttttgccattccggaagcaatccatttttattcacttgtgtgtcatgtaatggtctttggcaggagagagcactgagtcattgctggagttcagttcaacagagctgcagcttgggaagccctgtaagcccacagcttcctctcttatattaattgatggaattttactgtatgtgcctctgtacaagatgtagctttgagagctacaaaatgataacactgctttattacacactggtttcattgtcattgcaaaaacttaccctggttgtgggggagagttctagatctgtgccatgatccatacactggctaatagagtacataatttttccattttccattttttgtttttacttactactgaaggatctcagatgtaaaattatgtatttggtttgagatggccacttattgtccttaaaaatccatactgata

SEQ ID NO: 343494 - DNA, 3417 bp, Homo sapiens
cagactttgacacatctcttttgccaccaaatcttatctgctcctttgagtctctcttgcccagtctatagaaggggcatatgtgtggagagtctaatatgcaagttgttgtttaaataatattttctgataatattgatccattgagctcttttagatcatgctgggccaagcactgtcagccatctggtgggaagaccttccagatgacaagcatggcgctcattggttgaactgagaggggtcttttccttggccacttctccttgccccctcgactcttagcttgagctccagtctttttgagagcaccagtggtttctagttgtttagttggccatatgtgacgctatattggaaaggaagagaaagagagtatcagttgagtgctaggcatcacacatacattattttagttaaccttcccagctctgtgaaatgcagataacatctctaggctccaggaagatcagtaacttgcctaggttacacagatgccagaacaggaattcgaactcaagtttgccagcttccagaggccacaatctttccatttttgccacacgcacgtttaccatttacgatttactccattgtcagccttccgaaaggacttgagattggtgggactttgttagtgccaatcaagatgccactcgcagtgaatgatccctgttcctttaagaaccaggctgaagctgggctgttttgggacctttacaaaatggaacttttctgcctgacctaattgccaggatagccgactgagccaagatagttttgtgttcaccaagcaactgtggaccaaccttagcttcaggaaaacagtggtaaaaaaagatcgatgaggaacactgccaaagaaataccctttcttccccgactgaaagatggctttgtccgttgagttgaaaactattaagtcctgccttcctcacttttcatcacgtggcttctgtttttgaattcctttttgttttcagtgatcccaccaccagatatccacattgacagctatggtgaaaattatctaagcttcaccctgaccatggagagtgatatcaaggtgaatggctatgtggtgaaccttttctgggcatttgacacccacaagcaagagaggagaactttgaacttccgaggaagcatattgtcacacaaagttggcaatctgacagctcatacatcctatgagatttctgcctgggccaagactgacttgggggatagccctctggcatttgagcatgttatgaccagaggggttcgcccacctgcacctagcctcaaggccaaagccatcaaccagactgcagtggaatgtacctggaccggcccccggaatgtggtttatggtattttctatgccacgtcctttcttgacctctatcgcaacccgaagagcttgactacttcactccacaacaagacggtcattgtcagtaaggatgagcagtatttgtttctggtccgtgtagtggtaccctaccaggggccatcctctgactacgttgtagtgaagatgatcccggacagcaggcttccaccccgtcacctgcatgtggttcatacgggcaaaacctccgtggtcatcaagtgggaatcaccgtatgactctcctgaccaggacttgttgtatgcaattgcagtcaaagatctcataagaaagactgacaggagctacaaagtaaaatcccgtaacagcactgtggaatacacccttaacaagttggagcctggcgggaaataccacatcattgtccaactggggaacatgagcaaagattccagcataaaaattaccacagtttcattatcagcacctgatgccttaaaaatcataacagaaaatgatcatgttcttctgttttggaaaagcctggctttaaaggaaaagcattttaatgaaagcaggggctatgagatacacatgtttgatagtgccatgaatatcacagcttaccttgggaatactactgacaatttctttaaaatttccaacctgaagatgggtcataattacacgttcaccgtccaagcaagatgcctttttggcaaccagatctgtggggagcctgccatcctgctgtacgatgagctggggtctggtgcagatgcatctgcaacgcaggctgccagatctacggatgttgctgctgtggtggtgcccatcttattcctgatactgctgagcctgggggtggggtttgccatcctgtacacgaagcaccggaggctgcagagcagcttcaccgccttcgccaacagccactacagctccaggctggggtccgcaatcttctcctctggggatgacctgggggaagatgatgaagatgcccctatgataactggattttcagatgacgtccccatggtgatagcctgaaagagctttcctcactagaaaccaaatggtgtaaatattttatttgataaagatagttgatggtttattttaaaagatgcactttgagttgcaatatgttatttttatatgggccaaaaacaaaaaacaaaaaaaaaaaaaaggaaagaaaggaatgaataaactttgtagtaatcaactgtgaacttcaaaccaggttgattttagtaacccaattgctttgatttgacattaatgtagtcttacagggctgtgcttgctgggcatgcttttacgtctgtgagataatttcggttcagtaaattggccaatctttttatttttctaagacacagaaatgtatttaataaaaacctcgagagagtgatgggtggaaccccttctccttgaaagtgtgtacagatattccattttgtttggatatagtttataggaaagtgtgtggatgtattatggcggaaggtttctttatgttattttgttaatttattgggactctgtgtaaggccaggctttagtggtcattagacaccacatgtgttatgagccccttacccatagggttgggggtgggaagagaagcatatttttttgccattccggaagcaatccatttttattcacttgtgtgtcatgtaatggtctttggcaggagagagcactgagtcattgctggagttcagttcaacagagctgcagcttgggaagccctgtaagcccacagcttcctctcttatattaattgatggaattttactgtatgtgcctctgtacaagatgtagctttgagagctacaaaatgataacactgctttattacacactggtttcattgtcattgcaaaaacttaccctggttgtgggggagagttctagatctgtgccatgatccatacactggctaatagagtacataatttttccattttccattttttgtttttacttactactgaaggatctcagatgtaaaattatgtatttggtttgagatggccacttattgtccttaaaaatccatactgata

SEQ ID NO: 343495 - DNA, 873 bp, Homo sapiens
actgcacagacatggccgtttttcctggaatcctctgtagaactccactctctaacattttatccatgtggactcgtatctcataaagctcaaggggcattcaatgcatccagagacataactaaactgaatatcatcccatattgattttaggaattgactctaaaactctgtgcagaatcttgtgttgggattgtatcttgacattcctgttgtgttatttttcttaactggagtgtgtgctgcctttcaggtacaatttttgtgtaataaaagccagtgcattaagtttatatagactactttctatgcaagactgagatatggaatagataggaagagatatgtactgctgggtacatggacagtaagtgtgttttcagatggagtaccagcaccgaaaatgggttgagggaggatgggttgtatgtatgtttctgcccactaattttgagcagccatattatgaattaaatcgtcacagccaagtaataacccaagaatggtatgagtttcatgtgtaatagctcaaatggaataagcatgaatgctggagtggaccattatcctcaaatattctatgtcacttctcatttaaagactcttgttatgaactattagaaactttaggcaaaatcaaaagtatttgcggcaaaataaaggcctattctactcttatttaaagtgaaacactgtatacttgtttctctccaaagcgaaattaagtatttataatttcaattgcctcgataagtttccaagtcactgaaatctgctgaaggttttactgtattgttgcacaactttaagataatttttgtctcaatgtcaacttttttcactgaataaaaatttaactgggtcaagaaaaca

SEQ ID NO: 343496 - DNA, 3885 bp, Homo sapiens
ttgctgcgtcaactgtgttccctttggcctggctgagtttgatactgtggggattcagtttaggcgctggcccgaggatatcccagcggtggtacttcggagacacctgtctgcatctgactgagccggctctcctggcctcgcgctgcacattctctcctggcggcggcgccacctgcagtagcgttcgcccgaacatggcgacacggagcagcaggagggagtcgcgactcccgttcctattcaccctggtcgcactgctgccgcccggagctctctgcgaagtctggacgcagaggctgcacggcggcagcgcgcccttgccccaggaccggggcttcctcgtggtgcagggcgacccgcgcgagctgcggctgtgggcgcgcggggatgccaggggggcgagccgcgcggacgagaagccgctccggaggaaacggagcgctgccctgcagcccgagcccatcaaggtgtacggacaggttagtctgaatgattcccacaatcagatggtggtgcactgggctggagagaaaagcaacgtgatcgtggccttggcccgagatagcctggcattggcgaggcccaagagcagtgatgtgtacgtgtcttacgactatggaaaatcattcaagaaaatttcagacaagttaaactttggcttgggaaataggagtgaagctgttatcgcccagttctaccacagccctgcggacaacaagcggtacatctttgcagacgcttatgcccagtacctctggatcacgtttgacttctgcaacactcttcaaggcttttccatcccatttcgggcagctgatctcctcctacacagtaaggcctccaaccttctcttgggctttgacaggtcccaccccaacaagcagctgtggaagtcagatgactttggccagacctggatcatgattcaggaacatgtcaagtccttttcttggggaattgatccctatgacaaaccaaataccatctacattgaacgacacgaaccctctggctactccactgtcttccgaagtacagatttcttccagtcccgggaaaaccaggaagtgatccttgaggaagtgagagattttcagcttcgggacaagtacatgtttgctacaaaggtggtgcatctcttgggcagtgaacagcagtcttctgtccagctctgggtctcctttggccggaagcccatgagagcagcccagtttgtcacaagacatcctattaatgaatattacatcgcagatgcctccgaggaccaggtgtttgtgtgtgtcagccacagtaacaaccgcaccaatttatacatctcagaggcagaggggctgaagttctccctgtccttggagaacgtgctctattacagcccaggaggggccggcagtgacaccttggtgaggtattttgcaaatgaaccatttgctgacttccaccgagtggaaggattgcaaggagtctacattgctactctgattaatggttctatgaatgaggagaacatgagatcggtcatcacctttgacaaagggggaacctgggagtttcttcaggctccagccttcacgggatatggagagaaaatcaattgtgagctttcccagggctgttcccttcatctggctcagcgcctcagtcagctcctcaacctccagctccggagaatgcccatcctgtccaaggagtcggctccaggcctcatcatcgccactggctcagtgggaaagaacttggctagcaagacaaacgtgtacatctctagcagtgctggagccaggtggcgagaggcacttcctggacctcactactacacatggggagaccacggcggaatcatcacggccattgcccagggcatggaaaccaacgagctaaaatacagtaccaatgaaggggagacctggaaaacattcatcttctctgagaagccagtgtttgtgtatggcctcctcacagaacctggggagaagagcactgtcttcaccatctttggctcgaacaaagagaatgtccacagctggctgatcctccaggtcaatgccacggatgccttgggagttccctgcacagagaatgactacaagctgtggtcaccatctgatgagcgggggaatgagtgtttgctgggacacaagactgttttcaaacggcggaccccccatgccacatgcttcaatggagaggactttgacaggccggtggtcgtgtccaactgctcctgcacccgggaggactatgagtgtgacttcggtttcaagatgagtgaagatttgtcattagaggtttgtgttccagatccggaattttctggaaagtcatactcccctcctgtgccttgccctgtgggttctacttacaggagaacgagaggctaccggaagatttctggggacacttgtagcggaggagatgttgaagcgcgactggaaggagagctggtcccctgtcccctggcagaagagaacgagttcattctgtatgctgtgaggaaatccatctaccgctatgacctggcctcgggagccaccgagcagttgcctctcaccgggctacgggcagcagtggccctggactttgactatgagcacaactgtttgtattggtccgacctggccttggacgtcatccagcgcctctgtttgaatggaagcacagggcaagaggtgatcatcaattctggcctggagacagtagaagctttggcttttgaacccctcagccagctgctttactgggtagatgcaggcttcaaaaagattgaggtagctaatccagatggcgacttccgactcacaatcgtcaattcctctgtgcttgatcgtcccagggctctggtcctcgtgccccaagagggggtgatgttctggacagactggggagacctgaagcctgggatttatcggagcaatatggatggttctgctgcctatcacctggtgtctgaggatgtgaagtggcccaatggcatctctgtggacgaccagtggatttactggacggatgcctacctggagtgcatagagcggatcacgttcagtggccagcagcgctctgtcattctggacaacctcccgcacccctatgccattgctgtctttaagaatgaaatctactgggatgactggtcacagctcagcatattccgagcttccaaatacagtgggtcccagatggagattctggcaaaccagctcacggggctcatggacatgaagattttctacaaggggaagaacactggaagcaatgcctgtgtgcccaggccatgcagcctgctgtgcctgcccaaggccaacaacagtagaagctgcaggtgtccagaggatgtgtccagcagtgtgcttccatcaggggacctgatgtgtgactgccctcagggctatcagctcaagaacaatacctgtgtcaaagaagagaacacctgtcttcgcaaccagtatcgctgcagcaacgggaactgtatcaacagcatttggtggtgtgactttgacaacgactgtggagacatgagcgatgagagaaactgccgtgagtcttctggattggacgttaagcacttaccattactcagaagcctggttggctcttcccaggctgagggcctaaggtctagggcgagggccacccatgattggtgatgcccatctaagttgatggggcttagatgacagagaaaacatatttccatacacaggtagatattagatatataggattaatattatatacataatatttttttaaccaccccagaagtaccactcgttacaagagatttataaataaacgtcacatggctgaaactgaattgatttggcaatctgggctctaatcttggctgtggctctgtaataaagctggtgacttggggcgagtaaa

SEQ ID NO: 343497 - DNA, 1572 bp, Homo sapiens
cagactttgacacatctcttttgccaccaaatcttatctgctcctttgagtctctcttgcccagtctatagaaggggcatatgtgtggagagtctaatatgcaagttgttgtttaaataatattttctgataatattgatccattgagctcttttagatcatgctgggccaagcactgtcagccatctggtgggaagaccttccagatgacaagcatggcgctcattggttgaactgagaggggtcttttccttggccacttctccttgccccctcgactcttagcttgagctccagtctttttgagagcaccagtggtttctagttgtttagttggccatatgtgacgctatattggaaaggaagagaaagagagtatcagttgagtgctaggcatcacacatacattattttagttaaccttcccagctctgtgaaatgcagataacatctctaggctccaggaagatcagtaacttgcctaggttacacagatgccagaacaggaattcgaactcaagtttgccagcttccagaggccacaatctttccatttttgccacacgcacgtttaccatttacgatttactccattgtcagccttccgaaaggacttgagattggtgggactttgttagtgccaatcaagatgccactcgcagtgaatgatccctgttcctttaagaaccaggctgaagctgggctgttttgggacctttacaaaatggaacttttctgcctgacctaattgccaggatagccgactgagccaagatagttttgtgttcaccaagcaactgtggaccaaccttagcttcaggaaaacagtggtaaaaaaagatcgatgaggaacactgccaaagaaataccctttcttccccgactgaaagatggctttgtccgttgagttgaaaactattaagtcctgccttcctcacttttcatcacgtggcttctgtttttgaattcctttttgttttcagtgatcccaccaccagatatccacattgacagctatggtgaaaattatctaagcttcaccctgaccatggagagtgatatcaaggtaatgtgggaatttcaagccagcagctggatggggctttattttgtatgggaactgaaaggacatagcacagtaagactggaaaaaaacaaaaaacaacttcccccatgaagaacaacttgagtcttcacatgtaattattctgcctcagcctggtgcctttttatccttaaccatataattaaatggttcacagctacagtgcaaataaagagttggtgttaacagaatatgtatgccctgtaattttcagctttattggatttcctggtgctaagcgctaatgctgaggcgctcacagtggaagaacaaccttcttgtgggagagttggataccttggaaacatattcactttccatccacctaagatcttcctcttccagcaccgccatcccctctactggccctctgcatagccgacttcatcattgttacctgtgcccatgtggttcctcaagctgagatccgctttccatagtgttccttcttatctgtccctcctcac

SEQ ID NO: 343498 - DNA, 2579 bp, Homo sapiens
ttgctgcgtcaactgtgttccctttggcctggctgagtttgatactgtggggattcagtttaggcgctggcccgaggatatcccagcggtggtacttcggagacacctgtctgcatctgactgagccggctctcctggcctcgcgctgcacattctctcctggcggcggcgccacctgcagtagcgttcgcccgaacatggcgacacggagcagcaggagggagtcgcgactcccgttcctattcaccctggtcgcactgctgccgcccggagctctctgcgaagtctggacgcagaggctgcacggcggcagcgcgcccttgccccaggaccggggcttcctcgtggtgcagggcgacccgcgcgagctgcggctgtgggcgcgcggggatgccaggggggcgagccgcgcggacgagaagccgctccggaggaaacggagcgctgccctgcagcccgagcccatcaaggtgtacggacaggttagtctgaatgattcccacaatcagatggtggtgcactgggctggagagaaaagcaacgtgatcgtggccttggcccgagatagcctggcattggcgaggcccaagagcagtgatgtgtacgtgtcttacgactatggaaaatcattcaagaaaatttcagacaagttaaactttggcttgggaaataggagtgaagctgttatcgcccagttctaccacagccctgcggacaacaagcggtacatctttgcagacgcttatgcccagtacctctggatcacgtttgacttctgcaacactcttcaaggcttttccatcccatttcgggcagctgatctcctcctacacagtaaggcctccaaccttctcttgggctttgacaggtcccaccccaacaagcagctgtggaagtcagatgactttggccagacctggatcatgattcaggaacatgtcaagtccttttcttggggaattgatccctatgacaaaccaaataccatctacattgaacgacacgaaccctctggctactccactgtcttccgaagtacagatttcttccagtcccgggaaaaccaggaagtgatccttgaggaagtgagagattttcagcttcgggacaagtacatgtttgctacaaaggtggtgcatctcttgggcagtgaacagcagtcttctgtccagctctgggtctcctttggccggaagcccatgagagcagcccagtttgtcacaagacatcctattaatgaatattacatcgcagatgcctccgaggaccaggtgtttgtgtgtgtcagccacagtaacaaccgcaccaatttatacatctcagaggcagaggggctgaagttctccctgtccttggagaacgtgctctattacagcccaggaggggccggcagtgacaccttggtgaggtattttgcaaatgaaccatttgctgacttccaccgagtggaaggattgcaaggagtctacattgctactctgattaatggttctatgaatgaggagaacatgagatcggtcatcacctttgacaaagggggaacctgggagtttcttcaggctccagccttcacgggatatggagagaaaatcaattgtgagctttcccagggctgttcccttcatctggctcagcgcctcagtcagctcctcaacctccagctccggagaatgcccatcctgtccaaggagtcggctccaggcctcatcatcgccactggctcagtgggaaagaacttggctagcaagacaaacgtgtacatctctagcagtgctggagccaggtggcgagaggcacttcctggacctcactactacacatggggagaccacggcggaatcatcacggccattgcccagggcatggaaaccaacgagctaaaatacagtaccaatgaaggggagacctggaaaacattcatcttctctgagaagccagtgtttgtgtatggcctcctcacagaacctggggagaagagcactgtcttcaccatctttggctcgaacaaagagaatgtccacagctggctgatcctccaggtcaatgccacggatgccttgggagttccctgcacagagaatgactacaagctgtggtcaccatctgatgagcgggggaatgagtgtttgctgggacacaagactgttttcaaacggcggaccccccatgccacatgcttcaatggagaggactttgacaggccggtggtcgtgtccaactgctcctgcacccgggaggactatgagtggtcagttcttctttgatggctggggactgagttgtgttttattcactcagcagtgttgggggaagagattaggcatggtccctttccctgagcaaaggaagggaatagaaggaaacaagtatttgtgaagcatcttttagatacacatgctaaagtatttagagataaaatatggtattatagattccttcaaaataatcctgtaaggactagagggcagtgagtggggtatggatgaaagaggattggccctttggtgataatagttgttgctaggaatagagacacatggggattcatcactataaaacaaaaataaacgatttttact

SEQ ID NO: 343499 - DNA, 593 bp, Homo sapiens
aaaaaaacgaacggctagatctagtgaagctaaaataccaggactagggtggttccttcccccatgaagaacaacttgagtcttcacatgtaattattctgcctcagcctggtgcctttttatccttaaccatataattaaatggttcacagctacagtgcaaataaagagttggtgttaacagaatatgtatgccctgtaattttcagctttattggatttcctggtgctaagcgctaatgctgaggcgctcacagtggaagaacaaccttcttgtgggagagttggataccttggaaacatattcactttccatccacctaagatcttcctcttccagcaccgccatcccctctactggccctctgcatagccgacttcatcattgttacctgtgcccatgtggttcctcaagctgagatccgctttccatagtgttccttcttatctgtccctcctcacagcctctccattgatgaatttgtgttgggacaagttgggacaagcaaccttcagagtctttctgccatttacttaactgccatttagtgtcatgaccttggcttcagaatgggttgatataagaaatggcc

SEQ ID NO: 343500 - DNA, 534 bp, Homo sapiens
atttgcttatccctcgtcgaccttggattgcttccacattttagctgttgtgaataatgctgctatctgtgaaaggtttttaaggacactgtttcttcgttgaaaagtgctgagtaatcatcctttggtttttaccattacctagaggctagtcttgagtgaaatataatttttggtaatccataaatggaaggcaagtcctactcatttttccttccagttgctattgagagaacacataggtacacagttgtctttcctttcttgcccttgtttgcttttggagcaactgagctggctttggcagtctcagtgcctgccttcacagacagcgtgtcatggaaggtgggatttcagcgggtgtttgatggtgatgccattcaggttgtattatacatgcctcttgcatcatgaccacttgtctttgcagctgtggaagtcagatgactttggccagacctggatcatgattcaggaacatgtcaagtccttttcttggtaagttgtgtcatctaagaaatcttgatatatgta

SEQ ID NO: 343501 - DNA, 585 bp, Homo sapiens
ctttgggttcagaagagaaagcagacactgaagttcactgtgctagtgtagggtatagataactcaaactggggaacccaaactacccacttagcttttgagtaggtaataagagtcttctcctgagaagctttgttttcctaatttggctacgttcaaacgaccactaaaataaatgtgaggatccatcgatgggtagaaggtggccaggagggacagtgggaagctgggctaggtttcacagctgattatggtggctgcctggctatggcattgaccttctcagctagagggttgtggtagggttgaggggtgggtagagtggtgggatatggggtcaggtgaaaatgtgttggaactcaccaaggcctgactgttttgtctctaggggaagatgatgaagatgcccctatgataactggattttcagatgacgtccccatggtgatagcctgaaagagctttcctcactagaaaccaaatggtgtaaatattttatttgataaagatagttgatggtttattttaaaagatgcactttgagttgcaatatgttatttttatatgggccaaaaacaaaaaaca

SEQ ID NO: 343502 - DNA, 962 bp, Homo sapiens
  misc_feature (655)..(655): n is a, c, g, or t
  misc_feature (669)..(669): n is a, c, g, or t
  misc_feature (678)..(678): n is a, c, g, or t
  misc_feature (701)..(701): n is a, c, g, or t
  misc_feature (705)..(705): n is a, c, g, or t
  misc_feature (713)..(713): n is a, c, g, or t
  misc_feature (729)..(729): n is a, c, g, or t
  misc_feature (731)..(731): n is a, c, g, or t
  misc_feature (740)..(740): n is a, c, g, or t
  misc_feature (745)..(745): n is a, c, g, or t
  misc_feature (753)..(753): n is a, c, g, or t
  misc_feature (755)..(755): n is a, c, g, or t
  misc_feature (773)..(773): n is a, c, g, or t
  misc_feature (777)..(777): n is a, c, g, or t
  misc_feature (779)..(779): n is a, c, g, or t
  misc_feature (782)..(782): n is a, c, g, or t
  misc_feature (788)..(788): n is a, c, g, or t
  misc_feature (826)..(826): n is a, c, g, or t
  misc_feature (840)..(840): n is a, c, g, or t
  misc_feature (844)..(844): n is a, c, g, or t
  misc_feature (850)..(850): n is a, c, g, or t
  misc_feature (853)..(853): n is a, c, g, or t
  misc_feature (856)..(856): n is a, c, g, or t
  misc_feature (859)..(859): n is a, c, g, or t
  misc_feature (878)..(878): n is a, c, g, or t
  misc_feature (898)..(898): n is a, c, g, or t
  misc_feature (929)..(929): n is a, c, g, or t
ggcgcgggcggcctggagccccgggagcggcgcgcgcggtcccggcccagcggctctcctggcctcgcgctgcacattctctcctggcggcggcgccacctgcagtagcgttcgcccgaacatggcgacacggagcagcaggagggagtcgcgactcccgttcctattcaccctggtcgcactgctgccgcccggagctctctgcgaagtctggacgcagaggctgcacggcggcagcgcgcccttgccccaggaccggggcttcctcgtggtgcagggcgacccgcgcgagctgcggctgtgggcgcgcggggatgccaggggggcgagccgcgcggacgagaagccgctccggaggaaacggagcgctgccctgcagcccgagcccatcaaggtgtacggacaggttagtctgaatgattcccacaatcagatggtggtgcactgggctggagagaaaagcaacgtgatcgtggccttggcccgagatagcctggcattggcgaggcccaagagcagtgatgtgtacgtgtcttacgactatggaaaatcattcaagaaaatttcagacaagttaaactttggcttgggaaataggagtgaagctgttatcgcccagttctaccacagccctgcggacaacaagcggtacatntttgcagacgctangccatactntggatcacgttgacttgcacatntcangcttgcanccattcgggagtgttncnctaacagtnaggcncaactttntnggttgaagtccaccacanatgngnatnaagttngcaatggtactgtcagactagcatcttgtgggtgtacntagaacaaactatnatgnagatanacngtncantcgaaattcagcgggacanatatggagattcatcgaatntgtaatggtttagctgaaattctcatagtcnagcgcacaaagacttgcgatatatattatatgt

SEQ ID NO: 343503 - DNA, 7870 bp, Homo sapiens
ttgctgcgtcaactgtgttccctttggcctggctgagtttgatactgtggggattcagtttaggcgctggcccgaggatatcccagcggtggtacttcggagacacctgtctgcatctgactgagccggctctcctggcctcgcgctgcacattctctcctggcggcggcgccacctgcagtagcgttcgcccgaacatggcgacacggagcagcaggagggagtcgcgactcccgttcctattcaccctggtcgcactgctgccgcccggagctctctgcgaagtctggacgcagaggctgcacggcggcagcgcgcccttgccccaggaccggggcttcctcgtggtgcagggcgacccgcgcgagctgcggctgtgggcgcgcggggatgccaggggggcgagccgcgcggacgagaagccgctccggaggaaacggagcgctgccctgcagcccgagcccatcaaggtgtacggacaggttagtctgaatgattcccacaatcagatggtggtgcactgggctggagagaaaagcaacgtgatcgtggccttggcccgagatagcctggcattggcgaggcccaagagcagtgatgtgtacgtgtcttacgactatggaaaatcattcaagaaaatttcagacaagttaaactttggcttgggaaataggagtgaagctgttatcgcccagttctaccacagccctgcggacaacaagcggtacatctttgcagacgcttatgcccagtacctctggatcacgtttgacttctgcaacactcttcaaggcttttccatcccatttcgggcagctgatctcctcctacacagtaaggcctccaaccttctcttgggctttgacaggtcccaccccaacaagcagctgtggaagtcagatgactttggccagacctggatcatgattcaggaacatgtcaagtccttttcttggggaattgatccctatgacaaaccaaataccatctacattgaacgacacgaaccctctggctactccactgtcttccgaagtacagatttcttccagtcccgggaaaaccaggaagtgatccttgaggaagtgagagattttcagcttcgggacaagtacatgtttgctacaaaggtggtgcatctcttgggcagtgaacagcagtcttctgtccagctctgggtctcctttggccggaagcccatgagagcagcccagtttgtcacaagacatcctattaatgaatattacatcgcagatgcctccgaggaccaggtgtttgtgtgtgtcagccacagtaacaaccgcaccaatttatacatctcagaggcagaggggctgaagttctccctgtccttggagaacgtgctctattacagcccaggaggggccggcagtgacaccttggtgaggtattttgcaaatgaaccatttgctgacttccaccgagtggaaggattgcaaggagtctacattgctactctgattaatggttctatgaatgaggagaacatgagatcggtcatcacctttgacaaagggggaacctgggagtttcttcaggctccagccttcacgggatatggagagaaaatcaattgtgagctttcccagggctgttcccttcatctggctcagcgcctcagtcagctcctcaacctccagctccggagaatgcccatcctgtccaaggagtcggctccaggcctcatcatcgccactggctcagtgggaaagaacttggctagcaagacaaacgtgtacatctctagcagtgctggagccaggtggcgagaggcacttcctggacctcactactacacatggggagaccacggcggaatcatcacggccattgcccagggcatggaaaccaacgagctaaaatacagtaccaatgaaggggagacctggaaaacattcatcttctctgagaagccagtgtttgtgtatggcctcctcacagaacctggggagaagagcactgtcttcaccatctttggctcgaacaaagagaatgtccacagctggctgatcctccaggtcaatgccacggatgccttgggagttccctgcacagagaatgactacaagctgtggtcaccatctgatgagcgggggaatgagtgtttgctgggacacaagactgttttcaaacggcggaccccccatgccacatgcttcaatggagaggactttgacaggccggtggtcgtgtccaactgctcctgcacccgggaggactatgagtgtgacttcggtttcaagatgagtgaagatttgtcattagaggtttgtgttccagatccggaattttctggaaagtcatactcccctcctgtgccttgccctgtgggttctacttacaggagaacgagaggctaccggaagatttctggggacacttgtagcggaggagatgttgaagcgcgactggaaggagagctggtcccctgtcccctggcagaagagaacgagttcattctgtatgctgtgaggaaatccatctaccgctatgacctggcctcgggagccaccgagcagttgcctctcaccgggctacgggcagcagtggccctggactttgactatgagcacaactgtttgtattggtccgacctggccttggacgtcatccagcgcctctgtttgaatggaagcacagggcaagaggtgatcatcaattctggcctggagacagtagaagctttggcttttgaacccctcagccagctgctttactgggtagatgcaggcttcaaaaagattgaggtagctaatccagatggcgacttccgactcacaatcgtcaattcctctgtgcttgatcgtcccagggctctggtcctcgtgccccaagagggggtgatgttctggacagactggggagacctgaagcctgggatttatcggagcaatatggatggttctgctgcctatcacctggtgtctgaggatgtgaagtggcccaatggcatctctgtggacgaccagtggatttactggacggatgcctacctggagtgcatagagcggatcacgttcagtggccagcagcgctctgtcattctggacaacctcccgcacccctatgccattgctgtctttaagaatgaaatctactgggatgactggtcacagctcagcatattccgagcttccaaatacagtgggtcccagatggagattctggcaaaccagctcacggggctcatggacatgaagattttctacaaggggaagaacactggaagcaatgcctgtgtgcccaggccatgcagcctgctgtgcctgcccaaggccaacaacagtagaagctgcaggtgtccagaggatgtgtccagcagtgtgcttccatcaggggacctgatgtgtgactgccctcagggctatcagctcaagaacaatacctgtgtcaaagaagagaacacctgtcttcgcaaccagtatcgctgcagcaacgggaactgtatcaacagcatttggtggtgtgactttgacaacgactgtggagacatgagcgatgagagaaactgccctaccaccatctgtgacctggacacccagtttcgttgccaggagtctgggacttgtatcccactgtcctataaatgtgaccttgaggatgactgtggagacaacagtgatgaaagtcattgtgaaatgcaccagtgccggagtgacgagtacaactgcagttccggcatgtgcatccgctcctcctgggtatgtgacggggacaacgactgcagggactggtctgatgaagccaactgtaccgccatctatcacacctgtgaggcctccaacttccagtgccgaaacgggcactgcatcccccagcggtgggcgtgtgacggggatacggactgccaggatggttccgatgaggatccagtcaactgtgagaagaagtgcaatggattccgctgcccaaacggcacttgcatcccatccagcaaacattgtgatggtctgcgtgattgctctgatggctccgatgaacagcactgcgagcccctctgtacgcacttcatggactttgtgtgtaagaaccgccagcagtgcctgttccactccatggtctgtgacggaatcatccagtgccgcgacgggtccgatgaggatgcggcgtttgcaggatgctcccaagatcctgagttccacaaggtatgtgatgagttcggtttccagtgtcagaatggagtgtgcatcagtttgatttggaagtgcgacgggatggatgattgcggcgattattctgatgaagccaactgcgaaaaccccacagaagccccaaactgctcccgctacttccagtttcggtgtgagaatggccactgcatccccaacagatggaaatgtgacagggagaacgactgtggggactggtctgatgagaaggattgtggagattcacatattcttcccttctcgactcctgggccctccacgtgtctgcccaattactaccgctgcagcagtgggacctgcgtgatggacacctgggtgtgcgacgggtaccgagattgtgcagatggctctgacgaggaagcctgccccttgcttgcaaacgtcactgctgcctccactcccacccaacttgggcgatgtgaccgatttgagttcgaatgccaccaaccgaagacgtgtattcccaactggaagcgctgtgacggccaccaagattgccaggatggccgggacgaggccaattgccccacacacagcaccttgacttgcatgagcagggagttccagtgcgaggacggggaggcctgcattgtgctctcggagcgctgcgacggcttcctggactgctcggacgagagcgatgaaaaggcctgcagtgatgagttgactgtgtacaaagtacagaatcttcagtggacagctgacttctctggggatgtgactttgacctggatgaggcccaaaaaaatgccctctgcttcttgtgtatataatgtctactacagggtggttggagagagcatatggaagactctggagacccacagcaataagacaaacactgtattaaaagtcttgaaaccagataccacgtatcaggttaaagtacaggttcagtgtctcagcaaggcacacaacaccaatgactttgtgaccctgaggaccccagagggattgccagatgcccctcgaaatctccagctgtcactccccagggaagcagaaggtgtgattgtaggccactgggctcctcccatccacacccatggcctcatccgtgagtacattgtagaatacagcaggagtggttccaagatgtgggcctcccagagggctgctagtaactttacagaaatcaagaacttattggtcaacactctatacaccgtcagagtggctgcggtgactagtcgtggaataggaaactggagcgattctaaatccattaccaccataaaaggaaaagtgatcccaccaccagatatccacattgacagctatggtgaaaattatctaagcttcaccctgaccatggagagtgatatcaaggtgaatggctatgtggtgaaccttttctgggcatttgacacccacaagcaagagaggagaactttgaacttccgaggaagcatattgtcacacaaagttggcaatctgacagctcatacatcctatgagatttctgcctgggccaagactgacttgggggatagccctctggcatttgagcatgttatgaccagaggggttcgcccacctgcacctagcctcaaggccaaagccatcaaccagactgcagtggaatgtacctggaccggcccccggaatgtggtttatggtattttctatgccacgtcctttcttgacctctatcgcaacccgaagagcttgactacttcactccacaacaagacggtcattgtcagtaaggatgagcagtatttgtttctggtccgtgtagtggtaccctaccaggggccatcctctgactacgttgtagtgaagatgatcccggacagcaggcttccaccccgtcacctgcatgtggttcatacgggcaaaacctccgtggtcatcaagtgggaatcaccgtatgactctcctgaccaggacttgttgtatgcaattgcagtcaaagatctcataagaaagactgacaggagctacaaagtaaaatcccgtaacagcactgtggaatacacccttaacaagttggagcctggcgggaaataccacatcattgtccaactggggaacatgagcaaagattccagcataaaaattaccacagtttcattatcagcacctgatgccttaaaaatcataacagaaaatgatcatgttcttctgttttggaaaagcctggctttaaaggaaaagcattttaatgaaagcaggggctatgagatacacatgtttgatagtgccatgaatatcacagcttaccttgggaatactactgacaatttctttaaaatttccaacctgaagatgggtcataattacacgttcaccgtccaagcaagatgcctttttggcaaccagatctgtggggagcctgccatcctgctgtacgatgagctggggtctggtgcagatgcatctgcaacgcaggctgccagatctacggatgttgctgctgtggtggtgcccatcttattcctgatactgctgagcctgggggtggggtttgccatcctgtacacgaagcaccggaggctgcagagcagcttcaccgccttcgccaacagccactacagctccaggctggggtccgcaatcttctcctctggggatgacctgggggaagatgatgaagatgcccctatgataactggattttcagatgacgtccccatggtgatagcctgaaagagctttcctcactagaaaccaaatggtgtaaatattttatttgataaagatagttgatggtttattttaaaagatgcactttgagttgcaatatgttatttttatatgggccaaaaacaaaaaacaaaaaaaaaaaaaaggaaagaaaggaatgaataaactttgtagtaatcaactgtgaacttcaaaccaggttgattttagtaacccaattgctttgatttgacattaatgtagtcttacagggctgtgcttgctgggcatgcttttacgtctgtgagataatttcggttcagtaaattggccaatctttttatttttctaagacacagaaatgtatttaataaaaacctcgagagagtgatgggtggaaccccttctccttgaaagtgtgtacagatattccattttgtttggatatagtttataggaaagtgtgtggatgtattatggcggaaggtttctttatgttattttgttaatttattgggactctgtgtaaggccaggctttagtggtcattagacaccacatgtgttatgagccccttacccatagggttgggggtgggaagagaagcatatttttttgccattccggaagcaatccatttttattcacttgtgtgtcatgtaatggtctttggcaggagagagcactgagtcattgctggagttcagttcaacagagctgcagcttgggaagccctgtaagcccacagcttcctctcttatattaattgatggaattttactgtatgtgcctctgtacaagatgtagctttgagagctacaaaatgataacactgctttattacacactggtttcattgtcattgcaaaaacttaccctggttgtgggggagagttctagatctgtgccatgatccatacactggctaatagagtacataatttttccattttccattttttgtttttacttactactgaaggatctcagatgtaaaattatgtatttggtttgagatggccacttattgtccttaaaaatccatactgata

SEQ ID NO: 343504 - DNA, 6025 bp, Homo sapiens
ttgctgcgtcaactgtgttccctttggcctggctgagtttgatactgtggggattcagtttaggcgctggcccgaggatatcccagcggtggtacttcggagacacctgtctgcatctgactgagccggctctcctggcctcgcgctgcacattctctcctggcggcggcgccacctgcagtagcgttcgcccgaacatggcgacacggagcagcaggagggagtcgcgactcccgttcctattcaccctggtcgcactgctgccgcccggagctctctgcgaagtctggacgcagaggctgcacggcggcagcgcgcccttgccccaggaccggggcttcctcgtggtgcagggcgacccgcgcgagctgcggctgtgggcgcgcggggatgccaggggggcgagccgcgcggacgagaagccgctccggaggaaacggagcgctgccctgcagcccgagcccatcaaggtgtacggacaggttagtctgaatgattcccacaatcagatggtggtgcactgggctggagagaaaagcaacgtgatcgtggccttggcccgagatagcctggcattggcgaggcccaagagcagtgatgtgtacgtgtcttacgactatggaaaatcattcaagaaaatttcagacaagttaaactttggcttgggaaataggagtgaagctgttatcgcccagttctaccacagccctgcggacaacaagcggtacatctttgcagacgcttatgcccagtacctctggatcacgtttgacttctgcaacactcttcaaggcttttccatcccatttcgggcagctgatctcctcctacacagtaaggcctccaaccttctcttgggctttgacaggtcccaccccaacaagcagctgtggaagtcagatgactttggccagacctggatcatgattcaggaacatgtcaagtccttttcttggggaattgatccctatgacaaaccaaataccatctacattgaacgacacgaaccctctggctactccactgtcttccgaagtacagatttcttccagtcccgggaaaaccaggaagtgatccttgaggaagtgagagattttcagcttcgggacaagtacatgtttgctacaaaggtggtgcatctcttgggcagtgaacagcagtcttctgtccagctctgggtctcctttggccggaagcccatgagagcagcccagtttgtcacaagacatcctattaatgaatattacatcgcagatgcctccgaggaccaggtgtttgtgtgtgtcagccacagtaacaaccgcaccaatttatacatctcagaggcagaggggctgaagttctccctgtccttggagaacgtgctctattacagcccaggaggggccggcagtgacaccttggtgaggtattttgcaaatgaaccatttgctgacttccaccgagtggaaggattgcaaggagtctacattgctactctgattaatggttctatgaatgaggagaacatgagatcggtcatcacctttgacaaagggggaacctgggagtttcttcaggctccagccttcacgggatatggagagaaaatcaattgtgagctttcccagggctgttcccttcatctggctcagcgcctcagtcagctcctcaacctccagctccggagaatgcccatcctgtccaaggagtcggctccaggcctcatcatcgccactggctcagtgggaaagaacttggctagcaagacaaacgtgtacatctctagcagtgctggagccaggtggcgagaggcacttcctggacctcactactacacatggggagaccacggcggaatcatcacggccattgcccagggcatggaaaccaacgagctaaaatacagtaccaatgaaggggagacctggaaaacattcatcttctctgagaagccagtgtttgtgtatggcctcctcacagaacctggggagaagagcactgtcttcaccatctttggctcgaacaaagagaatgtccacagctggctgatcctccaggtcaatgccacggatgccttgggagttccctgcacagagaatgactacaagctgtggtcaccatctgatgagcgggggaatgagtgtttgctgggacacaagactgttttcaaacggcggaccccccatgccacatgcttcaatggagaggactttgacaggccggtggtcgtgtccaactgctcctgcacccgggaggactatgagtgtgacttcggtttcaagatgagtgaagatttgtcattagaggtttgtgttccagatccggaattttctggaaagtcatactcccctcctgtgccttgccctgtgggttctacttacaggagaacgagaggctaccggaagatttctggggacacttgtagcggaggagatgttgaagcgcgactggaaggagagctggtcccctgtcccctggcagaagagaacgagttcattctgtatgctgtgaggaaatccatctaccgctatgacctggcctcgggagccaccgagcagttgcctctcaccgggctacgggcagcagtggccctggactttgactatgagcacaactgtttgtattggtccgacctggccttggacgtcatccagcgcctctgtttgaatggaagcacagggcaagaggtgatcatcaattctggcctggagacagtagaagctttggcttttgaacccctcagccagctgctttactgggtagatgcaggcttcaaaaagattgaggtagctaatccagatggcgacttccgactcacaatcgtcaattcctctgtgcttgatcgtcccagggctctggtcctcgtgccccaagagggggtgatgttctggacagactggggagacctgaagcctgggatttatcggagcaatatggatggttctgctgcctatcacctggtgtctgaggatgtgaagtggcccaatggcatctctgtggacgaccagtggatttactggacggatgcctacctggagtgcatagagcggatcacgttcagtggccagcagcgctctgtcattctggacaacctcccgcacccctatgccattgctgtctttaagaatgaaatctactgggatgactggtcacagctcagcatattccgagcttccaaatacagtgggtcccagatggagattctggcaaaccagctcacggggctcatggacatgaagattttctacaaggggaagaacactggaagcaatgcctgtgtgcccaggccatgcagcctgctgtgcctgcccaaggccaacaacagtagaagctgcaggtgtccagaggatgtgtccagcagtgtgcttccatcaggggacctgatgtgtgactgccctcagggctatcagctcaagaacaatacctgtgtcaaagaagagaacacctgtcttcgcaaccagtatcgctgcagcaacgggaactgtatcaacagcatttggtggtgtgactttgacaacgactgtggagacatgagcgatgagagaaactgccctaccaccatctgtgacctggacacccagtttcgttgccaggagtctgggacttgtatcccactgtcctataaatgtgaccttgaggatgactgtggagacaacagtgatgaaagtcattgtgaaatgcaccagtgccggagtgacgagtacaactgcagttccggcatgtgcatccgctcctcctgggtatgtgacggggacaacgactgcagggactggtctgatgaagccaactgtaccgccatctatcacacctgtgaggcctccaacttccagtgccgaaacgggcactgcatcccccagcggtgggcgtgtgacggggatacggactgccaggatggttccgatgaggatccagtcaactgtgagaagaagtgcaatggattccgctgcccaaacggcacttgcatcccatccagcaaacattgtgatggtctgcgtgattgctctgatggctccgatgaacagcactgcgagcccctctgtacgcacttcatggactttgtgtgtaagaaccgccagcagtgcctgttccactccatggtctgtgacggaatcatccagtgccgcgacgggtccgatgaggatgcggcgtttgcaggatgctcccaagatcctgagttccacaaggtatgtgatgagttcggtttccagtgtcagaatggagtgtgcatcagtttgatttggaagtgcgacgggatggatgattgcggcgattattctgatgaagccaactgcgaaaaccccacagaagccccaaactgctcccgctacttccagtttcggtgtgagaatggccactgcatccccaacagatggaaatgtgacagggagaacgactgtggggactggtctgatgagaaggattgtggagattcacatattcttcccttctcgactcctgggccctccacgtgtctgcccaattactaccgctgcagcagtgggacctgcgtgatggacacctgggtgtgcgacgggtaccgagattgtgcagatggctctgacgaggaagcctgccccttgcttgcaaacgtcactgctgcctccactcccacccaacttgggcgatgtgaccgatttgagttcgaatgccaccaaccgaagacgtgtattcccaactggaagcgctgtgacggccaccaagattgccaggatggccgggacgaggccaattgccccacacacagcaccttgacttgcatgagcagggagttccagtgcgaggacggggaggcctgcattgtgctctcggagcgctgcgacggcttcctggactgctcggacgagagcgatgaaaaggcctgcagtgatgagttgactgtgtacaaagtacagaatcttcagtggacagctgacttctctggggatgtgactttgacctggatgaggcccaaaaaaatgccctctgcttcttgtgtatataatgtctactacagggtggttggagagagcatatggaagactctggagacccacagcaataagacaaacactgtattaaaagtcttgaaaccagataccacgtatcaggttaaagtacaggttcagtgtctcagcaaggcacacaacaccaatgactttgtgaccctgaggaccccagagggattgccagatgcccctcgaaatctccagctgtcactccccagggaagcagaaggtgtgattgtaggccactgggctcctcccatccacacccatggcctcatccgtgagtacattgtagaatacagcaggagtggttccaagatgtgggcctcccagagggctgctagtaactttacagaaatcaagaacttattggtcaacactctatacaccgtcagagtggctgcggtgactagtcgtggaataggaaactggagcgattctaaatccattaccaccataaaaggaaaagtgatcccaccaccagatatccacattgacagctatggtgaaaattatctaagcttcaccctgaccatggagagtgatatcaaggtaatgtgggaatttcaagccagcagctggatggggctttattttgtatgggaactgaaaggacatagcacagtaagactggaaaaaaacaaaaaacaacttcccccatgaagaacaacttgagtcttcacatgtaattattctgcctcagcctggtgcctttttatccttaaccatataattaaatggttcacagctacagtgcaaataaagagttggtgttaacagaatatgtatgccctgtaattttcagctttattggatttcctggtgctaagcgctaatgctgaggcgctcacagtggaagaacaaccttcttgtgggagagttggataccttggaaacatattcactttccatccacctaagatcttcctcttccagcaccgccatcccctctactggccctctgcatagccgacttcatcattgttacctgtgcccatgtggttcctcaagctgagatccgctttccatagtgttccttcttatctgtccctcctcac

SEQ ID NO: 343505 - DNA, 3911 bp, Homo sapiens
ttgctgcgtcaactgtgttccctttggcctggctgagtttgatactgtggggattcagtttaggcgctggcccgaggatatcccagcggtggtacttcggagacacctgtctgcatctgactgagccggctctcctggcctcgcgctgcacattctctcctggcggcggcgccacctgcagtagcgttcgcccgaacatggcgacacggagcagcaggagggagtcgcgactcccgttcctattcaccctggtcgcactgctgccgcccggagctctctgcgaagtctggacgcagaggctgcacggcggcagcgcgcccttgccccaggaccggggcttcctcgtggtgcagggcgacccgcgcgagctgcggctgtgggcgcgcggggatgccaggggggcgagccgcgcggacgagaagccgctccggaggaaacggagcgctgccctgcagcccgagcccatcaaggtgtacggacaggttagtctgaatgattcccacaatcagatggtggtgcactgggctggagagaaaagcaacgtgatcgtggccttggcccgagatagcctggcattggcgaggcccaagagcagtgatgtgtacgtgtcttacgactatggaaaatcattcaagaaaatttcagacaagttaaactttggcttgggaaataggagtgaagctgttatcgcccagttctaccacagccctgcggacaacaagcggtacatctttgcagacgcttatgcccagtacctctggatcacgtttgacttctgcaacactcttcaaggcttttccatcccatttcgggcagctgatctcctcctacacagtaaggcctccaaccttctcttgggctttgacaggtcccaccccaacaagcagctgtggaagtcagatgactttggccagacctggatcatgattcaggaacatgtcaagtccttttcttggggaattgatccctatgacaaaccaaataccatctacattgaacgacacgaaccctctggctactccactgtcttccgaagtacagatttcttccagtcccgggaaaaccaggaagtgatccttgaggaagtgagagattttcagcttcgggacaagtacatgtttgctacaaaggtggtgcatctcttgggcagtgaacagcagtcttctgtccagctctgggtctcctttggccggaagcccatgagagcagcccagtttgtcacaagacatcctattaatgaatattacatcgcagatgcctccgaggaccaggtgtttgtgtgtgtcagccacagtaacaaccgcaccaatttatacatctcagaggcagaggggctgaagttctccctgtccttggagaacgtgctctattacagcccaggaggggccggcagtgacaccttggtgaggtattttgcaaatgaaccatttgctgacttccaccgagtggaaggattgcaaggagtctacattgctactctgattaatggttctatgaatgaggagaacatgagatcggtcatcacctttgacaaagggggaacctgggagtttcttcaggctccagccttcacgggatatggagagaaaatcaattgtgagctttcccagggctgttcccttcatctggctcagcgcctcagtcagctcctcaacctccagctccggagaatgcccatcctgtccaaggagtcggctccaggcctcatcatcgccactggctcagtgggaaagaacttggctagcaagacaaacgtgtacatctctagcagtgctggagccaggtggcgagaggcacttcctggacctcactactacacatggggagaccacggcggaatcatcacggccattgcccagggcatggaaaccaacgagctaaaatacagtaccaatgaaggggagacctggaaaacattcatcttctctgagaagccagtgtttgtgtatggcctcctcacagaacctggggagaagagcactgtcttcaccatctttggctcgaacaaagagaatgtccacagctggctgatcctccaggtcaatgccacggatgccttgggagttccctgcacagagaatgactacaagctgtggtcaccatctgatgagcgggggaatgagtgtttgctgggacacaagactgttttcaaacggcggaccccccatgccacatgcttcaatggagaggactttgacaggccggtggtcgtgtccaactgctcctgcacccgggaggactatgagtgtgacttcggtttcaagatgagtgaagatttgtcattagaggtttgtgttccagatccggaattttctggaaagtcatactcccctcctgtgccttgccctgtgggttctacttacaggagaacgagaggctaccggaagatttctggggacacttgtagcggaggagatgttgaagcgcgactggaaggagagctggtcccctgtcccctggcagaagagaacgagttcattctgtatgctgtgaggaaatccatctaccgctatgacctggcctcgggagccaccgagcagttgcctctcaccgggctacgggcagcagtggccctggactttgactatgagcacaactgtttgtattggtccgacctggccttggacgtcatccagcgcctctgtttgaatggaagcacagggcaagaggtgatcatcaattctggcctggagacagtagaagctttggcttttgaacccctcagccagctgctttactgggtagatgcaggcttcaaaaagattgaggtagctaatccagatggcgacttccgactcacaatcgtcaattcctctgtgcttgatcgtcccagggctctggtcctcgtgccccaagagggggtgatgttctggacagactggggagacctgaagcctgggatttatcggagcaatatggatggttctgctgcctatcacctggtgtctgaggatgtgaagtggcccaatggcatctctgtggacgaccagtggatttactggacggatgcctacctggagtgcatagagcggatcacgttcagtggccagcagcgctctgtcattctggacaacctcccgcacccctatgccattgctgtctttaagaatgaaatctactgggatgactggtcacagctcagcatattccgagcttccaaatacagtgggtcccagatggagattctggcaaaccagctcacggggctcatggacatgaagattttctacaaggggaagaacactggaagcaatgcctgtgtgcccaggccatgcagcctgctgtgcctgcccaaggccaacaacagtagaagctgcaggtgtccagaggatgtgtccagcagtgtgcttccatcaggggacctgatgtgtgactgccctcagggctatcagctcaagaacaatacctgtgtcaaagaagagaacacctgtcttcgcaaccagtatcgctgcagcaacgggaactgtatcaacagcatttggtggtgtgactttgacaacgactgtggagacatgagcgatgagagaaactgccctaccaccatctgtgacctggacacccagtttcgttgccaggagtctgggacttgtatcccactgtcctataaatgtgaccttgaggatgactgtggagacaacagtgatgaaagtcattgtgaaatgcaccagtgccggagtgacgagtacaactgcagttccggcatgtgcatccgctcctcctgggtatgtgacggggacaacgactgcagggactggtctgatgaagccaactgtaccggtcagtacttcctggactcagttgacagcactcatccgttcatgcagtggttaacattatagctttaaacgatcggaaaatctaggctctgagaattagcttggaccttagaaatcagcgagtttcatgcttct

SEQ ID NO: 343506 - DNA, 407 bp, Homo sapiens
actccagagcccatcctatctattgtgtcccacaagggaacacgacattcaaattcaagtaacatttgctaagtgccaaagacatagtacacatcaagctaaatgccttctcatttgcccacaaactctaagatggtaatgttattcctcttttcatggatggactccaaggctttgagaggtgggaactttggtattttctgacatcctgattttgtgacattcttctccagttcccttggatttgtatgaaaactcaagtaatggtagtatcagattcaaactggaaaatccaagtaccagtaaaaggttctctctctttttattttttaatttaaaaaaaaatttttttagagacaaagtctcactctgttgctcaggctagagtacactggtgtgatcacagc

SEQ ID NO: 343507 - DNA, 166 bp, Homo sapiens
tccaagttttgacaattatgaataaagccgtcataaacatctatgtgcacgcaggcttttgcgtaggcataagttttctcaaggattttttcaaatctatcttttttttttttagatggagtctcactctgtcacccaggctggagtgcagtagtgcgatctcagc

SEQ ID NO: 343508 - DNA, 477 bp, Homo sapiens
actttaaccccttgactgctctgatgtgagacgacacccttacagtggctgccttgtatgtgaaacctacccttaactaacccccatttatggctgtaggatatgtaatataattactgggaggggactgtgttggactcttctaatggggcctttttggctgtgacaagccttagattagtgtcgacagaaggacaattcattccctccagtggagccccttctttaggcatatttagcttttaatggtatcataggcaataaccacttttaatttgcagatgattctttctcaaccagtagatgaaataatgatatcaaatggtacatttccccatcaaacttgcttagtttgatgttatgttattatgttatcgattgctgggtaacaaattaccccaacaaattacctctcctacccatctattgctgggtagcaaattaccccccaaaatgtggcagcttaaaattaaaaaa

SEQ ID NO: 343509 - DNA, 392 bp, Homo sapiens
ttgtctagggaacagcgcaggtcgggaggaaaaacactcctggagctcagcaaagtccgggatgtaaccccaactcccggcttctcacctatggcaggtacgcagctccatagggctgtcatgcaagtaacatgaaataaaccaagagcctaagcccgtgtccgtccgccatctgttcccatgaaaccattactgttagtgcacaaaaacataaaaatacaaaacaaaaatagaaaagctcctgtcttgtcaccagtggatgtaaaactgtagatatggtatgtggaacccaatcctacaagcaaatattctccctctccactactccttttgctgaaacatcaagccgtcctcactccagaacagggaaagtcaagacaaagggatacacc

SEQ ID NO: 343510 - DNA, 379 bp, Homo sapiens
gaaaagttatgaaaggggtcttgtctgtcataaccagctctaaattggctacctgtaaagaggaacgtcctggatggcacataaatagcgggtaatccaacaaaaaataatcttcatagctaacatgttcatttttagtattgctccaatttttactcctttttggggggatggggggaacagagcctcgctctgtcacccaggctggatctcgacccactgcaacctccacctcctgggctcaagccatcctcccccgacctcagcctcctgagtagctgaggtgggaatatcgctggagtccaggagttcaaggatgcagtgagctatgatcacgtcactgcaccccagcctggggaaaaagagcgaaactccgtct

SEQ ID NO: 343511 - DNA, 226 bp, Homo sapiens
gtgcagctttaaatattttcattttctaaccatttgttgctagcaatatagaaacgcaattgatttacatacattgatcttgtatccaataaccttatgaaactcacttatggatcctaaccaattatctgtacatttcttctgtattttttcatgtacaaaatctgtaagtgtcagttttctttctttccaatctttgtatctttcatattctgttcttgccttc

SEQ ID NO: 343512 - DNA, 654 bp, Homo sapiens
ttacgaataaattaggtattaagtcaatcgcatttttgaggagccagaaaatggatcggcttgcccatggttctgcaccacctacttaaaactcctaataggtattaaaactttaagcacaattgtggcatctttattgagttaattttcttgaaattaaattttgtcatgaattgactcatttgtaccagggactcattcttgaactgatagtaccctggttataaacctcttcatatcttaagaatcgggggtatttctattttacagggccaagtaaccatgaaattgtattgcatcttttggcaatgaaaatacatagtaatcataggaaagcaatcgggtgattactctcccctaaactggggggtttattagctgagccattacaggttttagttactctttaaccccttacaaggtagcttaaagtcctcttgggacacgtgtcaataaaaggttgtttataagcacctacaccttcccaggccctgaactagatagtatataaaaatgaatgaggggcattgtcatgagggtgacaaaaggcttggaagaggagccaatgatgcagagatagcccagatggaagagaatggccctgctcccccaggggtcgcgtgctccctcatggatgcgtgcatttcaggaaaa

SEQ ID NO: 343513 - DNA, 503 bp, Homo sapiens
ccttccagatcttgctactctccatcacaaggcaaagtctatcttcctttcttttgaatctgggaagacacttgtgactgcctcaatgaataggaagaatacagtggaagtgatgctgcgtggctgctaagaacaggctggaaaaggccatgcagcctctgttcgtctccctcttggaacacttgtctttggaaccctgagttgccaagtaggacatccagggctgccgtgctgtggggaagcccaaaactagcccacacagagagaccacatgaaaaaacactgacattgcatgaagagagggtgatgtgctccagctgcctaaggcttcatctcctgcctgttccagctccagaaaacctgaaggcaacagcatgagacaccctgagctaaaaccatctagctgagctgtttctgaacttctgaccaatttcttatttctgaccaataaaaaataattttattatctgtgattgataataaatttattattgtttcaagcc

SEQ ID NO: 343514 - DNA, 218 bp, Homo sapiens
gggtgactcttgctttgaaacacacatttctatttaactgtttggatttctggagtatgtgtgtaataaatgactttaataatctctattcatatttattcatcaaaatgtgaaagattattataagaattagtgttaggttgaaaaaggtgctttgacgttaattgtgatatagtaattctacatttaaattcaaatgcatgttgaaatttgcaatt

SEQ ID NO: 343515 - DNA, 282 bp, Homo sapiens
tcccactcggctcctcctcccacttcctctccccgcctccgaaagcttacctctcttggaggcctttttcagtgtccccctgcccagtctgggcaccacggatgacatactaatagcagaacgtggtttaaatagctaaggccttggactatccgatccaggcctgccactgaggtgggaattcaataagatgatacagacaaaggaaggcttggcacatagcaagtgctcagttaaaccgttgctaatgtttacagttatcactccgagcctgattactgc

SEQ ID NO: 343516 - DNA, 664 bp, Homo sapiens
tgaggtttatttaacctattcaaggctaactcagcattggagaataaactaatattttactgagcaaagcagagaatcttcttctatgaggttttagaagactttcaatttagcaattagtagactttcaaatgcgggatagtttctggaagggactggtagaatctcccatgtaaaaagaaatgttttcagtttgcaaagcagaccatgaatatttttctaagaaaatgggtactataaaatttcacttatgattttgtcagtaaaattttaatgcagtggagatagcttaagtcctaaaattaggctagatgtgataacatgaggaattgaaaggattaagtatgtactatcatttagagttaataattagaagaaacagaaacttaaaataagtatggccgggcgcagtggttcatgcctgtaatcccagcactttgggaggccaaggtcaggagtttgagaccagcctggccaacatgacgaaaccttgtctgaactaaaaatacaaaaattagctaggcctggtggtgggagcctgtagtcccatctactcaggaggctgaggcagaagcatcgcttgaaccaggaggcaaatgttgcagtgagctcagattgcgccactgcactctagcctgggcgacagagtgagacttcatctcaa

SEQ ID NO: 343517 - DNA, 548 bp, Homo sapiens
agctgaatagccataattaaatagtgttctttgttgctttttatttttaaaaggcatgtaaaacttgaaatgtagttcactgtattttatatttgtaattttaataattttggtttagaatagggaattccaaactgatacttgagttctcaatcatggggtggagtttctgttaatggttatcttgttgaattagtttatctagtgtaaaaaaattgtcatcctcagtttattttcagtatatctcattgatatgagacataattgatttccagttttccttaaagatggttagagattaaaatttcttctgttaaaaaaattgttaatgctattggtcccagatttcccttctttgcatcctgccaaaggaaaaagtgctctgtacttattttgtgccctgtaatgttatagatgcttaataagatcccagattttaagtagcagctgtcattgatttgtttactgaatgaatttttcatgtttcattgtatttgtgcacagaactactctgatgactgtttacttaaataataatcatagtgcac

SEQ ID NO: 343518 - DNA, 500 bp, Homo sapiens
tgtcactacaaaaagagaagaaaagaaagaagaagacgaccttcttctgcagggtacaggcttgctttttgggagattatgtgtagaaatatttccaaactgccaccaacatagttctttggccatctccttatatctctgaatgaatgtgtgattagaaaaagcatttttatgttatcctatgctaagtataattttaaaagcaagcatatggctgcaaaaaaaaaaatcacttaatagatgatgctacttatccagaggttgggagacaggagacataaatttctctaaagcttcttctagttctaacattttctttttctgtgtaaaacaatctcccccactaccttattctactggtgtgcatgttgatattataaagacacggcaaattattgaaatttgagtctcaaaaatgcatctaaggatatgagatgtgcctggatatttagcaatgctggctacttacttgttataaatcatctagagatattacaact

SEQ ID NO: 343519 - DNA, 609 bp, Homo sapiens
aatccaagctactcaggaggctgaggcaggagaatcgcttaaacctgggaggcggaggctgcagtgagctgagattatgccactgcgctccagcctgggcaacagagcaagactccatctcaaaaggaatctaagaggagtcaaaatctaagtctaagataatcattcccaaatactctcttccaaagggtaggaagactgacagtgtcctactgaagggccagaaaaagaaattatctttgctcagtgttgaactattctgttataaagcattgtaaacattatagcaacacttatgaccattataaccctacatgtgttcccattgcatgtttaataatttctctactttaaaaaaattgagaactagatcgagaagacaactgattgtagaacagtcagagagcttcgtgctggtgaacattaatagagctataatagtctgccaaaattatgatgaaatcactggaggcatcaaggcaaaaaaacaaatcaaggggaagctattaacagtttagcatttctagtttgtgtgagaatatggattccagctagcagaagaatacttcaactcagattggctgttaggcattgctagaaatcttgttt

SEQ ID NO: 343520 - DNA, 134 bp, Homo sapiens
tgaagggtccaggaaaactgctctgaatgctacagctacgcttccaactatggtggactctgacctgtgactgtttgcttggttttgcaatctgcccccgggaacaacatagatatggaggtgtaggaactggc

SEQ ID NO: 343521 - DNA, 434 bp, Homo sapiens
agtcgtgtatggcagagcattagctgggagaggtcacactagctgggtgtggaccttgtcctcctgtgcgtcccctcaaaaccaggtaatgtgtcctcaggatttccctggcacaaacgacctcgctctccctcagtcctcaaaggtgatggccagtcctggttacccgggaagcccgtgccctgtgactcccttcctgccactgggcatccctgtagcccccattcctccagcaatcagcctcagtggtgtgtttggttcacaccttgtgcttgcactgtgactgaaacctcccctcctcagcgaggcttctcctgggcccccaggctgggcttatgcccctcaggtccttctcagccctgtgcttttccttagggctttggtgtgattctcgggcacctgtgcttagggagtgcttgtttctgtaactgggt

SEQ ID NO: 343522 - DNA, 271 bp, Homo sapiens
agtgagcattcgtgttccgccacaccctcacgaacacttgcccttgtctgtctctttgatttgagctatcctaatggatgcgaaatggtatcctctggttctgatgtgcacttccctggtggctaatgatgttgagtatcttgtcatggccatttgtatacctctttcttttttgtacagctgcatactattcccctgtttagagaaactgtagttgatttaacctgtttactactgcaatagtcctgcccaagaaattaaaaaaaaaaaa

SEQ ID NO: 343523 - DNA, 382 bp, Homo sapiens
gttcactgacttgggttgatcagttgagtggacaaataacctttaaaaaccaaagtgtaggcctgacgtcacatgaatgtagacagcaaattcatctaccttcaatgaaacagatgactgggacacaggcattctgtgttaccagattaggcaaatgcaggttccttttggcacccctatctctagtgattctagatttgatgacagtataatgacagtataatgatgaaaattcagaaatttaacattgatacaatgctactgtttaattcagtacccatagtcaaattttgtcaattgtctcaatgtttttccctttctcaacacaatttcagtccagaatcactgtgtttaagtctctttagcctcctttaatctggaa

SEQ ID NO: 343524 - DNA, 657 bp, Homo sapiens
ctcgtgatccaccctccttagcctcccaaagtgctgggattacaggcatgagccacaggtcttcctctgtcactgaggctggagcgcagtggcataatcagctcactgcaagctctgcttcaacctccgcctcactgcaacctctgctgggctcaagtgatactcctgcctcagcctcccaagtagctgggactacagatacggaccaccatgcccaactaatttttgtatattttgtagagatgggtttttgccatgttgcccaggctttcaaactcttgagctcaagtgatccacccactttggcctcccaaagtgatgggattataggcatgagccactgcgcctggtctgtgtacaagttttatagttttagatattacgtttaggtctatgatccatcttaaattttgtatatgatgagacgtgtggattaagttcacttttccacaaaaggagagccagttgcgcctgcacagtggattattattcagtcattagaaagaatgaaatgtgatatgtgatactacatggatgagctttgaaaatactatgccaactgaaagaaggcagacacaaaaggtcacatgttgtatgattccatttatatgaaatatccaggatagttaaatccagagacagagtccagattggttg

SEQ ID NO: 343525 - DNA, 437 bp, Homo sapiens
ctcctctttaaggccaataactccagaggctactttctagatgctgtaggcatgctttattattttcttttttttctctgactgtatattttctgtttgcctatcttcaagctcactaagtctttcttctgtttcatccattatattaatacatctctgatgtattcttctgtatgccaattttatcttttagctctggaatttctgcttaattattttaataccccattattctcatggaattctgaatttattctccgtgttatatcaaatttctttgcgtttcaacactggtcttcaaattctctgaggtatcacctccaagataccacccagttgaacaattacaatcctaaagtatcaatggttcttaatacttaaaaaggttttctaaacataaatcattatccaacttagataaagtctgcgatcttcgg

SEQ ID NO: 343526 - DNA, 733 bp, Homo sapiens
gagctgtagagaagagcaaccacagggctgtttgagaatgctggggctgtcttcacatttctcacagttgtggtgaaaggtgtgtcctctggaccctcctaagatggtttcccaatgtgtaggagtcgctcaaccactttctggctctcagagagaattgatccatgtggaaatgtttattctctgcatctgtgggagagagaaaagtaaggaacctcctattccaccatgttgctgacatcagtctctacaaattctgcttccaaaggcaaggaggacccagcagagtttagagatttactctccaactttctccagttactgtatgtttcaaagagtgaacctccaaagagtgaatcaatgggcttgcttgctctctggcttccaggtgaattcagccagtggaaccatggcaggagatcagagggaggaaatacaatgagatcaaggaatgtatttccatggtttcttccctgcagcatcacagcagtgggcatgtacctttcccagacctcttacctcttattacactactctctccatagagctctcttttacctaggtctccaataaccattccttctcctttcctcttcaaggttaggggtagtaacattatcccactttttctgcctcgagattattaaagttttccttatgtttttgctggacacccctcctttgtaaagagtatgtcactttattaaactcaaatgaaacccgattgtgctat

SEQ ID NO: 343527 - DNA, 456 bp, Homo sapiens
agcatttatattttttttattgtggcaaaatcacataaggaattcattagtaaaagccaaatcacagtttttaaatggtagtcaaccataatatctaatggaaagaagccaggcatagcagctccatataatgccttgtaaaaaacattgttagcattgttaaatgcagtcaattccttataatgatctagacggttttgtcatcccattacaaagcactgtgaatttaagctgttggactagtaggagactcagaagtcaaattcctgttacatcgacaattttggatatagtagaacgtcatggaactttctacccattaaatcaaggatgagcgagcttttacttgttgaattttgatatctgtacacttaactgtcgtgatagaaatggtattagaaagctggctgcggtggctcacgcctgtaatcccagcactttgtgaggccgaggcag

SEQ ID NO: 343528 - DNA, 403 bp, Homo sapiens
atgtctgatcccaaattcttgcctcctgaaccaatagtttattcattcattcggaaaataatttttcagcacctatgtccaaagcactcttctaagctaacagacaaaatccacgttctcaggaacttactttctactgagaaagatagaaaaacaaacatgcaagtttagaataagtcagaaagtggtaagtaacttcaataaaaatcaaggagataaggaggataaggaatgtatatgtgtaggtgggtagtcttttacttatgcttctcagagaaggcctcattgataagatgtcatttgagagacaagccatatgccattgttccaggaagagggaaaaccaagtttataccattgttggcattttggagcaacagcagagaggacaataaagctggag

SEQ ID NO: 343529 - DNA, 864 bp, Homo sapiens
gtcccactcattactaccagttgcaaccctcaggaattgagtactagaaacaccctcacagttttcatggggttggtgagcaagtaccttctgttgagaattggtctagtcctttgaagaatgctaggtagctctttctaaaataggttaatttcatgtcatagtgtttaggtaaaagcttcacattggacatgaataaaaaggattagagttcagtgtattcaggaaactaatataagatctttgaatcttcttattttgttccaagattgatgaaattcaggagaggacttgctacagtgtttttggagggtaattttgcactactgtttgaatcaaaattttaaattacgcatttgtcattaactccacttctaggaatctagcctgtaggaatcttggagggcataaaaaattatttgccaggatgttcatttgcagtattattggtaatcacaaaaatagtaaaaactaaaaaaaagaacgaaataaccaacaacaatataaccccacctacctgaatgagtattataaatagagaaaaggttaaatgggcatatagtacatgctatacgtttattatttaaaaggaaccaggactctatatcctgaataaatttttaacaatgtattattaaaggaaaaaaagaacagtatgggccatgcacagtggctcacaccagtgatcccagcactttgggaggccaaggtgggcagatcacaaggtcaagagatcgagactatcctggccaacgtggtgaaaccccgcctttactcaaaatacaaaaattagttgggcatggtggtgcacacctgtagtcccagctactcgggaggctgaggcaggagaatcacttgaacctg

SEQ ID NO: 343530 - DNA, 284 bp, Homo sapiens
aaaatgaacctagtaatatgagacattataactgtcaacaaaacctagaaagtatagatttttatgtcaaatcacccacttcttttcttttcaaggagacagtctcactctgtcacccaggctggagtgcagtggcatgatgtcagctcactgcagcctttgccttctgggttcaagcgattgtcctgcctcagcctcccaagtagctgggactacaggaatatgccaccacgtccagctatttttttttcctttttctttttttttgagatggagtctcgctc

SEQ ID NO: 343531 - DNA, 163 bp, Homo sapiens
ggatgcatagaaatgtaatatttagacaggtgaaggtaatgagtcagcctggtaaaaataaagggagaactgcaatttggggtgactgaaaattaccccaaggtaacgagcaagttgtagagggtgcaggagtttgtgcgtgtgtgtatttgtgtgtgtgtgt

SEQ ID NO: 343532 - DNA, 420 bp, Homo sapiens
atggcccacctgggagtggcacaaagccaaaggaatccccacccccagccaagggaagcagtgagttattgtgcgactactcttaggaaaccacacttctcccacgaatctttgcagcctgcatgcattagtccgttggcggctcacacctgtaatcccagcactttgggaggccaaggcgggcagatcacgaggtcaagagatcgagaccatcctagctaacatggtgaaaccccgtctctactaaaaatacaaaaattagctgggtgtggtgccacacgcctgtagtcccagctacttgggaggctgaggcaggagaatcgcttgaacccgggaaggggaggttgcagtaagccaagatgaggccactactccagcctggcaacagagtgagactctgtctcaaaaagaaaaaaaaaa

SEQ ID NO: 343533 - DNA, 354 bp, Homo sapiens
atgtattgttaccttaaaaattccgtgaaatataaaatgtgaaaatcacagaaacacagtcagacttaaaaagaagatgattagttacagaaagctactaaaagcagcccatggtgctgaagccataggcctgctgaaatctggatctagaatcacatcgagatacctagaattccagctctttagagtaatgaggtcaaagaggctccatttgaaatggtggacctgaacctggcttactactttatcacgaggctacaaaaatttggccaactactgcctggggaaacagcttatatagggctgcaggacctgagagctggaagaataaagatacagcattatgataaaata

SEQ ID NO: 343534 - DNA, 263 bp, Homo sapiens
cgtgaactttattttgttgggtattggatatttttgtattcctgtaaatttttttgagctttgttgtgggacacagttaaattttttttacctttttttaattttatatatatatataattatactttaagttctagggtacatgtgcaaaatgtgcaggtttgttacatatgtatacatgtgccatgttggtgtgctgcactcattaacttgtcatttactttaggtatatctcctaatgctatccctcccccgctctccca

SEQ ID NO: 343535 - DNA, 1587 bp, Homo sapiens
gcagaatacggaaagcgggagggacaaattgccaatgtttggagtctggtttccaggttgccgtttttgggggctctgggtgtggcggttgccgtagctgaaattggctgcaccatgtcggccttcgagaagcctcagatcatcgcccatatccagaagggcttcaactacacggtgtttgactgtaagtgggtgccctgcagcgccaaatttgtgaccatgggcaacttcgcacggggcaccggcgtcattcagctgtacgagatccagcacggggacctgaagctgcttcgggagattgaaaaggccaaacctattaaatgtggaacatttggtgcaacatctttacagcagagatatttagctactggagattttggtggaaaccttcatatatggaatttagaagctccagagatgccagtatattctgtaaagggccataaagaaattataaatgccatagatggcataggtggactaggaattggagaaggagcacctgaaattgtgactggcagccgagatggaactgtgaaggtgtgggacccaaggcaaaaagatgatcctgttgctaatatggaacctgtacaaggagaaaacaagagagactgttggactgtggcatttggcaatgcttataatcaagaagaacgtgttgtttgtgctggctatgacaatggggatatcaaactatttgatctcagaaatatggcattacggtgggagacaaacatcaaaaatggggtgtgtagcttggagtttgacagaaaagacataagtatgaataagttagtagccacatctctggaaggaaagttccatgtttttgacatgagaacacagcatccaaccaaaggttttgcctctgtttcagaaaaggctcataaatctactgtgtggcaggtccgacacctgccgcagaacagggagctctttctgacagctggaggcgccggcggccttcacctctggaagtagtaagtctgccagtgcacactgctccttttaaagttacctgtgggtgtaaagtaggattagattgaacttttttttcttttttttcctgctttgacttagttcattttgatatgatttaaaatttcatggtgttacataacttgttttctaagcattttgtatgaatatactttacacttagtagagtgtacactaatcttcttttgatacattttagtatatcattttagttgtgtcttctaagtatgaaaaagttggcccaagacttttatcagatactatcttgaagtgattagaacactcactgcctctaaaagatggggaaagggttccttgcctaaatttagataacatcattgtgatagaccccaacagagcctgaggctgctgattggtctccaggaaagatcttatcactgaatttgctttctgcatatctaggcagggtgagttacaatgaaagcttttactatgcacaccactttctgaatcccaagggcgctaacatcacagatactagatcatttaaaaggtctgatatcattgctcagggttggcctgtgaaaaggaaacaaaacaaaacaaaacaaaaattaaaggtctgat

SEQ ID NO: 343536 - DNA, 2635 bp, Homo sapiens
gcagaatacggaaagcgggagggacaaattgccaatgtttggagtctggtttccaggttgccgtttttgggggctctgggtgtggcggttgccgtagctgaaattggctgcaccatgtcggccttcgagaagcctcagatcatcgcccatatccagaagggcttcaactacacggtgtttgactgtaagtgggtgccctgcagcgccaaatttgtgaccatgggcaacttcgcacggggcaccggcgtcattcagctgtacgagatccagcacggggacctgaagctgcttcgggagattgaaaaggccaaacctattaaatgtggaacatttggtgcaacatctttacagcagagatatttagctactggagattttggtggaaaccttcatatatggaatttagaagctccagagatgccagtatattctgtaaagggccataaagaaattataaatgccatagatggcataggtggactaggaattggagaaggagcacctgaaattgtgactggcagccgagatggaactgtgaaggtgtgggacccaaggcaaaaagatgatcctgttgctaatatggaacctgtacaaggagaaaacaagagagactgttggactgtggcatttggcaatgcttataatcaagaagaacgtgttgtttgtgctggctatgacaatggggatatcaaactatttgatctcagaaatatggcattacggtgggagacaaacatcaaaaatggggtgtgtagcttggagtttgacagaaaagacataagtatgaataagttagtagccacatctctggaaggaaagttccatgtttttgacatgagaacacagcatccaaccaaaggttttgcctctgtttcagaaaaggctcataaatctactgtgtggcaggtccgacacctgccgcagaacagggagctctttctgacagctggaggcgccggcggccttcacctctggaagtatgaataccctattcagcggtcaaagaaagattctgagggaatagaaatgggagtcgcaggttctgtaagccttctgcagaatgttacgttgtccacccagcccatttcaagtttggattggagtccagataaaaggggtctctgcgtctgtagttcatttgaccaaacggtgagagtactgatcgttacaaagctcaataaaatttgacttcaagactttggacttgaggctgggcacggtggctcactcctgtaatcccagcactttgggaggccgaggcgggtggatcagaaggtcaggagatcgagaccatcctggctaacatggtgaaaccccgtctctactaaaaatataaaaaaaaatttgctgggtgtcatggcgggcatctgtagtcctagctacttgggaggctgaggcaggagaatggcgtgaacccgggaggcggaggttgcagtgagccgagattgtgccactgcactccagcctgggcaactgagcaagactgtctcaaaaaaaaaaaaaaaaaaaaagactttggacttgaaaccttccagaggaacactcacacaatttaagataggttctggagtcctctgaccctcattgaacaaagctggatttggctgatgataaaagaccccagccacaagcctctgggccagcctccagcctctctcggggcttgtttgctgacttgctgctgcacgtgggtatcagaagcaccaagtaaactatctccagggccagttcttttctctcccttccatttctaagtcaatagttgtctataattaaacatatttcagatttgttctgtgtccctgaagttccatattttatctttatgcttgtgttatgttttagtgtctataatgttgtggtgggaatcatttcatttggtttaaaagagtttgccttggaaaaactgaattaaccttcataaatacattttgagagatttcagtgtgagtaattttctggacataatattattgtataaaatatcaaaatggtgggccaggcgtggtagctcacgcctgtaattccagcactttgggaggctgaggcgggtgaatcacgaggtcaggaattcgagaccagcctggccaacatggtcaaaacccgtctctactaaaaatacaaaaaattagctgggcttagtggcgggcgcctgtaatcacagctacttgggaggctgaggcaggagaatcacttgaacccaggaggtggagattgcagtgagctgagattgcgccactgcactccagccctggcgacagagtgagactccgtctcaaaaaaaaaaaaaacaaatatatatatatatatctctctctctcaaaacggcacggttggtctagatttgggtagctattttctgcaatttaattcataaaacaaaatgctttgattttaaagagctcttttttacttaaaatacaggaactgaattggtgagacttttggtttttgactgtggtaagtgatggtgaaatgtacaagattgtaggggttttgtagtcttatttttggtcatactttaaaaatgcattttatgaataaacttctgtttttgagatctacagaagctttgattctgttaccttaacagtagtaataaagttaacattgtcacatcattttgctttataaa

SEQ ID NO: 343537 - DNA, 1810 bp, Homo sapiens
gcagaatacggaaagcgggagggacaaattgccaatgtttggagtctggtttccaggttgccgtttttgggggctctgggtgtggcggttgccgtagctgaaattggctgcaccatgtcggccttcgagaagcctcagatcatcgcccatatccagaagggcttcaactacacggtgtttgactgtaagtgggtgccctgcagcgccaaatttgtgaccatgggcaacttcgcacggggcaccggcgtcattcagctgtacgagatccagcacggggacctgaagctgcttcgggagattgaaaaggccaaacctattaaatgtggaacatttggtgcaacatctttacagcagagatatttagctactggagattttggtggaaaccttcatatatggaatttagaagctccagagatgccagtatattctgtaaagggccataaagaaattataaatgccatagatggcataggtggactaggaattggagaaggagcacctgaaattgtgactggcagccgagatggaactgtgaaggtgtgggacccaaggcaaaaagatgatcctgttgctaatatggaacctgtacaaggagaaaacaagagagactgttggactgtggcatttggcaatgcttataatcaagaagaacgtgttgtttgtgctggctatgacaatggggatatcaaactatttgatctcagaaatatggcattacggtgggagacaaacatcaaaaatggggtgtgtagcttggagtttgacagaaaagacataagtatgaataagttagtagccacatctctggaaggaaagttccatgtttttgacatgagaacacagcatccaaccaaaggttttgcctctgtttcagaaaaggctcataaatctactgtgtggcaggtccgacacctgccgcagaacagggagctctttctgacagctggaggcgccggcggccttcacctctggaagtatgaataccctattcagcggtcaaagaaagattctgagggaatagaaatgggagtcgcaggttctgtaagccttctgcagaatgttacgttgtccacccagcccatttcaagtttggattggagtccagataaaaggggtctctgcgtctgtagttcatttgaccaaacggtgagagtactgatcgttacaaagctcaataaaatttgacttcaagactttggacttgaggctgggcacggtggctcactcctgtaatcccagcactttgggaggccgaggcgggtggatcagaaggtcaggagatcgagaccatcctggctaacatggtgaaaccccgtctctactaaaaatataaaaaaaaatttgctgggtgtcatggcgggcatctgtagtcctagctacttgggaggctgaggcactgagattgcgccactgcactccagccctggcgacagagtgagactccgtctcaaaaaaaaaaaaaacaaatatatatatatatatctctctctctcaaaacggcacggttggtctagatttgggtagctattttctgcaatttaattcataaaacaaaatgctttgattttaaagagctcttttttacttaaaatacaggaactgaattggtgagacttttggtttttgactgtggtaagtgatggtgaaatgtacaagattgtaggggttttgtagtcttatttttggtcatactttaaaaatgcattttatgaataaacttctgtttttgagatctacagaagctttgattctgttaccttaacagtagtaataaagttaacattgtcacatcattttgctttataaa

SEQ ID NO: 343538 - DNA, 1233 bp, Homo sapiens
gcagaatacggaaagcgggagggacaaattgccaatgtttggagtctggtttccaggttgccgtttttgggggctctgggtgtggcggttgccgtagctgaaattggctgcaccatgtcggccttcgagaagcctcagatcatcgcccatatccagaagggcttcaactacacggtgtttgactgtaagtgggtgccctgcagcgccaaatttgtgaccatgggcaacttcgcacggggcaccggcgtcattcagctgtacgagatccagcacggggacctgaagctgcttcgggagattgaaaaggccaaacctattaaatgtggaacatttggtgcaacatctttacagcagagatatttagctactggagattttggtggaaaccttcatatatggaatttagaagctccagagatgccagtatattctgtaaagggccataaagaaattataaatgccatagatggcataggtggactaggaattggagaaggagcacctgaaattgtgactggcagccgagatggaactgtgaaggtgtgggacccaaggcaaaaagatgatcctgttgctaatatggaacctgtacaaggagaaaacaagagagactgttggactgtggcatttggcaatgcttataatcaagaagaacgtgttgtttgtgctggctatgacaatggggatatcaaactatttgatctcagaaatatggcattacggtgggagacaaacatcaaaaatggggtgtgtagcttggagtttgacagaaaagacataagtatgaataagttagtagccacatctctggaaggaaagttccatgtttttgacatgagaacacagcatccaaccaaaggttttgcctctgtttcagaaaaggctcataaatctactgtgtggcaggtccgacacctgccgcagaacagggagctctttctgacagctggaggcgccggcggccttcacctctggaagtagtctaacatctccaccctgtgacgccttcccatagaaatggtacacaaaaggtccttaggcttgggtccgtgtaatggagctcgagggttagaagctggcatcagtttttcattctggaagtgtttagatgaagttctgcaaatgttacttacagccattgcctttgcacattgtttgcctgtgatatccagcaatctatatctggagaaaaattacaataaataaaagattgccaaaagcaccaaaaaaaaa

SEQ ID NO: 343539 - DNA, 319 bp, Homo sapiens
ataacttaggaacacttgttggcttttctgtgtgtctattaatttggaaaccaagtcagatagttacatatgggtgatatctctgatattaaatacaacttacccaattagaagtcagaacaatgtggatattttcagatgtcataacatctgtcatattgccatgtacacaggaagccatagaagaagaatgtagaaaagaaacataatcatttacttttgaatttttgccaactcacttttatgcatggcaggaactgtgaaggtgtgggacccaaggcaaaaagatgatcctgttgctaatatggaacctgtacaa

SEQ ID NO: 343540 - DNA, 1906 bp, Homo sapiens
gcagaatacggaaagcgggagggacaaattgccaatgtttggagtctggtttccaggttgccgtttttgggggctctgggtgtggcggttgccgtagctgaaattggctgcaccatgtcggccttcgagaagcctcagatcatcgcccatatccagaagggcttcaactacacggtgtttgactgtaagtgggtgccctgcagcgccaaatttgtgaccatgggcaacttcgcacggggcaccggcgtcattcagctgtacgagatccagcacggggacctgaagctgcttcgggagattgaaaaggccaaacctattaaatgtggaacatttggtgcaacatctttacagcagagatatttagctactggagattttggtggaaaccttcatatatggaatttagaagctccagagatgccagtatattctgtaaagggccataaagaaattataaatgccatagatggcataggtggactaggaattggagaaggagcacctgaaattgtgactggcagccgagatggaactgtgaaggtgtgggacccaaggcaaaaagatgatcctgttgctaatatggaacctgtacaaggagaaaacaagagagactgttggactgtggcatttggcaatgcttataatcaagaagaacgtgttgtttgtgctggctatgacaatggggatatcaaactatttgatctcagaaatatggcattacggtgggagacaaacatcaaaaatggggtgtgtagcttggagtttgacagaaaagacataagtatgaataagttagtagccacatctctggaaggaaagttccatgtttttgacatgagaacacagcatccaaccaaaggttttgcctctgtttcagaaaaggctcataaatctactgtgtggcaggtccgacacctgccgcagaacagggagctctttctgacagctggaggcgccggcggccttcacctctggaagtagtaagtctgccagtgcacactgctccttttaaagttacctgtgggtgtaaagtaggattagattgaacttttttttcttttttttcctgctttgacttagttcattttgatatgatttaaaatttcatggtgttacataacttgttttctaagcattttgtatgaatatactttacacttagtagagtgtacactaatcttcttttgatacattttagtatatcattttagttgtgtcttctaagtatgaaaaagttggcccaagacttttatcagatactatcttgaagtgattagaacactcactgcctctaaaagatggggaaagggttccttgcctaaatttagataacatcattgtgatagaccccaacagagcctgaggctgctgattggtctccaggaaagatcttatcactgaatttgctttctgcatatctaggcagggtgagttacaatgaaagcttttactatgcacaccactttctgaatcccaagggcgctaacatcacagatactagatcatttaaaaggtctgatatcattgctcagggttggcctgtgaaaaggaaacaaaacaaaacaaaacaaaaattaaaggtctgataaaaattgtgagttaatggtatttctgaatactttattagctaagcaatatgtacttggaggggaaaaattatatctttcttaaacatcactcagggaaaaaacagcaagcccataaatgaaggatatttcaaaaataaagtttcattaataatgtaagaagaaaaacaccatcctcaatatatctgggactttcacatttataaaattcttctctattagctcctttgagaagctggaaggggttctgaaaaacagggctacagttggaaagtacttgttaaagtactgtgtgcagggataccgctgacaaaaagcag

SEQ ID NO: 343541 - DNA, 1321 bp, Homo sapiens
gcagaatacggaaagcgggagggacaaattgccaatgtttggagtctggtttccaggttgccgtttttgggggctctgggtgtggcggttgccgtagctgaaattggctgcaccatgtcggccttcgagaagcctcagatcatcgcccatatccagaagggcttcaactacacggtgtttgactgtaagtgggtgccctgcagcgccaaatttgtgaccatgggcaacttcgcacggggcaccggcgtcattcagctgtacgagatccagcacggggacctgaagctgcttcgggagattgaaaaggccaaacctattaaatgtggaacatttggtgcaacatctttacagcagagatatttagctactggagattttggtggaaaccttcatatatggaatttagaagctccagagatgccagtatattctgtaaagggccataaagaaattataaatgccatagatggcataggtggactaggaattggagaaggagcacctgaaattgtgactggcagccgagatggaactgtgaaggtgtgggacccaaggcaaaaagatgatcctgttgctaatatggaacctgtacaaggagaaaacaagagagactgttggactgtggcatttggcaatgcttataatcaagaagaacgtgttgtttgtgctggctatgacaatggggatatcaaactatttgatctcagaaatatggcattacggtgggagacaaacatcaaaaatggggtgtgtagcttggagtttgacagaaaagacataagtatgaataagttagtagccacatctctggaaggaaagttccatgtttttgacatgagaacacagcatccaaccaaaggttttgcctctgtttcagaaaaggtaaatatgagggaaatgtctttctatgaagaagaatgatagcttggtttagactgataagtagaattagtcaccaaggtttcttccaggtctttatgtgaagggagctatttttgatatattcctgtgagatcttgacaagtttttctgtgcaaagagtacttccccaaagtttatcaactttagacttcttgattataataaagatctcaggtaggaatcttattttgtagtttaggagcaattagaagaaacctagctgatattaggaatttgatcaacaaaacccagcctggtgtttcctaataagtatataatatttgtgctaatacctggttatatatttttcaaaataaactatatgtacatgatgtcatttcattacactttgttttatattccagtttgctatattaaatgaaattatttgaatcactga

SEQ ID NO: 343542 - DNA, 3548 bp, Homo sapiens
  misc_feature (1540)..(1540): n is a, c, g, or t
  misc_feature (2160)..(2160): n is a, c, g, or t
gaaataagtataagtcaatttggggtttccctccagggttgtgctccaagatccagggggacttaggcagcaccaaggcccttgtgaggacatctgttgtggtttatcatcaatctactttggcagctactgggacatcctctttcttattgagtctttggtggttggtctgtgtcagcaatccttctttgttcctcatgtgtccccctctccttggttccttccatgcaatttgctggcaccagaggcgattctgctgctcacacaccacactgggccatgagggaccctggatatttgcctcaggcctgtcttggccacactcaacacttgcttctcccctggtgcctccctagggctctgcctggggaagggatccggcttctctccactcttagattctgtgaatctgtttggtggttgcctcatcatctccctccccgggcttgttcgggatgagttgggcagggtgcagatttttttcttatagatccctgtacctacatatactttgctttactgatttactctccactttggtctaggaaatctttacccatatgctcgtgtggtggggcggggaacaagggtggtatcctggctttgtcatcagacattctgtcaaagctgttttccataaatctcacgttctttctctcctccctaaggacttttgaaaaaatgccaagaattgactctttttctgcattatccctgaggcaatgaacacagaatgccctccctgactgaggagggaccaagggggtcaagaaaatttggagaaaagcattcaatatttcaaagtattaactacagtgaatttccttccttctccatctcctccatcctggcctagcctgccattacctcttgctgggaccagtgcaacccaaagtttctcagggtctcctgactcagagcttctcacccacagttggcattttgggctggatcatttgtggttgaaggtgctgttctgtataacataggatgtttagcagcattcctgacctgtacccactagatgccagtagcatccctgctcccagttgtgacaatcaaaaatgtctccagacatagccaaatgtcccctggggacaaaatcactcctagttgagaaccacagttctaagcggtctccctgcttcttttcttgtcccatagtctactctccccacagcagccagcagtaatctgtacaccatttaaatctggccatgtcacttccctgtttaaaacccttcagtagcatctcattgcatgagactagaatccaagcccctcaactgcacttagaaagccacgctgtgctcacctctttccctcccctggtcactctccccttgtcattctatccagtcatgctggcctgtactggtttctggacttctccaagcttgtacttgctttgggcctttgcacttagattttccatctttctggaatgctcttgccctggattgccacttgattggctccttcttggtattctgctttgaggttgcatgccacctgcagactaacccatcttaagtagccnaacagcaactctctattggatcagctgacctgaattcttagcagagcactaaaagctatatgatatttttcacgctttctttgtttcttctcttcaccaggactgaaactcaataagagctttgatttctcttgttcattagtgttttttggcacctagaacacagtgtaggatgtttagcagcattcctgacctgtactcactagatgccagtagcatccccgctcccagttgtgacaatcaaaaatgtctccagacatagccaaatgtcccctgggggcaatgggtgttctaggtgccaatggtcacaatttttgttgaacgaatgaatgattataggtgttcttgtgatggactttgcatacaagaacacatagatattacgttttggggtgcatactgaagcagatccagtctttccccaaaccctgattgagacgtaatgcaggaagatgaaaaatccagagatgggataattgtatccatgcagagccacccaatggatgacttagaaggaagtgaagtgaacaggtggccgattgcaggaatactgcagggaatctggcatatattctattaattgagttcctagtatgtgtctgagatggggacacaaaaanagtttcatagttttatgaaacttaagtcttatcaaagataagaatgggaactatatttcaccaatttttgcatccccatctcagacacatagttctatgaaaagacagtgttaatctcttctttcactgctataaagaaacacctgagactgggtactttataaagaaaagaggtttaattggctcacagttccacaggctgtacgggaagcatgatgctgacatctacttgggttctggggagacctcaggatacttacaatcatggcagaaggtgaaggggaagcaggcacatcttacatggcaggagtaggaagaagagggggggggaagtgccacacacttttaaacaaccagatctcctgagaactcactcaccatcatgagaacagcaccaaagtgatggtgctaaaccattcatgaaggatccatccccctgatccaatcacctcccaccagcccccacctccaacactggggattacaatttgacatgagatttgggcggggacacaaccaaactatcagaccgttataaaaataggttaataaattatgacacagtgtagtaagtactgggacagtggtagaaccaggcactgtggaaacttacaatgaagtttcaactttaccagggagagctggagaaactcttatagaagaaggatcttttaagcaggattttgaaggatgaatagaagctctccaggtggtgaaaggcattacctgaagagaagacagcatgtgcaaaggtatgggggtcacaaaagggtcagggtacttgagaaatggtgaggagtttgaggtggctaaaatcctgagtaggtggaacaaaatggtggtgggagatgaggctggaaaggagaagagcttgaagttcctgtctgatcatcagatcctgtaagtctttgaccttgaagatggtatggatgagagtcgtatttatttgttgtggtaaaatacacaaacacaaagtttaccgtcttacccatttttaattgtgcagcttagtggtattaaatgcattcacattaaatgccacccatcttcataacttttttcatcttgtgaaatgcaactctgtacccattaaacaatagctccttggccgggcgcggtggctcgtgcttgtaatcccagcactttgggaggctgaggcgggcagatcacggggtcaggagatcgagaccatcctggctaacacggtgaaacactgtctctactgaaaatacaaaaaaattagccagctgcagtggcgggcgcctgtagtcccagctaatcgggaggctgaggcaggagaatggcgtgaatccggcaggtggagcttgcagtgagccgagatcatgccactgcactccagcctgggtgacagagcgagactccatctc

SEQ ID NO: 343543 - DNA, 615 bp, Homo sapiens
gtatttttccttagcttgttaatgaattactgtaaagggggtagaacaatcaagcttattcctaaggattttgttttgacaaataagtgggtggtagtgttgtttattgagataggaaaaactatgggaggaaattatttgaagtgggtggttggaaataaaagttttgtttaaatttgagatgatttattgacatttatgtggagcaatcagaaggtcaatggcatttaagagactcatggtgaggctagggcttcaagtatttatgttggcggcatcaatacgtgtagtgtgttaaattccagggagtggaagaggatacatagggagatggattgtgtggagaaaaaagaacagggcacaggccagcaaagggggctgagaaagagcccagggatgttggagaaaaatcaagagaacatgatgcgtgtacgtcaaggaaaatagatttttttcaaggagaagggagaggccaattgtggtgagtaccactaagcggagggggaagtgagaacgtgacagagaagcaagtgctgggtttggtggagttgatatttgcagtcagtggagtatccagggaggaaactggattggacaatttgaagagcgagtaga

SEQ ID NO: 343544 - DNA, 825 bp, Homo sapiens
ttttccttcagattctcatttacttctataattggtagcaggccaggtggaagtaggtcaaccttcttagtaggattttagggtcaagagaggatctccccagcaggaaaagcagggagtaaggacagaatgagaagagagatgtgggtggctaaaggctagaggcatttccagttacataccttgcaaaatgttctgaaaaaccattagcctatggcagtttttcttgtcaggccatttgcattgacccatagacattggttcagtgccttcctgccttgactgtttctttatctttctcttaaacacacatgcacaaatatgtacagcagcccagaaacataagcatcctcgaatggctttgggcagggatggggtgatgggaacacacagataagaaatcaggcccaagcactggtgccttgtgacatcagttggacagtcttgagttttcagtatggtctaaaaccttgtcttcagttctccagggtttataggccttttctgccttaatgccttgggcctggagttattgtgtgattttaattctgaactctaaaacacattgactgactgcctggtttgtcctcctttttgcttgaaccagggcaggatggatagctgttgtgcatttctcttaaccgggttatttctaggtgtcacggtcgagagtttaagttatatcccagctgggccgggcatggtggctcatgcctgtaatcccagcactttgggagtctgaggtgggtggatcacttgaggtcagtagtttgagacgagcctggtcaacatggtgaaaccccgtctctactaaaaatacaaaaa

SEQ ID NO: 343545 - DNA, 678 bp, Homo sapiens
cacaaacagagcaaccttacgaagatctgccacccacaaggcctctggctctggctgtttccaaaggtcccacccagcttggccttgtgatggttttgactatagctgagtataaaattaaaaaagaaaacacaccctgatttgattaatgggattaccgagtttgttgttcaacaaaatggaaaaaaaaaaattagcctctgaaacacaaggatagaaggttaagcttccacttacccaagataagtaatctgggctaaagaggtactgctatctgggtaagagactaaattttgcctaaggataaaagtttgtcactcattaagtttttccctatgtaatttacatcttctaaaacaaaaaaggtagcttgttatggcaacattttaatatagggcacgtggttaatcttttggtttacactttgcttttccttctgattgtactggaattccccgaagtcataccgggtatccctcagaagcacattcccagagttctccatgtcagcttgtgtgtcacactcacagctccaaaagggctaatgccagtcttaatgggacagggtcagttcttccaggaaatccttaaagtgtgatttgaggagcagctgaaggaactatgatctaaactaccttccccagtgatctcctaagacatttcatcacctacatttat

SEQ ID NO: 343546 - DNA, 197 bp, Homo sapiens
atgaggaggatgaagaggagattcaaggcagagggactcgaaaagccaggtgacagcaggttgtccactgtggtaagagaatgaaggcatctatgtccatgtgaggagagtgtgggatatagttggaacacagtaaattgagactctatattggagacccatatatggagctttaaatttgttttcttttcttttct

SEQ ID NO: 343547 - DNA, 255 bp, Homo sapiens
cacatgtctgagcaataaaagatttcagtacaaagacatgaaatcatacaaatagtggaagaaaacatgggagtgtttattttctcatcatggaatgggaaaatcaggctttaaatgagacacgaacccagaagccaataaggaaaatactgctgaatctaactgtgaaggtcaaatttatacatttctctaactgtataaaggtcaaatttgcttatacgggggggtgggggagtgcagacaggtgcagcgtag

SEQ ID NO: 343548 - DNA, 452 bp, Homo sapiens
gggccccagcccccctcccttcactaaagacaagccagctccttagatcccatgatgccagagctgtgatcttccagtacactggagaagctccttgtatcttcctatctcctagtaggctgatttcatccaccaacagccacagcaccttgaagcaacccaggagctgctgtttcccgtgatcatgtggtcaaccctggtccttcaaacttctttcagaactcacacacacaccacgtccccttatgagttttgagcagaatgctttttctttgaaagtctgtattcaacaccccctttttatttatacaaacttggagggtatgtgagaaattttatggcatgtatataatgcgcagtgatgaagtcagggcattcagggtgcccatcactcaaatacaatacattttggttttggggtttgtttgttttttttttttttttttttgaga

SEQ ID NO: 343549 - DNA, 721 bp, Homo sapiens
ggctctgacagttgatgcctttggccagagtttgcaagactggaagtctatgtgctaaatgaatttggccccacatacagtttatttgttcaggtcaagtttcaaaagtcagcatagacaggtgggcattatgattgttcctcgtgcaagtgtagtttctgtatcatggaagctaaagatctgttttcattggcacttcatgtatttatgatacctggttggtccctgtgggtatttgtgcttgtgacatttgctggtatatggtcacagtgtaatgatgtatgtgtaagttcagaagcagcatagaggaggtggtgattaatctgggtggggaataggacccataaaaggcttcattgaaaggctgtgactggaaagatgagtagatatttgccaggcatagaatttggacaagggagggtattccaggaaaagccaagtgcatatgcaaagacagctgtgtggattagcattatatgttaggggatttctgagtagatccaaagtgctggggcttaataagcaaggtgaattatagcctaagccagaagtacctgaaggactcagtttgccgtgcatgaggaggctggccttggggcaatggggaaccatgggaaggtttgaaacagatcattgccatactagatttctgttttaggaaggttattctccaaacacccaggagaaatagttgcacgcagaacgcgcctagaatagcttt

SEQ ID NO: 343550 - DNA, 99 bp, Homo sapiens
agaggtgtgcatcaatttttagaagtcttcactacaccaaaaagaaacccccaaccccgcagtcatttctccctatttttcccccagcctattaataga

SEQ ID NO: 343551 - DNA, 388 bp, Homo sapiens
caagcgtgaggcaccgtgtctggccaagagtcaatatgttaagatgagaagttagtaatagataaaaattgaacttcccagaaaatataaagtaacagatcaatagcagggccaagttagagtcaataagttgagcttcgtatgtttcttacgtttccaacaaccatggcagaaaggaagacactggatacagacagactgactcctctgaaggcacaaagacttcctggcagataccttttttggtcataacatagggacccatagtgaataagcttccagtgataaccctgaaatgagtgcagcctattgagtcaaactgcttttttaatttttatttcacacaggttccagttttcttttggatgtagtgttgatcagtaaatta

SEQ ID NO: 343552 - DNA, 405 bp, Homo sapiens
atttattaatttctttaaaaaactgctgtggcatcttattttggttgaaacgtttttattttgattgagggagaggtattgtggacataacactgtaattagaattaaacaaattggtttcatattctgccaagttctctaactagctctatgaccttgaacaagggatttatgctttcttcaattttctgatccggaaaaatgaggataatatcagctacctcaccaggatgttgtgagatataaatgggaaaaaacatctaaagagtacttagcaactataagaaattacaggaatgtaagatattattttgatagaaacaataataaatactttgctgtatagtgtaaggttgaagaatgtatgttatagtataaggcaaactatgtctatagaaagttgat

SEQ ID NO: 343553 - DNA, 714 bp, Homo sapiens
cataaacacattttatattttggcaaataaatctatttcttttaaagcattgcccatctcagctaatgatgataatatcaagccagtcgccaagaaaatttagagtatttataccttgactcttccttctaaatgaattattaagttcagctgtttctaccttgaattacctttctattctgccatttctcttctgtgttgctgctaatgttttaatttagttattcatcacatcatgcctgtactgctggaataatcttgactattctttctgactttttcttctaactgcatctcaaaaacttctatctagaatgaaaataagtatatatatatatactatatatacatatatacatatacactatatgtatgtatatagtataagtatagacatgctatatactatatatactatatatttatatacacacacacccactatgcttttaaaaattgtttacttatgtcccatcattgaagggtaaaatacaaaatcactgatattgagagacattctcctcaatcatttaacattttccttcacaaacctgtgctgtagccacacccagaacaggttatgttccttcaaagacacacacacttttctatcactctccttttactccttctattccatctgcttagaccattttttacttgttttctgtctatctccattcatttttcaggatccaattaaaatattgatac

SEQ ID NO: 343554 - DNA, 1177 bp, Homo sapiens
  misc_feature (635)..(635): n is a, c, g, or t
agcgggggtgtgctgggggactgtgcagctcgaggctccagaggcacactccagagagagccaaggttctgacgcgatgaggaagcacctgagctggtggtggctggccactgtctgcatgctgctcttcagccacctctctgcggtccagacgaggggcatcaagcacagaatcaagtggaaccggaaggccctgcccagcactgcccagatcactgaggcccaggtggctgagaaccgcccgggagccttcatcaagcaaggccgcaagctcgacattgacttcggagccgagggcaacaggtactacgaggccaactactggcagttccccgatggcatccactacaacggctgctctgaggctaatgtgaccaaggaggcatttgtcaccggctgcatcaatgccacccaggcggcgaaccagggggagttccagaagccagacaacaagctccaccagcaggtgctctggcggctggtccaggagctctgctccctcaagcattgcgagttttggttggagaggggcgcaggacttcgggtcaccatgcaccagccagtgctcctctgccttctggctttgatctggctcatggtgaaataagcttgccaggaggctggcagtacagagngcagcagcgagcaaatcctggcaagtgacccagctcttctcccccaaacccacgcgtgttctgaaggtgcccaggagcggcgatgcactcgcactgcaaatgccgctcccacgtatgcgccctggtatgtgcctgcgttctgatagatgggggactgtggcttctccgtcactccattctcagcccctagcagagcgtctggcacactagattagtagtaaatgcttgatgagaagaacacatcaggcactgcgccacctgcttcacagtacttcccaacaactcttagaggtaggtgtattcccgttttacagataaggaaactgaggcccagagagctgaagtactgcacccagcatcaccagctagaaagtggcagagccaggattcaaccctggcttgtctaaccccaggttttctgctctgtccaattccagagctgtctggtgatcactttatgtctcacagggacccacatccaaacatgtatctctaatgaaattgtgaaagctccatgtttagaaataaatgaaaacacctga

SEQ ID NO: 343555 - DNA, 1395 bp, Homo sapiens
  misc_feature (635)..(635): n is a, c, g, or t
  misc_feature (1189)..(1189): n is a, c, g, or t
agcgggggtgtgctgggggactgtgcagctcgaggctccagaggcacactccagagagagccaaggttctgacgcgatgaggaagcacctgagctggtggtggctggccactgtctgcatgctgctcttcagccacctctctgcggtccagacgaggggcatcaagcacagaatcaagtggaaccggaaggccctgcccagcactgcccagatcactgaggcccaggtggctgagaaccgcccgggagccttcatcaagcaaggccgcaagctcgacattgacttcggagccgagggcaacaggtactacgaggccaactactggcagttccccgatggcatccactacaacggctgctctgaggctaatgtgaccaaggaggcatttgtcaccggctgcatcaatgccacccaggcggcgaaccagggggagttccagaagccagacaacaagctccaccagcaggtgctctggcggctggtccaggagctctgctccctcaagcattgcgagttttggttggagaggggcgcaggacttcgggtcaccatgcaccagccagtgctcctctgccttctggctttgatctggctcatggtgaaataagcttgccaggaggctggcagtacagagngcagcagcgagcaaatcctggcaagtgacccagctcttctcccccaaacccacgcgtgttctgaaggtgcccaggagcggcgatgcactcgcactgcaaatgccgctcccacgtatgcgccctggtatgtgcctgcgttctgatagatgggggactgtggcttctccgtcactccattctcagcccctagcagagcgtctggcacactagattagtagtaaatgcttgatgagaagaacacatcaggcactgcgccacctgcttcacagtacttcccaacaactcttagaggtaggtgtattcccgttttacagataaggaaactgaggcccagagagctgaagtactgcacccagcatcaccagctagaaagtggcagagccaggattcaaccctggcttgtctaaccccaggttttctgctctgtccaattccagagctgtctggtgatcactttatgtctcacagggacccacatccaaacatgtatctctaatgaaattgtgaaagctccatgtttagaaataaatgaaaacacctgagctggtggctgngtactttgactggtacatggaggctattttaatccttctaactaaactaaaatagattaaaggaattaaactaaaatacaagtaaagctagacaaaggcccagaaatcatactgtaaggaaatgttattggaagctgattcccagagcagaccacatatacagcaggatgtgcctgtggcatgaagattttctttctctttttttt

SEQ ID NO: 343556 - DNA, 187 bp, Homo sapiens
tgctgggattacaggtgtaagcctctccacccagccagcaaaatagaaatatatttaaacacatcaataaacccctacaaatattctagagttcttctcttaatgccagttccttctcactaaggaatttgtgaattttctaggtggatataactacagaaaatgcttgtttctatcttctccttta

SEQ ID NO: 343557 - DNA, 430 bp, Homo sapiens
tgtcgcacaccctgtgagggggataagggaacttttcccatttcactattaagaggaaagaaagcaccatgcctgttctaaataagcaaaatagaaaaaaaaatattgattaagtaaaattcttactatttaaagaagcccaatgtaaaactagtgaccactcttttgatgaaattctttttttaaaccaatattgcagggctttataataatgatttataataattattgtttccattacttgggatcatcttaataccacgataaaaaaaaattctcagattttctttatttccaatggtttcttaccatagaggtcttcagtaattatattatataaacaagtacccctccctcatccagtccacagatataacttcatcaccacatctttcttcacactctctttaccctttattttcctcctagt

SEQ ID NO: 343558 - DNA, 473 bp, Homo sapiens
gcaggttatgaataataatctatatctgaggtcagccagaggttatatctaataaaccatagctgagacgtggaagcaaggcaatttgagaactaacttccttggctattctatttcagggcctttaatttctacaagggaggaaaattgagatcatgataactatgcccataaattaaaaccagttcccttttcctcaaagaaatttttctcaaaagcctataaggcattcctaatctcattttcatttggtggtgtccaggaaataattatgatcaatggggaaacctttgcagtaggaaaaagctgcttgttgtgatattgatattttggttgttagtaatgggggaataaatggtaagggtctggatagagtaatggttgtttgaaataatatttaaactacataatgctcatctggcttcaaacactatatattgagaggctataacttttattttattatttattta

SEQ ID NO: 343559 - DNA, 284 bp, Homo sapiens
agagagagagagagagagacagagagagcaaaagtgcaggggaaactgccgcttttaaaccgtcagatctcatgagaactccctcactatcacaagaacagcatagggaaaactgcccacatgatccagtcacctcccaccaagtccctttcttgacacatgggggattacaatttgagataagatttaggtggggacacagagccaaaccatatcagagggaaacctcgaacagatcctggcagtctaccttagtggagggattagaaattagagttcatgga

SEQ ID NO: 343560 - DNA, 827 bp, Homo sapiens
ggtaattgaagcccctataagttcactttgagttaattaaaaaaggagattattctgaggagtctttacctaatcagatgaacccttgaaagaggatctagaagtgagagagatttcaagcaacagaaatgctgtcttgatggctttgaaggaacaaacaaccatgtgaactacttatggaggagacaatacagcaggaacctaagggtgacctctagtaactgggagtaattcccaactgacagtcagcaagaaaaatagggtcttctgtcctacaatcacacagaactaattctaccaagaagcaatgagcttggaggaggacccaagcttcagatgaaattgtacctgtgagtaacatttcagcttagtaagaccctgaggagagttgccagctaacctgtacttggacatctaacacatggaaactgtgagataataattttgtattgttttaagccactacattttggtaattcattatccagcaacagaaaatgaatgcacaggtctgtcatgcttcatattctatcatactaaagtctattgatacatgtattttttctctctgagagttggatatggccttggggttgagggatggtgtgtgtgtttatgattggttggttgttttatttagcatatattctatttccttacgtaaaacaataagattgctttacttttacaggcatttctaaattatgatcatagtttaaagaatattattaattaaatctttatcattaccaattttggtgagacaaattcatttggtaatgaaataatattaataatagcagcaacaatatcagtaactcctaaca

SEQ ID NO: 343561 - DNA, 451 bp, Homo sapiens
cctccgtaactgaaacttattttgcattaaagtaaattcatatgtaaactttttacattaccaatctttgtggataaaataacaaaaatactaccttctatttatatgatgtattatacttatcaaaatacatttataaacattatttactttgatcctttaacccaggagttggttaggagagatattatctgtgtttgaaagatggaagatattgacattctgcaaggtgaagtatgtgcccaaagtctcacaacagtaaatgcagaatttggacttgaacccaggttactgacttggagctagaaaattattttcattaaagcatatttcccttgaaatgataatggaaattttaaccagaaaatacatgataccccactatagcaaagatgaaatgtagtgttttacattttttcttatttttttttctgaataaaaagtggcactc

SEQ ID NO: 343562 - DNA, 354 bp, Homo sapiens
gtcaaccaggaagtgaaggattggaagagacaaatatgcccagtcatcagtagatgaaagtgaaacacagagaggttgtgctttgcccaagaagcacacagcacagcagggagggagagtgcctggacctgaatccagcttcaacacatttcagggtccacgaagccagcctccaggagaccccacgtgcacagtgcttggtctggtcccacccccaagccctttgtcatcacccagaaaactccctcctccctgtatctggtactaagagagttgggaggggcctccaaagtccccagcatggcctacccccttccttacattaatattacagttgaggtaaccgagtcaaga

SEQ ID NO: 343563 - DNA, 234 bp, Homo sapiens
agagattttaacataccagtagaattcagcagcatgtactggtaggcttctgctgaacaagccgaagtgtgggcagtaaaaatgttggtgtcaggttaaaattcctgagagaactgtttctaatggaatctgtcctggacacttactagtagtaagctttgagacagaatgaaattggagtagaataaaatcccacctccattcacctaaatgttaattgtttccttggcaaag

SEQ ID NO: 343564 - DNA, 295 bp, Homo sapiens
ctgttagtggtactccaaaaacggcatcaccagtattagaggttagacagcagtttaaaacatttcttcctgtctcatttggttcctgcaaaaatctcaatagtaatttttgagttttacctaaggatgtgcagagaaagacatcagtagaaagaggaaacaagaagtatcaaagtaggataactcatctcccattccaagcacttttctttttctttttcttctcttctttttttttttttttttttttttttttgagacattgtctcactttgtcaccctggctggagtgcag

SEQ ID NO: 343565 - DNA, 721 bp, Homo sapiens
tgggaatgtgaatacagcaaaatgaaccatattgatttactaatcataagttgaaccccaggcgtcattttaagaaaactttatggacaactttaaatatctacagaagcaaagagtgaaatgagcccatccatccctcctatggattattctgaagcaaatcccaaatcatatcattttaccaagactaagaaaaaaagagtccctcttatgtgactggtattctctgaggggtttcaaacctactgcctgatgcgaatccttaactgggattctcctcactttacatgtgaggaaggagcacagcgtgcccagggtcacgcctagtcacacagggagccgagaaacaaatccaggcaacccggcttttttttttttttcccccattacacctacagtactgtgaatccaactgtttttaagaaggaaacaaaaagtattaaccggtttaagttgaaacacaacgaatgtatttactaaaactatttaatcaaaaccagaaatctcaaatattctatagactgtttaaatataaaccaaactaaactatttaagttccaggatattagtgactttttacctgagatacttgctcagattatctatctgttgtgaactccattttaaaagcacctcactataccatgcttgaagtcaggtagtctgtagacttcatcacagcccctttatatataattacttctctcacggaggagtatgg

SEQ ID NO: 343566 - DNA, 564 bp, Homo sapiens
tctccaggcggccgctctggtgtggggagggagcgtcatctcaaggacactgaaaaagctgtttgccgttttgctgtttgcctccttgtcacgacctcagcgacggcagatggagccagtggagggagagagacagacggcaatgcttgggtagccagggctccctgccggccccactcctcctgcagacacgagcacgcacacacacacgcgcgcaaaacacacacgctgcccttcgccacacgtagccaagtaaaatacacaaaaagcaactgagataccattcgcacatgaccacatggaaacacacaaatgaacaaacgcattcaggcatagccacatgccagtcacacagatggatagacaagagcctggggtacaaagccacatggcacaaagccacctggatgtatatgcccctacacacgcacacagaaaaaaacatgcaaacttaagtacacacctatccagacaagtgtgagtgcacacacacacacactcacacactctacctgacacgttagtgcatccccattgggccccagtttctctcagcaaattcag

SEQ ID NO: 343567 - DNA, 554 bp, Homo sapiens
tctaagctgttactgtcattttgatttgtctgtccctccaaactgaaccactaaaagcttggcaggattcagttgaagatgaacaggagttaaattttttcactgatattgtttcttttccacttagtgtttcctctactaggagctaactatgtccaaaaacagaattttgattggtgagggtgaaaaatgaagtttagaacaataaaataaatacctgttccaaatgtaacctgcaggtatttcacagtattgcttattaatggaagttattttttgtggtctttgtagaatcagttatgaaattaccaacttggatattttaatgacttcttcttgtaattgtttttgcaattttatattttcaggaagttctatgccaggtctcaagcagtttattaaaatttgcccaagagtaaattctaccacaagtaaatctctttggaaacactaccattatgttgttattttattgtcacaagtctcagtagttgtgaaagagcaaccttggaaattaaggaattgaagcaaagcagatttcctgacagaataaa

SEQ ID NO: 343568 - DNA, 418 bp, Homo sapiens
ctttaggaaaatgatactggagaagtacaaagctatcaaatttacaaatcttagcagcagagaccacgaaaatatctgctttattctagtttggaatttaacacaaggatgaataacatgcacgattttagttcagcgattaaagtgcatactcagttaagggggggtggagcaatagagagagagccttctctttgatctcataggttgcattaaaaactcactactcgtaatgaatttttgatcatcccctgggtacacataacttggtccttgctctttcaaaatgagtggactcaaactgacttacaatgtgactgtgtctacggtgcacttacaaccatctttcagtaaaggtcttcagatttaggctctaggtagaataaggcaggaaaaaaaggacaccaaaattatcagc

SEQ ID NO: 343569 - DNA, 274 bp, Homo sapiens
cctcggttatgtaatccagcccttggctagcagcctgggatcaggacccaggggagagaaaagcaggaagtggcctccccctgatatagaagcatcttggtgaagggagctgagcaggcgccaccccactccctgagagcagctcctcaagaacagccaagggtgcctgggcttcgaccagacaaacacagagctgcacacctactgcaccctcgtgtttacttctcgtaaaagcccactgtgaaattcttaccatctccattttacagaggat

SEQ ID NO: 343570 - DNA, 637 bp, Homo sapiens
ctcagcttccagattacaggtgtgcgccactacgcccagctaattttgtatttttagtagagacagggcttctccatgttggtcaggctgatctcaaactcctgacctcaggtgatccgcccgcctgagactcccaaagtgctgggattacaggcatgggtcaccgcgcccagcccactctcaccctttcttgccctcccaccttccaccatggggtgatacagcatgcaggcccttgtcagatgctggcaccatgctcttggacttcccagactccagaactgtgagccaaataaatttctgttcattgtaaattacccagtctgtgacattgtgttaaagcaacacaaaatgaactaagacaacgtatttgtgaaaagtattctccataagggcaaggaccatatttgttttgtttaccaatctaccgtctgggcttaataggcacaggcacataaggtctctctgagatgcaagcaatgcatatgtttctcttcataacataaagaatattacctaaattcttacatttaattacatgaaagaactgagagaagtcttaaatatctagttgcatcggctaatataaaaaccaaaatggtcattattcaaaatcacagaaaggttttcctatgca

SEQ ID NO: 343571 - DNA, 321 bp, Homo sapiens
aaataaaagcaaaaaaaataaaggggatacttgcaaggtttttgagaggatgagagactctgggacctgcagctaaaatggagggttggcttttgataaaaacagagacacttcatccacagtaacaggagagaagtcagaaaaaatcatgaatgaataggtaatttattcaccagacatttaatgagcgcctgttactatactacttactggggattcaccactaaacaagatcaagtctctaccgtcgtgaaataagtggaagggtcttacccttatttctgttttctcaatgaatctgaattaaagtcatcccctaag

SEQ ID NO: 343572 - DNA, 468 bp, Homo sapiens
ctcatgcactttgtttgggcccaggcattcaagcccactgcagagatcctgctgcacccaggctctactctgagtttggcaataaccttaaaccaaaatcaacaaatctgacaagatgccaggccaacctagccaccctattagctgcttgttcctcctgggatttgcagagagcacctgcagcctaaacaaggacaaaagttgaagcatggatctttctgtgcagcagctgtgatttctgcaccttctagctccctcgccgagcaccactccctcatatcttgctggcagagcaaggcagcatcgtgagcagagcaagtcctaagaagtacatgggttcaaatctggtctctgtcactgaccaacagactctttacctttctgagccttagtttcttcaactcctgcttcatttcacattttaaaaagtagaataaagacaaactccatgtttttatctctggcaaa

SEQ ID NO: 343573 - DNA, 419 bp, Homo sapiens
agtctcgctctgtcacccaggctggagtccagtggcacaatttcagcttactacaacctctgcctttccccgggttcaagcgattttcatgcctcggcctcccaagtagctgggattacagagagcacctgcagcctaaacaaggacaaaagttgaagcatggatctttctgtgcagcagctgtgatttctgcaccttctagctccctcgccgagcaccactccctcatatcttgctggcagagcaaggcagcatcgtgagcagagcaagtcctaagaagtacatgggttcaaatctggtctctgtcactgaccaacagactctttacctttctgagccttagtttcttcaactcctgcttcatttcacattttaaaaagtagaataaagacaaactccatgtttttatctctggcaaa

SEQ ID NO: 343574 - DNA, 2617 bp, Homo sapiens
agcggctgccgtcgtggaagcaggatttccgcggttgtgtaacggcctgtcgcaggcgtgcagggacctggactccgcctcgtccccggggctcgggcagccgagccatggcggggaactgtggggcccgcggcgcgctgtcggcgcacacgctgctgttcgacctgccgcccgcgctgctcggagagctctgcgctgttctggacagctgcgacggcgcgctgggctggcgcggcctggagagactttcaagcagctggctggatgttcgtcatattgaaaagtatgtagaccaaggtaaaagtggaacaagagaattactttggtcctgggcacagaaaaacaagaccatcggtgaccttttacaggtcctccaggagatgggacatcgtcgagctattcatttaattacaaactatggagcagtgttgagtccttcagagaagagttatcaggaaggtggatttccaaatatattattcaaggaaacagccaatgtcaccgtggataatgttcttattcctgaacataatgaaaaaggagtactgcttaaatcttccatcagctttcaaaatatcatagaaggaactagaaatttccacaaagacttcctaattggagaaggagagatttttgaggtatacagagtggagattcaaaacctaacatatgctgtcaaattatttaaacaggagaaaaaaatgcagtgtaagaagcattggaagaggtttttatctgagcttgaagttttactactgtttcatcacccaaacatactagagttggctgcatattttacagagactgagaagttctgtctgatttatccatacatgagaaatggaacactttttgacagattgcagtgtgtaggtgacacggccccactcccttggcacattcgaatcggtatattaataggaatatccaaagccattcactacctgcacaacgttcaaccatgctcggtcatctgtggcagtatatcaagtgcaaacatccttttggatgatcagtttcaacccaaactaactgattttgccatggcacacttccggtcccacctagaacatcagagttgtaccataaatatgaccagcagcagcagtaaacatctgtggtacatgccagaagagtacatcagacaggggaaactttccattaaaacagatgtctacagctttggaattgtaataatggaagttctaacaggatgtagagtagtgttagatgatccaaaacatatccagctgcgggatctccttagagaattgatggagaagagaggcctggattcatgtctctcatttctagataagaaagtgcctccctgccctcggaatttctctgccaagctcttctgtttggcaggccggtgtgctgcaacgcgggcaaagttaagaccatcaatggatgaagttttaaatactcttgaaagtactcaagccagcttgtattttgctgaagatcctcccacatcactaaagtccttcaggtgtccttctcctctattcctggagaatgtaccaagtattccagtggaagatgatgaaagccagaataacaatttactaccttctgatgaaggcctgaggatagacagaatgactcagaaaactccttttgaatgcagccagtctgaggttatgtttctgagcttggacaaaaagccagagagcaagagaaatgaggaagcttgcaacatgcccagttcttcttgtgaagaaagttggttcccaaagtatatagttccatcccaggacttaaggccctataaggtaaatatagatccttcttcagaagctccagggcattcttgcaggagcaggccagtggagagcagctgttcctccaaattttcctgggatgaatatgaacagtacaaaaaagaataaattctaccagaagataaagaaaaaagcaagtattgcataggcacctgagcataggtatgaccttgggaagacattggctccataagcaatgccaagagaatgatcaatagtgagtttgggtgatgcagataaacaatctggataattccatttcttttttcccaaaccctcaaacagagtgccttaaaaaattgttttatcaggataattgtctcatgaccaaatccacgctcaattagagccattcaaaattccttaagatcatgggttctgacttcagccaaacaaaacaatcaaaacctaccaaaaagggactggattgtaatgtcctctccatcatcctcagtgtgagtcctcagagcctccatctgccaagaacattcagttggattccatcgtttggtttagcttgcttgcacgggttgtaggaaatgtctaatttgtaaatgttaatagatacctttggaaagaaaaaacacaaaacaaaaaaaaaaaaaaattttggggcggtgggcctcggaaaaagtttctaaacattcgtgggggcggggccagggttattggacctgggcaaacgtggtgccaggaaatcgggctggacatgcgtctgttctcaccataaaaacgcggggaacggggttctgacaatcagaggcttccggcataggttctacaacggccaggacgttacccccccgcggcgggagaacaacaggaaacac

SEQ ID NO: 343575 - DNA, 479 bp, Homo sapiens
aagatcatgggttctgacttcagccaaacaaaacaatcaaaacctaccaaaaagggactggattgtaatgtcctctccatcatcctcagtgtgagtcctcagagcctccatctgccaagaacattcagttggattccatcgtttggtttagcttgcttgcacgggttgtaggaaatgtctaatttgtaaatgttaatagatacctttggaaagaatcaccttgttattctgattgacccctcttgttttttggttaatccctgactagcctgcttgtctgaaaatgagccaggttcacccttagctacggcatgctctgggttgaaaggggatttcttcccaagatctatcctaaactcttaggacagtttatcctgtattgactattattacagctttttaaaaacagacttagtgacctattatatcttaaggagactatgtgaaatgtccatcaagtaatttttattcctgagaaa

SEQ ID NO: 343576 - DNA, 1084 bp, Homo sapiens
agcggctgccgtcgtggaagcaggatttccgcggttgtgtaacggcctgtcgcaggcgtgcagggacctggactccgcctcgtccccggggctcgggcagccgagccatggcggggaactgtggggcccgcggcgcgctgtcggcgcacacgctgctgttcgacctgccgcccgcgctgctcggagagctctgcgctgttctggacagctgcgacggcgcgctgggctggcgcggcctggtgtctaaaaacaagctttgtgagaatggagtcttaattttgcaggggttttggcatgtggttgtatgcaaatacaaagattccaaatacggatgtgttgcattatttgaaaaaaccccttcagagacatatttgcatatggagacgtgatttctgcaactgaaaacagtcagtcctgcactctcaaaacagccttcaaggacttttgagcatctgatttctgaacttcttaggttgactttttggcttatgtgactccaatacgactttcaacaaagatttgtgttccaaaaaatggttttaaacaatgcttaactaacagcatgtttttcttaatttgtattttcagtttagaatgcttttaactttatcaacataattagtcattgagaacttttctctgtatttttatttgatatgtactgcgagtaaacaaagtcctatattctgaaaggggacacgtaagggagagttgaagaaaatgataaatattgaagaatgtaattaacatgttgagagtttgcattcctgttgtatcagattggagctattttatagaattggatctaaatgaagtatacattttatggatgctaaaaatactctttagcaatgtttctattcagaatgcatcatcattagagaaaagctattaaggttgcagtgtgaatcaccagttggaaaaagagaaaacatatttcatttccagtccggaagcaatccatgcatgcaggcagtattcattttaacagtctggatcagttttttaccatgaacttctgctattagaaaaaatgcctttgtctaatctagctttccttagatgtgatgcaaactcagaacta

SEQ ID NO: 343577 - DNA, 709 bp, Homo sapiens
agcggctgccgtcgtggaagcaggatttccgcggttgtgtaacggcctgtcgcaggcgtgcagggacctggactccgcctcgtccccggggctcgggcagccgagccatggcggggaactgtggggcccgcggcgcgctgtcggcgcacacgctgctgttcgacctgccgcccgcgctgctcggagagctctgcgctgttctggacagctgcgacggcgcgctgggctggcgcggcctggagagactttcaagcagctggctggatgttcgtcatattgaaaagtatgtagaccaaggtaaaagtggaacaagagaattactttggtcctgggcacagaaaaacaagaccatcggtgaccttttacaggtcctccaggagatgggacatcgtcgagctattcatttaattacaaactatggagcagtgttgagtccttcagagaagagttatcaggaaggtggatttccaaatatattattcaaggaaacagccaatgtcaccgtggataatgttcttattcctgaacataatgaaaaaggagtactgcttaaatcttccatcagctttcaaaatatcatagaaggaactagaaatttccacaaagacttcctaattggagaaggagagatttttgaggtatacagagtggagattcaaaacctaacatatgctgtcaaattatttaaacaggtatggaaagaattact

SEQ ID NO: 343578 - DNA, 341 bp, Homo sapiens
caacattccagagatactcaggggggtaaggggccagcaaccgcgacctttctctcgtctcagaaaaattataagcagatgtgggcgcctcggggaggcgtagagcagggagccagagcaagttttgggaacacggaatgcagaccctgaagccggctgcggggatgggcactgcggtaactcatcctctcctgagctcaggagctgaggcagcagagccgtctgaagtgctgggagccaggggtggtggggatggagaggaccccatttccgaatggctgacagggcagtctgagggaggcgggagcttttccttaaatgcaaggccaggttggtgacct

SEQ ID NO: 343579 - DNA, 372 bp, Homo sapiens
agaaacgatacaggtacattgtggcaaaaatagaagatacaaaacaagcaaatatgagaaaaaatatacatgccaccacctatatatgacttttagtactttataatcttttgtctatatatgtctatatggatatatacgtattctttttatccaaatggtattacattgtacattctgttttgaaacctgccttttttagtcatttacatctacttttccatctcagtaacttttcatcttgtgtaatgcccggatcacattaaaatgtttccaattagctcaaaaatgtcctttatggctggtttggctaaaacagtatccaggccagcattgcacctatgaaattggctgttaggaatcttgtatctt

SEQ ID NO: 343580 - DNA, 1405 bp, Homo sapiens
gaggaaacactggatttgaactacactttagaccaaatggccctaccagatatttatagaatattccatacaacagtaacagaatatacattattctcagtgcatatggaacattctccaggatagagcatgttaggccacaaaacaagtcttaacaaatttaagaacactgaaatcatacgaagtatcttatgtgaccacactaacatgaaactagaaatcagtaatcaatgaaaccaaagtttttttttaaagataaacaaatagacaaacctttagctagattaacaaagaaaaagagaagatgccaacaaaatcagaattaaagaggagacattacaactgacatcgaagaaaaagagactactaatcacgactatgttccaataaattggataacctagaagaaatgaagatattactagaaacatgcagcctacaaaagctggagtaaggaagtcatgaaaatctgaataggccaataataattaaggaaactgattcaataaaaagtatcttatcaaagaaagacgaggcactgggcgcagtggctcatgcctgtaatctcagcactttgggaagctaaggcaggtggatcacctgaggtcaggtcaggagttcaagaccagcctggacaacatggtgaaaccctgtctctattaaaaatacaaaaattagctgggtgtggtggcatgggcctataatcccagctactcaacaggctgaggcaggagaatcacttgaacccaggagatggaggttgcaatgagccgagatcgcgccactgcactccagcctgggcaacagagcaagagttggtctcaaaaaaaaaaaaaaagacagacagaccaggacctcatggcttcaccgctgagttctaccaaacatataaagaacagcaaccaatccttaaacttttcaaaaaaattgaagagaaggtaatacttccaaactcattttagaaagccagtatttaccctgatttcgaaggcagaaaaagacactacaaaaaaataaacaaaggaaactacaggccaacagccctgatgaaaaaaaatgcaaaaatccttaataaaatattagtgaaccaaatccaagagcatagtaaaaagatcactcaccatgatcaagtgagatttatcccagagatgcaagagtagtttgatgtacataaatcaataaaaataatacacattaagcaaattaaagacaaaagccacatgattattttgatagatgcagaaaaaacatatgacaaaattcaacatcctttcatgataaaaactacccctgaaaaataaggtatggaaaaaatgtaccccagcataataaaggtcatatacccacagctaacatcatactcagtggtgaaaactgaaaagcttttcctctaagattagaaaca

SEQ ID NO: 343581 - DNA, 408 bp, Homo sapiens
tgtatttccgcattgtcaccatggatagcaacttcgttccagtgaatgacaagtttctctattggacaggatccaaatagcaacaggattgcacagtggctggaagtggtacctgagcaaggcattgtagacctgtccttccaactggcaccagaggcaatgctgggcacctacactgtggcagtggctgagggcaagacctttggtactttcagtgtggaggaatatgtgctgccgaagtttaaggtggaagtggtggaacccaaggagttatcaacggtgcaggaatctttcttagtaaaaatttgttgtaggtacacctatggaaagcccatgctaggggcagtgcaggtatctgtgtgtcagaaggcaaatacttactggtatcgagaggtggaacgggaacag

SEQ ID NO: 343582 - DNA, 2286 bp, Homo sapiens
  misc_feature (1)..(1): n is a, c, g, or t
  misc_feature (4)..(4): n is a, c, g, or t
  misc_feature (6)..(6): n is a, c, g, or t
  misc_feature (8)..(8): n is a, c, g, or t
ngcncnangccggtccgggtgccacctctccctgcttgggcgccgccgcgcgagcgcttcccttccccctgcaagcgcccggataatgtctgagaatgtccatttctgggacgcttagcagctattatgtcgactcgatcataagtcacgagagtgaggacgcgcctccagccaagtttccttctggccagtacgcgagctcgcggcagccgggccacgcggagcacctggagttcccctcgtgcagcttccagcccaaagcgccggtgttcggcgcctcctgggcgccgctgagcccgcacgcgtccgggagcctgccgtccgtctaccacccttacatccagccccagggcgtcccgccggccgagagcaggtacctccgcacctggctggagccggcgccgcgcggcgaagcggccccggggcagggccaggcggcggtgaaggcggagccgctgctgggcgcgcctggggagctgctcaaacagggcacgcccgagtacagtttggaaacttcggcgggcagggaggccgtgctgtctaatcaaagacccggctacggggacaataaaatttgcgaaggaagcgaggacaaagagaggccggatcaaaccaacccctccgccaactggctgcacgctcgctcttcccggaaaaagcgctgtccctacaccaaataccagacgctggagctagagaaggagtttctgttcaatatgtacctcaccagggaccgtaggcacgaagtggccagactcctcaatctgagtgagagacaagtcaaaatctggtttcagaaccggcggatgaaaatgaagaaaatgaataaggagcagggcaaagagtaaagattaaagattacccccagtcctccctagctcttccccatctcactcttagttatgtgacgactgcaaagccagtgctgtctgggatgtattcaagtgaatggggaagggagtctctcttccaagtcctttatctgcacctagaacctccctcctttcctttgcccttacctgtctctctcttctctctaggtgtcagccctcagactgtcaggcaagcccgggttctacccctaatgcaaatacccaccagggagatgtctagaggcagactcctgagtgaggagttgcagcccaaaggctgcagcattgccataccattcccatggagttgccaactattctcaggccaagggccatggggaagatggagcaaacctagcccccaagccggtgggctagaaagtacaagaaaaggcagcacgtggttttatgaaggtatcttaggtggagctactccccacctcccaccaacatatacattttgttgcaggaaatgtttaattccgcatgatgtttccctctccttccaacaaaagaaggtcaaactgtgggtcgtagagccttgacaatgttgtcctcctgttcatctgtgcaccacttgacagactgtagcttctcttgctctcgaccggccctgcattcttccgcaccctccctagctctgaaatcaactctcttcggtcgtatccaccttgcacccgcaagtcaagccgccccttgtagaaaaatccctccaccttccgttccccgctaggtcaaccccactgtagacaggaaagccaggccaggagagtccgaatgagaatttattgtgaatcgattcccaagctcccttccgggacaagtggtctgggacagggaggagcaacggccccagcgcgcaacgctctgcgcgttcctccgaatcccgtcggcttctcgacccacgcagagaagccccgggcttggcggctctagccccagcgccaaaggagacccgccccagggccgggcttggcctcctgcttcatgggcctggatgcagatctgcgtggctggtgcgtgcgcgcgcttctgggaaacagtcccgcgtgcaaaggaaaggggcaaaatggcacctaagcatcagatggaagcttactctctgcttccgttcctccccctgctcccctacttctcagtccccttcaatttgtagactcttgctcctgcttctcctgatcctgcaaggggacattccagtagaagttttttgctttgtcggtggctgtcgtgaaattgtgcttgtgtttcgtgatttctttgggggtgattgtctcgcttgttttcagttgtcgattatatgggagggttctgggtgggagtggggagggcgaggggcctagagctctaattgtttgttttggaagaaaaaaagaaaaagaacaaaaaatatatatcactctagaaaataaat

SEQ ID NO: 343583 - DNA, 2357 bp, Homo sapiens
  misc_feature (1)..(1): n is a, c, g, or t
  misc_feature (4)..(4): n is a, c, g, or t
  misc_feature (6)..(6): n is a, c, g, or t
  misc_feature (8)..(8): n is a, c, g, or t
ngcncnangccggtccgggtgccacctctccctgcttgggcgccgccgcgcgagcgcttcccttccccctgcaagcgcccggataatgtctgagaatgtccatttctgggacgcttagcagctattatgtcgactcgatcataagtcacgagagtgaggacgcgcctccagccaagtttccttctggccagtacgcgagctcgcggcagccgggccacgcggagcacctggagttcccctcgtgcagcttccagcccaaagcgccggtgttcggcgcctcctgggcgccgctgagcccgcacgcgtccgggagcctgccgtccgtctaccacccttacatccagccccagggcgtcccgccggccgagagcaggtacctccgcacctggctggagccggcgccgcgcggcgaagcggccccggggcagggccaggcggcggtgaaggcggagccgctgctgggcgcgcctggggagctgctcaaacagggcacgcccgagtacagtttggaaacttcggcgggcagggaggccgtgctgtctaatcaaagacccggctacggggacaataaaatttgcgaaggaagcgaggacaaagagaggccggatcaaaccaacccctccgccaactggctgcacgctcgctcttcccggaaaaagcgctgtccctacaccaaataccagacgctggagctagagaaggagtttctgttcaatatgtacctcaccagggaccgtaggcacgaagtggccagactcctcaatctgagtgagagacaagtcaaaatctggtttcagaaccggcggatgaaaatgaagaaaatgaataaggagcagggcaaagagtaaagattaaagattacccccagtcctccctagctcttccccatctcactcttagttatgtgacgactgcaaagccagtgctgtctgggatgtattcaagtgaatggggaagggagtctctcttccaagtcctttatctgcacctagaacctccctcctttcctttgcccttacctgtctctctcttctctctaggtgtcaggagaaagttttgttgatttagaagatagaaatagttggttcctaagaatgtgatgggccacaaggaaagagagaccccagtcaagctcctagtatgccctgtaatttttctgggaagtcctagcccctcacttccagcttgcctgtttcttctctacacccacccaaaagtcacccagggacactccaactctacacagctcagcagacatccacacacagtaatggggtgagctcacaaccaccattcagtcaagtgaggtgacactccagttgcagaccatcgcacaccaaatttggcaaaacagccctcagactgtcaggcaagcccgggttctacccctaatgcaaatacccaccagggagatgtctagaggcagactcctgagtgaggagttgcagcccaaaggctgcagcattgccataccattcccatggagttgccaactattctcaggccaagggccatggggaagatggagcaaacctagcccccaagccggtgggctagaaagtacaagaaaaggcagcacgtggttttatgaaggtatcttaggtggagctactccccacctcccaccaacatatacattttgttgcaggaaatgtttaattccgcatgatgtttccctctccttccaacaaaagaaggtcaaactgtgggtcgtagagccttgacaatgttgtcctcctgttcatctgtgcaccacttgacagactgtagcttctcttgctctcgaccggccctgcattcttccgcaccctccctagctctgaaatcaactctcttcggtcgtatccaccttgcacccgcaagtcaagccgccccttgtagaaaaatccctccaccttccgttccccgctaggtcaacccctcctgcttcatgggcctggatgcagatctgcgtggctggtgcgtgcgcgcgcttctgggaaacagtcccgcgtgcaaaggaaaggggcaaaatggcacctaagcatcagatggaagcttactctctgcttccgttcctccccctgctcccctacttctcagtccccttcaatttgtagactcttgctcctgcttctcctgatcctgcaaggggacattccagtagaagttttttgctttgtcggtggctgtcgtgaaattgtgcttgtgtttcgtgatttctttgggggtgattgtctcgcttgttttcagttgtcgattatatgggagggttctgggtgggagtggggagggcgaggggcctagagctctaattgtttgttttggaagaaaaaaagaaaaagaacaaaaaatatatatcactctagaaaataaat

SEQ ID NO: 343584 - DNA, 3411 bp, Homo sapiens
  misc_feature (1)..(1): n is a, c, g, or t
  misc_feature (4)..(4): n is a, c, g, or t
  misc_feature (6)..(6): n is a, c, g, or t
  misc_feature (8)..(8): n is a, c, g, or t
ngcncnangccggtccgggtgccacctctccctgcttgggcgccgccgcgcgagcgcttcccttccccctgcaagcgcccggataatgtctgagaatgtccatttctgggacgcttagcagctattatgtcgactcgatcataagtcacgagagtgaggacgcgcctccagccaagtttccttctggccagtacgcgagctcgcggcagccgggccacgcggagcacctggagttcccctcgtgcagcttccagcccaaagcgccggtgttcggcgcctcctgggcgccgctgagcccgcacgcgtccgggagcctgccgtccgtctaccacccttacatccagccccagggcgtcccgccggccgagagcaggtacctccgcacctggctggagccggcgccgcgcggcgaagcggccccggggcagggccaggcggcggtgaaggcggagccgctgctgggcgcgcctggggagctgctcaaacagggcacgcccgagtacagtttggaaacttcggcgggcagggaggccgtgctgtctaatcaaagacccggctacggggacaataaaatttgcgaaggaagcgaggacaaagagaggccggatcaaaccaacccctccgccaactggctgcacgctcgctcttcccggaaaaagcgctgtccctacaccaaataccagacgctggagctagagaaggagtttctgttcaatatgtacctcaccagggaccgtaggcacgaagtggccagactcctcaatctgagtgagagacaagtcaaaatctggtttcagaaccggcggatgaaaatgaagaaaatgaataaggagcagggcaaagagtaaagattaaagattacccccagtcctccctagctcttccccatctcactcttagttatgtgacgactgcaaagccagtgctgtctgggatgtattcaagtgaatggggaagggagtctctcttccaagtcctttatctgcacctagaacctccctcctttcctttgcccttacctgtctctctcttctctctaggtgtcaggagaaagttttgttgatttagaagatagaaatagttggttcctaagaatgtgatgggccacaaggaaagagagaccccagtcaagctcctagtatgccctgtaatttttctgggaagtcctagcccctcacttccagcttgcctgtttcttctctacacccacccaaaagtcacccagggacactccaactctacacagctcagcagacatccacacacaacacacacacacacacactcaggtccggcggggccagacgtctgggcgcgggcagcctcttgattcttttacagtctcatcctatcctctcaggcctcctctcccccgacaaaaagcccaactgtttctcctcagaatttgaaacaatcgcgtggagtttgaaaactgctcggtccccctttttacacgccataaagggcgcactgctttgcggtctccgctagaaattaggggcaggggtgggaggtgtacgtagaaagaaaaaagcttagggcttcttttttttcctcccctctgttgtgttttttttctattttttagcttatctacacaatttcatgaaccgtttcctgattccgatgcccactccctatccctccccttttactgctagttatgaaagtttctcctgctggccacctctgcggctgctctcccagaaaactggtggagccggtggctgcggcgccttttcgcagagcagccgctagatggcacccttgctccatgtgaaactccctggagcggcagctgcggatgtctgctcccggcaccgcgccttggtcggccctgaatccaggaactgagtgctaccaaaagtcatgaataatttgtacctaataaaaaaaatagggctcgttatggccttacccccattttatagatttcagttatagtagtgttcccccatctcctcaaatggtcaattttctgaattttccccaagaggagggctcagtgattctcacccagttgctgtgttcggtggggcaacaaatgcgtgaaaacggggaataatagtaataataggaataatgggtccaaatccaaaaggagaattgattcgaaacaacgagattttccgtgaaaggaggcgaaaggaatgtccctggatgcgggtcagcaggtcaggtgagaggggctagccggcaaaagaaggtaggatggagaggaagctgcccatcggctggagagaaaatcacgtaagccagcccgagaccccccagtttgtgtgtgtgggggaatggagccatagcttttgtggggattcggagatgcccaaagccggcagggcggcttcgcacgggcgcaagctctggagcctttgtatgagtccagggctgggctgggctcgcgcagggcgacctaggcacggggcaggggctccccagggcagcagggtgcgggaaggctcggatgtggtctctggatgctttgcgcgctcccaaagaatgcgcgttttcccatgggcgcgaaggcgggcgcggcgtcaggacgcaggagctctgttctccctgggttcctgggcttccaggtgagaggtgcggcttcagtgcgccttggccctggccgcaggcaaacctgggggcgccggtcctttcctcattgagcagctggaggtctggactccgggcactttcgttctgagacccgcaccctggttgttcacagccccttgcattccaaatctcctgtgtcctcccggccccgccggatccctgccttccatccgacaaacctgcgccagcaatagatactcccaccccctcaaaatcaccccagctgcagcctctcctctcccccaccaggacttagtgcaaggaggtaagcggagtttctcctcaacttgagtttctctaataaatctgcgctccgctgggtgtttataaattgtctcctcgctctttcgttttttttttttttttcctataacagaaacattttccttccatcaggaatttctggcacggtgtagagatgatttagaacaagccattgaatttgtacctcgccggtgagttttcaaataatgaccataaaatcctctgcacttgataaaaatgtttgcttcggcaacaatttaactcggccctccgttgcctcacggtcccctcagccacgcgctgaaaattcaaagccctggttctctccattcctcctcttttcctttatctctctcccgcttctagcccctctctcattctctaggttcacttttgaagaaccaaatgacctcactggtaaggttccctttggaaaagtgatagtttcatttttacaaatgttggggtgtatggggtccccaaaaggtgcccgtcaaaaaaacaaaccactgtttcctgaataaacaatggattgaatat

SEQ ID NO: 343585 - DNA, 3488 bp, Homo sapiens
  misc_feature (1)..(1): n is a, c, g, or t
  misc_feature (4)..(4): n is a, c, g, or t
  misc_feature (6)..(6): n is a, c, g, or t
  misc_feature (8)..(8): n is a, c, g, or t
ngcncnangccggtccgggtgccacctctccctgcttgggcgccgccgcgcgagcgcttcccttccccctgcaagcgcccggataatgtctgagaatgtccatttctgggacgcttagcagctattatgtcgactcgatcataagtcacgagagtgaggacgcgcctccagccaagtttccttctggccagtacgcgagctcgcggcagccgggccacgcggagcacctggagttcccctcgtgcagcttccagcccaaagcgccggtgttcggcgcctcctgggcgccgctgagcccgcacgcgtccgggagcctgccgtccgtctaccacccttacatccagccccagggcgtcccgccggccgagagcaggtacctccgcacctggctggagccggcgccgcgcggcgaagcggccccggggcagggccaggcggcggtgaaggcggagccgctgctgggcgcgcctggggagctgctcaaacagggcacgcccgagtacagtttggaaacttcggcgggcagggaggccgtgctgtctaatcaaagacccggctacggggacaataaaatttgcgaaggaagcgaggacaaagagaggccggatcaaaccaacccctccgccaactggctgcacgctcgctcttcccggaaaaagcgctgtccctacaccaaataccagacgctggagctagagaaggagtttctgttcaatatgtacctcaccagggaccgtaggcacgaagtggccagactcctcaatctgagtgagagacaagtcaaaatctggtttcagaaccggcggatgaaaatgaagaaaatgaataaggagcagggcaaagagtaaagattaaagattacccccagtcctccctagctcttccccatctcactcttagttatgtgacgactgcaaagccagtgctgtctgggatgtattcaagtgaatggggaagggagtctctcttccaagtcctttatctgcacctagaacctccctcctttcctttgcccttacctgtctctctcttctctctaggtgtcaggagaaagttttgttgatttagaagatagaaatagttggttcctaagaatgtgatgggccacaaggaaagagagaccccagtcaagctcctagtatgccctgtaatttttctgggaagtcctagcccctcacttccagcttgcctgtttcttctctacacccacccaaaagtcacccagggacactccaactctacacagctcagcagacatccacacacaacacacacacacacacactcaggtccggcggggccagacgtctgggcgcgggcagcctcttgattcttttacagtctcatcctatcctctcaggcctcctctcccccgacaaaaagcccaactgtttctcctcagaatttgaaacaatcgcgtggagtttgaaaactgctcggtccccctttttacacgccataaagggcgcactgctttgcggtctccgctagaaattaggggcaggggtgggaggtgtacgtagaaagaaaaaagcttagggcttcttttttttcctcccctctgttgtgttttttttctattttttagcttatctacacaatttcatgaaccgtttcctgattccgatgcccactccctatccctccccttttactgctagttatgaaagtttctcctgctggccacctctgcggctgctctcccagaaaactggtggagccggtggctgcggcgccttttcgcagagcagccgctagatggcacccttgctccatgtgaaactccctggagcggcagctgcggatgtctgctcccggcaccgcgccttggtcggccctgaatccaggaactgagtgctaccaaaagtcatgaataatttgtacctaataaaaaaaatagggctcgttatggccttacccccattttatagatttcagttatagtagtgttcccccatctcctcaaatggtcaattttctgaattttccccaagaggagggctcagtgattctcacccagttgctgtgttcggtggggcaacaaatgcgtgaaaacggggaataatagtaataataggaataatgggtccaaatccaaaaggagaattgattcgaaacaacgagattttccgtgaaaggaggcgaaaggaatgtccctggatgcgggtcagcaggtcaggtgagaggggctagccggcaaaagaaggtaggatggagaggaagctgcccatcggctggagagaaaatcacgtaagccagcccgagaccccccagtttgtgtgtgtgggggaatggagccatagcttttgtggggattcggagatgcccaaagccggcagggcggcttcgcacgggcgcaagctctggagcctttgtatgagtccagggctgggctgggctcgcgcagggcgacctaggcacggggcaggggctccccagggcagcagggtgcgggaaggctcggatgtggtctctggatgctttgcgcgctcccaaagaatgcgcgttttcccatgggcgcgaaggcgggcgcggcgtcaggacgcaggagctctgttctccctgggttcctgggcttccaggtgagaggtgcggcttcagtgcgccttggccctggccgcaggcaaacctgggggcgccggtcctttcctcattgagcagctggaggtctggactccgggcactttcgttctgagacccgcaccctggttgttcacagccccttgcattccaaatctcctgtgtcctcccggccccgccggatccctgccttccatccgacaaacctgcgccagcaatagatactcccaccccctcaaaatcaccccagctgcagcctctcctctcccccaccaggacttagtgcaaggaggtaagcggagtttctcctcaacttgagtttctctaataaatctgcgctccgctgggtgtttataaattgtctcctcgctctttcgttttttttttttttttcctataacagaaacattttccttccatcaggaatttctggcacggtgtagagatgatttagaacaagccattgaatttgtacctcgccggtgagttttcaaataatgaccataaaatcctctgcacttgataaaaatgtttgcttcggcaacaatttaactcggccctccgttgcctcacggtcccctcagccacgcgctgaaaattcaaagccctggttctctccattcctcctcttttcctttatctctctcccgcttctagcccctctctcattctctaggttcacttttgaagaaccaaatgacctcactggtaaggttccctttggaaaagtgatagtttcatttttacaaatgttggggtgtatggggtccccaaaaggtgcccgtcaaaaaaacaaaccactgtttcctgaataaacaatggattgaatatatttgtaaagcctccacttttgttgctcaaaattttctttctgtctctcattcctctcccttgccgaagcttgatca

SEQ ID NO: 343586 - DNA, 2593 bp, Homo sapiens
  misc_feature (1)..(1): n is a, c, g, or t
  misc_feature (4)..(4): n is a, c, g, or t
  misc_feature (6)..(6): n is a, c, g, or t
  misc_feature (8)..(8): n is a, c, g, or t
ngcncnangccggtccgggtgccacctctccctgcttgggcgccgccgcgcgagcgcttcccttccccctgcaagcgcccggataatgtctgagaatgtccatttctgggacgcttagcagctattatgtcgactcgatcataagtcacgagagtgaggacgcgcctccagccaagtttccttctggccagtacgcgagctcgcggcagccgggccacgcggagcacctggagttcccctcgtgcagcttccagcccaaagcgccggtgttcggcgcctcctgggcgccgctgagcccgcacgcgtccgggagcctgccgtccgtctaccacccttacatccagccccagggcgtcccgccggccgagagcaggtacctccgcacctggctggagccggcgccgcgcggcgaagcggccccggggcagggccaggcggcggtgaaggcggagccgctgctgggcgcgcctggggagctgctcaaacagggcacgcccgagtacagtttggaaacttcggcgggcagggaggccgtgctgtctaatcaaagacccggctacggggacaataaaatttgcgaaggaagcgaggacaaagagaggccggatcaaaccaacccctccgccaactggctgcacgctcgctcttcccggaaaaagcgctgtccctacaccaaataccagacgctggagctagagaaggagtttctgttcaatatgtacctcaccagggaccgtaggcacgaagtggccagactcctcaatctgagtgagagacaagtcaaaatctggtttcagaaccggcggatgaaaatgaagaaaatgaataaggagcagggcaaagagtaaagattaaagattacccccagtcctccctagctcttccccatctcactcttagttatgtgacgactgcaaagccagtgctgtctgggatgtattcaagtgaatggggaagggagtctctcttccaagtcctttatctgcacctagaacctccctcctttcctttgcccttacctgtctctctcttctctctaggtgtcaggagaaagttttgttgatttagaagatagaaatagttggttcctaagaatgtgatgggccacaaggaaagagagaccccagtcaagctcctagtatgccctgtaatttttctgggaagtcctagcccctcacttccagcttgcctgtttcttctctacacccacccaaaagtcacccagggacactccaactctacacagctcagcagacatccacacacagtaatggggtgagctcacaaccaccattcagtcaagtgaggtgacactccagttgcagaccatcgcacaccaaatttggcaaaacagccctcagactgtcaggcaagcccgggttctacccctaatgcaaatacccaccagggagatgtctagaggcagactcctgagtgaggagttgcagcccaaaggctgcagcattgccataccattcccatggagttgccaactattctcaggccaagggccatggggaagatggagcaaacctagcccccaagccggtgggctagaaagtacaagaaaaggcagcacgtggttttatgaaggtatcttaggtggagctactccccacctcccaccaacatatacattttgttgcaggaaatgtttaattccgcatgatgtttccctctccttccaacaaaagaaggtcaaactgtgggtcgtagagccttgacaatgttgtcctcctgttcatctgtgcaccacttgacagactgtagcttctcttgctctcgaccggccctgcattcttccgcaccctccctagctctgaaatcaactctcttcggtcgtatccaccttgcacccgcaagtcaagccgccccttgtagaaaaatccctccaccttccgttccccgctaggtcaaccccactgtagacaggaaagccaggccaggagagtccgaatgagaatttattgtgaatcgattcccaagctcccttccgggacaagtggtctgggacagggaggagcaacggccccagcgcgcaacgctctgcgcgttcctccgaatcccgtcggcttctcgacccacgcagagaagccccgggcttggcggctctagccccagcgccaaaggagacccgccccagggccgggcttggcctcctgcttcatgggcctggatgcagatctgcgtggctggtgcgtgcgcgcgcttctgggaaacagtcccgcgtgcaaaggaaaggggcaaaatggcacctaagcatcagatggaagcttactctctgcttccgttcctccccctgctcccctacttctcagtccccttcaatttgtagactcttgctcctgcttctcctgatcctgcaaggggacattccagtagaagttttttgctttgtcggtggctgtcgtgaaattgtgcttgtgtttcgtgatttctttgggggtgattgtctcgcttgttttcagttgtcgattatatgggagggttctgggtgggagtggggagggcgaggggcctagagctctaattgtttgttttggaagaaaaaaagaaaaagaacaaaaaatatatatcactctagaaaataaat

SEQ ID NO: 343587 - DNA, 2008 bp, Homo sapiens
  misc_feature (1)..(1): n is a, c, g, or t
  misc_feature (4)..(4): n is a, c, g, or t
  misc_feature (6)..(6): n is a, c, g, or t
  misc_feature (8)..(8): n is a, c, g, or t
ngcncnangccggtccgggtgccacctctccctgcttgggcgccgccgcgcgagcgcttcccttccccctgcaagcgcccggataatgtctgagaatgtccatttctgggacgcttagcagctattatgtcgactcgatcataagtcacgagagtgaggacgcgcctccagccaagtttccttctggccagtacgcgagctcgcggcagccgggccacgcggagcacctggagttcccctcgtgcagcttccagcccaaagcgccggtgttcggcgcctcctgggcgccgctgagcccgcacgcgtccgggagcctgccgtccgtctaccacccttacatccagccccagggcgtcccgccggccgagagcaggtacctccgcacctggctggagccggcgccgcgcggcgaagcggccccggggcagggccaggcggcggtgaaggcggagccgctgctgggcgcgcctggggagctgctcaaacagggcacgcccgagtacagtttggaaacttcggcgggcagggaggccgtgctgtctaatcaaagacccggctacggggacaataaaatttgcgaaggaagcgaggacaaagagaggccggatcaaaccaacccctccgccaactggctgcacgctcgctcttcccggaaaaagcgctgtccctacaccaaataccagacgctggagctagagaaggagtttctgttcaatatgtacctcaccagggaccgtaggcacgaagtggccagactcctcaatctgagtgagagacaagtcaaaatctggtttcagaaccggcggatgaaaatgaagaaaatgaataaggagcagggcaaagagtaaagattaaagattacccccagtcctccctagctcttccccatctcactcttagttatgtgacgactgcaaagccagtgctgtctgggatgtattcaagtgaatggggaagggagtctctcttccaagtcctttatctgcacctagaacctccctcctttcctttgcccttacctgtctctctcttctctctaggtgtcaggagaaagttttgttgatttagaagatagaaatagttggttcctaagaatgtgatgggccacaaggaaagagagaccccagtcaagctcctagtatgccctgtaatttttctgggaagtcctagcccctcacttccagcttgcctgtttcttctctacacccacccaaaagtcacccagggacactccaactctacacagctcagcagacatccacacacagtaatggggtgagctcacaaccaccattcagtcaagtgaggtgacactccagttgcagaccatcgcacaccaaatttggcaaaacagccctcagactgtcaggcaagcccgggttctacccctaatgcaaatacccaccagggagatgtctagaggcagactcctgagtgaggagttgcagcccaaaggctgcagcattgccataccattcccatggagttgccaactattctcaggccaagggccatggggaagatggagcaaacctagcccccaagccggtgggctagaaagtacaagaaaaggcagcacgtggttttatgaaggtatcttaggtggagctactccccacctcccaccaacatatacattttgttgcaggaaatgtttaattccgcatgatgtttccctctccttccaacaaaagaaggtcaaactgtgggtcgtagagccttgacaatgttgtcctcctgttcatctgtgcaccacttgacagactgtagcttctcttgctctcgacattccagtagaagttttttgctttgtcggtggctgtcgtgaaattgtgcttgtgtttcgtgatttctttgggggtgattgtctcgcttgttttcagttgtcgattatatgggagggttctgggtgggagtggggagggcgaggggcctagagctctaattgtttgttttggaagaaaaaaagaaaaagaacaaaaaatatatatcactctagaaaataaat

SEQ ID NO: 343588 - DNA, 918 bp, Homo sapiens
gagcaagaacatattctgggaaagataaggcatattgcaactgcttattctgagacagatgctccaaatctcagaatttgctttctagtcttgtgtcctttttactgacatgttgtgccagactagaaggaaaggaatgaaaataaatgtgggtttgggggaaggggaggcatggaggaaggcctacgtaggccaatttgtccatgcgcctggttgggtatttctagacttcttttcttccctcgagagctgtgggcatgtgaataagcagagggtcttaatgctgagaagaggtagacagcctgtgatggcaaagggtcattatctcggaagtcctccacattgattatcattgaatgtgtccttggagaaacagtcaatacaaaagaacatggtcactgtcctaaaggacatacatcctaaaggacaactaaagaagtcttaatgatatatacaatttatatatcaggatttagtgtggtgtgtcctaagtcagagagatgggacagaatgggcaaattcttcaacaaaacagataccatcttccagggctcaagaaacacaatgcccaggctgattagtttagatttatgtgtgtggaaaggaaagcattgttttgaaaagtgtctttgctgggcgcggtggctcacccctgtaatcccaatgctttgggaggccgaggcgggcggatcatgaggtcaggagatcgagaccatcctgactaacacagtgaaaccctgtctctactaaaaatacaaaaaattagccaggtatggtggtgggtgcctgtagtcccagctactcgggaggctgaggcaggagaatggcgtgaacccgggaggcggaacttgcagtgagccgagattgtgccactgcactccagcctgggcaacagagcgagattcgtctcaaaaaaag

SEQ ID NO: 343589 - DNA, 280 bp, Homo sapiens
gagcaagaacatattctgggaaagataaggcatattgcaactgcttattctgagacagatgctccaaatctcagaatttgctttctagtcttgtgtcctttttactgacatgttgtgccagactagaaggaaaggaatgaaaataaatgtgggtttgggggaaggggaggcatggaggaaggcctacgtaggccaatttgtccatgcgcctggttgctgcatcatgctgcctagctggtttgtgctccagagcttgtacctgtggaaaagtaggtaccga

SEQ ID NO: 343590 - DNA, 866 bp, Homo sapiens
ctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggttatgaaccaccagtccaagaatctgtttaaagttcagacttcaatagtgggaataaaagtgctttgtgcaaaaaaaaaaacaaaaaaaa

SEQ ID NO: 343591 - DNA, 1190 bp, Homo sapiens
  misc_feature (183)..(185): n is a, c, g, or t
  misc_feature (512)..(512): n is a, c, g, or t
  misc_feature (557)..(557): n is a, c, g, or t
  misc_feature (692)..(693): n is a, c, g, or t
  misc_feature (744)..(744): n is a, c, g, or t
  misc_feature (759)..(759): n is a, c, g, or t
  misc_feature (765)..(765): n is a, c, g, or t
  misc_feature (768)..(768): n is a, c, g, or t
  misc_feature (838)..(838): n is a, c, g, or t
ctgaccagcaccatggcggttggcaagaacaagcgccttacgaaaggcggcaaaaagggagccaagaagaaagtggttgatccattttctaagaaagattggtatgatgtgaaagcacctgctatgttcaatataaggaagatagtgtggaataggaccgcatcggtcaacctagcgcacccnnnaaggaagaccaaacatgttgccattctagatgagtcatctaaggagctcgtcgtgctattcgataggtggagatcattgccatgactattcgtccaaggacattgggactgggataggattttggccattatcaggaacagatagttactacacgccattgcagtatgacttgggatatggattcgtttcctatggggcttagacacacatcgttggctcctgtaaactaaaatcgtgtgcgcgatcgcgcctatttgcgtagttcatttaactcccggtgggagcaaaacagagtcgatggtatcctcgagtggagcttgctacantaaaaatactcgaggccagggaacgagaattcgccatttgtcganaacacgaccttcgatccggttctcggtaatcggatccaacaaggaacttgtaacaccgtaactggcgatatgaacctttagacctgttccgctacctgatgtcctagatggctgtgggtgggttttagcttaatnnacagagaacgcccaaatcaaatccagtgataaaccgcgataagcaaccctncgtataattgcgctncaggtncanccagaagcaggtggtcacggcgcatacacatgcgcggtacacgtaacgattcgactcggacatacgtcanttggagcccagaggatgcgatgcaagaagccaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggttatgaaccaccagtccaagaatctgtttaaagttcagacttcaatagtgggaataaaagtgctttgtgcaaaaaaaaaaacaaaaaaaa

SEQ ID NO: 343592 - DNA, 489 bp, Homo sapiens
tcttgggttttccctgcctctgtttcccatatcttcctcttctgtgcctcatcctaccttccctgttctgtgactagtactgcttccagaaactgcagaagagactgggctggatttcctaatctaagtcaaagatttggaggcgcagagtctaggcccaggacaacaaacagtttccttcttgcatgccagctctcaacagtggtaaaggaggccaggagtgctaagctgaaagggtttctaggctccaccaacaagagtgctgggattgattatcaatgtctgctcttgtctagggactggtgaacaggaacaccaaagttactgcctggccacactccatctcggcaggtgattcccagactggaataagcacaggaatcactggggatcttagtaagatgcagattctggtccagttgggctgagattctgtagttctggtctgataagcccttaggtgacatggatgctgctggtctcaggacc

SEQ ID NO: 343593 - DNA, 554 bp, Homo sapiens
tcatttcaagcagaggattaacaaataattgctatgatgatacgcattgccatcctccaaaaacttccatttaacccttttttctatcataattacctaatattaacaaatcttaagcattgaaggttttcctaagtcatatttttatctactcttgaatttattaattagaaattctattcacggttactttgattaaaaaaagtttttttacttaaaaaaatgctgaaataatgctttctctttatgtcacattattgaaaataaatcttgtttacaatcagaatttaattttagttttggcagatttcttcagtttccaaggtaagactttttttttttttcgggttggggagggggggggggaaatctaagtgggggcccggtccacccgggaaacagactggcgcgggccaagatggtatcaaagaggtctctccgggtggaaatagctataattgtgtccccttatccagactggcgtgtacctagctcttcggtccccagggtggacttgggcctgggatgacatcggttccattggtacactgaaa

SEQ ID NO: 343594 - DNA, 3699 bp, Homo sapiens
tggcaactggagcaatcagagcaccgcagccagggagatgctggcgagacgacagcgagatcctctccaggccctgcggcgccgcaatcaggagctgaagcaacaggttgatagtttgctttctgagagccaactgaaagaagctctagaacccaataaaagacaacatatttatcaaagatgtatccagttaaagcaggcaatagatgaaaataaaaatgctcttcaaaaattaagcaaagctgatgaatctgcacctgttgcaaactataatcagagaaaagaagaggagcatactcttttggacaagcttacccaacaactgcagggccttgctgtgacaataagcagagaaaatataactgaagttggggcacctactgaagaagaggaagaaagtgaaagtgaagatagtgaagacagtggtggggaggaagaagatgcagaggaggaagaggaagagaaagaggaaaatgaatctcacaaatggtcaaccggtgaagaatacatcgctgttggagattttactgctcagcaagttggagatcttacatttaagaaaggggaaattctccttgtaattgaaaaaaaacctgatggttggtggatagctaaggatgccaaaggaaatgaaggtcttgttcccagaacctacctagagccttatagtgaagaagaagaaggccaagagtcaagtgaagagggcagtgaagaagatgtagaggcggtggatgaaacagcagatggagcagaagttaagcaaagaactgatccccactggagtgctgttcagaaagcgatttcagaggcgggcatcttctgtcttgttaatcatgtctcgttttgctacctaatagttctgatgcgaaataggatggagactgtggaagacaccaatggatctgaaacagggttcagggcatggaatgtacagagcagaggacgtatatttctggtttctaagcctgtgctccaaaataaacactgttgatgtgttaactacgatgggagctattcctgcagggttcaggccttccacgctctcacagcttctggaggaagggaatcaatttcgagcaaattacttcttacaaccagagctcatgccttcacaactggccttcagagatctgatgtgggatgctacagaaggcactattaggtcgagaccaagtcgtatttcattgattctgacattatggagctgtaaaatgattcctcttccaggaatgagcatacaggttctcagcagacatgtacgcctctgtctatttgatggtaataaggttctgagcaacattcatacagtcagagccacatggcaacctaaaaagcccaaaacatggaccttttctccccaggttactcgcatcttaccatgtttgcttgatggtgattgctttatcaggtctaattctgcatctccagatcttggaatattatttgaacttggaatttcttatattcgcaattcaactggtgaaagaggagagttaagctgtggctgggtgtttcttaaactttttgatgccagtggagttcctattccagcaaaaacttatgagcttttcttgaatggtggtactccttatgaaaaaggtattgaagtggacccttcaatatccagaagagcacacggcagtgttttctaccagattatgacaatgagaaggcagcctcaacttctagtgaaactgagatccttgaacagaagatcaagaaatgtactaagtctactgccagaaacattaattggaaatatgtgttctattcacttgttgatattttatcgacaaattcttggagatgtgctcctgaaagacaggatgagcttgcaaagtactgatttaattagccatcccatgctggccaccttccccatgctcttggagcagcctgatgtgatggatgctctcaggagttcgtgggctggaaaagaaagcacattaaaaagatcagagaagagagacaaagagttcctgaagtccacgtttctcctggtttaccatgactgcgtgctcccacttctccactccacacgcctacccccattcaggtgggcagaagaagagactgagactgcacggtggaaagttatcactgacttccttaagcaaaaccaagaaaaccagggcgccctccaagctctgctgtcaccagacggagttcatgaaccttttgacctttcagagcagacctatgacttcttgggtgaaatgagaaagaatgcagtgtgacagtggcagcctctagccctcagcttcccacggaatcagatggatcctccacgattacgtgaataaaatgatggaaccaaaaatcactgtcactttacaacttaggttttactcttttctttctacagaccatatttttaaagaaatgtttatacaataatttaaatattttttaaaaccataaaataaatttttataaggaatactgttatatctaaatttaaacagtatttattttttcaaaaacagctacttaagttaatggtatagatttctataaaagcaagattttgtcaaaaactaaatttatgattattcaagaaagtgaaaaaaacaacctacagaatgggaaaacatatttgcaaatcatctaactgataaaggtctagtatccaaaatatttaaatttatgagtgttaataaaatttatcttgttcaatgaagaggaagttaaagtgatccatttgagaaagttgtatcacttaattcagtctgatacttgaatgtgatttacccctaattaagtacaaaaacagagtcgcttttgccttttcaaatcaagaaaataagtgctctgtcaaaagcacaaaaagaaactttcaggcactggagagtggagtcgactcaccctttcaggccttgttgcatctcagataaacctgtgactgctggtaaaataatgtcccaagcctttccttttagtgataaacagtagcagcctgcgttaattgagcacctactgtgtgtctgagcatttctcattagcccagttaatcctcacacctactgtaggagataggtactgttgttttttattaccgccgaagaaacaggccagataagtgaagtaatttgcctaaggtcacagctaataagtggcacagctaatattcccagtaaagataccatgtataattttctacaacctaagatgttctgccttatcggggcgaaccttttaggattccatgtgaaaataaaatatgaggaaaagtttaacctaaataattagaatcccattagaggtacttttttttgatggcatgctgccttaaaagagccatttatttttagagatctgtcatattatgaaagttctgggctatcttagctaacttatcctaaacccttaacctaaatttaacttgagccccagtctcagaaattaacatggtatgaaagtgtttccaggccaggcgcggtggctcacgcctgtaatcccaacactttgggaggccgaggtgggtggatcacctgaggtcaggagtttgagaccagcctggccaacactatctgtactaaaaacacaaaattagctgggtgtggtagtgcgtgcctgtgatcccagctacttgggaggctgaggtagaagaattgtttgaacctgggaggtggaggttgcagtgagccaagatcgtgccattgcactccagcctaggcaacaagagtgaaactccatctc

SEQ ID NO: 343595 - DNA, 3345 bp, Homo sapiens
tggcaactggagcaatcagagcaccgcagccagggagatgctggcgagacgacagcgagatcctctccaggccctgcggcgccgcaatcaggagctgaagcaacaggttgatagtttgctttctgagagccaactgaaagaagctctagaacccaataaaagacaacatatttatcaaagagttggggcacctactgaagaagaggaagaaagtgaaagtgaagatagtgaagacagtggtggggaggaagaagatgcagaggaggaagaggaagagaaagaggaaaatgaatctcacaaatggtcaaccggtgaagaatacatcgctgttggagattttactgctcagcaagttggagatcttacatttaagaaaggggaaattctccttgtaattgaaaaaaaacctgatggttggtggatagctaaggatgccaaaggaaatgaaggtcttgttcccagaacctacctagagccttatagtgaagaagaagaaggccaagagtcaagtgaagagggcagtgaagaagatgtagaggcggtggatgaaacagcagatggagcagaagttaagcaaagaactgatccccactggagtgctgttcagaaagcgatttcagagaataaacactgttgatgtgttaactacgatgggagctattcctgcagggttcaggccttccacgctctcacagcttctggaggaagggaatcaatttcgagcaaattacttcttacaaccagagctcatgccttcacaactggccttcagagatctgatgtgggatgctacagaaggcactattaggtcgagaccaagtcgtatttcattgattctgacattatggagctgtaaaatgattcctcttccaggaatgagcatacaggttctcagcagacatgtacgcctctgtctatttgatggtaataaggttctgagcaacattcatacagtcagagccacatggcaacctaaaaagcccaaaacatggaccttttctccccaggttactcgcatcttaccatgtttgcttgatggtgattgctttatcaggtctaattctgcatctccagatcttggaatattatttgaacttggaatttcttatattcgcaattcaactggtgaaagaggagagttaagctgtggctgggtgtttcttaaactttttgatgccagtggagttcctattccagcaaaaacttatgagcttttcttgaatggtggtactccttatgaaaaaggtattgaagtggacccttcaatatccagaagagcacacggcagtgttttctaccagattatgacaatgagaaggcagcctcaacttctagtgaaactgagatccttgaacagaagatcaagaaatgtactaagtctactgccagaaacattaattggaaatatgtgttctattcacttgttgatattttatcgacaaattcttggagatgtgctcctgaaagacaggatgagcttgcaaagtactgatttaattagccatcccatgctggccaccttccccatgctcttggagcagcctgatgtgatggatgctctcaggagttcgtgggctggaaaagaaagcacattaaaaagatcagagaagagagacaaagagttcctgaagtccacgtttctcctggtttaccatgactgcgtgctcccacttctccactccacacgcctacccccattcaggtgggcagaagaagagactgagactgcacggtggaaagttatcactgacttccttaagcaaaaccaagaaaaccagggcgccctccaagctctgctgtcaccagacggagttcatgaaccttttgacctttcagagcagacctatgacttcttgggtgaaatgagaaagaatgcagtgtgacagtggcagcctctagccctcagcttcccacggaatcagatggatcctccacgattacgtgaataaaatgatggaaccaaaaatcactgtcactttacaacttaggttttactcttttctttctacagaccatatttttaaagaaatgtttatacaataatttaaatattttttaaaaccataaaataaatttttataaggaatactgttatatctaaatttaaacagtatttattttttcaaaaacagctacttaagttaatggtatagatttctataaaagcaagattttgtcaaaaactaaatttatgattattcaagaaagtgaaaaaaacaacctacagaatgggaaaacatatttgcaaatcatctaactgataaaggtctagtatccaaaatatttaaatttatgagtgttaataaaatttatcttgttcaatgaagaggaagttaaagtgatccatttgagaaagttgtatcacttaattcagtctgatacttgaatgtgatttacccctaattaagtacaaaaacagagtcgcttttgccttttcaaatcaagaaaataagtgctctgtcaaaagcacaaaaagaaactttcaggcactggagagtggagtcgactcaccctttcaggccttgttgcatctcagataaacctgtgactgctggtaaaataatgtcccaagcctttccttttagtgataaacagtagcagcctgcgttaattgagcacctactgtgtgtctgagcatttctcattagcccagttaatcctcacacctactgtaggagataggtactgttgttttttattaccgccgaagaaacaggccagataagtgaagtaatttgcctaaggtcacagctaataagtggcacagctaatattcccagtaaagataccatgtataattttctacaacctaagatgttctgccttatcggggcgaaccttttaggattccatgtgaaaataaaatatgaggaaaagtttaacctaaataattagaatcccattagaggtacttttttttgatggcatgctgccttaaaagagccatttatttttagagatctgtcatattatgaaagttctgggctatcttagctaacttatcctaaacccttaacctaaatttaacttgagccccagtctcagaaattaacatggtatgaaagtgtttccaggccaggcgcggtggctcacgcctgtaatcccaacactttgggaggccgaggtgggtggatcacctgaggtcaggagtttgagaccagcctggccaacactatctgtactaaaaacacaaaattagctgggtgtggtagtgcgtgcctgtgatcccagctacttgggaggctgaggtagaagaattgtttgaacctgggaggtggaggttgcagtgagccaagatcgtgccattgcactccagcctaggcaacaagagtgaaactccatctc

SEQ ID NO: 343596 - DNA, 2894 bp, Homo sapiens
gagattttattctctaatagtacccgcttatcatttgagaccaagagaatatctgtcttcattcaaacagacaaggccttatacaagccaaagcaagaagtgaagtttcgcattgttacactcttctcagattttaagccttacaaaacctctttaaacattctcattaagaataaacactgttgatgtgttaactacgatgggagctattcctgcagggttcaggccttccacgctctcacagcttctggaggaagggaatcaatttcgagcaaattacttcttacaaccagagctcatgccttcacaactggccttcagagatctgatgtgggatgctacagaaggcactattaggtcgagaccaagtcgtatttcattgattctgacattatggagctgtaaaatgattcctcttccaggaatgagcatacaggttctcagcagacatgtacgcctctgtctatttgatggtaataaggttctgagcaacattcatacagtcagagccacatggcaacctaaaaagcccaaaacatggaccttttctccccaggttactcgcatcttaccatgtttgcttgatggtgattgctttatcaggtctaattctgcatctccagatcttggaatattatttgaacttggaatttcttatattcgcaattcaactggtgaaagaggagagttaagctgtggctgggtgtttcttaaactttttgatgccagtggagttcctattccagcaaaaacttatgagcttttcttgaatggtggtactccttatgaaaaaggtattgaagtggacccttcaatatccagaagagcacacggcagtgttttctaccagattatgacaatgagaaggcagcctcaacttctagtgaaactgagatccttgaacagaagatcaagaaatgtactaagtctactgccagaaacattaattggaaatatgtgttctattcacttgttgatattttatcgacaaattcttggagatgtgctcctgaaagacaggatgagcttgcaaagtactgatttaattagccatcccatgctggccaccttccccatgctcttggagcagcctgatgtgatggatgctctcaggagttcgtgggctggaaaagaaagcacattaaaaagatcagagaagagagacaaagagttcctgaagtccacgtttctcctggtttaccatgactgcgtgctcccacttctccactccacacgcctacccccattcaggtgggcagaagaagagactgagactgcacggtggaaagttatcactgacttccttaagcaaaaccaagaaaaccagggcgccctccaagctctgctgtcaccagacggagttcatgaaccttttgacctttcagagcagacctatgacttcttgggtgaaatgagaaagaatgcagtgtgacagtggcagcctctagccctcagcttcccacggaatcagatggatcctccacgattacgtgaataaaatgatggaaccaaaaatcactgtcactttacaacttaggttttactcttttctttctacagaccatatttttaaagaaatgtttatacaataatttaaatattttttaaaaccataaaataaatttttataaggaatactgttatatctaaatttaaacagtatttattttttcaaaaacagctacttaagttaatggtatagatttctataaaagcaagattttgtcaaaaactaaatttatgattattcaagaaagtgaaaaaaacaacctacagaatgggaaaacatatttgcaaatcatctaactgataaaggtctagtatccaaaatatttaaatttatgagtgttaataaaatttatcttgttcaatgaagaggaagttaaagtgatccatttgagaaagttgtatcacttaattcagtctgatacttgaatgtgatttacccctaattaagtacaaaaacagagtcgcttttgccttttcaaatcaagaaaataagtgctctgtcaaaagcacaaaaagaaactttcaggcactggagagtggagtcgactcaccctttcaggccttgttgcatctcagataaacctgtgactgctggtaaaataatgtcccaagcctttccttttagtgataaacagtagcagcctgcgttaattgagcacctactgtgtgtctgagcatttctcattagcccagttaatcctcacacctactgtaggagataggtactgttgttttttattaccgccgaagaaacaggccagataagtgaagtaatttgcctaaggtcacagctaataagtggcacagctaatattcccagtaaagataccatgtataattttctacaacctaagatgttctgccttatcggggcgaaccttttaggattccatgtgaaaataaaatatgaggaaaagtttaacctaaataattagaatcccattagaggtacttttttttgatggcatgctgccttaaaagagccatttatttttagagatctgtcatattatgaaagttctgggctatcttagctaacttatcctaaacccttaacctaaatttaacttgagccccagtctcagaaattaacatggtatgaaagtgtttccaggccaggcgcggtggctcacgcctgtaatcccaacactttgggaggccgaggtgggtggatcacctgaggtcaggagtttgagaccagcctggccaacactatctgtactaaaaacacaaaattagctgggtgtggtagtgcgtgcctgtgatcccagctacttgggaggctgaggtagaagaattgtttgaacctgggaggtggaggttgcagtgagccaagatcgtgccattgcactccagcctaggcaacaagagtgaaactccatctc

SEQ ID NO: 343597 - DNA, 2316 bp, Homo sapiens
tggcaactggagcaatcagagcaccgcagccagggagatgctggcgagacgacagcgagatcctctccaggccctgcggcgccgcaatcaggagctgaagcaacaggttgatagtttgctttctgagagccaactgaaagaagctctagaacccaataaaagacaacatatttatcaaagatgtatccagttaaagcaggcaatagatgaaaataaaaatgctcttcaaaaattaagcaaagctgatgaatctgcacctgttgcaaactataatcagagaaaagaagaggagcatactcttttggacaagcttacccaacaactgcagggccttgctgtgacaataagcagagaaaatataactgaagttggggcacctactgaagaagaggaagaaagtgaaagtgaagatagtgaagacagtggtggggaggaagaagatgcagaggaggaagaggaagagaaagaggaaaatgaatctcacaaatggtcaaccggtgaagaatacatcgctgttggagattttactgctcagcaagttggagatcttacatttaagaaaggggaaattctccttgtaattgaaaaaaaacctgatggttggtggatagctaaggatgccaaaggaaatgaaggtcttgttcccagaacctacctagagccttatagtgaagaagaagaaggccaagagtcaagtgaagagggcagtgaagaagatgtagaggcggtggatgaaacagcagatggagcagaagttaagcaaagaactgatccccactggagtgctgttcagaaagcgatttcagaggcgggcatcttctgtcttgttaatcatgtctcgttttgctacctaatagttctgatgcgaaataggatggagactgtggaagacaccaatggatctgaaacagggttcagggcatggaatgtacagagcagaggacgtatatttctggtttctaagcctgtgctccaaaataaacactgttgatgtgttaactacgatgggagctattcctgcagggttcaggccttccacgctctcacagcttctggaggaagggaatcaatttcgagcaaattacttcttacaaccagagctcatgccttcacaactggccttcagagatctgatgtgggatgctacagaaggcactattaggtcgagaccaagtcgtatttcattgattctgacattatggagctgtaaaatgattcctcttccaggaatgagcatacaggttctcagcagacatgtacgcctctgtctatttgatggtaataaggttctgagcaacattcatacagtcagagccacatggcaacctaaaaagcccaaaacatggaccttttctccccaggttactcgcatcttaccatgtttgcttgatggtgattgctttatcaggtctaattctgcatctccagatcttggaatattatttgaacttggaatttcttatattcgcaattcaactggtgaaagaggagagttaagctgtggctgggtgtttcttaaactttttgatgccagtggagttcctattccagcaaaaacttatgagcttttcttgaatggtggtactccttatgaaaaaggtattgaagtggacccttcaatatccagaagagcacacggcagtgttttctaccagattatgacaatgagaaggcagcctcaacttctagtgaaactgagatccttgaacagaagatcaagaaatgtactaagtctactgccagaaacattaattggaaatatgtgttctattcacttgttgatattttatcgacaaattcttggagatgtgctcctgaaagacaggatgagcttgcaaagtactgatttaattagccatcccatgctggccaccttccccatgctcttggagcagcctgatgtgatggatgctctcaggagttcgtgggctggaaaagaaagcacattaaaaagatcagagaagagagacaaagagttcctgaagtccacgtttctcctggtttaccatgactgcgtgctcccacttctccactccacacgcctacccccattcaggtgggcagaagaagagactgagactgcacggtggaaagttatcactgacttccttaagcaaaaccaagaaaaccagggcgccctccaagctctgctgtcaccagacggagttcatgaaccttttgacctttcagagcagacctatgacttcttgggtgaaatgagaaagaatgcagtgtgacagtggcagcctctagccctcagcttcccacggaatcagatggatcctccacgattacgtgaataaaatgatggaacca

SEQ ID NO: 343598 - DNA, 2202 bp, Homo sapiens
tggcaactggagcaatcagagcaccgcagccagggagatgctggcgagacgacagcgagatcctctccaggccctgcggcgccgcaatcaggagctgaagcaacaggttgatagtttgctttctgagagccaactgaaagaagctctagaacccaataaaagacaacatatttatcaaagatgtatccagttaaagcaggcaatagatgaaaataaaaatgctcttcaaaaattaagcaaagctgatgaatctgcacctgttgcaaactataatcagagaaaagaagaggagcatactcttttggacaagcttacccaacaactgcagggccttgctgtgacaataagcagagaaaatataactgaagttggggcacctactgaagaagaggaagaaagtgaaagtgaagatagtgaagacagtggtggggaggaagaagatgcagaggaggaagaggaagagaaagaggaaaatgaatctcacaaatggtcaaccggtgaagaatacatcgctgttggagattttactgctcagcaagttggagatcttacatttaagaaaggggaaattctccttgtaattgaaaaaaaacctgatggttggtggatagctaaggatgccaaaggaaatgaaggtcttgttcccagaacctacctagagccttatagtgaagaagaagaaggccaagagtcaagtgaagagggcagtgaagaagatgtagaggcggtggatgaaacagcagatggagcagaagttaagcaaagaactgatccccactggagtgctgttcagaaagcgatttcagaggcgggcatcttctgtcttgttaatcatgtctcgttttgctacctaatagttctgatgcgaaataggatggagactgtggaagacaccaatggatctgaaacagggttcagggcatggaatgtacagagcagaggacgtatatttctggtttctaagcctgtgctccaaaataaacactgttgatgtgttaactacgatgggagctattcctgcagggttcaggccttccacgctctcacagcttctggaggaagggaatcaatttcgagcaaattacttcttacaaccagagctcatgccttcacaactggccttcagagatctgatgtgggatgctacagaaggcactattaggtcgagaccaagtcgtatttcattgattctgacattatggagctgtaaaatgattcctcttccaggaatgagcatacaggttctcagcagacatgtacgcctctgtctatttgatggtaataaggttctgagcaacattcatacagtcagagccacatggcaacctaaaaagcccaaaacatggaccttttctccccaggttactcgcatcttaccatgtttgcttgatggtgattgctttatcaggtctaattctgcatctccagatcttggaatattatttgaacttggaatttcttatattcgcaattcaactggtgaaagaggagagttaagctgtggctgggtgtttcttaaactttttgatgccagtggagttcctattccagcaaaaacttatgagcttttcttgaatggtggtactccttatgaaaaaggtattgaagtggacccttcaatatccagaagagcacacggcagtgttttctaccagattatgacaatgagaaggcagcctcaacttctagtgaaactgagatccttgaacagaagatcaagaaatgtactaagtctactgccagaaacattaattggaaatatgtgttctattcacttgttgatattttatcgacaaattcttggagatgtgctcctgaaagacaggatgagcttgcaaagtactgatttaattagccatcccatgctggccaccttccccatgctcttggagcagcctgatgtgatggatgctctcaggagttcgtgggctggaaaagaaagcacattaaaaagatcagagaaggtaaaatatgagtctccacactgaactccatatttgcagtacctggtgtttgcttgcctattctaatcatgtctcttttttagcaaaagtagccatagtcataatccctcttaaccagggaaactgtttcattatggctgcaaaaacacattccaagagggttacgcatgatcgttagctaatgtgagaaggaatacttgttcaagacagccatttcagattactgagttttatttaa

SEQ ID NO: 343599 - DNA, 1501 bp, Homo sapiens
tggcaactggagcaatcagagcaccgcagccagggagatgctggcgagacgacagcgagatcctctccaggccctgcggcgccgcaatcaggagctgaagcaacaggttgatagtttgctttctgagagccaactgaaagaagctctagaacccaataaaagacaacatatttatcaaagatgtatccagttaaagcaggcaatagatgaaaataaaaatgctcttcaaaaattaagcaaagctgatgaatctgcacctgttgcaaactataatcagagaaaagaagaggagcatactcttttggacaagcttacccaacaactgcagggccttgctgtgacaataagcagagaaaatataactgaagttggggcacctactgaagaagaggaagaaagtgaaagtgaagatagtgaagacagtggtggggaggaagaagatgcagaggaggaagaggaagagaaagaggaaaatgaatctcacaaatggtcaaccggtgaagaatacatcgctgttggagattttactgctcagcaagttggagatcttacatttaagaaaggggaaattctccttgtaattgaaaaaaaacctgatggttggtggatagctaaggatgccaaaggaaatgaaggtcttgttcccagaacctacctagagccttatagtgaagaagaagaaggccaagagtcaagtgaagagggcagtgaagaagatgtagaggcggtggatgaaacagcagatggagcagaagttaagcaaagaactgatccccactggagtgctgttcagaaagcgatttcagaggcgggcatcttctgtcttgttaatcatgtctcgttttgctacctaatagttctgatgcgaaataggatggagactgtggaagacaccaatggatctgaaacagggttcagggcatggaatgtacagagcagaggacgtatatttctggtttctaagcctgtgctccaaaataaacactgttgatgtgttaactacgatgggagctattcctgcagggttcaggccttccacgctctcacagcttctggaggaagggaatcaatttcgagcaaattacttcttacaaccagagctcatgccttcacaactggccttcagagatctgatgtgggatgctacagaaggcactattaggtcgagaccaagtcgtatttcattgattctgacattatggagctgtaaaatgattcctcttccaggaatgagcatacaggttctcagcagacatgtacgcctctgtctatttgatggtaataaggtaaggttactgagaagtaaatcaattcatactaggattatggagaaacattcccttagattcttttccattcaactcctccccaattcccaagagagtattttttacctagtaccaaagaaaaatttgaatgactctttgaaaaattcattttttaaatgagatacaggttaaacagtacttagatggaaatttatagttttaattgtgtatat

SEQ ID NO: 343600 - DNA, 758 bp, Homo sapiens
agaacacctgctacaattatcttagataacatgacagttacctctgatatgctgtcagtaagtaggttcagctgacttggcattgttttagttatatttacccctaaccacactggtgtcaccaaaattagactgcaataccttgacagaatgtgtgagacaccctccatggagcttaggagacaccctggtctcatggagccacgtagaggctctcagggagaactgctccactgtactctgtgtaactctgctcacttccacttctgaagtgccatgtcctgcctgagcagctggctcagagccgatacctgccaggcactaatggcaccctccatcctacctcttaggtggcttttagttaatagagttcacagaatttaacactttaaaaataacaatgttatttgtgggggtggtgttttcccagagagacaaagagttcctgaagtccacgtttctcctggtttaccatgactgcgtgctcccacttctccactccacacgcctacccccattcaggtgggcagaagaagagactgagactgcacggtggaaagttatcactgacttccttaagcaaaaccaagaaaaccagggcgccctccaagctctgctgtcaccagacggagttcatgaaccttttgacctttcagagcagacctatgacttcttgggtgaaatgagaaagaatgcagtgtgacagtggcagcctctagccctcagcttcccacggaatcagatggatcctccacgat

SEQ ID NO: 343601 - DNA, 526 bp, Homo sapiens
aatttacctaaaatgactgatttaattttcaatgaacagagtattgaaacttttattgtatatgtgtaaattttttcttttttaaaaattctgtatacattttcataagccgaattcacaaaagacagatttgtgttagaaatcataaaaataaacttttttataactaatttttctttcagattaggtcgagaccaagtcgtatttcattgattctgacattatggagctgtaaaatgattcctcttccaggaatgagcatacaggttctcagcagacatgtacgcctctgtctatttgatggtaataaggtaaggttactgagaagtaaatcaattcatactaggattatggagaaacattcccttagattcttttccattcaactcctccccaattcccaagagagtattttttacctagtaccaaagaaaaatttgaatgactctttgaaaaattcattttttaaatgagatacaggttaaacagtacttagatggaaatttatagttttaattgtgtatat

SEQ ID NO: 343602 - DNA, 861 bp, Homo sapiens
  misc_feature (759)..(760): n is a, c, g, or t
  misc_feature (764)..(764): n is a, c, g, or t
  misc_feature (769)..(769): n is a, c, g, or t
  misc_feature (775)..(775): n is a, c, g, or t
  misc_feature (778)..(778): n is a, c, g, or t
  misc_feature (787)..(787): n is a, c, g, or t
  misc_feature (799)..(800): n is a, c, g, or t
  misc_feature (805)..(805): n is a, c, g, or t
  misc_feature (807)..(807): n is a, c, g, or t
  misc_feature (810)..(810): n is a, c, g, or t
  misc_feature (812)..(813): n is a, c, g, or t
tggcaactggagcaatcagagcaccgcagccagggagatgctggcgagacgacagcgagatcctctccaggccctgcggcgccgcaatcaggagctgaagcaacaggttgatagtttgctttctgagagccaactgaaagaagctctagaacccaataaaagacaacatatttatcaaagatgtatccagttaaagcaggcaatagatgaaaataaaaatgctcttcaaaaattaagcaaagctgatgaatctgcacctgttgcaaactataatcagagaaaagaagaggagcatactcttttggacaagcttacccaacaactgcagggccttgctgtgacaataagcagagaaaatataactgagtatgcttcctttctacctttcttttttcttttttaaagatatatcaccaatagctttaatgtttaactcaaagacatatagcagtatagatataaacaaatgacactaacaatagaatcagtcaacatttatttattgtgtataatagaaggtgttagatcccatgagagatggaaagaagtgtaagtcatagtctctgccctcaggcaatttataatttagttgaaacaaaacagagatctgaaaagctaaatgaacaaatgttagaaaataaagatgatatatttaatgtcaatgttgatgtgtaaaagggaaatgatttggaatgtctacttgcattgttctccctttcataaacattcttaaaattcaaaacaaaaaaaaaaaaattnngggngcggncggaanttntaacattgntggggcggcagnnagaangncangnncagaaccggggaagggggtttcaaaaaccggggcgggggaaaaggggg

SEQ ID NO: 343603 - DNA, 3804 bp, Homo sapiens
tggcaactggagcaatcagagcaccgcagccagggagatgctggcgagacgacagcgagatcctctccaggccctgcggcgccgcaatcaggagctgaagcaacaggttgatagtttgctttctgagagccaactgaaagaagctctagaacccaataaaagacaacatatttatcaaagatgtatccagttaaagcaggcaatagatgaaaataaaaatgctcttcaaaaattaagcaaagctgatgaatctgcacctgttgcaaactataatcagagaaaagaagaggagcatactcttttggacaagcttacccaacaactgcagggccttgctgtgacaataagcagagaaaatataactgaagttggggcacctactgaagaagaggaagaaagtgaaagtgaagatagtgaagacagtggtggggaggaagaagatgcagaggaggaagaggaagagaaagaggaaaatgaatctcacaaatggtcaaccggtgaagaatacatcgctgttggagattttactgctcagcaagttggagatcttacatttaagaaaggggaaattctccttgtaattgaaaaaaaacctgatggttggtggatagctaaggatgccaaaggaaatgaaggtcttgttcccagaacctacctagagccttatagtgaagaagaagaaggccaagagtcaagtgaagagggcagtgaagaagatgtagaggcggtggatgaaacagcagatggagcagaagttaagcaaagaactgatccccactggagtgctgttcagaaagcgatttcagaggcgggcatcttctgtcttgttaatcatgtctcgttttgctacctaatagttctgatgcgaaataggatggagactgtggaagacaccaatggatctgaaacagggttcagggcatggaatgtacagagcagaggacgtatatttctggtttctaagcctgtgctccaaaataaacactgttgatgtgttaactacgatgggagctattcctgcagggttcaggccttccacgctctcacagcttctggaggaagggaatcaatttcgagcaaattacttcttacaaccagagctcatgccttcacaactggccttcagagatctgatgtgggatgctacagaaggcactattaggtcgagaccaagtcgtatttcattgattctgacattatggagctgtaaaatgattcctcttccaggaatgagcatacaggttctcagcagacatgtacgcctctgtctatttgatggtaataaggttctgagcaacattcatacagtcagagccacatggcaacctaaaaagcccaaaacatggaccttttctccccaggttactcgcatcttaccatgtttgcttgatggtgattgctttatcaggtctaattctgcatctccagatcttggaatattatttgaacttggaatttcttatattcgcaattcaactggtgaaagaggagagttaagctgtggctgggtgtttcttaaactttttgatgccagtggagttcctattccagcaaaaacttatgagcttttcttgaatggtggtactccttatgaaaaaggtattgaagtggacccttcaatatccagaagagcacacggcagtgttttctaccagattatgacaatgagaaggcagcctcaacttctagtgaaactgagatccttgaacagaagatcaagaaatgtactaagtctactgccagaaacattaattggaaatatgtgttctattcacttgttgatattttatcgacaaattcttggagatgtgctcctgaaagacaggatgagcttgcaaagtactgatttaattagccatcccatgctggccaccttccccatgctcttggagcagcctgatgtgatggatgctctcaggagttcgtgggctggaaaagaaagcacattaaaaagatcagagaagctctcaaagcctgtatcaccaagagaagggaaaaaaaaatggcctgagctgtaccatatattgaaaacaatgcattgctcctgcttaccttgctataaaatcatgagagacaaagagttcctgaagtccacgtttctcctggtttaccatgactgcgtgctcccacttctccactccacacgcctacccccattcaggtgggcagaagaagagactgagactgcacggtggaaagttatcactgacttccttaagcaaaaccaagaaaaccagggcgccctccaagctctgctgtcaccagacggagttcatgaaccttttgacctttcagagcagacctatgacttcttgggtgaaatgagaaagaatgcagtgtgacagtggcagcctctagccctcagcttcccacggaatcagatggatcctccacgattacgtgaataaaatgatggaaccaaaaatcactgtcactttacaacttaggttttactcttttctttctacagaccatatttttaaagaaatgtttatacaataatttaaatattttttaaaaccataaaataaatttttataaggaatactgttatatctaaatttaaacagtatttattttttcaaaaacagctacttaagttaatggtatagatttctataaaagcaagattttgtcaaaaactaaatttatgattattcaagaaagtgaaaaaaacaacctacagaatgggaaaacatatttgcaaatcatctaactgataaaggtctagtatccaaaatatttaaatttatgagtgttaataaaatttatcttgttcaatgaagaggaagttaaagtgatccatttgagaaagttgtatcacttaattcagtctgatacttgaatgtgatttacccctaattaagtacaaaaacagagtcgcttttgccttttcaaatcaagaaaataagtgctctgtcaaaagcacaaaaagaaactttcaggcactggagagtggagtcgactcaccctttcaggccttgttgcatctcagataaacctgtgactgctggtaaaataatgtcccaagcctttccttttagtgataaacagtagcagcctgcgttaattgagcacctactgtgtgtctgagcatttctcattagcccagttaatcctcacacctactgtaggagataggtactgttgttttttattaccgccgaagaaacaggccagataagtgaagtaatttgcctaaggtcacagctaataagtggcacagctaatattcccagtaaagataccatgtataattttctacaacctaagatgttctgccttatcggggcgaaccttttaggattccatgtgaaaataaaatatgaggaaaagtttaacctaaataattagaatcccattagaggtacttttttttgatggcatgctgccttaaaagagccatttatttttagagatctgtcatattatgaaagttctgggctatcttagctaacttatcctaaacccttaacctaaatttaacttgagccccagtctcagaaattaacatggtatgaaagtgtttccaggccaggcgcggtggctcacgcctgtaatcccaacactttgggaggccgaggtgggtggatcacctgaggtcaggagtttgagaccagcctggccaacactatctgtactaaaaacacaaaattagctgggtgtggtagtgcgtgcctgtgatcccagctacttgggaggctgaggtagaagaattgtttgaacctgggaggtggaggttgcagtgagccaagatcgtgccattgcactccagcctaggcaacaagagtgaaactccatctc

SEQ ID NO: 343604 - DNA, 3834 bp, Homo sapiens
tggcaactggagcaatcagagcaccgcagccagggagatgctggcgagacgacagcgagatcctctccaggccctgcggcgccgcaatcaggagctgaagcaacaggttgatagtttgctttctgagagccaactgaaagaagctctagaacccaataaaagacaacatatttatcaaagatgtatccagttaaagcaggcaatagatgaaaataaaaatgctcttcaaaaattaagcaaagctgatgaatctgcacctgttgcaaactataatcagagaaaagaagaggagcatactcttttggacaagcttacccaacaactgcagggccttgctgtgacaataagcagagaaaatataactgaagttggggcacctactgaagaagaggaagaaagtgaaagtgaagatagtgaagacagtggtggggaggaagaagatgcagaggaggaagaggaagagaaagaggaaaatgaatctcacaaatggtcaaccggtgaagaatacatcgctgttggagattttactgctcagcaagttggagatcttacatttaagaaaggggaaattctccttgtaattgaaaaaaaacctgatggttggtggatagctaaggatgccaaaggaaatgaaggtcttgttcccagaacctacctagagccttatagtgaagaagaagaaggccaagagtcaagtgaagagggcagtgaagaagatgtagaggcggtggatgaaacagcagatggagcagaagttaagcaaagaactgatccccactggagtgctgttcagaaagcgatttcagaggcgggcatcttctgtcttgttaatcatgtctcgttttgctacctaatagttctgatgcgaaataggatggagactgtggaagacaccaatggatctgaaacagggttcagggcatggaatgtacagagcagaggacgtatatttctggtttctaagcctgtgctccaaaataaacactgttgatgtgttaactacgatgggagctattcctgcagggttcaggccttccacgctctcacagcttctggaggaagggaatcaatttcgagcaaattacttcttacaaccagagctcatgccttcacaactggccttcagagatctgatgtgggatgctacagaaggcactattaggtcgagaccaagtcgtatttcattgattctgacattatggagctgtaaaatgattcctcttccaggaatgagcatacaggttctcagcagacatgtacgcctctgtctatttgatggtaataaggttctgagcaacattcatacagtcagagccacatggcaacctaaaaagcccaaaacatggaccttttctccccaggttactcgcatcttaccatgtttgcttgatggtgattgctttatcaggtctaattctgcatctccagatcttggaatattatttgaacttggaatttcttatattcgcaattcaactggtgaaagaggagagttaagctgtggctgggtgtttcttaaactttttgatgccagtggagttcctattccagcaaaaacttatgagcttttcttgaatggtggtactccttatgaaaaaggtattgaagtggacccttcaatatccagaagagcacacggcagtgttttctaccagattatgacaatgagaaggcagcctcaacttctagtgaaactgagatccttgaacagaagatcaagaaatgtactaagtctactgccagaaacattaattggaaatatgtgttctattcacttgttgatattttatcgacaaattcttggagatgtgctcctgaaagacaggatgagcttgcaaagtactgatttaattagccatcccatgctggccaccttccccatgctcttggagcagcctgatgtgatggatgctctcaggagttcgtgggctggaaaagaaagcacattaaaaagatcagagaagctctcaaagcctgtatcaccaagagaagggaaaaaaaaatggcctgagctgtaccatatattgaaaacaatgcattgctcctgcttaccttgctataaaatcatggtaattaccaatccgaacttgctttaatcgagagacaaagagttcctgaagtccacgtttctcctggtttaccatgactgcgtgctcccacttctccactccacacgcctacccccattcaggtgggcagaagaagagactgagactgcacggtggaaagttatcactgacttccttaagcaaaaccaagaaaaccagggcgccctccaagctctgctgtcaccagacggagttcatgaaccttttgacctttcagagcagacctatgacttcttgggtgaaatgagaaagaatgcagtgtgacagtggcagcctctagccctcagcttcccacggaatcagatggatcctccacgattacgtgaataaaatgatggaaccaaaaatcactgtcactttacaacttaggttttactcttttctttctacagaccatatttttaaagaaatgtttatacaataatttaaatattttttaaaaccataaaataaatttttataaggaatactgttatatctaaatttaaacagtatttattttttcaaaaacagctacttaagttaatggtatagatttctataaaagcaagattttgtcaaaaactaaatttatgattattcaagaaagtgaaaaaaacaacctacagaatgggaaaacatatttgcaaatcatctaactgataaaggtctagtatccaaaatatttaaatttatgagtgttaataaaatttatcttgttcaatgaagaggaagttaaagtgatccatttgagaaagttgtatcacttaattcagtctgatacttgaatgtgatttacccctaattaagtacaaaaacagagtcgcttttgccttttcaaatcaagaaaataagtgctctgtcaaaagcacaaaaagaaactttcaggcactggagagtggagtcgactcaccctttcaggccttgttgcatctcagataaacctgtgactgctggtaaaataatgtcccaagcctttccttttagtgataaacagtagcagcctgcgttaattgagcacctactgtgtgtctgagcatttctcattagcccagttaatcctcacacctactgtaggagataggtactgttgttttttattaccgccgaagaaacaggccagataagtgaagtaatttgcctaaggtcacagctaataagtggcacagctaatattcccagtaaagataccatgtataattttctacaacctaagatgttctgccttatcggggcgaaccttttaggattccatgtgaaaataaaatatgaggaaaagtttaacctaaataattagaatcccattagaggtacttttttttgatggcatgctgccttaaaagagccatttatttttagagatctgtcatattatgaaagttctgggctatcttagctaacttatcctaaacccttaacctaaatttaacttgagccccagtctcagaaattaacatggtatgaaagtgtttccaggccaggcgcggtggctcacgcctgtaatcccaacactttgggaggccgaggtgggtggatcacctgaggtcaggagtttgagaccagcctggccaacactatctgtactaaaaacacaaaattagctgggtgtggtagtgcgtgcctgtgatcccagctacttgggaggctgaggtagaagaattgtttgaacctgggaggtggaggttgcagtgagccaagatcgtgccattgcactccagcctaggcaacaagagtgaaactccatctc

SEQ ID NO: 343605 - DNA, 1236 bp, Homo sapiens
tggcaactggagcaatcagagcaccgcagccagggagatgctggcgagacgacagcgagatcctctccaggccctgcggcgccgcaatcaggagctgaagcaacaggttgatagtttgctttctgagagccaactgaaagaagctctagaacccaataaaagacaacatatttatcaaagatgtatccagttaaagcaggcaatagatgaaaataaaaatgctcttcaaaaattaagcaaagctgatgaatctgcacctgttgcaaactataatcagagaaaagaagaggagcatactcttttggacaagcttacccaacaactgcagggccttgctgtgacaataagcagagaaaatataactgaagttggggcacctactgaagaagaggaagaaagtgaaagtgaagatagtgaagacagtggtggggaggaagaagatgcagaggaggaagaggaagagaaagaggaaaatgaatctcacaaatggtcaaccggtgaagaatacatcgctgttggagattttactgctcagcaagttggagatcttacatttaagaaaggggaaattctccttgtaattgaaaaaaaacctgatggttggtggatagctaaggatgccaaaggaaatgaaggtcttgttcccagaacctacctagagccttatagtgaagaagaagaaggccaagagtcaagtgaagagggcagtgaagaagatgtagaggcggtggatgaaacagcagatggagcagaagttaagcaaagaactgatccccactggagtgctgttcagaaagcgatttcagaggcgggcatcttctgtcttgttaatcatgtctcgttttgctacctaatagttctgatgcgaaataggatggagactgtggaagacaccaatggatctgaaacagggttcagggcatggaatgtacagagcagaggacgtatatttctggtttctaagcctgtgctccaagtaacatttctcattagtttttttttttttttgtacaaaaagaatagataattcatggtgtcacttgaggacttggaaacattctcattgatcctgctttcctatcatttgagtggaaacagatgttaaattttatttactattcgaaaaatcctgaaagcctttaataaaaagtaagaaattggccaggcatggtgattcacactggtaatcccaacattttgggaagctgaagcaggaggatcacttgaggccaggaa

SEQ ID NO: 343606 - DNA, 469 bp, Homo sapiens
aggggcttcagacaaaggtgagcttgtggttctgaaacttttattctcccctactgcccaagtctgtccactacctccaatggtgagtcacggagatttcgtctgccacccgcggccttgtgagcgctacaaccacggaactgtggtggagttttactgcgatcctggctacagcctcaccagcgactacaagtacatcacctgccagtatggagagtggtttccttcttatcaagtctactgcatcaaatcagagcaaacgtggcccagcacccatgagaccctcctgaccacgtggaagattgtggcgttcacggcaaccagtgtgctgctggtgctgctgctcgtcatcctggccaggatgttccagaccaagttcaaggcccactttccccccagggggcctccccggagttccagcagtgaccctgactttgtggtggtagacggcgtgcccgtcatgctcccg

SEQ ID NO: 343607 - DNA, 578 bp, Homo sapiens
  misc_feature (8)..(8): n is a, c, g, or t
aggaatgnggcttaatttcctccaggtaaaagcttttaatgtaaagaactgtgaaccacctgtaataatagtgtggaactcggtaacaaactatttgacagtgttttcttggaaagtgggttataaatcggtatattggtgtataagctcttctttgtggaaatgcaatttttatactaaaaacattgcttatttgcaatgcaatatgttataaatttgttgtttatattactggtattagtcttagcctaatgaacctaattatttttctttctgtattctttgcttcctcaaatagcatctgcagcaattggaatgagaaatccagatatgtgtttcaagtagtacattgcctgaatcacaaatcacttgatcacagtattgtatataatccctgatcctatttgtttcattttattgtaaattcccatttgcatcaaaacctaatgatagtgattggtaagtaaaaacaaatggtgtattgcttttcatacaagtgttttcacaaaagccatttgcctaggcagcaaaaaatattaatttgttaaaaaaaattttccttcgtgtccatcctcaaa

SEQ ID NO: 343608 - DNA, 6160 bp, Homo sapiens
  misc_feature (4375)..(4375): n is a, c, g, or t
cgtggcctgcgggacgggcaagcggcgataagaggtggcgtcctccgcggcattgcgagcaccgccagtctgcgccgctaggcgtaggcggggtggcccttgcgtctcccgcttccttgaaaaacccggcgggcgagcgaggctgcgggccggccgctgcccttccccacactccccgccgagaagcctcgctcggcgcccaacatggcgggtgggcgctgcggcccgcagctaacggcgctcctggccgcctggatcgcggctgtggcggcgacggcaggccccgaggaggccgcgctgccgccggagcagagccgggtccagcccatgaccgcctccaactggacgctggtgatggagggcgagtggatgctgaaattttacgccccatggtgtccatcctgccagcagactgattcagaatgggaggcttttgcaaagaatggtgaaatacttcagatcagtgtggggaaggtagatgtcattcaagaaccaggtttgagtggccgcttctttgtcaccactctcccagcattttttcatgcaaaggatgggatattccgccgttatcgtggcccaggaatcttcgaagacctgcagaattatatcttagagaagaaatggcaatcagtcgagcctctgactggctggaaatccccggcttctctaacgatgtctggaatggctggtctttttagcatctctggcaagatatggcatcttcacaactatttcacagtgactcttggaattcctgcttggtgttcttatgtctttttcgtcatagccaccttggtttttggcctttttatgggtctggtcttggtggtaatatcagaatgtttctatgtgccacttccaaggcatttatctgagcgttctgagcagaatcggagatcagaggaggctcatagagctgaacagttgcaggatgcggaggaggaaaaagatgattcaaatgaagaagaaaacaaagacagccttgtagatgatgaagaagagaaagaagatcttggcgatgaggatgaagcagaggaagaagaggaggaggacaacttggctgctggtgtggatgaggagagaagtgaggccaatgatcaggggcccccaggagaggacggtgtgacccgggaggaagtagagcctgaggaggctgaagaaggcatctctgagcaaccctgcccagctgacacagaggtggtggaagactccttgaggcagcgtaaaagtcagcatgctgacaagggactgtagatttaatgatgcgttttcaagaatacacaccaaaacaatatgtcagcttccctttggcctgcagtttgtaccaaatccttaatttttcctgaatgagcaagcttctcttaaaagatgctctctagtcatttggtctcatggcagtaagcctcatgtatactaaggagagtcttccaggtgtgacaatcaggatatagaaaaacaaacgtagtgttgggatctgtttggagactgggatgggaacaagttcatttacttaggggtcagagagtctcgaccagaggaggccattcccagtcctaatcagcaccttccagagacaaggctgcaggccctgtgaaatgaaagccaagcaggagccttggctcctgagcatccccaaagtgtaacgtagaagccttgcatccttttcttgtgtaaagtatttatttttgtcaaattgcaggaaacatcaggcaccacagtgcatgaaaaatctttcacagctagaaattgaaagggccttgggtatagagagcagctcagaagtcatcccagccctctgaatctcctgtgctatgttttatttcttacctttaatttttccagcatttccaccatgggcattcaggctctccacactcttcactattatctcttggtcagaggactccaataacagccaggtttacatgaactgtgtttgttcattctgacctaaggggtttagataatcagtaaccataacccctgaagctgtgactgccaaacatctcaaatgaaatgttgtggccatcagagactcaaaaggaagtaaggattttacaagacagattaaaaaaaaattgttttgtccaaaatatagttgttgttgatttttttttaagttttctaagcaatatttttcaagccagaagtcctctaagtcttgccagtacaaggtagtcttgtgaagaaaagttgaatactgttttgttttcatctcaaggggttccctgggtcttgaactactttaataataactaaaaaaccacttctgattttccttcagtgatgtgcttttggtgaaagaattaatgaactccagtacctgaaagtgaaagatttgattttgtttccatcttctgtaatcttccaaagaattatatctttgtaaatctctcaatactcaatctactgtaagtacccagggaggctaatttccttaaaaaaaaaaaatctatccatctacttctctcttacctgatttatgtgttagaataaattcatgaaattcgattccaagcatacgaaagatgcctaaagttgattctatgctccttagatccagacagaataatgagtacaggtttatgaaattctaaaagtttctgtcgtctttaaaaaggaacgtgcagtatatttctatctggctgtttagataaccctttccttgtattaattgtgagcacggagctcactggtgggggaggttctgaaactctctgccctcctgtggttgaatgaagatgttgcaagacttgcacaaaggaggttattcttctgacagcatcaacttttagagatggttctttttcatctttccaattcagttacttgacagtctccttccccagtatgctgaagtttgttaagagtcaccagtaattgtgcttttcagacagtagtgcagcttcaaaatcgaggccatcactgggctgatgggctgggagaaccttgccatgtgcctgcctgtttcctgcccccttagtcactgcccatttcctgcccccttggtcgctgacacaccttcacccaaagtgccatggttctgatggtggcagttccatctccctgacatcaggaagcttttctcgatcagagcagagcggggcctgcctgccctcgtgtcactggatttctttctcttataatcagctgaaacagagttctcaaagaacagtaaactcaggttcagaggtattatggaataagaatggtttcatagtttggcttttctatataattcctccctctcaaactgaaatattcatttttttagtggagtatttgactagagagaaggtaaggcagaaatacagtctacactggcttttaaaaatgtaaagccaatttccaaccggaccccaaatagtacaggttgaacattccgttccaacaatccaaaaccccaaatgctccaaaatcttaaactttgagttccagcattccgtcagaagtggaaaattttacacctgacctcatttgacaggtggcagttacagtgcaatcaaaactttgttccatgcccaagattattaaaaatattggataaaattaccttcaagctatgttgtataaggtgtatataaaacaaatgaattttgtgtttagacttgggtctactcccaagatacctcattatatatatacaaaaatccccaaatccaaaaacatttgaaacacttctggtcccacacattttggataagggatatttgacctatatctaattatataataagaaaaatgtattttcttttttttttttttttgagatggagtttcactcttgttgtcgcccaggctgcaatggcacaatcttggcttactacaacctccgcctccctagttcaagggattctcctgcctcagcctcccaggtagctgggattacaggcatgtgccaccatgcctggctaattttgtatttttagtagagacggggtttcgccatgttggtcagactggtcttgaactcctgacctcaggtgatccgcccgcctcagcctcccaacgtgctgggattacaggtgtgagccaccgtacctggcagaaaatgtactttctttctcagaaatacttttaaaaaaaattgaagggtgaggagaaaaacatcttggagaagaggacccattaaaactttaaatatctgtgggaaccatttttcctgattttcccttttttaacatcatggcaaagatgggtttttttccaacaaaatttaatttaatatctttccacttgaagattttaggtttgttttcaatacttaatgaatataaaactaaaggagaaaagccaacctgaaataatttaaactttatatgaacatttcgataagagtttgtggattttttctgtagataatatatttgatccngaactcaagtgcatggaaacatgattttgatttttaaaatctaaaaaaaaaaaaaattaaaatcatgcttccctctattgcagtatcagttatttagtcacagaatggtattttatgtaaattaaaattaggtgaatgcaatgcaggtaactggttttggaatgggaatgtgcagtgctttatgtttggggagttggagcagggtatcttttcatcaattagaaggaaagtttgaaacttctgattacctttatgttggtttctcttattatttgtctcttgctagatctgctaaaccaacccagcttgctcagagatctcatattgaagcaacatacaggcaatccacatctttctttccctttgaagtatagtcattggatgggatgagggacagggcctgttgggttcacagggccttgcactgcatgggcacatacttaaaagctcttgtgcatggaatccctgtctgttagccacaggcctctttagctctatacattcaaaataactactgtagtagaaaatagataagcttcagctgagttggcttttgatagtggaaaaaaaacaaaatttgactttttatggccaaaattccttgttgacagctgtgatgttctaatatgatttgggaatatgtcagtctacagaacctgcatcctgtaaaaacacctttggggtagacgataaaagtcatttttaaggcaaatacttaccatgtgactttttattaccaaatgcatcagtagtggagctggtatgttgtttcataggatggaaacattagaagtccagagaaaaataaattttaaaaaaaggtggaaaagttacggcaaacctgagatttcagcataaaatctttagtatgaagtgagagaaagaagagggaggctggttctgttgctcgtatcaataggttatctgtgtccctcatcttggtgttacagtgttatttctgtcagtattatgaatatgtggttgacccatcctgtcaaatgtaccaacattttcgaaagaattcattcaaatctcttatgccaacagaaaagttccttcttgtttaatatctctttacctcagtcctacattttgattctctggaggagattttagcttgtcttaaaaagccaaatttggagtcatcaagcctgctgaacctgatggggcagctttttgaacagctttctggaagtaagaacttcagttgaaaagccctttgatcgcttcagcccgggacatgcccttcagatggcttattctcagtaaagctttatgtagactgtgacactgtatatgtgtgactcgtacaactttgacgtgtttctgaagtggtttaatcgtatttgttattagcttctttgtggaaatgcaatttttatactaaaaacattgcttatttgcaatgcaatatgttataaatttgttgtttatattactggtattagtcttagcctaatgaacctaattatttttctttctgtattctttgcttcctcaaatagcatctgcagcaattggaatgagaaatccagatatgtgtttcaagtagtacattgcctgaatcacaaatcacttgatcacagtattgtatataatccctgatcctatttgtttcattttattgtaaattcccatttgcatcaaaacctaatgatagtgattggtaagtaaaaacaaatggtgtattgcttttcatacaagtgttttcacaaaagccatttgcctaggcagcaaaaaatattaatttgttaaaaaaaattttccttcgtgtccatcctcaaa

SEQ ID NO: 343609 - DNA, 6100 bp, Homo sapiens
  misc_feature (4375)..(4375): n is a, c, g, or t
cgtggcctgcgggacgggcaagcggcgataagaggtggcgtcctccgcggcattgcgagcaccgccagtctgcgccgctaggcgtaggcggggtggcccttgcgtctcccgcttccttgaaaaacccggcgggcgagcgaggctgcgggccggccgctgcccttccccacactccccgccgagaagcctcgctcggcgcccaacatggcgggtgggcgctgcggcccgcagctaacggcgctcctggccgcctggatcgcggctgtggcggcgacggcaggccccgaggaggccgcgctgccgccggagcagagccgggtccagcccatgaccgcctccaactggacgctggtgatggagggcgagtggatgctgaaattttacgccccatggtgtccatcctgccagcagactgattcagaatgggaggcttttgcaaagaatggtgaaatacttcagatcagtgtggggaaggtagatgtcattcaagaaccaggtttgagtggccgcttctttgtcaccactctcccagcattttttcatgcaaaggatgggatattccgccgttatcgtggcccaggaatcttcgaagacctgcagaattatatcttagagaagaaatggcaatcagtcgagcctctgactggctggaaatccccggcttctctaacgatgtctggaatggctggtctttttagcatctctggcaagatatggcatcttcacaactatttcacagtgactcttggaattcctgcttggtgttcttatgtctttttcgtcatagccaccttggtttttggcctttttatgggtctggtcttggtggtaatatcagaatgtttctatgtgccacttccaaggcatttatctgagcgttctgagcagaatcggagatcagaggaggctcatagagctgaacagttgcaggatgcggaggaggaaaaagatgattcaaatgaagaagaaaacaaagacagccttgtagatgatgaagaagagaaagaagatcttggcgatgaggatgaagcagaggaagaagaggaggaggacaacttggctgctggtgtggatgaggagagaagtgaggccaatgatcaggggcccccaggagaggacggtgtgacccgggaggaagtagagcctgaggaggctgaagaaggcatctctgagcaaccctgcccagctgacacagaggtggtggaagactccttgaggcagcgtaaaagtcagcatgctgacaagggactgtagatttaatgatgcgttttcaagaatacacaccaaaacaatatgtcagcttccctttggcctgcagtttgtaccaaatccttaatttttcctgaatgagcaagcttctcttaaaagatgctctctagtcatttggtctcatggcagtaagcctcatgtatactaaggagagtcttccaggtgtgacaatcaggatatagaaaaacaaacgtagtgttgggatctgtttggagactgggatgggaacaagttcatttacttaggggtcagagagtctcgaccagaggaggccattcccagtcctaatcagcaccttccagagacaaggctgcaggccctgtgaaatgaaagccaagcaggagccttggctcctgagcatccccaaagtgtaacgtagaagccttgcatccttttcttgtgtaaagtatttatttttgtcaaattgcaggaaacatcaggcaccacagtgcatgaaaaatctttcacagctagaaattgaaagggccttgggtatagagagcagctcagaagtcatcccagccctctgaatctcctgtgctatgttttatttcttacctttaatttttccagcatttccaccatgggcattcaggctctccacactcttcactattatctcttggtcagaggactccaataacagccaggtttacatgaactgtgtttgttcattctgacctaaggggtttagataatcagtaaccataacccctgaagctgtgactgccaaacatctcaaatgaaatgttgtggccatcagagactcaaaaggaagtaaggattttacaagacagattaaaaaaaaattgttttgtccaaaatatagttgttgttgatttttttttaagttttctaagcaatatttttcaagccagaagtcctctaagtcttgccagtacaaggtagtcttgtgaagaaaagttgaatactgttttgttttcatctcaaggggttccctgggtcttgaactactttaataataactaaaaaaccacttctgattttccttcagtgatgtgcttttggtgaaagaattaatgaactccagtacctgaaagtgaaagatttgattttgtttccatcttctgtaatcttccaaagaattatatctttgtaaatctctcaatactcaatctactgtaagtacccagggaggctaatttccttaaaaaaaaaaaatctatccatctacttctctcttacctgatttatgtgttagaataaattcatgaaattcgattccaagcatacgaaagatgcctaaagttgattctatgctccttagatccagacagaataatgagtacaggtttatgaaattctaaaagtttctgtcgtctttaaaaaggaacgtgcagtatatttctatctggctgtttagataaccctttccttgtattaattgtgagcacggagctcactggtgggggaggttctgaaactctctgccctcctgtggttgaatgaagatgttgcaagacttgcacaaaggaggttattcttctgacagcatcaacttttagagatggttctttttcatctttccaattcagttacttgacagtctccttccccagtatgctgaagtttgttaagagtcaccagtaattgtgcttttcagacagtagtgcagcttcaaaatcgaggccatcactgggctgatgggctgggagaaccttgccatgtgcctgcctgtttcctgcccccttagtcactgcccatttcctgcccccttggtcgctgacacaccttcacccaaagtgccatggttctgatggtggcagttccatctccctgacatcaggaagcttttctcgatcagagcagagcggggcctgcctgccctcgtgtcactggatttctttctcttataatcagctgaaacagagttctcaaagaacagtaaactcaggttcagaggtattatggaataagaatggtttcatagtttggcttttctatataattcctccctctcaaactgaaatattcatttttttagtggagtatttgactagagagaaggtaaggcagaaatacagtctacactggcttttaaaaatgtaaagccaatttccaaccggaccccaaatagtacaggttgaacattccgttccaacaatccaaaaccccaaatgctccaaaatcttaaactttgagttccagcattccgtcagaagtggaaaattttacacctgacctcatttgacaggtggcagttacagtgcaatcaaaactttgttccatgcccaagattattaaaaatattggataaaattaccttcaagctatgttgtataaggtgtatataaaacaaatgaattttgtgtttagacttgggtctactcccaagatacctcattatatatatacaaaaatccccaaatccaaaaacatttgaaacacttctggtcccacacattttggataagggatatttgacctatatctaattatataataagaaaaatgtattttcttttttttttttttttgagatggagtttcactcttgttgtcgcccaggctgcaatggcacaatcttggcttactacaacctccgcctccctagttcaagggattctcctgcctcagcctcccaggtagctgggattacaggcatgtgccaccatgcctggctaattttgtatttttagtagagacggggtttcgccatgttggtcagactggtcttgaactcctgacctcaggtgatccgcccgcctcagcctcccaacgtgctgggattacaggtgtgagccaccgtacctggcagaaaatgtactttctttctcagaaatacttttaaaaaaaattgaagggtgaggagaaaaacatcttggagaagaggacccattaaaactttaaatatctgtgggaaccatttttcctgattttcccttttttaacatcatggcaaagatgggtttttttccaacaaaatttaatttaatatctttccacttgaagattttaggtttgttttcaatacttaatgaatataaaactaaaggagaaaagccaacctgaaataatttaaactttatatgaacatttcgataagagtttgtggattttttctgtagataatatatttgatccngaactcaagtgcatggaaacatgattttgatttttaaaatctaaaaaaaaaaaaaattaaaatcatgcttccctctattgcagtatcagttatttagtcacagaatggtattttatgtaaattaaaattaggtgaatgcaatgcaggtaactggttttggaatgggaatgtgcagtgctttatgtttggggagttggagcagggtatcttttcatcaattagaaggaaagtttgaaacttctgattacctttatgttggtttctcttattatttgtctcttgctagatctgctaaaccaacccagcttgctcagagatctcatattgaagcaacatacaggcaatccacatctttctttccctttgaagtatagtcattggatgggatgagggacagggcctgttgggttcacagggccttgcactgcatgggcacatacttaaaagctcttgtgcatggaatccctgtctgttagccacaggcctctttagctctatacattcaaaataactactgtagtagaaaatagataagcttcagctgagttggcttttgatagtctaatatgatttgggaatatgtcagtctacagaacctgcatcctgtaaaaacacctttggggtagacgataaaagtcatttttaaggcaaatacttaccatgtgactttttattaccaaatgcatcagtagtggagctggtatgttgtttcataggatggaaacattagaagtccagagaaaaataaattttaaaaaaaggtggaaaagttacggcaaacctgagatttcagcataaaatctttagtatgaagtgagagaaagaagagggaggctggttctgttgctcgtatcaataggttatctgtgtccctcatcttggtgttacagtgttatttctgtcagtattatgaatatgtggttgacccatcctgtcaaatgtaccaacattttcgaaagaattcattcaaatctcttatgccaacagaaaagttccttcttgtttaatatctctttacctcagtcctacattttgattctctggaggagattttagcttgtcttaaaaagccaaatttggagtcatcaagcctgctgaacctgatggggcagctttttgaacagctttctggaagtaagaacttcagttgaaaagccctttgatcgcttcagcccgggacatgcccttcagatggcttattctcagtaaagctttatgtagactgtgacactgtatatgtgtgactcgtacaactttgacgtgtttctgaagtggtttaatcgtatttgttattagcttctttgtggaaatgcaatttttatactaaaaacattgcttatttgcaatgcaatatgttataaatttgttgtttatattactggtattagtcttagcctaatgaacctaattatttttctttctgtattctttgcttcctcaaatagcatctgcagcaattggaatgagaaatccagatatgtgtttcaagtagtacattgcctgaatcacaaatcacttgatcacagtattgtatataatccctgatcctatttgtttcattttattgtaaattcccatttgcatcaaaacctaatgatagtgattggtaagtaaaaacaaatggtgtattgcttttcatacaagtgttttcacaaaagccatttgcctaggcagcaaaaaatattaatttgttaaaaaaaattttccttcgtgtccatcctcaaa

SEQ ID NO: 343610 - DNA, 5061 bp, Homo sapiens
  misc_feature (4375)..(4375): n is a, c, g, or t
cgtggcctgcgggacgggcaagcggcgataagaggtggcgtcctccgcggcattgcgagcaccgccagtctgcgccgctaggcgtaggcggggtggcccttgcgtctcccgcttccttgaaaaacccggcgggcgagcgaggctgcgggccggccgctgcccttccccacactccccgccgagaagcctcgctcggcgcccaacatggcgggtgggcgctgcggcccgcagctaacggcgctcctggccgcctggatcgcggctgtggcggcgacggcaggccccgaggaggccgcgctgccgccggagcagagccgggtccagcccatgaccgcctccaactggacgctggtgatggagggcgagtggatgctgaaattttacgccccatggtgtccatcctgccagcagactgattcagaatgggaggcttttgcaaagaatggtgaaatacttcagatcagtgtggggaaggtagatgtcattcaagaaccaggtttgagtggccgcttctttgtcaccactctcccagcattttttcatgcaaaggatgggatattccgccgttatcgtggcccaggaatcttcgaagacctgcagaattatatcttagagaagaaatggcaatcagtcgagcctctgactggctggaaatccccggcttctctaacgatgtctggaatggctggtctttttagcatctctggcaagatatggcatcttcacaactatttcacagtgactcttggaattcctgcttggtgttcttatgtctttttcgtcatagccaccttggtttttggcctttttatgggtctggtcttggtggtaatatcagaatgtttctatgtgccacttccaaggcatttatctgagcgttctgagcagaatcggagatcagaggaggctcatagagctgaacagttgcaggatgcggaggaggaaaaagatgattcaaatgaagaagaaaacaaagacagccttgtagatgatgaagaagagaaagaagatcttggcgatgaggatgaagcagaggaagaagaggaggaggacaacttggctgctggtgtggatgaggagagaagtgaggccaatgatcaggggcccccaggagaggacggtgtgacccgggaggaagtagagcctgaggaggctgaagaaggcatctctgagcaaccctgcccagctgacacagaggtggtggaagactccttgaggcagcgtaaaagtcagcatgctgacaagggactgtagatttaatgatgcgttttcaagaatacacaccaaaacaatatgtcagcttccctttggcctgcagtttgtaccaaatccttaatttttcctgaatgagcaagcttctcttaaaagatgctctctagtcatttggtctcatggcagtaagcctcatgtatactaaggagagtcttccaggtgtgacaatcaggatatagaaaaacaaacgtagtgttgggatctgtttggagactgggatgggaacaagttcatttacttaggggtcagagagtctcgaccagaggaggccattcccagtcctaatcagcaccttccagagacaaggctgcaggccctgtgaaatgaaagccaagcaggagccttggctcctgagcatccccaaagtgtaacgtagaagccttgcatccttttcttgtgtaaagtatttatttttgtcaaattgcaggaaacatcaggcaccacagtgcatgaaaaatctttcacagctagaaattgaaagggccttgggtatagagagcagctcagaagtcatcccagccctctgaatctcctgtgctatgttttatttcttacctttaatttttccagcatttccaccatgggcattcaggctctccacactcttcactattatctcttggtcagaggactccaataacagccaggtttacatgaactgtgtttgttcattctgacctaaggggtttagataatcagtaaccataacccctgaagctgtgactgccaaacatctcaaatgaaatgttgtggccatcagagactcaaaaggaagtaaggattttacaagacagattaaaaaaaaattgttttgtccaaaatatagttgttgttgatttttttttaagttttctaagcaatatttttcaagccagaagtcctctaagtcttgccagtacaaggtagtcttgtgaagaaaagttgaatactgttttgttttcatctcaaggggttccctgggtcttgaactactttaataataactaaaaaaccacttctgattttccttcagtgatgtgcttttggtgaaagaattaatgaactccagtacctgaaagtgaaagatttgattttgtttccatcttctgtaatcttccaaagaattatatctttgtaaatctctcaatactcaatctactgtaagtacccagggaggctaatttccttaaaaaaaaaaaatctatccatctacttctctcttacctgatttatgtgttagaataaattcatgaaattcgattccaagcatacgaaagatgcctaaagttgattctatgctccttagatccagacagaataatgagtacaggtttatgaaattctaaaagtttctgtcgtctttaaaaaggaacgtgcagtatatttctatctggctgtttagataaccctttccttgtattaattgtgagcacggagctcactggtgggggaggttctgaaactctctgccctcctgtggttgaatgaagatgttgcaagacttgcacaaaggaggttattcttctgacagcatcaacttttagagatggttctttttcatctttccaattcagttacttgacagtctccttccccagtatgctgaagtttgttaagagtcaccagtaattgtgcttttcagacagtagtgcagcttcaaaatcgaggccatcactgggctgatgggctgggagaaccttgccatgtgcctgcctgtttcctgcccccttagtcactgcccatttcctgcccccttggtcgctgacacaccttcacccaaagtgccatggttctgatggtggcagttccatctccctgacatcaggaagcttttctcgatcagagcagagcggggcctgcctgccctcgtgtcactggatttctttctcttataatcagctgaaacagagttctcaaagaacagtaaactcaggttcagaggtattatggaataagaatggtttcatagtttggcttttctatataattcctccctctcaaactgaaatattcatttttttagtggagtatttgactagagagaaggtaaggcagaaatacagtctacactggcttttaaaaatgtaaagccaatttccaaccggaccccaaatagtacaggttgaacattccgttccaacaatccaaaaccccaaatgctccaaaatcttaaactttgagttccagcattccgtcagaagtggaaaattttacacctgacctcatttgacaggtggcagttacagtgcaatcaaaactttgttccatgcccaagattattaaaaatattggataaaattaccttcaagctatgttgtataaggtgtatataaaacaaatgaattttgtgtttagacttgggtctactcccaagatacctcattatatatatacaaaaatccccaaatccaaaaacatttgaaacacttctggtcccacacattttggataagggatatttgacctatatctaattatataataagaaaaatgtattttcttttttttttttttttgagatggagtttcactcttgttgtcgcccaggctgcaatggcacaatcttggcttactacaacctccgcctccctagttcaagggattctcctgcctcagcctcccaggtagctgggattacaggcatgtgccaccatgcctggctaattttgtatttttagtagagacggggtttcgccatgttggtcagactggtcttgaactcctgacctcaggtgatccgcccgcctcagcctcccaacgtgctgggattacaggtgtgagccaccgtacctggcagaaaatgtactttctttctcagaaatacttttaaaaaaaattgaagggtgaggagaaaaacatcttggagaagaggacccattaaaactttaaatatctgtgggaaccatttttcctgattttcccttttttaacatcatggcaaagatgggtttttttccaacaaaatttaatttaatatctttccacttgaagattttaggtttgttttcaatacttaatgaatataaaactaaaggagaaaagccaacctgaaataatttaaactttatatgaacatttcgataagagtttgtggattttttctgtagataatatatttgatccngaactcaagtgcatggaaacatgattttgatttttaaaatctaaaaaaaaaaaaaattaaaatcatgcttccctctattgcagtatcagttatttagtcacagaatggtattttatgtaaattaaaattaggtgaatgcaatgcaggtaactggttttggaatgggaatgtgcagtgctttatgtttggggagttggagcagggtatcttttcatcaattagaaggaaagtttgaaacttctgattacctttatgttggtttctcttattatttgtctcttgctagatctgctaaaccaacccagcttgctcagagatctcatattgaagcaacatacaggcaatccacatctttctttccctttgaagtatagtcattggatgggatgagggacagggcctgttgggttcacagggccttgcactgcatgggcacatacttaaaagctcttgtgcatggaatccctgtctgttagccacaggcctctttagctctatacattcaaaataactactgtagtagaaaatagataagcttcagctgagttggcttttgatagttgattggtaagtaaaaacaaatggtgtattgcttttcatacaagtgttttcacaaaagccatttgcctaggcagcaaaaaatattaatttgttaaaaaaaattttccttcgtgtccatcctcaaa

SEQ ID NO: 343611 - DNA, 2369 bp, Homo sapiens
  misc_feature (2369)..(2369): n is a, c, g, or t
cgtggcctgcgggacgggcaagcggcgataagaggtggcgtcctccgcggcattgcgagcaccgccagtctgcgccgctaggcgtaggcggggtggcccttgcgtctcccgcttccttgaaaaacccggcgggcgagcgaggctgcgggccggccgctgcccttccccacactccccgccgagaagcctcgctcggcgcccaacatggcgggtgggcgctgcggcccgcagctaacggcgctcctggccgcctggatcgcggctgtggcggcgacggcaggccccgaggaggccgcgctgccgccggagcagagccgggtccagcccatgaccgcctccaactggacgctggtgatggagggcgagtggatgctgaaattttacgccccatggtgtccatcctgccagcagactgattcagaatgggaggcttttgcaaagaatggtgaaatacttcagatcagtgtggggaaggtagatgtcattcaagaaccaggtttgagtggccgcttctttgtcaccactctcccagcattttttcatgcaaaggatgggatattccgccgttatcgtggcccaggaatcttcgaagacctgcagaattatatcttagagaagaaatggcaatcagtcgagcctctgactggctggaaatccccggcttctctaacgatgtctggaatggctggtctttttagcatctctggcaagatatggcatcttcacaactatttcacagtgactcttggaattcctgcttggtgttcttatgtctttttcgtcatagccaccttggtttttggcctttttatgggtctggtcttggtggtaatatcagaatgtttctatgtgccacttccaaggcatttatctgagcgttctgagcagaatcggagatcagaggaggctcatagagctgaacagttgcaggatgcggaggaggaaaaagatgattcaaatgaagaagaaaacaaagacagccttgtagatgatgaagaagagaaagaagatcttggcgatgaggatgaagcagaggaagaagaggaggaggacaacttggctgctggtgtggatgaggagagaagtgaggccaatgatcaggggcccccaggagaggacggtgtgacccgggaggaagtagagcctgaggaggctgaagaaggcatctctgagcaaccctgcccagctgacacagaggtggtggaagactccttgaggcagcgtaaaagtcagcatgctgacaagggactgtagatttaatgatgcgttttcaagaatacacaccaaaacaatatgtcagcttccctttggcctgcagtttgtaccaaatccttaatttttcctgaatgagcaagcttctcttaaaagatgctctctagtcatttggtctcatggcagtaagcctcatgtatactaaggagagtcttccaggtgtgacaatcaggatatagaaaaacaaacgtagtgttgggatctgtttggagactgggatgggaacaagttcatttacttaggggtcagagagtctcgaccagaggaggccattcccagtcctaatcagcaccttccagagacaaggctgcaggccctgtgaaatgaaagccaagcaggagccttggctcctgagcatccccaaagtgtaacgtagaagccttgcatccttttcttgtgtaaagtatttatttttgtcaaattgcaggaaacatcaggcaccacagtgcatgaaaaatctttcacagctagaaattgaaagggccttgggtatagagagcagctcagaagtcatcccagccctctgaatctcctgtgctatgttttatttcttacctttaatttttccagcatttccaccatgggcattcaggctctccacactcttcactattatctcttggtcagaggactccaataacagccaggtttacatgaactgtgtttgttcattctgacctaaggggtttagataatcagtaaccataacccctgaagctgtgactgccaaacatctcaaatgaaatgttgtggccatcagagactcaaaaggaagtaaggattttacaagacagattaaaaaaaaattgttttgtccaaaatatagttgttgttgatttttttttaagttttctaagcaatatttttcaagccagaagtcctctaagtcttgccagtacaaggtagtcttgtgaagaaaagttgaatactgttttgttttcatctcaaggggttccctgggtcttgaactactttaataataactaaaaaaccacttctgattttccttcagtgatgtgcttttggtgaaagaattaaaggaaacctcccattccccttgaaggtggaaaggatttttaaaaaataaacattattcn

SEQ ID NO: 343612 - DNA, 1683 bp, Homo sapiens
cgtggcctgcgggacgggcaagcggcgataagaggtggcgtcctccgcggcattgcgagcaccgccagtctgcgccgctaggcgtaggcggggtggcccttgcgtctcccgcttccttgaaaaacccggcgggcgagcgaggctgcgggccggccgctgcccttccccacactccccgccgagaagcctcgctcggcgcccaacatggcgggtgggcgctgcggcccgcagctaacggcgctcctggccgcctggatcgcggctgtggcggcgacggcaggccccgaggaggccgcgctgccgccggagcagagccgggtccagcccatgaccgcctccaactggacgctggtgatggagggcgagtggatgctgaaattttacgccccatggtgtccatcctgccagcagactgattcagaatgggaggcttttgcaaagaatggtgaaatacttcagatcagtgtggggaaggtagatgtcattcaagaaccaggtttgagtggccgcttctttgtcaccactctcccagcattttttcatgcaaaggatgggatattccgccgttatcgtggcccaggaatcttcgaagacctgcagaattatatcttagagaagaaatggcaatcagtcgagcctctgactggctggaaatccccggcttctctaacgatgtctggaatggctggtctttttagcatctctggcaagatatggcatcttcacaactatttcacagtgactcttggaattcctgcttggtgttcttatgtctttttcgtcatagccaccttggtttttggcctttttatgggtctggtcttggtggtaatatcagaatgtttctatgtgccacttccaaggcatttatctgagcgttctgagcagaatcggagatcagaggaggctcatagagctgaacagttgcaggatgcggaggaggaaaaagatgattcaaatgaagaagaaaacaaagacagccttgtagatgatgaagaagagaaagaagatcttggcgatgaggatgaagcagaggaagaagaggaggaggacaacttggctgctggtgtggatgaggagagaagtgaggccaatgatcaggggcccccaggagaggacggtgtgacccgggaggaagtagagcctgaggaggctgaagaaggcatctctgagcaaccctgcccagctgacacagaggtggtggaagactccttgaggcagcgtaaaagtcagcatgctgacaagggactgtagatttaatgatgcgttttcaagaatacacaccaaaacaatatgtcagcttccctttggcctgcagtttgtaccaaatccttaatttttcctgaatgagcaagcttctcttaaaagatgctctctagtcatttggtctcatggcagtaagcctcatgtatactaaggagagtcttccaggtgtgacaatcaggatatagaaaaacaaacgtagtgttgggatctgtttggagactgggatgggaacaagttcatttacttaggggtcagagagtctcgaccagaggaggccattcccagtcctaatcagcaccttccagagacaaggctgcaggccctgtgaaatgaaagccaagcaggagccttggctcctgagcatccacccaacgacgacgtagacgacggccgcctcctagctgtgctaaacatagc

SEQ ID NO: 343613 - DNA, 524 bp, Homo sapiens
ctactctcagtttcccaatattataaaattgacttgttctttaagaatcatttagatacataaagctttgtgggaacctatgtatgtagaaacaacagctagagagagagattgaaatatttttggttctcttaaaaattaatgttttattttttttcttctgattccagcatcttcacaactatttcacagtgactcttggaattcctgcttggtgttcttatgtctttttcgtcatagccaccttggtttttggcctttttatgggtctggtaagagataataccaaactttttctatctttaaggcaaaatgaatttcatgtacaaataaaaggcagccaagaaagaaaaagcacataaaaaatagtattttgtgcaatctaagtagttaaatagcatttgcttgtttgagactgctttcaatggtaatgtgagatataacagaaaatttattaaattcttatcccctaatcctatcccttaagtattttgaagatgtgtactgcctatagacagtaatta

SEQ ID NO: 343614 - DNA, 6082 bp, Homo sapiens
  misc_feature (4297)..(4297): n is a, c, g, or t
cgtggcctgcgggacgggcaagcggcgataagaggtggcgtcctccgcggcattgcgagcaccgccagtctgcgccgctaggcgtaggcggggtggcccttgcgtctcccgcttccttgaaaaacccggcgggcgagcgaggctgcgggccggccgctgcccttccccacactccccgccgagaagcctcgctcggcgcccaacatggcgggtgggcgctgcggcccgcagctaacggcgctcctggccgcctggatcgcggctgtggcggcgacggcaggccccgaggaggccgcgctgccgccggagcagagccgggtccagcccatgaccgcctccaactggacgctggtgatggagggcgagtggatgctgaaattttacgccccatggtgtccatcctgccagcagactgattcagaatgggaggcttttgcaaagaatggtgaaatacttcagatcagtgtggggaaggtagatgtcattcaagaaccaggtttgagtggccgcttctttgtcaccactctcccagcattttttcatgcaaaggatgggatattccgccgttatcgtggcccaggaatcttcgaagacctgcagaattatatcttagagaagaaatggcaatcagtcgagcctctgactggctggaaatccccggcttctctaacgatgtctggaatggctggtctttttagcatctctggcaagatatggcatcttcacaactatttcacagtgactcttggaattcctgcttggtgttcttatgtctttttcgtcatagccaccttggtttttggcctttttatgggtctggtcttggtggtaatatcagaatgtttctatgtgccacttccaaggcatttatctgagcgttctgagcagaatcggagatcagaggaggctcatagagctgaacagttgcaggatgcggaggaggaaaaagatgattcaaatgaagaagaaaacaaagacagccttgtagatgatgaagaagagaaagaagatcttggcgatgaggatgaagcagaggaagaagaggaggaggacaacttggctgctggtgtggatgaggagagaagtgaggccaatgatcaggggcccccaggagaggacggtgtgacccgggaggaagtagagcctgaggaggctgaagaaggcatctctgagcaaccctgcccagctgacacagaggtggtggaagactccttgaggcagcgtaaaagtcagcatgctgacaagggactgtagatttaatgatgcgttttcaagaatacacaccaaaacaatatgtcagcttccctttggcctgcagtttgtaccaaatccttaatttttcctgaatgagcaagcttctcttaaaagatgctctctagtcatttggtctcatggcagtaagcctcatgtatactaaggagagtcttccaggtgtgacaatcaggatatagaaaaacaaacgtagtgttgggatctgtttggagactgggatgggaacaagttcatttacttaggggtcagagagtctcgaccagaggaggccattcccagtcctaatcagcaccttccagagacaaggctgcaggccctgtgaaatgaaagccaagcaggagccttggctcctgagcatccccaaagtgtaacgtagaagccttgcatccttttcttgtgtaaagtatttatttttgtcaaattgcaggaaacatcaggcaccacagtgcatgaaaaatctttcacagctagaaattgaaagggccttgggtatagagagcagctcagaagtcatcccagccctctgaatctcctgtgctatgttttatttcttacctttaatttttccagcatttccaccatgggcattcaggctctccacactcttcactattatctcttggtcagaggactccaataacagccaggtttacatgaactgtgtttgttcattctgacctaaggggtttagataatcagtaaccataacccctgaagctgtgactgccaaacatctcaaatgaaatgttgtggccatcagagactcaaaaggaagtaaggattttacaagacagattaaaaaaaaattgttttgtccaaaatatagttgttgttgatttttttttaagttttctaagcaatatttttcaagccagaagtcctctaagtcttgccagtacaaggtagtcttgtgaagaaaagttgaatactgttttgttttcatctcaaggggttccctgggtcttgaactactttaataataactaaaaaaccacttctgattttccttcagtgatgtgcttttggtgaaagaattaatgaactccagtacctgaaagtgaaagatttgattttgtttccatcttctgtaatcttccaaagaattatatctttgtaaatctctcaatactcaatctactgtaagtacccagggaggctaatttccttaaaaaaaaaaaatctatccatctacttctctcttacctgatttatgtgttagaataaattcatgaaattcgattccaagcatacgaaagatgcctaaagttgattctatgctccttagatccagacagaataatgagtacaggtttatgaaattctaaaagtttctgtcgtctttaaaaaggaacgtgcagtatatttctatctggctgtttagataaccctttccttgtattaattgtgagcacggagctcactggtgggggaggttctgaaactctctgccctcctgtggttgaatgaagatgttgcaagacttgcacaaaggaggttattcttctgacagcatcaacttttagagatggttctttttcatctttccaattcagttacttgacagtctccttccccagtatgctgaagtttgttaagagtcaccagtaattgtgcttttcagacagtagtgcagcttcaaaatcgaggccatcactgggctgatgggctgggagaaccttgccatgtgcctgcctgtttcctgcccccttagtcactgcccatttcctgcccccttggtcgctgacacaccttcacccaaagtgccatggttctgatggtggcagttccatctccctgacatcaggaagcttttctcgatcagagcagagcggggcctgcctgccctcgtgtcactggatttctttctcttataatcagctgaaacagagttctcaaagaacagtaaactcaggttcagaggtattatggaataagaatggtttcatagtttggcttttctatataattcctccctctcaaactgaaatattcatttttttagtggagtatttgactagagagaaggtaaggcagaaatacagtctacactggcttttaaaaatgtaaagccaatttccaaccggaccccaaatagtacaggttgaacattccgttccaacaatccaaaaccccaaatgctccaaaatcttaaactttgagttccagcattccgtcagaagtggaaaatattggataaaattaccttcaagctatgttgtataaggtgtatataaaacaaatgaattttgtgtttagacttgggtctactcccaagatacctcattatatatatacaaaaatccccaaatccaaaaacatttgaaacacttctggtcccacacattttggataagggatatttgacctatatctaattatataataagaaaaatgtattttcttttttttttttttttgagatggagtttcactcttgttgtcgcccaggctgcaatggcacaatcttggcttactacaacctccgcctccctagttcaagggattctcctgcctcagcctcccaggtagctgggattacaggcatgtgccaccatgcctggctaattttgtatttttagtagagacggggtttcgccatgttggtcagactggtcttgaactcctgacctcaggtgatccgcccgcctcagcctcccaacgtgctgggattacaggtgtgagccaccgtacctggcagaaaatgtactttctttctcagaaatacttttaaaaaaaattgaagggtgaggagaaaaacatcttggagaagaggacccattaaaactttaaatatctgtgggaaccatttttcctgattttcccttttttaacatcatggcaaagatgggtttttttccaacaaaatttaatttaatatctttccacttgaagattttaggtttgttttcaatacttaatgaatataaaactaaaggagaaaagccaacctgaaataatttaaactttatatgaacatttcgataagagtttgtggattttttctgtagataatatatttgatccngaactcaagtgcatggaaacatgattttgatttttaaaatctaaaaaaaaaaaaaattaaaatcatgcttccctctattgcagtatcagttatttagtcacagaatggtattttatgtaaattaaaattaggtgaatgcaatgcaggtaactggttttggaatgggaatgtgcagtgctttatgtttggggagttggagcagggtatcttttcatcaattagaaggaaagtttgaaacttctgattacctttatgttggtttctcttattatttgtctcttgctagatctgctaaaccaacccagcttgctcagagatctcatattgaagcaacatacaggcaatccacatctttctttccctttgaagtatagtcattggatgggatgagggacagggcctgttgggttcacagggccttgcactgcatgggcacatacttaaaagctcttgtgcatggaatccctgtctgttagccacaggcctctttagctctatacattcaaaataactactgtagtagaaaatagataagcttcagctgagttggcttttgatagtggaaaaaaaacaaaatttgactttttatggccaaaattccttgttgacagctgtgatgttctaatatgatttgggaatatgtcagtctacagaacctgcatcctgtaaaaacacctttggggtagacgataaaagtcatttttaaggcaaatacttaccatgtgactttttattaccaaatgcatcagtagtggagctggtatgttgtttcataggatggaaacattagaagtccagagaaaaataaattttaaaaaaaggtggaaaagttacggcaaacctgagatttcagcataaaatctttagtatgaagtgagagaaagaagagggaggctggttctgttgctcgtatcaataggttatctgtgtccctcatcttggtgttacagtgttatttctgtcagtattatgaatatgtggttgacccatcctgtcaaatgtaccaacattttcgaaagaattcattcaaatctcttatgccaacagaaaagttccttcttgtttaatatctctttacctcagtcctacattttgattctctggaggagattttagcttgtcttaaaaagccaaatttggagtcatcaagcctgctgaacctgatggggcagctttttgaacagctttctggaagtaagaacttcagttgaaaagccctttgatcgcttcagcccgggacatgcccttcagatggcttattctcagtaaagctttatgtagactgtgacactgtatatgtgtgactcgtacaactttgacgtgtttctgaagtggtttaatcgtatttgttattagcttctttgtggaaatgcaatttttatactaaaaacattgcttatttgcaatgcaatatgttataaatttgttgtttatattactggtattagtcttagcctaatgaacctaattatttttctttctgtattctttgcttcctcaaatagcatctgcagcaattggaatgagaaatccagatatgtgtttcaagtagtacattgcctgaatcacaaatcacttgatcacagtattgtatataatccctgatcctatttgtttcattttattgtaaattcccatttgcatcaaaacctaatgatagtgattggtaagtaaaaacaaatggtgtattgcttttcatacaagtgttttcacaaaagccatttgcctaggcagcaaaaaatattaatttgttaaaaaaaattttccttcgtgtccatcctcaaa

SEQ ID NO: 343615 - DNA, 6103 bp, Homo sapiens
  misc_feature (4375)..(4375): n is a, c, g, or t
cgtggcctgcgggacgggcaagcggcgataagaggtggcgtcctccgcggcattgcgagcaccgccagtctgcgccgctaggcgtaggcggggtggcccttgcgtctcccgcttccttgaaaaacccggcgggcgagcgaggctgcgggccggccgctgcccttccccacactccccgccgagaagcctcgctcggcgcccaacatggcgggtgggcgctgcggcccgcagctaacggcgctcctggccgcctggatcgcggctgtggcggcgacggcaggccccgaggaggccgcgctgccgccggagcagagccgggtccagcccatgaccgcctccaactggacgctggtgatggagggcgagtggatgctgaaattttacgccccatggtgtccatcctgccagcagactgattcagaatgggaggcttttgcaaagaatggtgaaatacttcagatcagtgtggggaaggtagatgtcattcaagaaccaggtttgagtggccgcttctttgtcaccactctcccagcattttttcatgcaaaggatgggatattccgccgttatcgtggcccaggaatcttcgaagacctgcagaattatatcttagagaagaaatggcaatcagtcgagcctctgactggctggaaatccccggcttctctaacgatgtctggaatggctggtctttttagcatctctggcaagatatggcatcttcacaactatttcacagtgactcttggaattcctgcttggtgttcttatgtctttttcgtcatagccaccttggtttttggcctttttatgggtctggtcttggtggtaatatcagaatgtttctatgtgccacttccaaggcatttatctgagcgttctgagcagaatcggagatcagaggaggctcatagagctgaacagttgcaggatgcggaggaggaaaaagatgattcaaatgaagaagaaaacaaagacagccttgtagatgatgaagaagagaaagaagatcttggcgatgaggatgaagcagaggaagaagaggaggaggacaacttggctgctggtgtggatgaggagagaagtgaggccaatgatcaggggcccccaggagaggacggtgtgacccgggaggaagtagagcctgaggaggctgaagaaggcatctctgagcaaccctgcccagctgacacagaggtggtggaagactccttgaggcagcgtaaaagtcagcatgctgacaagggactgtagatttaatgatgcgttttcaagaatacacaccaaaacaatatgtcagcttccctttggcctgcagtttgtaccaaatccttaatttttcctgaatgagcaagcttctcttaaaagatgctctctagtcatttggtctcatggcagtaagcctcatgtatactaaggagagtcttccaggtgtgacaatcaggatatagaaaaacaaacgtagtgttgggatctgtttggagactgggatgggaacaagttcatttacttaggggtcagagagtctcgaccagaggaggccattcccagtcctaatcagcaccttccagagacaaggctgcaggccctgtgaaatgaaagccaagcaggagccttggctcctgagcatccccaaagtgtaacgtagaagccttgcatccttttcttgtgtaaagtatttatttttgtcaaattgcaggaaacatcaggcaccacagtgcatgaaaaatctttcacagctagaaattgaaagggccttgggtatagagagcagctcagaagtcatcccagccctctgaatctcctgtgctatgttttatttcttacctttaatttttccagcatttccaccatgggcattcaggctctccacactcttcactattatctcttggtcagaggactccaataacagccaggtttacatgaactgtgtttgttcattctgacctaaggggtttagataatcagtaaccataacccctgaagctgtgactgccaaacatctcaaatgaaatgttgtggccatcagagactcaaaaggaagtaaggattttacaagacagattaaaaaaaaattgttttgtccaaaatatagttgttgttgatttttttttaagttttctaagcaatatttttcaagccagaagtcctctaagtcttgccagtacaaggtagtcttgtgaagaaaagttgaatactgttttgttttcatctcaaggggttccctgggtcttgaactactttaataataactaaaaaaccacttctgattttccttcagtgatgtgcttttggtgaaagaattaatgaactccagtacctgaaagtgaaagatttgattttgtttccatcttctgtaatcttccaaagaattatatctttgtaaatctctcaatactcaatctactgtaagtacccagggaggctaatttccttaaaaaaaaaaaatctatccatctacttctctcttacctgatttatgtgttagaataaattcatgaaattcgattccaagcatacgaaagatgcctaaagttgattctatgctccttagatccagacagaataatgagtacaggtttatgaaattctaaaagtttctgtcgtctttaaaaaggaacgtgcagtatatttctatctggctgtttagataaccctttccttgtattaattgtgagcacggagctcactggtgggggaggttctgaaactctctgccctcctgtggttgaatgaagatgttgcaagacttgcacaaaggaggttattcttctgacagcatcaacttttagagatggttctttttcatctttccaattcagttacttgacagtctccttccccagtatgctgaagtttgttaagagtcaccagtaattgtgcttttcagacagtagtgcagcttcaaaatcgaggccatcactgggctgatgggctgggagaaccttgccatgtgcctgcctgtttcctgcccccttagtcactgcccatttcctgcccccttggtcgctgacacaccttcacccaaagtgccatggttctgatggtggcagttccatctccctgacatcaggaagcttttctcgatcagagcagagcggggcctgcctgccctcgtgtcactggatttctttctcttataatcagctgaaacagagttctcaaagaacagtaaactcaggttcagaggtattatggaataagaatggtttcatagtttggcttttctatataattcctccctctcaaactgaaatattcatttttttagtggagtatttgactagagagaaggtaaggcagaaatacagtctacactggcttttaaaaatgtaaagccaatttccaaccggaccccaaatagtacaggttgaacattccgttccaacaatccaaaaccccaaatgctccaaaatcttaaactttgagttccagcattccgtcagaagtggaaaattttacacctgacctcatttgacaggtggcagttacagtgcaatcaaaactttgttccatgcccaagattattaaaaatattggataaaattaccttcaagctatgttgtataaggtgtatataaaacaaatgaattttgtgtttagacttgggtctactcccaagatacctcattatatatatacaaaaatccccaaatccaaaaacatttgaaacacttctggtcccacacattttggataagggatatttgacctatatctaattatataataagaaaaatgtattttcttttttttttttttttgagatggagtttcactcttgttgtcgcccaggctgcaatggcacaatcttggcttactacaacctccgcctccctagttcaagggattctcctgcctcagcctcccaggtagctgggattacaggcatgtgccaccatgcctggctaattttgtatttttagtagagacggggtttcgccatgttggtcagactggtcttgaactcctgacctcaggtgatccgcccgcctcagcctcccaacgtgctgggattacaggtgtgagccaccgtacctggcagaaaatgtactttctttctcagaaatacttttaaaaaaaattgaagggtgaggagaaaaacatcttggagaagaggacccattaaaactttaaatatctgtgggaaccatttttcctgattttcccttttttaacatcatggcaaagatgggtttttttccaacaaaatttaatttaatatctttccacttgaagattttaggtttgttttcaatacttaatgaatataaaactaaaggagaaaagccaacctgaaataatttaaactttatatgaacatttcgataagagtttgtggattttttctgtagataatatatttgatccngaactcaagtgcatggaaacatgattttgatttttaaaatctaaaaaaaaaaaaaattaaaatcatgcttccctctattgcagtatcagttatttagtcacagaatggtattttatgtaaattaaaattaggtgaatgcaatgcaggtaactggttttggaatgggaatgtgcagtgctttatgtttggggagttggagcagggtatcttttcatcaattagaaggaaagtttgaaacttctgattacctttatgttggtttctcttattatttgtctcttgctagatctgctaaaccaacccagcttgctcagagatctcatattgaagcaacatacaggcaatccacatctttctttccctttgaagtatagtcattggatgggatgagggacagggcctgttgggttcacagggccttgcactgcatgggcacatacttaaaagctcttgtgcatggaatccctgtctgttagccacaggcctctttagctctatacattcaaaataactactgtagtagaaaatagataagcttcagctgagttggcttttgatagtggaaaaaaaacaaaatttgactttttatggccaaaattccttgttgacagctgtgatgttctaatatgatttgggaatatgtcagtctacagaacctgcatcctgtaaaaacacctttggggtagacgataaaagtcatttttaaggcaaatacttaccatgtgactttttattaccaaatgcatcagtagtggagctggtatgttgtttcataggatggaaacattagaagtccagagaaaaataaattttaaaaaaaggtggaaaagttacggcaaacctgagatttcagcataaaatctttagtatgaagtgagagaaagaagagggaggctggttctgttgctcgtatcaataggttatctgtgtccctcatcttggtgttacagtgttatttctgtcagtattatgaatatgtggttgacccatcctgtcaaatgtaccaacattttcgaaagaattcattcaaatctcttatgccaacagaaaagttccttcttgtttaatatctctttacctcagtcctacattttgattctctggaggagattttagcttgtcttaaaaagccaaatttggagtcatcaagcctgctgaacctgatggggcagctttttgaacagctttctggaagtaagaacttcagttgaaaactttatgtagactgtgacactgtatatgtgtgactcgtacaactttgacgtgtttctgaagtggtttaatcgtatttgttattagcttctttgtggaaatgcaatttttatactaaaaacattgcttatttgcaatgcaatatgttataaatttgttgtttatattactggtattagtcttagcctaatgaacctaattatttttctttctgtattctttgcttcctcaaatagcatctgcagcaattggaatgagaaatccagatatgtgtttcaagtagtacattgcctgaatcacaaatcacttgatcacagtattgtatataatccctgatcctatttgtttcattttattgtaaattcccatttgcatcaaaacctaatgatagtgattggtaagtaaaaacaaatggtgtattgcttttcatacaagtgttttcacaaaagccatttgcctaggcagcaaaaaatattaatttgttaaaaaaaattttccttcgtgtccatcctcaaa

SEQ ID NO: 343616 - DNA, 6076 bp, Homo sapiens
  misc_feature (4291)..(4291): n is a, c, g, or t
cgtggcctgcgggacgggcaagcggcgataagaggtggcgtcctccgcggcattgcgagcaccgccagtctgcgccgctaggcgtaggcggggtggcccttgcgtctcccgcttccttgaaaaacccggcgggcgagcgaggctgcgggccggccgctgcccttccccacactccccgccgagaagcctcgctcggcgcccaacatggcgggtgggcgctgcggcccgcagctaacggcgctcctggccgcctggatcgcggctgtggcggcgacggcaggccccgaggaggccgcgctgccgccggagcagagccgggtccagcccatgaccgcctccaactggacgctggtgatggagggcgagtggatgctgaaattttacgccccatggtgtccatcctgccagcagactgattcagaatgggaggcttttgcaaagaatggtgaaatacttcagatcagtgtggggaaggtagatgtcattcaagaaccaggaatcttcgaagacctgcagaattatatcttagagaagaaatggcaatcagtcgagcctctgactggctggaaatccccggcttctctaacgatgtctggaatggctggtctttttagcatctctggcaagatatggcatcttcacaactatttcacagtgactcttggaattcctgcttggtgttcttatgtctttttcgtcatagccaccttggtttttggcctttttatgggtctggtcttggtggtaatatcagaatgtttctatgtgccacttccaaggcatttatctgagcgttctgagcagaatcggagatcagaggaggctcatagagctgaacagttgcaggatgcggaggaggaaaaagatgattcaaatgaagaagaaaacaaagacagccttgtagatgatgaagaagagaaagaagatcttggcgatgaggatgaagcagaggaagaagaggaggaggacaacttggctgctggtgtggatgaggagagaagtgaggccaatgatcaggggcccccaggagaggacggtgtgacccgggaggaagtagagcctgaggaggctgaagaaggcatctctgagcaaccctgcccagctgacacagaggtggtggaagactccttgaggcagcgtaaaagtcagcatgctgacaagggactgtagatttaatgatgcgttttcaagaatacacaccaaaacaatatgtcagcttccctttggcctgcagtttgtaccaaatccttaatttttcctgaatgagcaagcttctcttaaaagatgctctctagtcatttggtctcatggcagtaagcctcatgtatactaaggagagtcttccaggtgtgacaatcaggatatagaaaaacaaacgtagtgttgggatctgtttggagactgggatgggaacaagttcatttacttaggggtcagagagtctcgaccagaggaggccattcccagtcctaatcagcaccttccagagacaaggctgcaggccctgtgaaatgaaagccaagcaggagccttggctcctgagcatccccaaagtgtaacgtagaagccttgcatccttttcttgtgtaaagtatttatttttgtcaaattgcaggaaacatcaggcaccacagtgcatgaaaaatctttcacagctagaaattgaaagggccttgggtatagagagcagctcagaagtcatcccagccctctgaatctcctgtgctatgttttatttcttacctttaatttttccagcatttccaccatgggcattcaggctctccacactcttcactattatctcttggtcagaggactccaataacagccaggtttacatgaactgtgtttgttcattctgacctaaggggtttagataatcagtaaccataacccctgaagctgtgactgccaaacatctcaaatgaaatgttgtggccatcagagactcaaaaggaagtaaggattttacaagacagattaaaaaaaaattgttttgtccaaaatatagttgttgttgatttttttttaagttttctaagcaatatttttcaagccagaagtcctctaagtcttgccagtacaaggtagtcttgtgaagaaaagttgaatactgttttgttttcatctcaaggggttccctgggtcttgaactactttaataataactaaaaaaccacttctgattttccttcagtgatgtgcttttggtgaaagaattaatgaactccagtacctgaaagtgaaagatttgattttgtttccatcttctgtaatcttccaaagaattatatctttgtaaatctctcaatactcaatctactgtaagtacccagggaggctaatttccttaaaaaaaaaaaatctatccatctacttctctcttacctgatttatgtgttagaataaattcatgaaattcgattccaagcatacgaaagatgcctaaagttgattctatgctccttagatccagacagaataatgagtacaggtttatgaaattctaaaagtttctgtcgtctttaaaaaggaacgtgcagtatatttctatctggctgtttagataaccctttccttgtattaattgtgagcacggagctcactggtgggggaggttctgaaactctctgccctcctgtggttgaatgaagatgttgcaagacttgcacaaaggaggttattcttctgacagcatcaacttttagagatggttctttttcatctttccaattcagttacttgacagtctccttccccagtatgctgaagtttgttaagagtcaccagtaattgtgcttttcagacagtagtgcagcttcaaaatcgaggccatcactgggctgatgggctgggagaaccttgccatgtgcctgcctgtttcctgcccccttagtcactgcccatttcctgcccccttggtcgctgacacaccttcacccaaagtgccatggttctgatggtggcagttccatctccctgacatcaggaagcttttctcgatcagagcagagcggggcctgcctgccctcgtgtcactggatttctttctcttataatcagctgaaacagagttctcaaagaacagtaaactcaggttcagaggtattatggaataagaatggtttcatagtttggcttttctatataattcctccctctcaaactgaaatattcatttttttagtggagtatttgactagagagaaggtaaggcagaaatacagtctacactggcttttaaaaatgtaaagccaatttccaaccggaccccaaatagtacaggttgaacattccgttccaacaatccaaaaccccaaatgctccaaaatcttaaactttgagttccagcattccgtcagaagtggaaaattttacacctgacctcatttgacaggtggcagttacagtgcaatcaaaactttgttccatgcccaagattattaaaaatattggataaaattaccttcaagctatgttgtataaggtgtatataaaacaaatgaattttgtgtttagacttgggtctactcccaagatacctcattatatatatacaaaaatccccaaatccaaaaacatttgaaacacttctggtcccacacattttggataagggatatttgacctatatctaattatataataagaaaaatgtattttcttttttttttttttttgagatggagtttcactcttgttgtcgcccaggctgcaatggcacaatcttggcttactacaacctccgcctccctagttcaagggattctcctgcctcagcctcccaggtagctgggattacaggcatgtgccaccatgcctggctaattttgtatttttagtagagacggggtttcgccatgttggtcagactggtcttgaactcctgacctcaggtgatccgcccgcctcagcctcccaacgtgctgggattacaggtgtgagccaccgtacctggcagaaaatgtactttctttctcagaaatacttttaaaaaaaattgaagggtgaggagaaaaacatcttggagaagaggacccattaaaactttaaatatctgtgggaaccatttttcctgattttcccttttttaacatcatggcaaagatgggtttttttccaacaaaatttaatttaatatctttccacttgaagattttaggtttgttttcaatacttaatgaatataaaactaaaggagaaaagccaacctgaaataatttaaactttatatgaacatttcgataagagtttgtggattttttctgtagataatatatttgatccngaactcaagtgcatggaaacatgattttgatttttaaaatctaaaaaaaaaaaaaattaaaatcatgcttccctctattgcagtatcagttatttagtcacagaatggtattttatgtaaattaaaattaggtgaatgcaatgcaggtaactggttttggaatgggaatgtgcagtgctttatgtttggggagttggagcagggtatcttttcatcaattagaaggaaagtttgaaacttctgattacctttatgttggtttctcttattatttgtctcttgctagatctgctaaaccaacccagcttgctcagagatctcatattgaagcaacatacaggcaatccacatctttctttccctttgaagtatagtcattggatgggatgagggacagggcctgttgggttcacagggccttgcactgcatgggcacatacttaaaagctcttgtgcatggaatccctgtctgttagccacaggcctctttagctctatacattcaaaataactactgtagtagaaaatagataagcttcagctgagttggcttttgatagtggaaaaaaaacaaaatttgactttttatggccaaaattccttgttgacagctgtgatgttctaatatgatttgggaatatgtcagtctacagaacctgcatcctgtaaaaacacctttggggtagacgataaaagtcatttttaaggcaaatacttaccatgtgactttttattaccaaatgcatcagtagtggagctggtatgttgtttcataggatggaaacattagaagtccagagaaaaataaattttaaaaaaaggtggaaaagttacggcaaacctgagatttcagcataaaatctttagtatgaagtgagagaaagaagagggaggctggttctgttgctcgtatcaataggttatctgtgtccctcatcttggtgttacagtgttatttctgtcagtattatgaatatgtggttgacccatcctgtcaaatgtaccaacattttcgaaagaattcattcaaatctcttatgccaacagaaaagttccttcttgtttaatatctctttacctcagtcctacattttgattctctggaggagattttagcttgtcttaaaaagccaaatttggagtcatcaagcctgctgaacctgatggggcagctttttgaacagctttctggaagtaagaacttcagttgaaaagccctttgatcgcttcagcccgggacatgcccttcagatggcttattctcagtaaagctttatgtagactgtgacactgtatatgtgtgactcgtacaactttgacgtgtttctgaagtggtttaatcgtatttgttattagcttctttgtggaaatgcaatttttatactaaaaacattgcttatttgcaatgcaatatgttataaatttgttgtttatattactggtattagtcttagcctaatgaacctaattatttttctttctgtattctttgcttcctcaaatagcatctgcagcaattggaatgagaaatccagatatgtgtttcaagtagtacattgcctgaatcacaaatcacttgatcacagtattgtatataatccctgatcctatttgtttcattttattgtaaattcccatttgcatcaaaacctaatgatagtgattggtaagtaaaaacaaatggtgtattgcttttcatacaagtgttttcacaaaagccatttgcctaggcagcaaaaaatattaatttgttaaaaaaaattttccttcgtgtccatcctcaaa

SEQ ID NO: 343617 - DNA, 2090 bp, Homo sapiens
cgtggcctgcgggacgggcaagcggcgataagaggtggcgtcctccgcggcattgcgagcaccgccagtctgcgccgctaggcgtaggcggggtggcccttgcgtctcccgcttccttgaaaaacccggcgggcgagcgaggctgcgggccggccgctgcccttccccacactccccgccgagaagcctcgctcggcgcccaacatggcgggtgggcgctgcggcccgcagctaacggcgctcctggccgcctggatcgcggctgtggcggcgacggcaggccccgaggaggccgcgctgccgccggagcagagccgggtccagcccatgaccgcctccaactggacgctggtgatggagggcgagtggatgctgaaattttacgccccatggtgtccatcctgccagcagactgattcagaatgggaggcttttgcaaagaatggtgaaatacttcagatcagtgtggggaaggtagatgtcattcaagaaccaggtttgagtggccgcttctttgtcaccactctcccagcattttttcatgcaaaggatgggatattccgccgttatcgtggcccaggaatcttcgaagacctgcagaattatatcttagagaagaaatggcaatcagtcgagcctctgactggctggaaatccccggcttctctaacgatgtctggaatggctggtctttttagcatctctggcaagatatggcatcttcacaactatttcacagtgactcttggaattcctgcttggtgttcttatgtctttttcgtcatagccaccttggtttttggcctttttatgggtctggtcttggtggtaatatcagaatgtttctatgtgccacttccaaggcatttatctgagcgttctgagcagaatcggagatcagaggaggctcatagagctgaacagttgcaggatgcggaggaggaaaaagatgattcaaatgaagaagaaaacaaagacagccttgtagatgatgaagaagagaaagaagatcttggcgatgaggatgaagcagaggaagaagaggaggaggacaacttggctgctggtgtggatgaggagagaagtgaggccaatgatcaggggcccccaggagaggacggtgtgacccgggaggaagtagagcctgaggaggctgaagaaggcatctctgagcaaccctgcccagctgacacagaggtggtggaagactccttgaggcagcgtaaaagtcagcatgctgacaagggactgtagatttaatgatgcgttttcaagaatacacaccaaaacaatatgtcagcttccctttggcctgcagtttgtaccaaatccttaatttttcctgaatgagcaagcttctcttaaaagatgctctctagtcatttggtctcatggcagtaagcctcatgtatactaaggagagtcttccaggtgtgacaatcaggatatagaaaaacaaacgtagtgttgggatctgtttggagactgggatgggaacaagttcatttacttaggggtcagagagtctcgaccagaggaggccattcccagtcctaatcagcaccttccagagacaaggctgcaggccctgtgaaatgaaagccaagcaggagccttggctcctgagcatccccaaagtgtaacgtagaagccttgcatccttttcttgtgtaaagtatttatttttgtcaaattgcaggaaacatcaggcaccacagtgcatgaaaaatctttcacagctagaaattgaaagggccttgggtatagagagcagctcagaagtcatcccagccctctgaatctcctgtgctatgttttatttcttacctttaatttttccagcatttccaccatgggcattcaggctctccacactcttcactattatctcttggtcagaggactccaataacagccaggtttacatgaactgtgtttgttcattctgacctaaggggtttagataatcagtaaccataacccctgaagctgtgactgccaaacatctcaaatgaaatgttgtggccatcagagactcaaaaggaagtaaggattttacaagacagattaaaaaaaaattgttttgtcca

SEQ ID NO: 343618 - DNA, 574 bp, Homo sapiens
cgtggcctgcgggacgggcaagcggcgataagaggtggcgtcctccgcggcattgcgagcaccgccagtctgcgccgctaggcgtaggcggggtggcccttgcgtctcccgcttccttgaaaaacccggcgggcgagcgaggctgcgggccggccgctgcccttccccacactccccgccgagaagcctcgctcggcgcccaacatggcgggtgggcgctgcggcccgcagctaacggcgctcctggccgcctggatcgcggctgtggcggcgacggcaggccccgaggaggccgcgctgccgccggagcagagccgggtccagcccatgaccgcctccaactggacgctggtgatggagggcgagtggatgctgaaattatacagatatgtattggaagagaaaggacattcagtgacatccacgtgcagtatgaatacgtagcacaggctaagcaagttacctgttgaagaaattgcagcacggtgaaggcaggccatttgtgtcgtagtcttccgtttgaagacctggagatgtcattgtgagaataaaacataaatatggatgcctttta

SEQ ID NO: 343619 - DNA, 793 bp, Homo sapiens
actcatagtgcaatgaaaaattattgaagggattttaaaagggaaatgatgtaatacaatctacttctttttttgagacagggtcttgctctgttgcccaggctagggtgtagtggtacaatcaaatcatagctcactgcaacctcaaattcctgggctcaagcaatcctcccacctcggcctctcaagtagctgggactacagttgcaagccaccttctaattttttctagagatgggtctcactatgttgtgcaggttagtctcaaacttctgggcttaagtgatcctcccaccttagcctttcaaagtgctgggttttcaggtgtgagccactgcatctggccacagtctacatttttaaaatgtcactttatcttctgtgtatagaatgttgggggagatgtaggaagggaaacaaggggtacaatttagatagttaatgaagaagtccagtgaaaaagaatagtagcttggactaggatggtagccatgaacacaagggaaataggcagagatgtgagatatatttcagggttctataaaattcagaggattaataatattgattccatgttgttgttaagaataaatgacccataataagtgatgaataaacattagctattattacaatcattaatgggcttttcaaaaggaagggatcagaaaaagtttttaacatcatgaaaaatcctaaatattaaaaacacctaatggaagcctatgagagttcttctggcaatgcaaatgaattagaaaagagtagtttaactggaaattaggaatctgat

SEQ ID NO: 343620 - DNA, 453 bp, Homo sapiens
cgatctagaggatccggtgtttatcgatgcatttatcttctgtgtatagaatgttgggggagatgtaggaagggaaacaaggggtacaatttagatagttaatgaagaagtccagtgaaaaagaatagtagcttggactaggatggtagccatgaacacaagggaaataggcagagatgtgagatatatttcagggttctataaaattcagaggattaataatattgattccatgttgttgttaagaataaatgacccataataagtgatgaataaacattagctattattacaatcattaatgggcttttcaaaaggaagggatcagaaaaagtttttaacatcatgaaaaatcctaaatattaaaaacacctaatggaagcctatgagagttcttctggcaatgcaaatgaattagaaaagagtagtttaactggaaattaggaatctgat

SEQ ID NO: 343621 - DNA, 311 bp, Homo sapiens
caggacaaggaacctcctccagaataggcaagaaacatgcaggctggagagctggatacggcttcctcctggaacagccatatcctcacaactgtatttcctcaggacggtgggggcagccccaaatctttacacaaaagaatacggactttggaatgagtccaactgggtcaaatctcagctgtgtagcttagtgtgatgttggacgagccatcggtctctctgagctgtagtgtcttcacctgtaaagtgcacagttaactgatagcgtttgattcttggtaatccaccagcatacctgttagttttca

SEQ ID NO: 343622 - DNA, 614 bp, Homo sapiens
cactcggctccaggtatcctggaggaaagaacgaacttctcctgggcccagaagtttaggtccgctgtcgtcccccgcctgcctctaaggccctctcctcgcgacagcctctgaaaccatcggctccttcctcatttctgtcacggcctggcttgcattccaagccaggcactcatttcatgtttattgttccagctggactaggggtacttaaaccgtggtccatggctgggcttccggggccgtgacccccttaaattatatgcagtatgtagcttgttgtgggtggcttctgtcacacttaaatgctgggtgccatcacaggactggcagggccctactgtggtcgtcagtgcgctctttgtcagcacagagcctgacgcaaatgtccaaaggtgctaattagacagaggcaaatatcccaactgttgccctctgcacacacctcggtctactcttttaagactacttgctgttacctgcacacacctttatttatttatttatttatttatttaatttttgagacagggtctcgctctgtcgcccaggctggagtgcagtggcgcgatctcggctcacgggctcaagcgaccctcctgcctcagcctccc

SEQ ID NO: 343623 - DNA, 491 bp, Homo sapiens
taaaaagatgtcgccttcgataggaagatttggggccagacatcagaaatccacgtgggagagactggccgtacacttccagatggaacaagtctgcccagtgatgtgagttccatctctttttgattctggaactccactttcatcttatttatgcacatggagatattgataaaggggaaatgtatccaaactgaaaataattggatccctacagctaactctgagatattaaaagcagtaccacttggctgtgtctttgtcttgttaggtttgatcataagatcacaatgtagtaatctcgggctcaaatttctggcataaagatgcactgttccaaatgtggcctcagggaacacgactgcccacacagccccaggattgtctcatcttattatttttcaacagttcttggcctgctgaggtcaatgttttgtctcttttgagtgttcctctatgcttgacaccttttcctattttctttcttaaaa

SEQ ID NO: 343624 - DNA, 303 bp, Homo sapiens
acgagacacacagcacacgcacacatcattgcactacacagcagactagcacacgagcacacacacaaagacacagcacacacatgcacacacagcggcacacacgcgcacacatacacacacacacacatccacacgtgctcatgtgtgtacacatgcccatacactccacataggtgcacatatacacatgtattcatgcatatacgagcctgtccacgtgcacacccatacaggtatatacatacactcatacatgtgcacgtatccacatgtgtatccacatacatgactatgagccct

SEQ ID NO: 343625 - DNA, 402 bp, Homo sapiens
gtcctgcagctcctcccagaggccacttataagcagccctgccatgtggccacacagcactggtcatgccatacccatgcacagtcatacatgtccacacacacatgcacacgtgtgcccaaacatgcatgcacatatatggccgtacttatacatgtgtgcacacatacacatgcatctatgcacatacatgcccatacacacgcgcacacatacacacacacacacatccacacgtgctcatgtgtgtacacatgcccatacactccacataggtgcacatatacacatgtattcatgcatatacgagcctgtccacgtgcacacccatacaggtatatacatacactcatacatgtgcacgtatccacatgtgtatccacatacatgactatgagccct

SEQ ID NO: 343626 - DNA, 380 bp, Homo sapiens
tcatttattggtagtttacatcagttgagtggttcagaaaaaatacagtaagttgcttataaaattctgaacactttggccaggcacaatggctcaagcctgtaatttgagccctttgtgaggctgaggcaggagaattgcttgagcttaggcgttcaagaccagcctaggtaacaaagaacgcctggaatgattgtggcatttgaactaatattcaggtttaacaagagataattgaccatcactctattttagaggctttatttgaaccagatagaaatctatttcccacagctatcactgcctgtcacctacaacttaagggggttggggaggaagtgagagattttctgttagggccaatagggacctgctagata

SEQ ID NO: 343627 - DNA, 1078 bp, Homo sapiens
cgtttggccctctgaacaaggtgcacgcgagctgggggatgaagacggctcccacttccttttccttaataagaaccatatggtgggtgtatgtgtgtacaagaggggttcatctgtgggggcttcctctccttccaccctctggttccaatttcctgttctaagcaggactagggcccaggaggctaaggctgggagagaaagggtgccaacaggtcccttgggaatgagttggctctggacgtttctgccctgttccccgatcagagctcctctgcaggaaacaggcaggatgcccctcccaacccctcagtccctacgtcaagcggagtggataaggctgagatgagtgctgggagtggtggacattcctgctcgtgcaaagatggccactttccccgcagctgcagggcctcgcgctcggccctcgccaggccagccccactccttgtaccaagtgtgaactggggtcattcggtctgtgatctcgttgcactgctccaagtctggctgtgtccaggcggtccatgttgaaaatggaggatggctgctgacttctgactggctgagcagtgggttccttcaggttccttgccaaccctcctcccctgcccacaacttctccaaacaaagcaggctgtttgctcacttcttcaaaaggaggaatgataacccaaatctgcccaagtgacacttgagaaggttttggctggggttcctggtggatttcttactacctaacgcccaagaaaaccaactaaggactctcaaaccatacctggtgggggttcttcgctcaacctcttcttccctaggtcaaagccactatcatctgatgtgttagggatgggttctgattggcagaaattaatcagctcccaatgggagcccacggaactaagtagggtcccaagaaaaaaaacgggagctatttcacagagctgagcttctgccaaatttcattcctcaaacctttcaggaggggtggttggcgtttctaaaatgtttatgggatttgagttgcaggtgtccacttaactgactagctttgataaacaatgtcagattttaactatga

SEQ ID NO: 343628 - DNA, 286 bp, Homo sapiens
ggtgctccgaggatcccccaattacctcactaaataaggactctcaaaccatacctggtgggggttcttcgctcaacctcttcttccctaggtcaaagccactatcatctgatgtgttagggatgggttctgattggcagaaattaatcagctcccaatgggagcccacggaactaagtagggtcccaagaaaaaaaacgggagctatttcacagagctgagcttctgccaaatttcattcctcaaacctttcaggagggttaattccgcgtaagatccctgagtc

SEQ ID NO: 343629 - DNA, 625 bp, Homo sapiens
ggtgctccgaggatcccccaattacctcactaaataaggactctcaaaccatacctggtgggggttcttcgctcaacctcttcttccctaggtcaaagccactatcatctgatgtgttagggatgggttctgattggcagaaattaatcagctcccaatgggagcccacggaactaagtagggtcccaagaaaaaaaacgggagctatttcacagagctgagcttctgccaaatttcattcctcaaacctttcaggaggggtggttggcgtttctaaaatgtttatgggatttgagttgcaggtgtccacttaactgactagctttgataaacaatgtcagattttaactatgaaaacgacattaccttgtgcatttttatattgattcctattttttttttaagattaaagtttaaatgttttccactagtcatttcacttctaacttggtataggaagcttagctctctacatacctatcatgtgccctgtatcacagaagattcaggaaaaatgcacttgggaatcaaagaaaatggaacttctttttgaaaagacaagcaaccatgttaactgtattgacacatcctcaataaaacctgttgtataaaacaaaaactgtgc

SEQ ID NO: 343630 - DNA, 621 bp, Homo sapiens
cggctccgaggattacgcagaaataacccttaaggactctcaaaccatacctggtgggggttcttcgctcaacctcttcttccctaggtcaaagccactatcatctgatgtgttagggatgggttctgattggcagaaattaatcagctcccaatgggagcccacggaactaagtagggtcccaagaaaaaaaacgggagctatttcacagagctgagcttctgccaaatttcattcctcaaacctttcaggaggggtggttggcgtttctaaaatgtttatgggatttgagttgcaggtgtccacttaactgactagctttgataaacaatgtcagattttaactatgaaaacgacattaccttgtgcatttttatattgattcctattttttttttaagattaaagtttaaatgttttccactagtcatttcacttctaacttggtataggaagcttagctctctacatacctatcatgtgccctgtatcacagaagattcaggaaaaatgcacttgggaatcaaagaaaatggaacttctttttgaaaagacaagcaaccatgttaactgtattgacacatcctcaataaaacctgttgtataaaacaaaaactgtgc

SEQ ID NO: 343631 - DNA, 1349 bp, Homo sapiens
cgtttggccctctgaacaaggtgcacgcgagctgggggatgaagacggctcccacttccttttccttaataagaaccatatggtgggtgtatgtgtgtacaagaggggttcatctgtgggggcttcctctccttccaccctctggttccaatttcctgttctaagcaggactagggcccaggaggctaaggctgggagagaaagggtgccaacaggtcccttgggaatgagttggctctggacgtttctgccctgttccccgatcagagctcctctgcaggaaacaggcaggatgcccctcccaacccctcagtccctacgtcaagcggagtggataaggctgagatgagtgctgggagtggtggacattcctgctcgtgcaaagatggccactttccccgcagctgcagggcctcgcgctcggccctcgccaggccagccccactccttgtaccaagtgtgaactggggtcattcggtctgtgatctcgttgcactgctccaagtctggctgtgtccaggcggtccatgttgaaaatggaggatggctgctgacttctgactggctgagcagtgggttccttcaggttccttgccaaccctcctcccctgcccacaacttctccaaacaaagcaggctgtttgctcacttcttcaaaaggaggaatgataacccaaatctgcccaagtgacacttgagaaggttttggctggggttcctggtggatttcttactacctaacgcccaagaaaaccaactaaggactctcaaaccatacctggtgggggttcttcgctcaacctcttcttccctaggtcaaagccactatcatctgatgtgttagggatgggttctgattggcagaaattaatcagctcccaatgggagcccacggaactaagtagggtcccaagaaaaaaaacgggagctatttcacagagctgagcttctgccaaatttcattcctcaaacctttcaggaggggtggttggcgtttctaaaatgtttatgggatttgagttgcaggtgtccacttaactgactagctttgataaacaatgtcagattttaactatgaaaacgacattaccttgtgcatttttatattgattcctattttttttttaagattaaagtttaaatgttttccactagtcatttcacttctaacttggtataggaagcttagctctctacatacctatcatgtgccctgtatcacagaagattcaggaaaaatgcacttgggaatcaaagaaaatggaacttctttttgaaaagacaagcaaccatgttaactgtattgacacatcctcaataaaacctgttgtataaaacaaaaactgtgc

SEQ ID NO: 343632 - DNA, 729 bp, Homo sapiens
gagaaagggctaatgtctgagcagtcgggtggcttcctagatgaggggactgtcctcccaggagctgctactcagagtagtttcttgtcctcctaaagtttagagtggaaatactttgcaaaagaggtccccaaccctaagtgtgagggctaagctcctgggcttagtaggcatatacaaatgcccccaggtgggtgacatcaagatgttctggtcctaggtctgctgagagcctctcctgggaatgttgtaggtactgcctttcccttttaggaaacaccatatcctcctaccactaacccccatccttgccctaaccagcaatctgtaacatcctgggcctcagggacgtgggtggagggtgactctgagctccagatagtgtctaggaggctcaaataagcctgctttttggtcctcaccctagccgtgggccaccctactactccagcctgggcgacagagcaagactccgtctcaaaaaaaaaaaaaaaaaaaaaaaaaaaaaaagatacttctccaaagtgttctcatgtggcctcacccaggtcttgtgtattatttggtaattaatttatggatcttaaaaactgcagtattcccccattttgtgatgagagtgtggggctggcaggggttggttggagggaggagagaagacagaggagcacttaaggtgcaaagcagcctattttttcttcaataaaaattgttaagagaaaaaaaaat

SEQ ID NO: 343633 - DNA, 1196 bp, Homo sapiens
catggaggccctgggacctgggggcgaccgcgcctccccggcctcgtccactagcagcctggacctgtggcatctgtccatgcgcgcggactcggcctacagctctttctccgcagcctccggcggccccgagccgcgcacgcagtcgccggggacagacctccttccttacctagactgggactacgtgcgtgtggtttggggcggcccgggccccgccccgcccgacgctgccctttgcacatccccgcggccccggcccgcggttgcagcccgcagtgggccgcagccaacagaggtcccggggaccccgggaccactgaacaggcaggccaccccgctgctgtacgcgctggcggccgaggcggaggccgcggcgcaggctgccgagccgcccagcccgccggcctcgagggccgcctaccgccagcggcttcagggcgcgcagcggcgagtgctccgggagacgtcgttccagcgcaaggagctccgcatgagcctgcccgcccgtctgcggcccactgtcccagcgcggcccccggcgactcacccgcgctccgcctcgctcagccacccgggcggggagggggagccggcgcgctcccgggctcccgcgccaggaactgccggccggggtcccctcgccaaccagcagcggaagtggtgcttctcagagccaggaaagctggatcgtgtgggtcggggcggtgggccggcgcgggaatgcctgggtgaggcctgctccagctctggcctccctgggcccgagcccttggagttccagcatccggcgctggctaagtttgaagatcacgaggtcggatggctgcccgagacgcaaccccaaggctccatgaacctggactccgggtccttgaagctcggtgatgccttcaggcccgccagtcggagtcggagcgcttcaggcgaagtcttgggttcctggggaggatcaggagggaccatacccattgtccaggctgttccccaaggagcagaaacccccagaccattgtttcagaccaaactttccaggttcttgcctcagaaagaggctgcggtgatgtatcctgcagagttaccccagagcagccctgctgacagtgaacagagggtctcagagaagacagaggagcacttaaggtgcaaagcagcctattttttcttcaataaaaattgttaagagaaaaaaaaat

SEQ ID NO: 343634 - DNA, 1848 bp, Homo sapiens
gagaaagggctaatgtctgagcagtcgggtggcttcctagatgaggggactgtcctcccaggagctgctactcagagtagtttcttgtcctcctaaagtttagagtggaaatactttgcaaaagaggtccccaaccctaagtgtgagggctaagctcctgggcttagtaggcatatacaaatgcccccaggtgggtgacatcaagatgttctggtcctaggtctgctgagagcctctcctgggaatgttgtaggtactgcctttcccttttaggaaacaccatatcctcctaccactaacccccatccttgccctaaccagcaatctgtaacatcctgggcctcagggacgtgggtggagggtgactctgagctccagatagtgtctaggaggctcaaataagcctgctttttggtcctcaccctagccgtgggccaccctactctgcactccctaccaagcagctcagagaatggaggccagcgcccaaaagtctccatagttcatagggagccccaaacctcaacactgccctttcccaagcctcaaaatttctcttaccctgacccaggcacacccactcaactcttacccttgatccccctcccaggaccagaagggattgatttctggtgagtcctgccccaagctgtgcttgcctgctctgttcgtacctaatattgcatgaggaacctggccagtgtctatggtggcaagtgcttcacccattctgtcctcttccccagaaaagactaatagggagggaagaagcgtgcgcagaagctaaggaactctcttccttctctaccaaggccacccctacatctactccctgcaaatctgttatttcccttgacattcagcaaatatttggggttttgttttgttttgttttgttttgttttgttttgagacagagcctcactttgtcgccaggctggagtgcagtggcgcgatctcggctcactacaacttccgcctcccgggttcaagcgattcttctgcctcagcctcccgagtagctgggactacaggcgtgtgccaccacgcccagctaatttttggtatttttagtagagatggggtttcacgatcttggccatcatgccccgtctcccagcccggcgcggcccccagggacctgtcctccagttcagccgcccttccctcttctccttacatagttataggtggagagggtggggtgcaccgcccctatctctcacccacgtaagtggggtgatgctgatttagtctctgcttttcccttgagggattggggaggacccagtccaggcctttctaagatactcctccagccgggcgcggtggctcacgcctgtaatcccagcactttgggaggccgaggcgggcggatcacaaggtcaggagatcgagaccatcctggctaacacggtgaaaccccgtctctactaaaaatataaaaaattagccgggcgtggtggcgggtgcctgtattgccagctactcggaaggctgaggcaggagaatggcgtgaacctgggaggtggagcttgcagtgagcggacatcgcgccactgcactccagcctgggcgacagagcaagactccgtctcaaaaaaaaaaaaaaaaaaaaaaaaaaaaaaagatacttctccaaagtgttctcatgtggcctcacccaggtcttgtgtattatttggtaattaatttatggatcttaaaaactgcagtattcccccattttgtgatgagagtgtggggctggcaggggttggttggagggaggagagaagacagaggagcacttaaggtgcaaagcagcctattttttcttcaataaaaattgttaagagaaaaaaaaat

SEQ ID NO: 343635 - DNA, 1117 bp, Homo sapiens
gagaaagggctaatgtctgagcagtcgggtggcttcctagatgaggggactgtcctcccaggagctgctactcagagtagtttcttgtcctcctaaagtttagagtggaaatactttgcaaaagaggtccccaaccctaagtgtgagggctaagctcctgggcttagtaggcatatacaaatgcccccaggtgggtgacatcaagatgttctggtcctaggtctgctgagagcctctcctgggaatgttgtaggtactgcctttcccttttaggaaacaccatatcctcctaccactaacccccatccttgccctaaccagcaatctgtaacatcctgggcctcagggacgtgggtggagggtgactctgagctccagatagtgtctaggaggctcaaataagcctgctttttggtcctcaccctagccgtgggccaccctactctgcactccctaccaagcagctcagagaatggaggccagcgcccaaaagtctccatagttcatagggagccccaaacctcaacactgccctttcccaagcctcaaaatttctcttaccctgacccaggcacacccactcaactcttacccttgatccccctcccaggaccagaagggattgatttctggtgagtcctgccccaagctgtgcttgcctgctctgttcgtacctaatattgcatgaggaacctggccagtgtctatggtggcaagtgcttcacccattctgtcctcttccccagaaaagactaatagggagggaagaagcgtgcgcagaagctaaggaactctcttccttctctaccaaggccacccctacatctactccactccagcctgggcgacagagcaagactccgtctcaaaaaaaaaaaaaaaaaaaaaaaaaaaaaaagatacttctccaaagtgttctcatgtggcctcacccaggtcttgtgtattatttggtaattaatttatggatcttaaaaactgcagtattcccccattttgtgatgagagtgtggggctggcaggggttggttggagggaggagagaagacagaggagcacttaaggtgcaaagcagcctattttttcttcaataaaaattgttaagagaaaaaaaaat

SEQ ID NO: 343636 - DNA, 1205 bp, Homo sapiens
gagaaagggctaatgtctgagcagtcgggtggcttcctagatgaggggactgtcctcccaggagctgctactcagagtagtttcttgtcctcctaaagtttagagtggaaatactttgcaaaagaggtccccaaccctaagtgtgagggctaagctcctgggcttagtaggcatatacaaatgcccccaggtgggtgacatcaagatgttctggtcctaggtctgctgagagcctctcctgggaatgttgtaggtactgcctttcccttttaggaaacaccatatcctcctaccactaacccccatccttgccctaaccagcaatctgtaacatcctgggcctcagggacgtgggtggagggtgactctgagctccagatagtgtctaggaggctcaaataagcctgctttttggtcctcaccctagccgtgggccaccctactctgcactccctaccaagcagctcagagaatggaggccagcgcccaaaagtctccatagttcatagggagccccaaacctcaacactgccctttcccaagcctcaaaatttctcttaccctgacccaggcacacccactcaactcttacccttgatccccctcccaggaccagaagggattgatttctggtgagtcctgccccaagctgtgcttgcctgctctgttcgtacctaatattgcatgaggaacctggccagtgtctatggtggcaagtgcttcacccattctgtcctcttccccagaaaagactaatagggagggaagaagcgtgcgcagaagctaaggaactctcttccttctctaccaaggccacccctacatctactccctgcaaatctgttatttcccttgacattcagcaaatatttggggttttgttttgttttgttttgttttgttttgttttgagacagagcactccagcctgggcgacagagcaagactccgtctcaaaaaaaaaaaaaaaaaaaaaaaaaaaaaaagatacttctccaaagtgttctcatgtggcctcacccaggtcttgtgtattatttggtaattaatttatggatcttaaaaactgcagtattcccccattttgtgatgagagtgtggggctggcaggggttggttggagggaggagagaagacagaggagcacttaaggtgcaaagcagcctattttttcttcaataaaaattgttaagagaaaaaaaaat

SEQ ID NO: 343637 - DNA, 1940 bp, Homo sapiens
catggaggccctgggacctgggggcgaccgcgcctccccggcctcgtccactagcagcctggacctgtggcatctgtccatgcgcgcggactcggcctacagctctttctccgcagcctccggcggccccgagccgcgcacgcagtcgccggggacagacctccttccttacctagactgggactacgtgcgtgtggtttggggcggcccgggccccgccccgcccgacgctgccctttgcacatccccgcggccccggcccgcggttgcagcccgcagtgggccgcagccaacagaggtcccggggaccccgggaccactgaacaggcaggccaccccgctgctgtacgcgctggcggccgaggcggaggccgcggcgcaggctgccgagccgcccagcccgccggcctcgagggccgcctaccgccagcggcttcagggcgcgcagcggcgagtgctccgggagacgtcgttccagcgcaaggagctccgcatgagcctgcccgcccgtctgcggcccactgtcccagcgcggcccccggcgactcacccgcgctccgcctcgctcagccacccgggcggggagggggagccggcgcgctcccgggctcccgcgccaggaactgccggccggggtcccctcgccaaccagcagcggaagtggtgcttctcagagccaggaaagctggatcgtgtgggtcggggcggtgggccggcgcgggaatgcctgggtgaggcctgctccagctctggcctccctgggcccgagcccttggagttccagcatccggcgctggctaagtttgaagatcacgaggtcggatggctgcccgagacgcaaccccaaggctccatgaacctggactccgggtccttgaagctcggtgatgccttcaggcccgccagtcggagtcggagcgcttcaggcgaagtcttgggttcctggggaggatcaggagggaccatacccattgtccaggctgttccccaaggagcagaaacccccagaccattgtttcagaccaaactttccaggttcttgcctcagaaagaggctgcggtgatgtatcctgcagagttaccccagagcagccctgctgacagtgaacagagggtctcagagacctgcattgtgcctgcctggctcccctcccttcctgatgaagtgttcctagaagaggccccactggtcagaatgagatcaccaccagacccccatgcctcccaggggcccccagccagtgtccatgcctctgaccagccgtatggaactggcttaggccaaagaactggccaggttacagtccccacagagtacccgctccatgagtgtccaggaactgcaggggcagatgactgctggcagggggtgaatggttctgtaggtatttccaggcccacaagccacacccccactgggactgcaaatgataacatcccaactattgaccccactggactgaccaccaatccccccacagctgcagagagtgacctcctcaaacctgtcccagctgatgccttgggactttcaggcaatgatactccaggtccctctcacaatactgccctagccaggggcactggccagcctggttccaggcccacatggcctagtcagtgcctcgaggagctggttcaggagctggccagattagatccctctctatgtgaccctcttgcttcccagcccagcccagagccacccctgggcctgctggatggactgattcctttagcagaggtccgggctgcaatgcggcctgcctgtggggaggctggagaggaggctgccagtacttttgagccagggtcctatcagttcacttcaccagtctggcggtcctcggagagacaaggtgaaacctgtccccccccttgttgacacctgggacgggccctccaaaacgtcccgcaaatgaggcccctcaaatgtgccc

SEQ ID NO: 343638 - DNA, 444 bp, Homo sapiens
cgagcccttggagttccagcatccggcgctggctaagtttgaagatcacgaggtcggatggctgcccgagacgcaaccccaaggctccatgaacctggactccgggtccttgaagctcggtgatgccttcaggcccgccagtcggagtcggagcgcttcaggcgaagtcttgggttcctggggaggatcaggagggaccatacccattgtccaggtatggaagtcaggagatgcaggctggtgaggggagcatctgggaaacaaaacttgagccacatttcagtcgactgttcacccttccaggctgttccccaaggagcagaaacccccagaccattgtttcagaccaaactttccaggtgagagacacggaccactctggaccaagttggggggaagcagcttgcatagcttttgcccaaaaaatgaaagggcttcctacct

SEQ ID NO: 343639 - DNA, 1840 bp, Homo sapiens
catggaggccctgggacctgggggcgaccgcgcctccccggcctcgtccactagcagcctggacctgtggcatctgtccatgcgcgcggactcggcctacagctctttctccgcagcctccggcggccccgagccgcgcacgcagtcgccggggacagacctccttccttacctagactgggactacgtgcgtgtggtttggggcggcccgggccccgccccgcccgacgctgccctttgcacatccccgcggccccggcccgcggttgcagcccgcagtgggccgcagccaacagaggtcccggggaccccgggaccactgaacaggcaggccaccccgctgctgtacgcgctggcggccgaggcggaggccgcggcgcaggctgccgagccgcccagcccgccggcctcgagggccgcctaccgccagcggcttcagggcgcgcagcggcgagtgctccgggagacgtcgttccagcgcaaggagctccgcatgagcctgcccgcccgtctgcggcccactgtcccagcgcggcccccggcgactcacccgcgctccgcctcgctcagccacccgggcggggagggggagccggcgcgctcccgggctcccgcgccaggaactgccggccggggtcccctcgccaaccagcagcggaagtggtgcttctcagagccaggaaagctggatcgtgtgggtcggggcggtgggccggcgcgggaatgcctgggtgaggcctgctccagctctggcctccctgggcccgagcccttggagttccagcatccggcgctggctaagtttgaagatcacgaggtcggatggctgcccgagacgcaaccccaaggctccatgaacctggactccgggtccttgaagctcggtgatgccttcaggcccgccagtcggagtcggagcgcttcaggcgaagtcttgggttcctggggaggatcaggagggaccatacccattgtccaggctgttccccaaggagcagaaacccccagaccattgtttcagaccaaactttccaggttcttgcctcagaaagaggctgcggtgatgtatcctgcagagttaccccagagcagccctgctgacagtgaacagagggtctcagagacctgcattgtgcctgcctggctcccctcccttcctgatgaagtgttcctagaagaggccccactggtcagaatgagatcaccaccagacccccatgcctcccaggggcccccagccagtgtccatgcctctgaccagccgtatggaactggcttaggccaaagaactggccaggttacagtccccacagagtacccgctccatgagtgtccaggaactgcaggggcagatgactgctggcagggggtgaatggttctctgcagagagtgacctcctcaaacctgtcccagctgatgccttgggactttcaggcaatgatactccaggtccctctcacaatactgccctagccaggggcactggccagcctggttccaggcccacatggcctagtcagtgcctcgaggagctggttcaggagctggccagattagatccctctctatgtgaccctcttgcttcccagcccagcccagagccacccctgggcctgctggatggactgattcctttagcagaggtccgggctgcaatgcggcctgcctgtggggaggctggagaggaggctgccagtacttttgagccagggtcctatcagttcacttcaccagtctggcggtcctcggagagacaaggtgaaacctgtccccccccttgttgacacctgggacgggccctccaaaacgtcccgcaaatgaggcccctcaaatgtgccc

SEQ ID NO: 343640 - DNA, 252 bp, Homo sapiens
acatgtcttggcttagttgttttgcttgattttctaaaagaagaaggttctctagataaggtagagtttagaactcttctaacaatataggtttgtcttttaatcttcctgctaaagatatgagcggttagagtattctgtatttatctgtgcacttactttcaccagtgagttttataccttcagatgatttcttgttgcttgttaatgtccttttctttcagattgaagaacttccctttagcattttct

SEQ ID NO: 343641 - DNA, 468 bp, Homo sapiens
tctgtgccaagagaagtttaaacaaaggggcacaaaggttttccgctttttatttattttttttacagtggggtgtcaggggattattctctgctttcatctcctgtaaaatgtttacaaatgagaaaaaatttttttaaatgacatccactgctttttgacaaaaagaagaattgaaatactgtgtctgaaatgtacaataaagaacagttgataatgttgtgaattatggaaggttagttagtgttggtgagtgtcaggaaagaactggaaatttaaaatctgattgcaagccagagttaggctggggcaacagggagttagatttgagtctctgcctgccacacatttggaaaatgcatgagaaaactagttcccttttggagtgttaaaataactaaaaaacaggtgattatgttgaggtggctctagtgtcctgagctctgagtggagagacaggccaaggcc

SEQ ID NO: 343642 - DNA, 3110 bp, Homo sapiens
ccttttgtgggagtccggtctgtccacttgccggtccctcagaccgtcggcggtctctgtccgcttcgggacctgtccgctggtcgctccgcgtccgatggctcctggccgcggaaccttaggcctggccctggtctccgagcgcgggttcgccgggaggagcgtgtggcgggggtgtgccggggcgtgagtgcgccgagcatggggctgagcctggtgtggggagtgggtatctgcggagccggcctgaaccccacctcagccgggcgcggggagggggctccgtgcgtgtgatcgtgcagctgtgagcgcgtggccgccccgcggggctccgctgcaggcccctcagccccaggagcagtactcgctcttcagggcctgccctggatcctggaggctacacagctgcccactcctcctggggaggctgccgtggaggccatggagatccctgccccggagcccgagaagacagctctttcctctcaggatcctgctctttccctgaaagagaatctcgaggatatatcgggttggggtcttcccgaagccaggtccaaggaatcggtgagtttcaaggatgtggctgtggacttcacccaggaggagtggggtcaactagactcccctcagagggccttgtaccgggatgtgatgttggagaactaccagaaccttcttgccctaggacctccactgcacaagccagatgtgatctctcatctggaacgaggcgaggagccatggagcatgcagagggaagtccccagagggccctgtccagaatgggagctgaaggcggtgccctctcaacagcagggcatttgcaaagaagaaccggcccaggagcccatcatggagcggcccctcggcggggcgcaggcgtgggggcgccaggcaggtgctctgcagaggagtcaggctgcgccctgggcgcccgcacctgccatggtctgggacgtccctgtagaggaattccccctcaggtgtcccctcttcgcccagcaacgcgttcccgaggggggacccttgctggacacacgcaagaacgtccaggccactgagggcagaaccaaggcccccgcgagactgtgtgcaggggaaaacgcctccacgccaagtgagccagaaaagttcccccaggtgcgccggcagcgcggggcgggcgccggggagggcgagttcgtgtgcggcgagtgcgggaaggcgttccgccagagctcctccctcacgctgcaccggcgctggcacagccgggagaaggcttacaagtgcgatgaatgcggcaaggccttcacctggagcaccaaccttctggagcaccggcgcatccacaccggcgagaagcccttcttctgcggcgagtgcgggaaggccttcagctgccactcgtccctcaacgtgcaccagcgcatccacacgggcgagcggccctacaagtgcagcgcctgcgagaaggccttcagctgcagctcgctgctcagcatgcacctgcgggtgcacaccggcgagaagccctaccggtgcggcgagtgcggcaaggccttcaaccagcgtacacacctcacacgccaccaccgcatccacacgggcgagaagccctaccagtgcggctcctgcggcaaggccttcacctgccactcatccctcaccgtgcatgagaagatccacagcggggacaagccgttcaagtgcagcgactgcgagaaggccttcaacagccgctcgcgcctcaccctccaccagaggacgcacacgggcgagaagcccttcaagtgcgccgactgcgggaagggcttcagctgccacgcgtacctgctcgtgcaccggcgcatccacagcggcgagaagcccttcaagtgcaacgagtgcggcaaagccttcagctcccacgcctacctcatcgtgcaccggcgcatccacacaggcgagaagcccttcgactgcagccagtgttggaaggccttcagctgccactcgtccctcatcgtgcaccagcgcatccacaccggtgagaagccctacaagtgcagcgagtgcggcagagccttcagccagaaccactgtctcattaaacatcagaaaatccactccggggagaagtcgtttaagtgtgagaaatgtggggagatgttcaactggagctcgcacctcactgagcaccagaggctgcacagcgaggggaagcccttggccatccagttcaacaaacacctgctcagcacatactacgtgcctggcagcctgctgggtgcaggggatgctggactgagggacgtggatcccatcgacgcgctggatgtggcaaagctcttgtgcgtggttccccccagagctggcaggaatttctccctggggagcaaacctcgaaactaacatgatgtgctttggtgtcagtagctgctttctgagctactcaacaaggaaagcaccctggtcctccctggctcctagatccagaccaccttcctccaggtgtgggagccttgccttatcacccccatcaggtctgcatgccagggtgcctcctctagttaaagtcagtcacctccccagaagggccacactccaggaggagtgttgagagtcatttgaggtagtcttgccacctgttttccttgatgggcctggaagttgttgacaaggggaaagatctttcttgccaataaaaagaagggatatcgttgggtgccatggctcacacctgtaatcttaacactgtgggaggccaaggcaaggggatcacttgagcccaggagtctaggaccagcctggacaacatggtgagacctcgtctctacaaaaaatgcaaaaattagccagatgtggcggcatgtccctgtggtcccagctactcaggaggctgaggtgggaggatcatttgagcctaggaggtcaaggctgcagtgagccatgattcacagcactgcactgcagcctgggtgacaaagcaagaccctgtgtgaaattaaaaggaggtatatcaactgttgtatcctcggacgggctcctgacatggctttaatcaggagtttcctccataaactattattttcagaataataataaaacaagaattatgactagcaaaaactttccagtgaacatta

SEQ ID NO: 343643 - DNA, 1040 bp, Homo sapiens
ccttttgtgggagtccggtctgtccacttgccggtccctcagaccgtcggcggtctctgtccgcttcgggacctgtccgctggtcgctccgcgtccgatggctcctggccgcggaaccttaggcctggccctggtctccgagcgcgggttcgccgggaggagcgtgtggcgggggtgtgccggggcgtgagtgcgccgagcatggggctgagcctggtgtggggagtgggtatctgcggagccggcctgaaccccacctcagccgggcgcggggagggggctccgtgcgtgtgatcgtgcagctgtgagcgcgtggccgccccgcggggctccgctgcaggcccctcagccccaggagcagtactcgctcttcagggcctgccctggatcctggaggctacacagctgcccactcctcctggggaggctgccgtggaggccatggagatccctgccccggagcccgagaagacaggaatcggtgagtttcaaggatgtggctgtggacttcacccaggaggagtggggtcaactagactcccctcagagggccttgtaccgggatgtgatgttggagaactaccagaaccttcttgccctaggacctccactgcacaagccagatgtgatctctcatctggaacgaggcgaggagccatggagcatgcagagggaagtccccagagggccctgtccagagacaggatctccctctgtcacccaggctggagtgtggtgccgcagtcacagctcactgcagcctcgaacttgtgggctcaagtgatcctgcctcagcctcctgagtagctgggactacagacacactccaccatgcctggggtctcactctgtcacccaggctggagtacagtggtgccattgcagatcactgcagcctcaacctcctgggttcaagtgatcctcccacctcagcctcctgagtaattaggattacaggcttaagccaccatgcccagcctactttaatcattttttaattttaattttatttatttttttaaattttactttaagttctg

SEQ ID NO: 343644 - DNA, 3784 bp, Homo sapiens
ccttttgtgggagtccggtctgtccacttgccggtccctcagaccgtcggcggtctctgtccgcttcgggacctgtccgctggtcgctccgcgtccgatggctcctggccgcggaaccttaggcctggccctggtctccgagcgcgggttcgccgggaggagcgtgtggcgggggtgtgccggggcgtgagtgcgccgagcatggggctgagcctggtgtggggagtgggtatctgcggagccggcctgaaccccacctcagccgggcgcggggagggggctccgtgcgtgtgatcgtgcagctgtgagcgcgtggccgccccgcggggctccgctgcaggcccctcagccccaggagcagtactcgctcttcagggcctgccctggatcctggaggctacacagctgcccactcctcctggggaggctgccgtggaggccatggagatccctgccccggagcccgagaagacaggtacagcttcactcttgtagtcagtatgtctgtggatttgcacttgaggatattgacactcagagagatcaggccagtttcccagaagcatccagcatcttttttttttttttttaaatggaatctcactctgtcacccaggcgggagtggtgcaatggcttgatcttccgctcactgcaacctctgcttcccgggttcaaactattctcccgcctcaacctcccaagtagttgggattgcaggcacgcgccaccacgcccggctaatgtttgtatttttagtagagacggggttttgccatgtttcccaggctggtcttaagctcaagcgatccgcccgcctcggcctcccaaagtgctgggattacaggcgtgagccgatcggctcctggcctcctgcttctttcttccccgcgcccaatcatttgttcccactcagacgtgcttgattggcggtagcagctcttttcgtcatgaattggagtgtctgagacacaggcagattattcctcgatgctgtttctgttggtgctagctactggggctcgttccccacctggccttgctggcaggttctgcctcctctctgattctcacttgtgccacgacaggtgggctttaagctcagccgtgagcctggtagccgtgaccttgactcatttctccttcgccagctctttcctctcaggatcctgctctttccctgaaagagaatctcgaggatatatcgggttggggtcttcccgaagccaggtccaaggaatcggtgagtttcaaggatgtggctgtggacttcacccaggaggagtggggtcaactagactcccctcagagggccttgtaccgggatgtgatgttggagaactaccagaaccttcttgccctaggacctccactgcacaagccagatgtgatctctcatctggaacgaggcgaggagccatggagcatgcagagggaagtccccagagggccctgtccagaatgggagctgaaggcggtgccctctcaacagcagggcatttgcaaagaagaaccggcccaggagcccatcatggagcggcccctcggcggggcgcaggcgtgggggcgccaggcaggtgctctgcagaggagtcaggctgcgccctgggcgcccgcacctgccatggtctgggacgtccctgtagaggaattccccctcaggtgtcccctcttcgcccagcaacgcgttcccgaggggggacccttgctggacacacgcaagaacgtccaggccactgagggcagaaccaaggcccccgcgagactgtgtgcaggggaaaacgcctccacgccaagtgagccagaaaagttcccccaggtgcgccggcagcgcggggcgggcgccggggagggcgagttcgtgtgcggcgagtgcgggaaggcgttccgccagagctcctccctcacgctgcaccggcgctggcacagccgggagaaggcttacaagtgcgatgaatgcggcaaggccttcacctggagcaccaaccttctggagcaccggcgcatccacaccggcgagaagcccttcttctgcggcgagtgcgggaaggccttcagctgccactcgtccctcaacgtgcaccagcgcatccacacgggcgagcggccctacaagtgcagcgcctgcgagaaggccttcagctgcagctcgctgctcagcatgcacctgcgggtgcacaccggcgagaagccctaccggtgcggcgagtgcggcaaggccttcaaccagcgtacacacctcacacgccaccaccgcatccacacgggcgagaagccctaccagtgcggctcctgcggcaaggccttcacctgccactcatccctcaccgtgcatgagaagatccacagcggggacaagccgttcaagtgcagcgactgcgagaaggccttcaacagccgctcgcgcctcaccctccaccagaggacgcacacgggcgagaagcccttcaagtgcgccgactgcgggaagggcttcagctgccacgcgtacctgctcgtgcaccggcgcatccacagcggcgagaagcccttcaagtgcaacgagtgcggcaaagccttcagctcccacgcctacctcatcgtgcaccggcgcatccacacaggcgagaagcccttcgactgcagccagtgttggaaggccttcagctgccactcgtccctcatcgtgcaccagcgcatccacaccggtgagaagccctacaagtgcagcgagtgcggcagagccttcagccagaaccactgtctcattaaacatcagaaaatccactccggggagaagtcgtttaagtgtgagaaatgtggggagatgttcaactggagctcgcacctcactgagcaccagaggctgcacagcgaggggaagcccttggccatccagttcaacaaacacctgctcagcacatactacgtgcctggcagcctgctgggtgcaggggatgctggactgagggacgtggatcccatcgacgcgctggatgtggcaaagctcttgtgcgtggttccccccagagctggcaggaatttctccctggggagcaaacctcgaaactaacatgatgtgctttggtgtcagtagctgctttctgagctactcaacaaggaaagcaccctggtcctccctggctcctagatccagaccaccttcctccaggtgtgggagccttgccttatcacccccatcaggtctgcatgccagggtgcctcctctagttaaagtcagtcacctccccagaagggccacactccaggaggagtgttgagagtcatttgaggtagtcttgccacctgttttccttgatgggcctggaagttgttgacaaggggaaagatctttcttgccaataaaaagaagggatatcgttgggtgccatggctcacacctgtaatcttaacactgtgggaggccaaggcaaggggatcacttgagcccaggagtctaggaccagcctggacaacatggtgagacctcgtctctacaaaaaatgcaaaaattagccagatgtggcggcatgtccctgtggtcccagctactcaggaggctgaggtgggaggatcatttgagcctaggaggtcaaggctgcagtgagccatgattcacagcactgcactgcagcctgggtgacaaagcaagaccctgtgtgaaattaaaaggaggtatatcaactgttgtatcctcggacgggctcctgacatggctttaatcaggagtttcctccataaactattattttcagaataataataaaacaagaattatgactagcaaaaactttccagtgaacatta

SEQ ID NO: 343645 - DNA, 2782 bp, Homo sapiens
ccttttgtgggagtccggtctgtccacttgccggtccctcagaccgtcggcggtctctgtccgcttcgggacctgtccgctggtcgctccgcgtccgatggctcctggccgcggaaccttaggcctggccctggtctccgagcgcggctctttcctctcaggatcctgctctttccctgaaagagaatctcgaggatatatcgggttggggtcttcccgaagccaggtccaaggaatcggtgagtttcaaggatgtggctgtggacttcacccaggaggagtggggtcaactagactcccctcagagggccttgtaccgggatgtgatgttggagaactaccagaaccttcttgccctaggacctccactgcacaagccagatgtgatctctcatctggaacgaggcgaggagccatggagcatgcagagggaagtccccagagggccctgtccagaatgggagctgaaggcggtgccctctcaacagcagggcatttgcaaagaagaaccggcccaggagcccatcatggagcggcccctcggcggggcgcaggcgtgggggcgccaggcaggtgctctgcagaggagtcaggctgcgccctgggcgcccgcacctgccatggtctgggacgtccctgtagaggaattccccctcaggtgtcccctcttcgcccagcaacgcgttcccgaggggggacccttgctggacacacgcaagaacgtccaggccactgagggcagaaccaaggcccccgcgagactgtgtgcaggggaaaacgcctccacgccaagtgagccagaaaagttcccccaggtgcgccggcagcgcggggcgggcgccggggagggcgagttcgtgtgcggcgagtgcgggaaggcgttccgccagagctcctccctcacgctgcaccggcgctggcacagccgggagaaggcttacaagtgcgatgaatgcggcaaggccttcacctggagcaccaaccttctggagcaccggcgcatccacaccggcgagaagcccttcttctgcggcgagtgcgggaaggccttcagctgccactcgtccctcaacgtgcaccagcgcatccacacgggcgagcggccctacaagtgcagcgcctgcgagaaggccttcagctgcagctcgctgctcagcatgcacctgcgggtgcacaccggcgagaagccctaccggtgcggcgagtgcggcaaggccttcaaccagcgtacacacctcacacgccaccaccgcatccacacgggcgagaagccctaccagtgcggctcctgcggcaaggccttcacctgccactcatccctcaccgtgcatgagaagatccacagcggggacaagccgttcaagtgcagcgactgcgagaaggccttcaacagccgctcgcgcctcaccctccaccagaggacgcacacgggcgagaagcccttcaagtgcgccgactgcgggaagggcttcagctgccacgcgtacctgctcgtgcaccggcgcatccacagcggcgagaagcccttcaagtgcaacgagtgcggcaaagccttcagctcccacgcctacctcatcgtgcaccggcgcatccacacaggcgagaagcccttcgactgcagccagtgttggaaggccttcagctgccactcgtccctcatcgtgcaccagcgcatccacaccggtgagaagccctacaagtgcagcgagtgcggcagagccttcagccagaaccactgtctcattaaacatcagaaaatccactccggggagaagtcgtttaagtgtgagaaatgtggggagatgttcaactggagctcgcacctcactgagcaccagaggctgcacagcgaggggaagcccttggccatccagttcaacaaacacctgctcagcacatactacgtgcctggcagcctgctgggtgcaggggatgctggactgagggacgtggatcccatcgacgcgctggatgtggcaaagctcttgtgcgtggttccccccagagctggcaggaatttctccctggggagcaaacctcgaaactaacatgatgtgctttggtgtcagtagctgctttctgagctactcaacaaggaaagcaccctggtcctccctggctcctagatccagaccaccttcctccaggtgtgggagccttgccttatcacccccatcaggtctgcatgccagggtgcctcctctagttaaagtcagtcacctccccagaagggccacactccaggaggagtgttgagagtcatttgaggtagtcttgccacctgttttccttgatgggcctggaagttgttgacaaggggaaagatctttcttgccaataaaaagaagggatatcgttgggtgccatggctcacacctgtaatcttaacactgtgggaggccaaggcaaggggatcacttgagcccaggagtctaggaccagcctggacaacatggtgagacctcgtctctacaaaaaatgcaaaaattagccagatgtggcggcatgtccctgtggtcccagctactcaggaggctgaggtgggaggatcatttgagcctaggaggtcaaggctgcagtgagccatgattcacagcactgcactgcagcctgggtgacaaagcaagaccctgtgtgaaattaaaaggaggtatatcaactgttgtatcctcggacgggctcctgacatggctttaatcaggagtttcctccataaactattattttcagaataataataaaacaagaattatgactagcaaaaactttccagtgaacatta

SEQ ID NO: 343646 - DNA, 689 bp, Homo sapiens
agttttctggctaggtgctgtgactgatgcttacaatcccagcactttgggaggctgaggcaggaggattgtttgagcccaggaagctgaggctgcctgcttttgcaccactccactccagcatgggtgacagagtgagaccttgtctcagcgacaataacaacaacaaaaagataagaaacaaagataaaagagttttctagtttaagctcttaactttgagtctttcggccgttatgagttaacttttatgtgtgatatgaagtagaagaatccaacgtcatttgttttgcagttggatatccagttgtcctagcaccatttgtttaaaagactgtttttttcttattgagttgccttggcacccttgtgaaagtcagttgaccataaatgtaatggtttatttctgggttatcagttgtattccactaatctacctgtttgtccttgtgtaactactctactgtcttgattactatatctttttaggaagttttgatatagggaggttcgagtcctccaacctttgttgtactttttcaagtttttcttgattttttggatcccttatatttccatatgaattttgcaattggcatgtcaattttcgctaaaagacagctgggattttgatagtgtttgtattttagatcaatttgaggagtgttactgtcttaatgtctttcaat

SEQ ID NO: 343647 - DNA, 497 bp, Homo sapiens
ctgtgcacagtgatgcctccagcagccactagtgaagccaaggagcagaacataggaaaaaaactcagctcctccatctggcagcatatggctagccagacctagtgctctaccttgcaaaactagctataaagctgaggtgagagtctttaatgaataaatgcaacaaataaactctgcaaagcagagtaataatggctatacgaagacaggtgacacgggttagagtagcagcaggaggccataaagtgcccaggacagattccagaaattttctggagtcagaatgtatagaacttgctgatagattgcacacacagagcatgaaaaagaagcaaagatgactccggggtttttggcttgagcaacagggtggaaggcagcaccatttacagtcggccctctgtacccacaggttccatatccatggatcaaaaatatttaggaaaaaagccaggtgccatggctcacttctgtaatcccagcactttgggagg

SEQ ID NO: 343648 - DNA, 128 bp, Homo sapiens
aagggtctcaggatcatggagtgcctgtctgcagcatgcactgacactccaagccgagtcccttataccaccctccccctacaagtgcccttcccacacctccccgcaatctggcccaccccactatg

SEQ ID NO: 343649 - DNA, 296 bp, Homo sapiens
tgatgttatccccaacacttatttaactggcctaatacgaaatttgtacctgtttactgacatttccccattttgccacctccccagtctctggcaactatcattctattttctgtttctatgagtttgacttttaaaattttcacaagtaagtgagattatgcagtatttgtctttctatgccctgcccagccactccagctccagctgtgacaaaaaggggccaatggacagctaaggctgttgcttcagaagatgcaggtcccaagccttggcacgcttccacatggtgttgg

SEQ ID NO: 343650 - DNA, 588 bp, Homo sapiens
gataatatacttgtaccttggttgtattttagttgcaattgttagttgcacaatttgggggaatgtttgaggtctctatagtagttactgtatttaccaggaagccctgcatgattagaattcttgagacagtgtataaagttaaattgggtgtgttgcctggatgtgaacagtaaaaaaggagaagcttctcaccatacaattatagcttaaaaggaaccaggtacaattctgtttccaaaaatagaaagtaagtcaaatattatatggatatgtaatagtaattatattaattttgactccctggccgactttttttttgaagctatcattttttgtcagagataaaaagtagcttttaaaggaaaagatatctcagcccttaattatgtgtgtgtgtatgtgtgtgtatgtatttatttatatattttagcccttgtaagagaggagcagtggaagggaactgaaggagcatgatatagagaaaagagcctgggttttggtgtgttgcatttgttctgttactagctgggagaccttgggcaaatttacctctctgatcagcagtttaattttttcatctgtaaa

SEQ ID NO: 343651 - DNA, 497 bp, Homo sapiens
ttcttgatggtcgctgtctctttggagctgttgggtacacctgcagaaagcctgtcacttcactgcccatccacgagggctggttgcatacactgcagaacatctgtgcaaaggaactggacagcctacaaagaacaatgatgcctgggaaccatcgccaggctacactgttgactaacaaagccacgggccccgcaagaaacaattcagtaatttccacagggttggagatgactcagcagttccactcctgcacgagcacccgagagttgccctgatagccgtgcacttgggcgttcatcacagcatttgcttcttacatgaatttttaattttggaataatttcagatttacagagaagttacaaatccaatacagagaattcttgtatactaccctgctcagttttctcctacaattaacatcttaatcatgatacatttatgaaaaccaagaaattaacattggtagaatgttattaattaaatgacagatt

SEQ ID NO: 343652 - DNA, 175 bp, Homo sapiens
gaagctgcttgttggttatttctttagttgaaagcacatcaattaagagaagaaaagtagcactgtactattttatatggtcttaccaaagtctaaagatgtttattttttaagaatgtgatagaatttgttttgctaaattcagtctcatttgtaattttttactggtggtttg

SEQ ID NO: 343653 - DNA, 590 bp, Homo sapiens
gctagatatattttaccataatttaaaaaaaggtatgcaaaagattaagaacttctctccatgcaaaaacaaaaagctaaagatagaaaaatataaactggaaagccagtaaccaaagaaagctggtatactattaataccagagaaaaacagacttctagagaaaaagctttattagaaagaaagaatgtcacttcataataatgtttcattgactctggaatttctaaacctgcatggtccatcatagtagccattagccacatgtaactatttaaatttaaactgattacagccgagcacagtggctcacgcctataatcccagcaatttgagaggccaaggcagctggaccacctgaggccaggagtttgagactagcctggccaacatggtgaaacctcgtctttactaaaaatacaaaaattagccaggcatagtggtgcacacctgtaatcccagctaatcgggaggctgagtgaggcaggagaattgcttgaacccaggaggcggaggttgcagtgagccaagatcaagccactgtactccagcctgggtgacagagtgagactctgtctcaaaaaaattaa

SEQ ID NO: 343654 - DNA, 245 bp, Homo sapiens
tgatcggcctgccttggcctcccaaagtgctaggattataggagtgacccactgcgctgagctactatagtgaattctctatcactggaaatactcaggctgagatcagacaatcacttgggatgctgcagaagcggttggttggttggacaagacaattatgaacaacctttcctaatctgagcttctgtgattctgcggcagcagaagtcacctttatgcctatggacacatgaagtgtgaca

SEQ ID NO: 343655 - DNA, 3768 bp, Homo sapiens
agaagtcagatgaaaaaattgtgattcaccataagccattgagatccacatggagccaactctctgcggtgaaaagaaagggattatctcagacagtaagccaggaggaaagaaagagacaagaggctatctttgaagtcatatcctctgaacattcatatttactcagcttggagatcttgatacgaatgtttaaaaattctaaagaactgagtgatacaatgactaaaaccgagaggcaccatcttttctccaatattacagatgtctgtgaggcaagcaaaaagttctttatagagttggaagcaagacatcagaataatatcttcatagatgacataagtgacattgtggaaaaacacacagcatccacatttgacccatatgtgaaatactgcacaaatgaagtctaccaacaacgaacactacaaaaattgttagctaccaatccatcctttaaggaagtattgtcaaggattgagtcccatgaagactgtaggaacttacccatgatctcttttctcattctccccatgcagagggtgacccgccttcccctgctgatggatactatctgtcaaaaaacacctaaggactctccgaagtatgaagtctgcaaaagagccttgaaggaagttagcaagttggttcgactatgcaatgagggcgcccggaagatggaaaggactgagatgatgtacacaattaactcccagctggaatttaaaattaagccttttcctttagtctcctcttcccggtggttggtaaaaagaggtgaattgacagcctatgttgaagacactgtgcttttctcaagaaggacatccaaacagcaagtctacttctttctctttaacgatgtgctcattatcaccaagaagaagagtgaagaaagttacaacgtcaatgattattccttaagagatcagctattggtggaatcttgtgacaatgaagagcttaattcttctccagggaagaacagctccacaatgctctattcaagacagagctctgccagtcacctctttactctgacagtccttagtaaccacgcgaatgagaaagtggagatgctactaggagctgagacgcagagcgagcgagcccgctggataactgccctgggacacagcagcgggaagccgcctgcagaccgaacctcactgacccaggtggaaatcgttaggtcatttactgctaagcagccagatgaactctccctgcaggtggctgacgtcgtcctcatctatcaacgtgtcagcgatggctggtatgagggggaacgactacgagatggagaaagaggctggtttcctatggaatgtgccaaggagataacatgtcaagctacaattgataagaatgtggagagaatgggacgcttgctaggactggagaccaacgtgtagtctctcagatggtcttttgttactgcaagatttgcacgacacttaccgggctggttggttctgggctagttttattgttaattttgtcacagcctatttaattaaaagaacgaaaacacttgcctttaagcttgccaggttgttctgctctctcatgagaagagcttggatacagtgagtttgcacagctcagtttttacctaaccacacacttgcagacctcctgaggtacacagaatagctgagcagttcacttcagggatcaggtcatctctgctcctcctagtttcaccatgttctggcaataaaaaacacatattatatcctggttttctctatccttgcattactaaggtgactgtctctctttatacatccttgtatggttctcccagtattagcaagattgtatatctgtaaagaatgtccagttttgtaaatatttccctgcctttttttttctttttttacatctgattttaatgcttcgttaacttcaaaaggaactggtagagttcagaaggtgagctgttgtttttctaaacctcttcccaggaaggggacattgacacttgaatttttgtcacctttttcctcattagaaggaaagtagaaagccttactgtaggatttttaaaaaaaaatccatctcaccccatattggtcttaaataagtatagactaattaacctaagctacctttaacaacgtagaatttagatgggttcatatatgtgagaaaaacctgaatataggacaggggtcctacttttttccccacctctgtcgcccaggctagagtatagtggtgtgatcttggcccactgcaacctctgcttcctaggttcaagtgattctcctgcctcagcctcccaagtagctgggattgtaagagtatgccaccacgcccagctactttttgtatttttagtagagacagggtttcatcatgttggccaggatggtctcttaactcctgccctcaagtgatccaccagagaggagatcctcggcctccccaagtgctgggattataggcatgagccaccgtgcccagcctactttctaattaattaaaaaaaaaaaaaaaaaaaaaaaaaaaccttcccaaatgagctgataaaaaactgacgtgaggctgctttgccttcaataatacctagttttcagctgttccaactcgtttccaaatagaaattagctggaacacactacagtaatctcaaggaagggaaaattaggccttaaaagataccaagaagtcagcatggtacccaattgaaaccttttgaccttagtgggaattcattctatttgcactaaaagccttaacttgctgtattcagagtccctcttaactgtgagtttctatagaactttactttttccactagtgcacagagagagaaaggttatcttaatagtcggtttcatggagatgaaggatgggagattaagaggggggaaatgatttttactggcagctatattccctctctgttctatttgctttaacaaagggataaaacctggcaaagtgtacattattggaggactcaaatctgtatgtgacatgtcccaactactgtccgctaactagttatccaaattgtaaagctacagaagcccagttgaggggtaagtgtgcctggctcacacagcctgcaccctgtcacctcggcaatgagccagtgtggggcactggggacttctaacccttggattgctctttttgacctgtgcataccttctaattgtaaaatatatttcagaccgtgagtaccttgagatctgagcaactgtgttaatgaagtaatagcaatggtccacagtgaaagatgtgttggggtttgcaaaacaagcattccgtcacctctttaataatgtcacagactttttaaaagagaggctatcaagttgtaatataatctgtcatgttttatttaggaaggaaggtaaatttgtgcttgcacggggatcattttgtattatttttgctaatacccagttgaagctaaaaagcaactatttgaatcctgtgaattaatttataagaatgttaaacagctttggaaatacatgcatcttatgaatcatagccttatttagcaagatcaatgttaaagtgttgttatatggcaagtatttaacacattcacagtgtttgtttgatttcaactgtgaattgtcttacagttttttcaaacctagttgtttctatggacacctgctctgaattgtacattgacttcattactaaagaacaaaaatgttcatttttgtcccagtaaattgagactgcttgtacactttcagaaaaatatgtgaatttataaagattttgtagatactt

SEQ ID NO: 343656 - DNA, 3921 bp, Homo sapiens
agaagtcagatgaaaaaattgtgattcaccataagccattgagatccacatggagccaactctctgcggtgaaaagaaagggattatctcagacagtaagccaggaggaaagaaagagacaagaggctatctttgaagtcatatcctctgaacattcatatttactcagcttggagatcttgatacgaatgtttaaaaattctaaagaactgagtgatacaatgactaaaaccgagaggcaccatcttttctccaatattacagatgtctgtgaggcaagcaaaaagttctttatagagttggaagcaagacatcagaataatatcttcatagatgacataagtgacattgtggaaaaacacacagcatccacatttgacccatatgtgaaatactgcacaaatgaagtctaccaacaacgaacactacaaaaattgttagctaccaatccatcctttaaggaagtattgtcaaggattgagtcccatgaagactgtaggaacttacccatgatctcttttctcattctccccatgcagagggtgacccgccttcccctgctgatggatactatctgtcaaaaaacacctaaggactctccgaagtatgaagtctgcaaaagagccttgaaggaagttagcaagttggttcgactatgcaatgagggcgcccggaagatggaaaggactgagatgatgtacacaattaactcccagctggaatttaaaattaagccttttcctttagtctcctcttcccggtggttggtaaaaagaggtgaattgacagcctatgttgaagacactgtgcttttctcaagaaggacatccaaacagcaagtctacttctttctctttaacgatgtgctcattatcaccaagaagaagagtgaagaaagttacaacgtcaatgattattccttaagagatcagctattggtggaatcttgtgacaatgaagagcttaattcttctccagggaagaacagctccacaatgctctattcaagacagagctctgccagtcacctctttactctgacagtccttagtaaccacgcgaatgagaaagtggagatgctactaggagctgagacgcagagcgagcgagcccgctggataactgccctgggacacagcagcgggaagccgcctgcagaccgaacctcactgacccaggtggaaatcgttaggtcatttactgctaagcagccagatgaactctccctgcaggtggctgacgtcgtcctcatctatcaacgtgtcagcgatggctggtatgagggggaacgactacgagatggagaaagaggctggtttcctatggaatgtgccaaggagataacatgtcaagctacaattgataagaatgtggagagaatgggacgcttgctaggactggagaccaacgtgtagtctctcagatggtcttttgttactgcaagatttgcacgacacttaccgggctggttggttctgggctagttttattgttaattttgtcacagcctatttaattaaaagaacgaaaacacttgcctttaagcttgccaggttgttctgctctctcatgagaagagcttggatacagtgagtttgcacagctcagtttttacctaaccacacacttgcagacctcctgaggtacacagaatagctgagcagttcacttcagggatcaggtcatctctgctcctcctagtttcaccatgttctggcaataaaaaacacatattatatcctggttttctctatccttgcattactaaggtgactgtctctctttatacatccttgtatggttctcccagtattagcaagattgtatatctgtaaagaatgtccagttttgtaaatatttccctgcctttttttttctttttttacatctgattttaatgcttcgttaacttcaaaaggaactggtagagttcagaaggtgagctgttgtttttctaaacctcttcccaggaaggggacattgacacttgaatttttgtcacctttttcctcattagaaggaaagtagaaagccttactgtaggatttttaaaaaaaaatccatctcaccccatattggtcttaaataagtatagactaattaacctaagctacctttaacaacgtagaatttagatgggttcatatatgtgagaaaaacctgaatataggacaggggtcctacttttttccccacctctgtcgcccaggctagagtatagtggtgtgatcttggcccactgcaacctctgcttcctaggttcaagtgattctcctgcctcagcctcccaagtagctgggattgtaagagtatgccaccacgcccagctactttttgtatttttagtagagacagggtttcatcatgttggccaggatggtctcttaactcctgccctcaagtgatccaccagagaggagatcctcggcctccccaagtgctgggattataggcatgagccaccgtgcccagcctactttctaattaattaaaaaaaaaaaaaaaaaaaaaaaaaaaccttcccaaatgagctgataaaaaactgacgtgaggctgctttgccttcaataatacctagttttcagctgttccaactcgtttccaaatagaaattagctggaacacactacagtaatctcaaggaagggaaaattaggccttaaaagataccaagaagtcagcatggtacccaattgaaaccttttgaccttagtgggaattcattctatttgcactaaaagccttaacttgctgtattcagagtccctcttaactgtgagtttctatagaactttactttttccactagtgcacagagagagaaaggttatcttaatagtcggtttcatggagatgaaggatgggagattaagaggggggaaatgatttttactggcagctatattccctctctgttctatttgctttaacaaagggataaaacctggcaaagtgtacattattggaggactcaaatctgtatgtgacatgtcccaactactgtccgctaactagttatccaaattgtaaagctacagaagcccagttgaggggtaagtgtgcctggctcacacagcctgcaccctgtcacctcggcaatgagccagtgtggggcactggggacttctaacccttggattgctctttttgacctgtgcataccttctaattgtaaaatatatttcagaccgtgagtaccttgagatctgagcaactgtgttaatgaagtaatagcaatggtccacagtgaaagatgtgttggggtttgcaaaacaagcattccgtcacctctttaataatgtcacagactttttaaaagagaggctatcaagttgtaatataatctgtcatgttttatttaggaaggaaggtaaatttgtgcttgcacggggatcattttgtattatttttgctaatacccagttgaagctaaaaagcaactatttgaatcctgtgaattaatttataagaatgttaaacagctttggaaatacatgcatcttatgaatcatagccttatttagcaagatcaatgttaaagtgttgttatatggcaagtatttaacacattcacagtgtttgtttgatttcaactgtgaattgtcttacagttttttcaaacctagttgtttctatggacacctgctctgaattgtacattgacttcattactaaagaacaaaaatgttcatttttgtcccagtaaattgagactgcttgtacactttcagaaaaatatgtgaatttataaagattttgtagatacttaaaaaaaaaaatacatattttactagattatttattgattaataaaaaacctctagggggggccccggtccccaattgcccttataggagtcgtttccaattcattggccgtgtttaacaagttgtactgggaaaaccctggtgtacccaatt

SEQ ID NO: 343657 - DNA, 3703 bp, Homo sapiens
agaagtcagatgaaaaaattgtgattcaccataagccattgagatccacatggagccaactctctgcggtgaaaagaaagggattatctcagacagtaagccaggaggaaagaaagagacaagaggctatctttgaagtcatatcctctgaacattcatatttactcagcttggagatcttgatacgaatgtttaaaaattctaaagaactgagtgatacaatgactaaaaccgagaggcaccatcttttctccaatattacagatgtctgtgaggcaagcaaaaagttctttatagagttggaagcaagacatcagaataatatcttcatagatgacataagtgacattgtggaaaaacacacagcatccacatttgacccatatgtgaaatactgcacaaatgaagtctaccaacaacgaacactacaaaaattgttagctaccaatccatcctttaaggaagtattgtcaaggattgagtcccatgaagactgtaggaacttacccatgatctcttttctcattctccccatgcagagggtgacccgccttcccctgctgatggatactatctgtcaaaaaacacctaaggactctccgaagtatgaagtctgcaaaagagccttgaaggaagttagcaagttggttcgactatgcaatgagggcgcccggaagatggaaaggactgagatgatgtacacaattaactcccagctggaatttaaaattaagccttttcctttagtctcctcttcccggtggttggtaaaaagaggtgaattgacagcctatgttgaagacactgtgcttttctcaagaaggacatccaaacagcaagtctacttctttctctttaacgatgtgctcattatcaccaagaagaagagtgaagaaagttacaacgtcaatgattattccttaagagatcagctattggtggaatcttgtgacaatgaagagcttaattcttctccagggaagaacagctccacaatgctctattcaagacagagctctgccagtcacctctttactctgacagtccttagtaaccacgcgaatgagaaagtggagatgctactaggagctgagacgcagagcgagcgagcccgctggataactgccctgggacacagcagcgggaagccgcctgcagaccgaacctgtggctgacgtcgtcctcatctatcaacgtgtcagcgatggctggtatgagggggaacgactacgagatggagaaagaggctggtttcctatggaatgtgccaaggagataacatgtcaagctacaattgataagaatgtggagagaatgggacgcttgctaggactggagaccaacgtgtagtctctcagatggtcttttgttactgcaagatttgcacgacacttaccgggctggttggttctgggctagttttattgttaattttgtcacagcctatttaattaaaagaacgaaaacacttgcctttaagcttgccaggttgttctgctctctcatgagaagagcttggatacagtgagtttgcacagctcagtttttacctaaccacacacttgcagacctcctgaggtacacagaatagctgagcagttcacttcagggatcaggtcatctctgctcctcctagtttcaccatgttctggcaataaaaaacacatattatatcctggttttctctatccttgcattactaaggtgactgtctctctttatacatccttgtatggttctcccagtattagcaagattgtatatctgtaaagaatgtccagttttgtaaatatttccctgcctttttttttctttttttacatctgattttaatgcttcgttaacttcaaaaggaactggtagagttcagaaggtgagctgttgtttttctaaacctcttcccaggaaggggacattgacacttgaatttttgtcacctttttcctcattagaaggaaagtagaaagccttactgtaggatttttaaaaaaaaatccatctcaccccatattggtcttaaataagtatagactaattaacctaagctacctttaacaacgtagaatttagatgggttcatatatgtgagaaaaacctgaatataggacaggggtcctacttttttccccacctctgtcgcccaggctagagtatagtggtgtgatcttggcccactgcaacctctgcttcctaggttcaagtgattctcctgcctcagcctcccaagtagctgggattgtaagagtatgccaccacgcccagctactttttgtatttttagtagagacagggtttcatcatgttggccaggatggtctcttaactcctgccctcaagtgatccaccagagaggagatcctcggcctccccaagtgctgggattataggcatgagccaccgtgcccagcctactttctaattaattaaaaaaaaaaaaaaaaaaaaaaaaaaaccttcccaaatgagctgataaaaaactgacgtgaggctgctttgccttcaataatacctagttttcagctgttccaactcgtttccaaatagaaattagctggaacacactacagtaatctcaaggaagggaaaattaggccttaaaagataccaagaagtcagcatggtacccaattgaaaccttttgaccttagtgggaattcattctatttgcactaaaagccttaacttgctgtattcagagtccctcttaactgtgagtttctatagaactttactttttccactagtgcacagagagagaaaggttatcttaatagtcggtttcatggagatgaaggatgggagattaagaggggggaaatgatttttactggcagctatattccctctctgttctatttgctttaacaaagggataaaacctggcaaagtgtacattattggaggactcaaatctgtatgtgacatgtcccaactactgtccgctaactagttatccaaattgtaaagctacagaagcccagttgaggggtaagtgtgcctggctcacacagcctgcaccctgtcacctcggcaatgagccagtgtggggcactggggacttctaacccttggattgctctttttgacctgtgcataccttctaattgtaaaatatatttcagaccgtgagtaccttgagatctgagcaactgtgttaatgaagtaatagcaatggtccacagtgaaagatgtgttggggtttgcaaaacaagcattccgtcacctctttaataatgtcacagactttttaaaagagaggctatcaagttgtaatataatctgtcatgttttatttaggaaggaaggtaaatttgtgcttgcacggggatcattttgtattatttttgctaatacccagttgaagctaaaaagcaactatttgaatcctgtgaattaatttataagaatgttaaacagctttggaaatacatgcatcttatgaatcatagccttatttagcaagatcaatgttaaagtgttgttatatggcaagtatttaacacattcacagtgtttgtttgatttcaactgtgaattgtcttacagttttttcaaacctagttgtttctatggacacctgctctgaattgtacattgacttcattactaaagaacaaaaatgttcatttttgtcccagtaaattgagactgcttgtacactttcagaaaaatatgtgaatttataaagattttgtagatactt

SEQ ID NO: 343658 - DNA, 1871 bp, Homo sapiens
agaagtcagatgaaaaaattgtgattcaccataagccattgagatccacatggagccaactctctgcggtgaaaagaaagggattatctcagacagtaagccaggaggaaagaaagagacaagaggctatctttgaagtcatatcctctgaacattcatatttactcagcttggagatcttgatacgaatgtttaaaaattctaaagaactgagtgatacaatgactaaaaccgagaggcaccatcttttctccaatattacagatgtctgtgaggcaagcaaaaagttctttatagagttggaagcaagacatcagaataatatcttcatagatgacataagtgacattgtggaaaaacacacagcatccacatttgacccatatgtgaaatactgcacaaatgaagtctaccaacaacgaacactacaaaaattgttagctaccaatccatcctttaaggaagtattgtcaaggattgagtcccatgaagactgtaggaacttacccatgatctcttttctcattctccccatgcagagggtgacccgccttcccctgctgatggatactatctgtcaaaaaacacctaaggactctccgaagtatgaagtctgcaaaagagccttgaaggaagttagcaagttggttcgactatgcaatgagggcgcccggaagatggaaaggactgagatgatgtacacaattaactcccagctggaatttaaaattaagccttttcctttagtctcctcttcccggtggttggtaaaaagaggtgaattgacagcctatgttgaagacactgtgcttttctcaagaaggacatccaaacagcaagtctacttctttctctttaacgatgtgctcattatcaccaagaagaagagtgaagaaagttacaacgtcaatgattattccttaagagatcagctattggtggaatcttgtgacaatgaagagcttaattcttctccagggaagaacagctccacaatgctctattcaagacagagctctgccagtcacctctttactctgacagtccttagtaaccacgcgaatgagaaagtggagatgctactaggagctgagacgcagagcgagcgagcccgctggataactgccctgggacacagcagcgggaagccgcctgcagaccgaacctgtggctgacgtcgtcctcatctatcaacgtgtcagcgatggctggtatgagggggaacgactacgagatggagaaagaggctggtttcctatggaatgtgccaaggagataacatgtcaagctacaattgataagaatgtggagagaatgggacgcttgctaggactggagaccaacgtgtagtctctcagatggtcttttgttactgcaagatttgcacgacacttaccgggctggttggttctgggctagttttattgttaattttgtcacagcctatttaattaaaagaacgaaaacacttgcctttaagcttgccaggttgttctgctctctcatgagaagagcttggatacagtgagtttgcacagctcagtttttacctaaccacacacttgcagacctcctgaggtacacagaatagctgagcagttcacttcagggatcaggtcatctctgctcctcctagtttcaccatgttctggagcttggtgtcttctttcaagctcatttctgttattggcaggattcacgtccttgctgttgctgagctgaggtccttgtttgcttgctggctgtgagctgggggctgctcacagcttctagaggcccttcatatcctcgccacaggctccttccatcttcaaagcagcaatggcatgttaactccttttctcacttggaatctgtttgactccctccta

SEQ ID NO: 343659 - DNA, 3713 bp, Homo sapiens
agaagtcagatgaaaaaattgtgattcaccataagccattgagatccacatggagccaactctctgcggtgaaaagaaagggattatctcagacagtaagccaggaggaaagaaagagacaagaggctatctttgaagtcatatcctctgaacattcatatttactcagcttggagatcttgatacgaatgtttaaaaattctaaagaactgagtgatacaatgactaaaaccgagaggcaccatcttttctccaatattacagatgtctgtgaggcaagcaaaaagttctttatagagttggaagcaagacatcagaataatatcttcatagatgacataagtgacattgtggaaaaacacacagcatccacatttgacccatatgtgaaatactgcacaaatgaagtctaccaacaacgaacactacaaaaattgttagctaccaatccatcctttaaggaagtattgtcaaggattgagtcccatgaagactgtaggaacttacccatgatctcttttctcattctccccatgcagagggtgacccgccttcccctgctgatggatactatctgtcaaaaaacacctaaggactctccgaagtatgaagtctgcaaaagagccttgaaggaagttagcaagttggttcgactatgcaatgagggcgcccggaagatggaaaggactgagatgatgtacacaattaactcccagctggaatttaaaattaagccttttcctttagtctcctcttcccggtggttggtaaaaagaggtgaattgacagcctatgttgaagacactgtgcttttctcaagaaggacatccaaacagcaagtctacttctttctctttaacgatgtgctcattatcaccaagaagaagagtgaagaaagttacaacgtcaatgattattccttaagagatcagctattggtggaatcttgtgacaatgaagagcttaattcttctccagggaagaacagctccacaatgctctattcaagacagagctctgccagtcacctctttactctgacagtccttagtaaccacgcgaatgagaaagtggagatgctactaggagctgagacgcagagcgagcgagcccgctggataactgccctgggacacagcagcgggaagccgcctgcagaccgaacctcactgacccaggtggaaatcgttaggtcatttactgctaagcagccagatgaactctccctgcaggtggctgacgtcgtcctcatctatcaacgtgtcagcgatggctggtatgagggggaacgactacgagatggagaaagaggctggtttcctatggaatgtgccaaggagataacatgtcaagctacaattgataagaatgtggagagaatgggacgcttgctaggactggagaccaacgtgtagtctctcagatggtcttttgttactgcaagatttgcacgacacttaccgggctggttggttctgggctagttttattgttaattttgtcacagcctatttaattaaaagaacgaaaacacttgcctttaagcttgccaggttgttctgctctctcatgagaagagcttggatacagtgagtttgcacagctcagtttttacctaaccacacacttgcagacctcctgaggtacacagaatagctgagcagttcacttcagggatcaggtcatctctgctcctcctagtttcaccatgttctggcaataaaaaacacatattatatcctggttttctctatccttgcattactaaggtgactgtctctctttatacatccttgtatggttctcccagtattagcaagattgtatatctgtaaagaatgtccagttttgtaaatatttccctgcctttttttttctttttttacatctgattttaatgcttcgttaacttcaaaaggaactggtagagttcagaaggtgagctgttgtttttctaaacctcttcccaggaaggggacattgacacttgaatttttgtcacctttttcctcattagaaggaaagtagaaagccttactgtaggatttttaaaaaaaaatccatctcaccccatattggtcttaaataagtatagactaattaacctaagctacctttaacaacgtagaatttagatgggttcatatatgtgagaaaaacctgaatataggacaggggtcctacttttttccccacctctgtcgcccaggctagagtatagtggtgtgatcttggcccactgcaacctctgcttcctaggttcaagtgattctcctgcctcagcctcccaagtagctgggattgtaagagtatgccaccacgcccagctactttttgtatttttagtagagacagggtttcatcatgttggccaggatggtctcttaactcctgccctcaagtgatccaccagagaggagatcctcggcctccccaagtgctgggattataggcatgagccaccgtgcccagcctactttctaattaattaaaaaaaaaaaaaaaaaaaaaaaaaaaccttcccaaatgagctgataaaaaactgacgtgaggctgctttgccttcaataatacctagttttcagctgttccaactcgtttccaaatagaaattagctggaacacactacagtaatctcaaggaagggaaaattaggccttaaaagataccaagaagtcagcatggtacccaattgaaaccttttgaccttagtgggaattcattctatttgcaaactttactttttccactagtgcacagagagagaaaggttatcttaatagtcggtttcatggagatgaaggatgggagattaagaggggggaaatgatttttactggcagctatattccctctctgttctatttgctttaacaaagggataaaacctggcaaagtgtacattattggaggactcaaatctgtatgtgacatgtcccaactactgtccgctaactagttatccaaattgtaaagctacagaagcccagttgaggggtaagtgtgcctggctcacacagcctgcaccctgtcacctcggcaatgagccagtgtggggcactggggacttctaacccttggattgctctttttgacctgtgcataccttctaattgtaaaatatatttcagaccgtgagtaccttgagatctgagcaactgtgttaatgaagtaatagcaatggtccacagtgaaagatgtgttggggtttgcaaaacaagcattccgtcacctctttaataatgtcacagactttttaaaagagaggctatcaagttgtaatataatctgtcatgttttatttaggaaggaaggtaaatttgtgcttgcacggggatcattttgtattatttttgctaatacccagttgaagctaaaaagcaactatttgaatcctgtgaattaatttataagaatgttaaacagctttggaaatacatgcatcttatgaatcatagccttatttagcaagatcaatgttaaagtgttgttatatggcaagtatttaacacattcacagtgtttgtttgatttcaactgtgaattgtcttacagttttttcaaacctagttgtttctatggacacctgctctgaattgtacattgacttcattactaaagaacaaaaatgttcatttttgtcccagtaaattgagactgcttgtacactttcagaaaaatatgtgaatttataaagattttgtagatactt

SEQ ID NO: 343660 - DNA, 3714 bp, Homo sapiens
agaagtcagatgaaaaaattgtgattcaccataagccattgagatccacatggagccaactctctgcggtgaaaagaaagggattatctcagacagtaagccaggaggaaagaaagagacaagaggctatctttgaagtcatatcctctgaacattcatatttactcagcttggagatcttgatacgaatgtttaaaaattctaaagaactgagtgatacaatgactaaaaccgagaggcaccatcttttctccaatattacagatgtctgtgaggcaagcaaaaagttctttatagagttggaagcaagacatcagaataatatcttcatagatgacataagtgacattgtggaaaaacacacagcatccacatttgacccatatgtgaaatactgcacaaatgaagtctaccaacaacgaacactacaaaaattgttagctaccaatccatcctttaaggaagtattgtcaaggattgagtcccatgaagactgtaggaacttacccatgatctcttttctcattctccccatgcagagggtgacccgccttcccctgctgatggatactatctgtcaaaaaacacctaaggactctccgaagtatgaagtctgcaaaagagccttgaaggaagttagcaagttggttcgactatgcaatgagggcgcccggaagatggaaaggactgagatgatgtacacaattaactcccagctggaatttaaaattaagccttttcctttagtctcctcttcccggtggttggtaaaaagaggtgaattgacagcctatgttgaagacactgtgcttttctcaagaaggacatccaaacagcaagtctacttctttctctttaacgatgtgctcattatcaccaagaagaagagtgaagaaagttacaacgtcaatgattattccttaagagatcagctattggtggaatcttgtgacaatgaagagcttaattcttctccagggaagaacagctccacaatgctctattcaagacagagctctgccagtcacctctttactctgacagtccttagtaaccacgcgaatgagaaagtggagatgctactaggagctgagacgcagagcgagcgagcccgctggataactgccctgggacacagcagcgggaagccgcctgcagaccgaacctcactgacccaggtggaaatcgttaggtcatttactgctaagcagccagatgaactctccctgcaggtggctgacgtcgtcctcatctatcaacgtgtcagcgatggctggtatgagggggaacgactacgagatggagaaagaggctggtttcctatggaatgtgccaaggagataacatgtcaagctacaattgataagaatgtggagagaatgggacgcttgctaggactggagaccaacgtgtagtctctcagatggtcttttgttactgcaagatttgcacgacacttaccgggctggttggttctgggctagttttattgttaattttgtcacagcctatttaattaaaagaacgaaaacacttgcctttaagcttgccaggttgttctgctctctcatgagaagagcttggatacagtgagtttgcacagctcagtttttacctaaccacacacttgcagacctcctgaggtacacagaatagctgagcagttcacttcagggatcaggtcatctctgctcctcctagtttcaccatgttctggcaataaaaaacacatattatatcctggttttctctatccttgcattactaaggtgactgtctctctttatacatccttgtatggttctcccagtattagcaagattgtatatctgtaaagaatgtccagttttgtaaatatttccctgcctttttttttctttttttacatctgattttaatgcttcgttaacttcaaaaggaactggtagagttcagaaggtgagctgttgtttttctaaacctcttcccaggaaggggacattgacacttgaatttttgtcacctttttcctcattagaaggaaagtagaaagccttactgtaggatttttaaaaaaaaatccatctcaccccatattggtcttaaataagtatagactaattaacctaagctacctttaacaacgtagaatttagatgggttcatatatgtgagaaaaacctgaatataggacaggggtcctacttttttccccacctctgtcgcccaggctagagtatagtggtgtgatcttggcccactgcaacctctgcttcctaggttcaagtgattctctactttttgtatttttagtagagacagggtttcatcatgttggccaggatggtctcttaactcctgccctcaagtgatccaccagagaggagatcctcggcctccccaagtgctgggattataggcatgagccaccgtgcccagcctactttctaattaattaaaaaaaaaaaaaaaaaaaaaaaaaaaccttcccaaatgagctgataaaaaactgacgtgaggctgctttgccttcaataatacctagttttcagctgttccaactcgtttccaaatagaaattagctggaacacactacagtaatctcaaggaagggaaaattaggccttaaaagataccaagaagtcagcatggtacccaattgaaaccttttgaccttagtgggaattcattctatttgcactaaaagccttaacttgctgtattcagagtccctcttaactgtgagtttctatagaactttactttttccactagtgcacagagagagaaaggttatcttaatagtcggtttcatggagatgaaggatgggagattaagaggggggaaatgatttttactggcagctatattccctctctgttctatttgctttaacaaagggataaaacctggcaaagtgtacattattggaggactcaaatctgtatgtgacatgtcccaactactgtccgctaactagttatccaaattgtaaagctacagaagcccagttgaggggtaagtgtgcctggctcacacagcctgcaccctgtcacctcggcaatgagccagtgtggggcactggggacttctaacccttggattgctctttttgacctgtgcataccttctaattgtaaaatatatttcagaccgtgagtaccttgagatctgagcaactgtgttaatgaagtaatagcaatggtccacagtgaaagatgtgttggggtttgcaaaacaagcattccgtcacctctttaataatgtcacagactttttaaaagagaggctatcaagttgtaatataatctgtcatgttttatttaggaaggaaggtaaatttgtgcttgcacggggatcattttgtattatttttgctaatacccagttgaagctaaaaagcaactatttgaatcctgtgaattaatttataagaatgttaaacagctttggaaatacatgcatcttatgaatcatagccttatttagcaagatcaatgttaaagtgttgttatatggcaagtatttaacacattcacagtgtttgtttgatttcaactgtgaattgtcttacagttttttcaaacctagttgtttctatggacacctgctctgaattgtacattgacttcattactaaagaacaaaaatgttcatttttgtcccagtaaattgagactgcttgtacactttcagaaaaatatgtgaatttataaagattttgtagatactt

SEQ ID NO: 343661 - DNA, 582 bp, Homo sapiens
tctcatttctttgatgatagcttctctgtttctccttcagaaagtcttgttttttatatgcatatttactttttgggtgcactctccttgttaatgagttatttgcatctgattttgagtttattcagcaaatatttattaatgatttactgtatactctgtgcttggggagttgacctagggaactcaaaggaggctcctttgaagaattgatgcttgagctgagatctcaggaatgagtaggaattatctaagacatgagagaacagctgttaaggtagggaaagtagcatttgtttatatatttggaggaaggaagtatgatgagtactaggtactgtaagaaaacccttgtggttggagtagagaatgtaggagaagggacagtatgaagtgagatgcggctagagaaggtacgtaggggcttgacttcccagggccttcatgtgagccatattaagcagttatttatccacctcctacccccagcagtggaaagccattgagaaacttttagtacagaagtgatatggtgaaatttgtattttgaaagatttacttaggctgcagtttggagaatga

SEQ ID NO: 343662 - DNA, 294 bp, Homo sapiens
aggtaagatgtgcgttgaatccagtgagttcaagaccagcactaggcaagtatagcaaaacccttgtggttggagtagagaatgtaggagaagggacagtatgaagtgagatgcggctagagaaggtacgtaggggcttgacttcccagggccttcatgtgagccatattaagcagttatttatccacctcctacccccagcagtggaaagccattgagaaacttttagtacagaagtgatatggtgaaatttgtattttgaaagatttacttaggctgcagtttggagaatga

SEQ ID NO: 343663 - DNA, 705 bp, Homo sapiens
aagctcttgaggcccaacatgtggcatgaatcagtgctccggggcagggctcctcaacctcggcattcctggtattgcgggctgggtcattctttgttgtgggaccctcctgtgcatgctaggatgtttaccagcatccctggctgctacccactagagttaggagcaccgtccttagttgtgacaacccaaaatgtctccagacatcgccaaacatgtcctagtttcggggggggaggtgcggggaattgccactgctgtgggtgacagctgctgttgccaagtctgccacagtcagtcagtggtggacctgccctcaacacttacctagcagacatcttcccagtctgcatgtgactggggcttagacccaacttagtccatagaggtgcatgcttagacaaaagctggtttttctcagcatatcgtgtgcttcctgcacaaagaccctaacagttaattgctgtgattaggcaggggctgcgccatctccttgttggtggtgactagttggtgatgactggcgaggagatgtgggagctttcacaggtctgttcccaagccacaaggagtccaggcccggttctagcacacctgtgccggcctcttctatttagcttggctggttcctggggctgcggaagcaactgtcttaaactacccatgaaaaaaataataaagccaaaaaagcgatttacaccatta

SEQ ID NO: 343664 - DNA, 1062 bp, Homo sapiens
atacagccaagattgagaatctggatgatttctagtcctggaggataaatacaatactaataacttccaaattaatgtatttaacacatttttcccaaactccagatgtgattattctgttgtctgttttacatttccactagaaataggcatcttgattgcatgccctttaccccacactggctccttcctgggtttgcctttcgtgcatgcagctctcaggccacaagcccaggaggcatcctgattcctctgttcactcatcacacagctcacctggcagcaagttctttccacttgccctagcaaatacgcacatcctaaatctcactgcttctcccaccatcacttctcttctgggtagcctcagaagcctcctaactcccctgtgctcttgcactgtcactctcagacagtccttgtgcaatgagaatggtcttatcgctgatcacagtcattcccttgctccaaccccccacggctttccattccaacggacaaactccccactccttaccaggagctacaggctccccttcatgtggcctctgcccaattctgctacctaatttcctcccactccctccttccctgcctcagtcaggccacactgaccaccatgctgttcctcaaacttcccaagctctttcctcctacttcagagcctttgcacacacccctccctctgcctggaagccccttccctatagattgttccttggctctctctctaatttttctcaggtttctgctcagatgttaccccaggagaaagcctatccaaaatgctcctctctcccacccactctctagcccctgcctctggtttgttttttccctccacagcgtttatctccactcaaaatcctgtttttccagctattttgttagaacttttgtcactgctctatccccagcaccatcagcagtgctcacacgcagtaaatgacctatacatacttgtggctgaatgatgaagtgctactccttgaggagtggtcccaggaccttggccccttttccagcctctgagcagaccatgctggctatggccaggatctc

SEQ ID NO: 343665 - DNA, 345 bp, Homo sapiens
tatttaaagtgtaccatttcatgctctttgacatacagatatacctgtgaacccgttgtcagaatcaagatattgaacatgtagattttcctcacaagtgtctttacaaccctttgtaatttatcatactcatccttcacctatcttcaggcaaccagtgatctgctttctattatcatggattagttttcttgctctgcatattatgtataatcatacagtgtaaattctattttgtctgacttctttcactaagcataagtctgaaatttattcatgtttgttcatgtatcagtggcttgcctttttttgtgctaagtaatattctattgtatgagtatatta

SEQ ID NO: 343666 - DNA, 415 bp, Homo sapiens
gatgaataatctaggaaatcccttgaaaggaagaaaagaggatcatcagagacatcttctggagctccacaaactgctcagagcagagaggccaccagatacgaatgctgcctcagataatccaatggaggaagagggtttggctggtattttctggctgagttcttgataagaaactgtaatcacatctgctagctagggatccaagaaaaacaagatattgtctctttatacacattccacagcccctaccttctctcaagagatgttaaaatggcttaaaatgtgttaaaatgtgacaatttaataaatgtggcagaaacaaaaaagagactcctaaagtattcctctcttcagagagtatgaagctattaattcagcaaatgaatccaggagctcagaaagggttaccccg

SEQ ID NO: 343667 - DNA, 824 bp, Homo sapiens
gggggagtggggagagggaagggtgctactggtatctcgtgggtagaggttaggtataaacaaggtataggacagcatccacaacaaaaaaattacctggtccagaatgccagccctgccaagcaacattgggaaacccagcttagttcctttgtataaggtactttgccagttagattctgtatacatgctgattattgataaagatgagtcacagacatggataggcttcatttaacattcattttaaaagacagacatgtaagaaggttagtaggtttcatttctttttaaggttacagggaaagtactccaaaattaatctaaaagtccttacacttttttcagaaactgagaaaaggttccagatgaattttactaatttaatttttttatgacgagctattcatgtaaaagtgtattatgaatagagggcttatgagatatgagtgccgtagtgtgtattcataaagtcaaacgtacacttaaaaaacaagtatcaaggtaaatggaatgatctattgggggaaaccttggagctctctctctttccatatgttttattactcaccaagtcaagggctctttaacttaggatcttgtttttctgtgtacacttttcctgtttactgtttaaaattggacccttactaaaaatacagaaaattagctgggcatggtggcgtgcacctgtaatttcagctactggggaggctgaggtagggagaatcgcttgaaccagggagacggaggttgcagtgagctgagatcgcgccattgcactccagcctgggtgacagggcgagactcagtctcaaaaaaaa

SEQ ID NO: 343668 - DNA, 127 bp, Homo sapiens
caatcaacattgccagcctagcactaaaagattccactatgacagacaaccacatgaggccgtatctcagcattagaaacaaatggatgggggagagtggttaagagcactgattttaagaattaaa

SEQ ID NO: 343669 - DNA, 614 bp, Homo sapiens
agttgagggcaactgacttgggcatattccacggggttacctccgtcctggggggtcaccgcttcctgtcttcagacccctcctccatatttccctctcttcactcttgagttctctctctgaagtgccaggagaggtgcattgaggttagttggcatattccttgaaatattcctggcctgcttctcagggggcagagtcaggaggtaattctgaagcactgggaggagagtgtgggcgcaggggggcttcccggggggcacttaagacactgtgtgttcaggaacctgggggctgtgccttgggaatccagagagtgctgagggctgccctgctcctggaaaagatgaagaagcccttctcttccttctgattcccaagttgtggaacccaagcagatccattattgccccagctaaactcctttgtgatgattcttttaagagaatgagctgggccaggggtggaggaaggcaagtggagggagagcattaggacaaatacctaatgcatgcggggcttcaaacctagatgacaggttgacaggtgcagcaaaccaccatggcacatgtatacctatgtaacaaacctgcacgttctgcacatgtatcccg

SEQ ID NO: 343670 - DNA, 207 bp, Homo sapiens
  misc_feature (47)..(49): n is a, c, g, or t
attcgcggccgcgtcgactgatatttcataatatctaaattttgtannntagatattttatattagttcaaaagtaacatgatacgcatttccaaaatgggacaggagaatctgaagttatatttggctctttttactatctcattttattcttgcatctatgcatattgaaaatctaaaacatctaattttataacttatatttac

SEQ ID NO: 343671 - DNA, 395 bp, Homo sapiens
gctgttttttttttttttaattgccctggccctacaacaatgcctagtacctggtaggagaacaagaaatagttgttaaataaatgaatatacttctctgaaacttactctctctttcctgatcaatatatgccatcatttggtgaacatacagaaatttatttaccatagacaacataatatactttaaaagtatattagttagagatagccaaaatattcaggaagttattactcatttatttttaatttttcctagtattaagttaggccatgtgaaatcgcaatttttgtagatacaaaaaaagatgaataaaggcaatttcatattgcccagctatttaaatgagcctctttctctcaagttttctgtcattttgaaaaaaaattgtttg

SEQ ID NO: 343672 - DNA, 224 bp, Homo sapiens
tgctgggattacaggtgtgagccaccgcgccctgccatttgggtccctcttaacggctgtgttcatggatcattatctcttctgagcctcagttccttgatctgtaaagtggaggactcaaagaatcagcctcctagaagagttgcatagattaaatgagatagtgggtgtaaagtgtttagctttctgtgcatgtgtaaactgcccaagaggaagttagctga

SEQ ID NO: 343673 - DNA, 657 bp, Homo sapiens
tctgtctgaaaatgagttgttgctaaactaattgttggattaaagtccagtttaaacatcgacgccattgataatgaaagaccttgagctgtcagctaattttcatgacattgtgtagcgcctgctttcctaaagtctgtgggatgttgcggaagcacacttccagttttttgtttcagatatttaatttctgttggtcataatattgggcatgtacccatgggctgacattggccatctgagatccatgatttctctctatctgcattataatttatgtattgtaattgtatgtggtttacatctgctggtatgtatacgtcttctctttgatatgttttgtcttagtgtgcttcaagtagcaaagaattaccttttctgggttaatagctttacaactggattatattctccgtgcttaaaaccttagcactgtttgatgcgttttcccaacatcgtaaggctggcagattggagtgttctttcttttcagtgtatggaagcaccaggtagcaatccagttttaattttctgcctgttaattcaggtatgggcattagatcattaatgaaattcagttaaggtaatgtacaaatctcgttaactgattctagacatttatttatttatttatttatttatttatttatttattta

SEQ ID NO: 343674 - DNA, 1272 bp, Homo sapiens
cagaaacattgtctgtaatacaagtgctaacttatagtgcaaaaattaccctaaagaaaaccatttgaggctgggcacggtggctcactcctgtaatcctagcactttgggaggccgaggtgggcgaatcacctgaggttggttgttccagaccagcctgaccaacatggagaaaccccatatctactaaaaatacaaaattagtcaggcgtggtggcgcgtgcctgtgataccagctactcaggaggctgaggcaggagaatcacttgaacccagaaggcagagattgtggtgagctgagatcatgccattgtattccagcctgggcaacgagagcaaaactctgtctcaaaaaaagaaagaaagccatttggtggctgggtgtggtagctcacccctgtaatctcagcacgttgggaggctgaggcgggtggatcacttgaggtcaggagtttgagaccagtccccccaacatggcaaaaccctgtctctactcaaaacacacagaaaaattagctgagtgtggcagcatgtgcctgtaatcccagctactcaggaggctgaggcaggagaatcgcttgaatctgggaggcagagaggttgcagtgagccgagattgtgccagtgcattccagtctgggcaacagtgagactccatttcaaaacaaaaacaaagaaacaaacaaaaagaaagccatttggtctcttaatagtgtattaggagatattttataggagtgtgtttgatttctttttttctttctgaaactttttaatgtacatgttatccctttttaaggagtggaggtaagtcacttgagccttaagaatttgaggtttgaattagggagttaggaagggggcccaattttagtattttacaagtatggtgggtggtaatggctttggacatgttgaaattaaggtgaatggcatattgtgttttactcttgtgtagtaaagttagcagcaaatacagaactgagcctaggccagggaactgggattggggttagatctaagcaagatcagcatgtaagtgatagtggagaaagtaaattgagaggtgaggactcatccccttggtggaaattcggaattaataaagcaggaggagagtcaggataatgggctgttgaataaagaaagtaagtttttaggaagaggtaatgtgtatccaagaagtaggaaagaaatgagacttaaagcgtttggggtttggctgtgttagagctcagtacccaacaggtgctcagtaaagtaacttgactc

SEQ ID NO: 343675 - DNA, 768 bp, Homo sapiens
cagaaacattgtctgtaatacaagtgctaacttatagtgcaaaaattaccctaaagaaaaccatttgaggctgggcacggtggctcactcctgtaatcctagcactttgggaggccgaggtgggcgaatcacctgaggttggttgttccagaccagcctgaccaacatggagaaaccccatatctactaaaaatacaaaattagtcaggcgtggtggcgcgtgcctgtgataccagctactcaggaggctgaggcaggagaatcacttgaacccagaaggcagagattgtggtgagctgagatcatgccattgtattccagcctgggcaacgagagcaaaactctgtctcaaaaaaagaaagaaagccatttggtggctgggtgtggtagctcacccctgtaatctcagcacgttgggaggctgaggcgggtggatcacttgaggtcaggagtttgagaccagtccccccaacatggcaaaaccctgtctctactcaaaacacacagaaaaattagctgagtgtggcagcatgtgcctgtaatcccagctactcaggaggctgaggcaggagaatcgcttgaatctgggaggcagagaggttgcagtgagccgagattgtgccagtgcattccagtctgggcaacagtgagactccatttcaaaacaaaaacaaagaaacaaacaaaaagaaagccatttggtctcttaatctatatgtatgaggacaggagtggtgactcacgcctgtacgaagggggatggcgagg

SEQ ID NO: 343676 - DNA, 358 bp, Homo sapiens
actcctgttcctggaacaggagtaggtcaggcaattcctctctacagttatcaagtgcaaaatgtgatacgtttactaaaaataatcattccaggacactggaaaatgaccaatggcaggcaacaacttaagcagtacttgctcagtggggaagtgctagggcactgggtgagaactgtgtgttcatggccttcctgcctggaggcgttcccatcgtaggcagtgacaccccagggcctggaggtgtgaacgtggtagagggcaagtggcaggcacagctgctagaaattgaagggggacagctggaagcaagagggctacagaggttaagagatgttacaatctccccacatctctg

SEQ ID NO: 343677 - DNA, 1592 bp, Homo sapiens
gcattcatggcaatccactactccagacagacggctttggaatccaccagctacatccagctccctgaggcagagttgagaatggagagaatgttacctctcctggctctggggctcttggcggctgggttctgccctgctgtcctctgccaccctaacagcccacttgacgaggagaatctgacccaggagaaccaagaccgagggacacacgtggacctcggattagcctccgccaacgtggacttcgctttcagcctgtacaagcagttagtcctgaaggcccctgataagaatgtcatcttctccccactgagcatctccaccgccttggccttcctgtctctgggggcccataataccaccctgacagagattctcaaaggcctcaagttcaacctcacggagacttctgaggcagaaattcaccagagcttccagcacctcctgcgcaccctcaatcagtccagcgatgagctgcagctgagtatgggaaatgccatgtttgtcaaagagcaactcagtctgctggacaggttcacggaggatgccaagaggctgtatggctccgaggcctttgccactgactttcaggactcagctgcagctaagaagctcatcaacgactacgtgaagaatggaactagggggaaaatcacagatctgatcaaggaccttgactcgcagacaatgatggtcctggtgaattacatcttctttaaagccaaatgggagatgccctttgacccccaagatactcatcagtcaaggttctacttgagcaagaaaaagtgggtaatggtgcccatgatgagtttgcatcacctgactataccttacttccgggacgaggagctgtcctgcaccgtggtggagctgaagtacacaggcaatgccagcgcactcttcatcctccctgatcaagacaagatggaggaagtggaagccatgctgctcccagagaccctgaagcggtggagagactctctggagttcagagagataggtgagctctacctgccaaagttttccatctcgagggactataacctgaacgacatacttctccagctgggcattgaggaagccttcaccagcaaggctgacctgtcagggatcacaggggccaggaacctagcagtctcccaggtggtccataaggctgtgcttgatgtatttgaggagggcacagaagcatctgctgccacagcagtcaaaatcaccctcctttctgcattagtggagacaaggaccattgtgcgtttcaacaggcccttcctgatgatcattgtccctacagacacccagaacatcttcttcatgagcaaagtcaccaatcccaagcaagcctagagcttgccatcaagcagtggggctctcagtaaggaacttggaatgcaagctggatgcctgggtctctgggcacagcctggcccctgtgcaccgagtggccatggcatgtgtggccctgtctgcttatccttggaaggtgacagcgattccctgtgtagctctcacatgcacaggggcccatggactcttcagtctggagggtcctgggcctcctgacagcaataaataatttcgttgga

SEQ ID NO: 343678 - DNA, 1401 bp, Homo sapiens
ccccagtcattccatgttgggaggctgcagggaccagagaagctgagatggtctttggggaggggaaaggaaagatggacagttattttggtcctagaaagcccaaaggtggggaagtgtcaagaaggaagatgagggcacaagagaatgtagggccacccagaagctggctctcattgcaattacagaaagaaaaaccaaaataaagaaagaaaggaaagaagctcccatttattgagcagctactctcaccagccattcacatgcaatacctcgtttaattctcgcagcggctctgaaaggtggatggtggtattgccatttgttaggtaggagacatgccgtccagaaaagcaaataattaaacattcaaagttgacctgggcccatttgaaaattccttttgctccctcattttaacccctaaagtaaagccgtttgtgactttatgagcttttaccaagcatctcctaaaaccaagaatggaggtgaaagattgtggagcccacaacctagagaaaggattgacaattttttttccataaagggcctagtagtatgtattttaggctgtgtggtccacatgagggcagattcttctttttgacttcctcctctgcatcttcttcatcttctctttcctcttcattttttttacaacgagctgtcctgcaccgtggtggagctgaagtacacaggcaatgccagcgcactcttcatcctccctgatcaagacaagatggaggaagtggaagccatgctgctcccagagaccctgaagcggtggagagactctctggagttcagagagataggtgagctctacctgccaaagttttccatctcgagggactataacctgaacgacatacttctccagctgggcattgaggaagccttcaccagcaaggctgacctgtcagggatcacaggggccaggaacctagcagtctcccaggtggtccataaggctgtgcttgatgtatttgaggagggcacagaagcatctgctgccacagcagtcaaaatcaccctcctttctgcattagtggagacaaggaccattgtgcgtttcaacaggcccttcctgatgatcattgtccctacagacacccagaacatcttcttcatgagcaaagtcaccaatcccaagcaagcctagagcttgccatcaagcagtggggctctcagtaaggaacttggaatgcaagctggatgcctgggtctctgggcacagcctggcccctgtgcaccgagtggccatggcatgtgtggccctgtctgcttatccttggaaggtgacagcgattccctgtgtagctctcacatgcacaggggcccatggactcttcagtctggagggtcctgggcctcctgacagcaataaataatttcgttgga

SEQ ID NO: 343679 - DNA, 712 bp, Homo sapiens
gcattcatggcaatccactactccagacagacggctttggaatccaccagctacatccagctccctgaggcagagttgagaatggagagaatgttacctctcctggctctggggctcttggcggctgggttctgccctgctgtcctctgccaccctaacagcccacttgacgaggagaatctgacccaggagaaccaagaccgagggacacacgtggacctcggattagcctccgccaacgtggacttcgctttcagcctgtacaagcagtggtccataaggctgtgcttgatgtatttgaggagggcacagaagcatctgctgccacagcagtcaaaatcaccctcctttctgcattagtggagacaaggaccattgtgcgtttcaacaggcccttcctgatgatcattgtccctacagacacccagaacatcttcttcatgagcaaagtcaccaatcccaagcaagcctagagcttgccatcaagcagtggggctctcagtaaggaacttggaatgcaagctggatgcctgggtctctgggcacagcctggcccctgtgcaccgagtggccatggcatgtgtggccctgtctgcttatccttggaaggtgacagcgattccctgtgtagctctcacatgcacaggggcccatggactcttcagtctggagggtcctgggcctcctgacagcaataaataatttcgttgga

SEQ ID NO: 343680 - DNA, 382 bp, Homo sapiens
  misc_feature (22)..(22): n is a, c, g, or t
caggcgttctagaggatccgangtagcccaagagctgtcctgcaccgtggtggagctgaagtacacaggcaatgccagcgcactcttcatcctccctgatcaagacaagatggaggaagtggaagccatgctgctcccagagaccctgaagcggtggagagactctctggagttcagagagataggtgagctctacctgccaaagttttccatctcgagggactataacctgaacgacatacttctccagctgggcattgaggaagccttcaccagcaaggctgacctgtcagggatcacaggggccaggaacctagcagtctcccagtccataaggctgtgcttgatctactttgaggagacgcgtcagttcggacgccta

SEQ ID NO: 343681 - DNA, 884 bp, Homo sapiens
ccccagtcattccatgttgggaggctgcagggaccagagaagctgagatggtctttggggaggggaaaggaaagatggacagttattttggtcctagaaagcccaaaggtggggaagtgtcaagaaggaagatgagggcacaagagaatgtagggccacccagaagctggctctcattgcaattacagaaagaaaaaccaaaataaagaaagaaaggaaagaagctcccatttattgagcagctactctcaccagccattcacatgcaatacctcgtttaattctcgcagcggctctgaaaggtggatggtggtattgccatttgttaggtaggagacatgccgtccagaaaagcaaataattaaacattcaaagttgacctgggcccatttgaaaattccttttgctccctcattttaacccctaaagtaaagccgtttgtgactttatgagcttttaccaagcatctcctaaaaccaagaatggaggtgaaagattgtggagcccacaacctagagaaaggattgacaattttttttccataaagggcctagtagtatgtattttaggctgtgtggtccacatgagggcagattcttctttttgacttcctcctctgcatcttcttcatcttctctttcctcttcattttttttacaacctttgaaaaatataagcaccattcttagctttaggtacacacaaaaataagctatggctgtattggcttacaggctatagtttcctgacccctgttctaggggaggaaaataattgtacccaactaaatgcgtgcgaatcatgggcctatgtcatgattcccaaagaatgagtttcatggaattttcaacattttaaatattttactccattcttcccttgct

SEQ ID NO: 343682 - DNA, 1650 bp, Homo sapiens
gcattcatggcaatccactactccagacagacggctttggaatccaccagctacatccagctccctgaggcagagttgagaatggagagaatgttacctctcctggctctggggctcttggcggctgggttctgccctgctgtcctctgccaccctaacagcccacttgacgaggagaatctgacccaggagaaccaagaccgagggacacacgtggacctcggattagcctccgccaacgtggacttcgctttcagcctgtacaagcagttagtcctgaaggcccctgataagaatgtcatcttctccccactgagcatctccaccgccttggccttcctgtctctgggggcccataataccaccctgacagagattctcaaaggcctcaagttcaacctcacggagacttctgaggcagaaattcaccagagcttccagcacctcctgcgcaccctcaatcagtccagcgatgagctgcagctgagtatgggaaatgccatgtttgtcaaagagcaactcagtctgctggacaggttcacggaggatgccaagaggctgtatggctccgaggcctttgccactgactttcaggactcagctgcagctaagaagctcatcaacgactacgtgaagaatggaactagggggaaaatcacagatctgatcaaggaccttgactcgcagacaatgatggtcctggtgaattacatcttctttaaagccaaatgggagatgccctttgacccccaagatactcatcagtcaaggttctacttgagcaagaaaaagtgggtaatggtgcccatgatgagtttgcatcacctgactataccttacttccgggacgaggagctgtcctgcaccgtggtggagctgaagtacacaggcaatgccagcgcactcttcatcctccctgatcaagacaagatggaggaagtggaagccatgctgctcccagagaccctgaagcggtggagagactctctggagttcagagagataggtgagctctacctgccaaagttttccatctcgagggactataacctgaacgacatacttctccagctgggcattgaggaagccttcaccagcaaggctgacctgtcagggatcacaggggccaggaacctagcagtctcccaggtggtccataaggctgtgcttgatgtatttgaggagggcacagaagcatctgctgccacagcagtcaaaatcaccctcctttctgcattagtggagacaaggaccattgtgcgtttcaacaggcccttcctgatgatcattgtccctacagacacccagaacatcttcttcatgagcaaagtcaccaatcccaagcaagcctagagcttgccatcaagcagtggggctctcagtaaggaacttggaatgcaagctggatgcctgggtctctgggcacagcctggcccctgtgcaccgagtggccatggcatgtgtggccctgtctgcttatccttggaaggtgacagcgattccctgtgtagctctcacatgcacaggggcccatggactcttcagtctggagggtcctgggcctcctgacagcaataaataatttcgttggaaaaaaaaaagagaagttggcctataggagtcgattacagtgagcgcggaatttagatt

SEQ ID NO: 343683 - DNA, 1805 bp, Homo sapiens
gcattcatggcaatccactactccagacagacggctttggaatccaccagctacatccagctccctgaggcagagttgagaatggagagaatgttacctctcctggctctggggctcttggcggctgggttctgccctgctgtcctctgccaccctaacagcccacttgacgaggagaatctgacccaggagaaccaagaccgagggacacacgtggacctcggattagcctccgccaacgtggacttcgctttcagcctgtacaagcagttagtcctgaaggcccctgataagaatgtcatcttctccccactgagcatctccaccgccttggccttcctgtctctgggggcccataataccaccctgacagagattctcaaaggcctcaagttcaacctcacggagacttctgaggcagaaattcaccagagcttccagcacctcctgcgcaccctcaatcagtccagcgatgagctgcagctgagtatgggaaatgccatgtttgtcaaagagcaactcagtctgctggacaggttcacggaggatgccaagaggctgtatggctccgaggcctttgccactgactttcaggactcagctgcagctaagaagctcatcaacgactacgtgaagaatggaactagggggaaaatcacagatctgatcaaggaccttgactcgcagacaatgatggtcctggtgaattacatcttctttaaagccaaatgggagatgccctttgacccccaagatactcatcagtcaaggttctacttgagcaagaaaaagtgggtaatggtgcccatgatgagtttgcatcacctgactataccttacttccgggacgaggagctgtcctgcaccgtggtggagctgaagtacacaggcaatgccagcgcactcttcatcctccctgatcaagacaagatggaggaagtggaagccatgctgctcccagagaccctgaagcggtggagagactctctggagttcagagagataggtgagctctacctgccaaagttttccatctcgagggactataacctgaacgacatacttctccagctgggcattgaggaagccttcaccagcaaggctgacctgtcagggatcacaggggccaggaacctagcagtctcccaggtggtccataaggctgtgcttgatgtatttgaggagggcacagaagcatctgctgccacagcagtcaaaatcaccctcctttctgcattagtggagacaaggaccattgtgcgtttcaacaggcccttcctgatgatcattgtccctacagacacccagaacatcttcttcatgagcaaagtcaccaatcccaagcaagcctagagcttgccatcaagcagtggggctctcagtaaggaacttggaatgcaagctggatgcctgggtctctgggcacagcctggcccctgtgcaccgagtggccatggcatgtgtggccctgtctgcttatccttggaaggtgacagcgattccctgtgtagctctcacatgcacaggggcccatggactcttcagtctggagggtcctgggcctcctgacagcaataaataatttcgttggagtaaaaacaagagacgacacaccagaaacaacaaacattgtgttggcgcggcctgggacccgcgaagaagggttttcaaagcccctctggttgggcgccgggggcccgatgggaacgcggaccgggccaacgcggggccacaggaaaccgggcacaagccggcgcggggtttcccacataaaaacccggggaacagggcgctgaaaccccaag

SEQ ID NO: 343684 - DNA, 1882 bp, Homo sapiens
  misc_feature (1629)..(1629): n is a, c, g, or t
  misc_feature (1717)..(1717): n is a, c, g, or t
  misc_feature (1854)..(1854): n is a, c, g, or t
  misc_feature (1861)..(1861): n is a, c, g, or t
gcattcatggcaatccactactccagacagacggctttggaatccaccagctacatccagctccctgaggcagagttgagaatggagagaatgttacctctcctggctctggggctcttggcggctgggttctgccctgctgtcctctgccaccctaacagcccacttgacgaggagaatctgacccaggagaaccaagaccgagggacacacgtggacctcggattagcctccgccaacgtggacttcgctttcagcctgtacaagcagttagtcctgaaggcccctgataagaatgtcatcttctccccactgagcatctccaccgccttggccttcctgtctctgggggcccataataccaccctgacagagattctcaaaggcctcaagttcaacctcacggagacttctgaggcagaaattcaccagagcttccagcacctcctgcgcaccctcaatcagtccagcgatgagctgcagctgagtatgggaaatgccatgtttgtcaaagagcaactcagtctgctggacaggttcacggaggatgccaagaggctgtatggctccgaggcctttgccactgactttcaggactcagctgcagctaagaagctcatcaacgactacgtgaagaatggaactagggggaaaatcacagatctgatcaaggaccttgactcgcagacaatgatggtcctggtgaattacatcttctttaaagccaaatgggagatgccctttgacccccaagatactcatcagtcaaggttctacttgagcaagaaaaagtgggtaatggtgcccatgatgagtttgcatcacctgactataccttacttccgggacgaggagctgtcctgcaccgtggtggagctgaagtacacaggcaatgccagcgcactcttcatcctccctgatcaagacaagatggaggaagtggaagccatgctgctcccagagaccctgaagcggtggagagactctctggagttcagagagataggtgagctctacctgccaaagttttccatctcgagggactataacctgaacgacatacttctccagctgggcattgaggaagccttcaccagcaaggctgacctgtcagggatcacaggggccaggaacctagcagtctcccaggtggtccataaggctgtgcttgatgtatttgaggagggcacagaagcatctgctgccacagcagtcaaaatcaccctcctttctgcattagtggagacaaggaccattgtgcgtttcaacaggcccttcctgatgatcattgtccctacagacacccagaacatcttcttcatgagcaaagtcaccaatcccaagcaagcctagagcttgccatcaagcagtggggctctcagtaaggaacttggaatgcaagctggatgcctgggtctctgggcacagcctggcccctgtgcaccgagtggccatggcatgtgtggccctgtctgcttatccttggaaggtgacagcgattccctgtgtagctctcacatgcacaggggcccatggactcttcagtctggaggcccaggaccctccagactgaagagtccatgggccccctgtgccatgtgagagcttacacagggaatcgctgtcacnttccaaggataagcagacagggccacacatgccagcgcactcttcatcctccctgatcaagacaagatggaggaagtggaagccatgntgctcccagagaccctgaagcggtggagagactctctggagttcagagagataggtgagctctacctgccaaagttttccatctcgagggactataacctgaacgacatacttctccagctgggcattgaggaagcnttcaccngcaaggctgacctgtcaaggg

SEQ ID NO: 343685 - DNA, 1582 bp, Homo sapiens
ggacgcgtgggtcgacccacgcgtccgtggaatccaccagctacatccagctccctgaggcagagttgagaatggagagaatgttacctctcctggctctggggctcttggcggctgggttctgccctgctgtcctctgccaccctaacagcccacttgacgaggagaatctgacccaggagaaccaagaccgagggacacacgtggacctcggattagcctccgccaacgtggacttcgctttcagcctgtacaagcagttagtcctgaaggcccctgataagaatgtcatcttctccccactgagcatctccaccgccttggccttcctgtctctgggggcccataataccaccctgacagagattctcaaaggcctcaagttcaacctcacggagacttctgaggcagaaattcaccagagcttccagcacctcctgcgcaccctcaatcagtccagcgatgagctgcagctgagtatgggaaatgccatgtttgtcaaagagcaactcagtctgctggacaggttcacggaggatgccaagaggctgtatggctccgaggcctttgccactgactttcaggactcagctgcagctaagaagctcatcaacgactacgtgaagaatggaactagggggaaaatcacagatctgatcaaggaccttgactcgcagacaatgatggtcctggtgaattacatcttctttaaagccaaatgggagatgccctttgacccccaagatactcatcagtcaaggttctacttgagcaagaaaaagtgggtaatggtgcccatgatgagtttgcatcacctgactataccttacttccgggacgaggagctgtcctgcaccgtggtggagctgaagtacacaggcaatgccagcgcactcttcatcctccctgatcaagacaagatggaggaagtggaagccatgctgctcccagagaccctgaagcggtggagagactctctggagttcagagagataggtgagctctacctgccaaagttttccatctcgagggactataacctgaacgacatacttctccagctgggcattgaggaagccttcaccagcaaggctgacctgtcagggatcacaggggccaggaacctagcagtctcccaggtggtccataaggctgtgcttgatgtatttgaggagggcacagaagcatctgctgccacagcagtcaaaatcaccctcctttctgcattagtggagacaaggaccattgtgcgtttcaacaggcccttcctgatgatcattgtccctacagacacccagaacatcttcttcatgagcaaagtcaccaatcccaagcaagcctagagcttgccatcaagcagtggggctctcagtaaggaacttggaatgcaagctggatgcctgggtctctgggcacagcctggcccctgtgcaccgagtggccatggcatgtgtggccctgtctgcttatccttggaaggtgacagcgattccctgtgtagctctcacatgcacaggggcccatggactcttcagtctggagggtcctgggcctcctgacagcaataaataatttcgttgga

SEQ ID NO: 343686 - DNA, 1600 bp, Homo sapiens
gcattcatggcaatccactactccagacagacggctttggaatccaccagctacatccagctccctgaggcagagttgagaatggagagaatgttacctctcctggctctggggctcttggcggctgggttctgccctgctgtcctctgccaccctaacagcccacttgacgaggagaatctgacccaggagaaccaagaccgagggacacacgtggacctcggattagcctccgccaacgtggacttcgctttcagcctgtacaagcagttagtcctgaaggcccctgataagaatgtcatcttctccccactgagcatctccaccgccttggccttcctgtctctgggggcccataataccaccctgacagagattctcaaaggcctcaagttcaacctcacggagacttctgaggcagaaattcaccagagcttccagcacctcctgcgcaccctcaatcagtccagcgatgagctgcagctgagtatgggaaatgccatgtttgtcaaagagcaactcagtctgctggacaggttcacggaggatgccaagaggctgtatggctccgaggcctttgccactgactttcaggactcagctgcagctaagaagctcatcaacgactacgtgaagaatggaactagggggaaaatcacagatctgatcaaggaccttgactcgcagacaatgatggtcctggtgaattacatcttctttaaagccaaatgggagatgccctttgacccccaagatactcatcagtcaaggttctacttgagcaagaaaaagtgggtaatggtgcccatgatgagtttgcatcacctgactataccttacttccgggacgaggagctgtcctgcaccgtggtggagctgaagtacacaggcaatgccagcgcactcttcatcctccctgatcaagacaagatggaggaagtggaagccatgctgctcccagagaccctgaagcggtggagagactctctggagttcagagagataggtgagctctacctgccaaagttttccatctcgagggactataacctgaacgacatacttctccagctgggcattgaggaagccttcaccagcaaggctgacctgtcagggatcacaggggccaggaacctagcagtctcccaggtggtccataaggctgtgcttgatgtatttgaggagggcacagaagcatctgctgccacagcagtcaaaatcaccctcctttctgcattagtggagacaaggaccattgtgcgtttcaacaggcccttcctgatgatcattgtccctacagacacccagaacatcaagcagtggggctctcagtaaggaacttggaatgcaagctggatgcctgggtctctgggcacagcctggcccctgtgcaccgagtggccatggcatgtgtggccctgtctgcttatccttggaaggtgacagcgattccctgtgtagctctcacatgcacaggggcccatggactcttcagtctggagggtcctgggcctcctgacagcaataaataatttcgttggaaaaaaaaaagagaagttggcctataggagtcgattacagtgagcgcggaatttagatt

SEQ ID NO: 343687 - DNA, 1538 bp, Homo sapiens
gcattcatggcaatccactactccagacagacggctttggaatccaccagctacatccagctccctgaggcagagttgagaatggagagaatgttacctctcctggctctggggctcttggcggctgggttctgccctgctgtcctctgccaccctaacagcccacttgacgaggagaatctgacccaggagaaccaagaccgagggacacacgtggacctcggattagcctccgccaacgtggacttcgctttcagcctgtacaagcagttagtcctgaaggcccctgataagaatgtcatcttctccccactgagcatctccaccgccttggccttcctgtctctgggggcccataataccaccctgacagagattctcaaaggcctcaagttcaacctcacggagacttctgaggcagaaattcaccagagcttccagcacctcctgcgcaccctcaatcagtccagcgatgagctgcagctgagtatgggaaatgccatgtttgtcaaagagcaactcagtctgctggacaggttcacggaggatgccaagaggctgtatggctccgaggcctttgccactgactttcaggactcagctgcagctaagaagctcatcaacgactacgtgaagaatggaactagggggaaaatcacagatctgatcaaggaccttgactcgcagacaatgatggtcctggtgaattacatcttctttaaagccaaatgggagatgccctttgacccccaagatactcatcagtcaaggttctacttgagcaagaaaaagtgggtaatggtgcccatgatgagtttgcatcacctgactataccttacttccgggacgaggagctgtcctgcaccgtggtggagctgaagtacacaggcaatgccagcgcactcttcatcctccctgatcaagacaagatggaggaagtggaagccatgctgctcccagagaccctgaagcggtggagagactctctggagttcagagagataggtgagctctacctgccaaagttttccatctcgagggactataacctgaacgacatacttctccagctgggcattgaggaagccttcaccagcaaggctgacctgtcagggatcacaggggccaggaacctagcagtctcccaggtggtccataaggctgtgcttgatgtatttgaggagggcacagaagcatctgctgccacagcagtcaggcccttcctgatgatcattgtccctacagacacccagaacatcttcttcatgagcaaagtcaccaatcccaagcaagcctagagcttgccatcaagcagtggggctctcagtaaggaacttggaatgcaagctggatgcctgggtctctgggcacagcctggcccctgtgcaccgagtggccatggcatgtgtggccctgtctgcttatccttggaaggtgacagcgattccctgtgtagctctcacatgcacaggggcccatggactcttcagtctggagggtcctgggcctcctgacagcaataaataatttcgttgga

SEQ ID NO: 343688 - DNA, 1367 bp, Homo sapiens
  misc_feature (1216)..(1216): n is a, c, g, or t
  misc_feature (1227)..(1227): n is a, c, g, or t
  misc_feature (1266)..(1266): n is a, c, g, or t
  misc_feature (1275)..(1275): n is a, c, g, or t
  misc_feature (1277)..(1277): n is a, c, g, or t
  misc_feature (1283)..(1283): n is a, c, g, or t
  misc_feature (1296)..(1296): n is a, c, g, or t
  misc_feature (1301)..(1302): n is a, c, g, or t
  misc_feature (1322)..(1322): n is a, c, g, or t
  misc_feature (1325)..(1325): n is a, c, g, or t
  misc_feature (1336)..(1336): n is a, c, g, or t
  misc_feature (1340)..(1341): n is a, c, g, or t
  misc_feature (1355)..(1355): n is a, c, g, or t
gcattcatggcaatccactactccagacagacggctttggaatccaccagctacatccagctccctgaggcagagttgagaatggagagaatgttacctctcctggctctggggctcttggcggctgggttctgccctgctgtcctctgccaccctaacagcccacttgacgaggagaatctgacccaggagaaccaagaccgagggacacacgtggacctcggattagcctccgccaacgtggacttcgctttcagcctgtacaagcagttagtcctgaaggcccctgataagaatgtcatcttctccccactgagcatctccaccgccttggccttcctgtctctgggggcccataataccaccctgacagagattctcaaaggcctcaagttcaacctcacggagacttctgaggcagaaattcaccagagcttccagcacctcctgcgcaccctcaatcagtccagcgatgagctgcagctgagtatgggaaatgccatgtttgtcaaagagcaactcagtctgctggacaggttcacggaggatgccaagaggctgtatggctccgaggcctttgccactgactttcaggactcagctgcagctaagaagctcatcaacgactacgtgaagaatggaactagggggaaaatcacagatctgatcaaggaccttgactcgcagacaatgatggtcctggtgaattacatcttctttaaagccaaatgggagatgccctttgacccccaagatactcatcagtcaaggttctacttgagcaagaaaaagtgggtaatggtgcccatgatgagtttgcatcacctgactataccttacttccgggacgaggagctgtcctgcaccgtggtggagctgaagtacacaggcaatgccagcgcactcttcatcctccctgatcaagacaagatggaggaagtggaagccatgctgctcccagagaccctgaagcggtggagagactctctggagttcagagagataggtgagctctacctgccaaagttttccatctcgagggactataacctgaacgacatacttctccagctgggcattgaggaagccttcaccagcaaggctgacctgtcagggatcacaggggccaggaacctagcagtctcccaggtggtccataaggctgtgcttgatgtatttgaggagggcacagaagcatctgctgccacagcagttnctgatgacatngcctacagcaccagacatctcttatgacaagcaccatcnagcagctanantgcatnagcatgggcttanagganntgatgagctgatgctggctntgncagctgccctngccnntgcatgatggtgcntgtgtatcttga

SEQ ID NO: 343689 - DNA, 1203 bp, Homo sapiens
gcattcatggcaatccactactccagacagacggctttggaatccaccagctacatccagctccctgaggcagagttgagaatggagagaatgttacctctcctggctctggggctcttggcggctgggttctgccctgctgtcctctgccaccctaacagcccacttgacgaggagaatctgacccaggagaaccaagaccgagggacacacgtggacctcggattagcctccgccaacgtggacttcgctttcagcctgtacaagcagttagtcctgaaggcccctgataagaatgtcatcttctccccactgagcatctccaccgccttggccttcctgtctctgggggcccataataccaccctgacagagattctcaaaggcctcaagttcaacctcacggagacttctgaggcagaaattcaccagagcttccagcacctcctgcgcaccctcaatcagtccagcgatgagctgcagctgagtatgggaaatgccatgtttgtcaaagagcaactcagtctgctggacaggttcacggaggatgccaagaggctgtatggctccgaggcctttgccactgactttcaggactcagctgcagctaagaagctcatcaacgactacgtgaagaatggaactagggggaaaatcacagatctgatcaaggaccttgactcgcagacaatgatggtcctggtgaattacatcttctttaaagccaaatgggagatgccctttgacccccaagatactcatcagtcaaggttctacttgagcaagaaaaagtgggtaatggtgcccatgatgagtttgcatcacctgactataccttacttccgggacgaggagctgtcctgcaccgtggtggagctgaagtacacaggcaatgccagcgcactcttcatcctccctgatcaagacaagatggaggaagtggaagccatgctgctcccagagaccctgaagcggtggagagactctctggagttcagagagataggtgagctctacctgccaaagttttccatctcgagggactataacctgaacgacatacttctccagctgggcattgaggaagccttcaccagcaaggctgacctgtcagggatcacaggggccaggaacctagcagtctcccagtccataaggctgtgcttgatctactttgaggagacgcgtcagttcggacgccta

SEQ ID NO: 343690 - DNA, 1263 bp, Homo sapiens
gcattcatggcaatccactactccagacagacggctttggaatccaccagctacatccagctccctgaggcagagttgagaatggagagaatgttacctctcctggctctggggctcttggcggctgggttctgccctgctgtcctctgccaccctaacagcccacttgacgaggagaatctgacccaggagaaccaagaccgagggacacacgtggacctcggattagcctccgccaacgtggacttcgctttcagcctgtacaagcagttagtcctgaaggcccctgataagaatgtcatcttctccccactgagcatctccaccgccttggccttcctgtctctgggggcccataataccaccctgacagagattctcaaaggcctcaagttcaacctcacggagacttctgaggcagaaattcaccagagcttccagcacctcctgcgcaccctcaatcagtccagcgatgagctgcagctgagtatgggaaatgccatgtttgtcaaagagcaactcagtctgctggacaggttcacggaggatgccaagaggctgtatggctccgaggcctttgccactgactttcaggactcagctgcagctaagaagctcatcaacgactacgtgaagaatggaactagggggaaaatcacagatctgatcaaggaccttgactcgcagacaatgatggtcctggtgaattacatcttctttaaagccaaatgggagatgccctttgacccccaagatactcatcagtcaaggttctacttgagcaagaaaaagtgggtaatggtgcccatgatgagtttgcatcacctgactataccttacttccgggacgaggagctgtcctgcaccgtggtggagctgaagtacacaggcaatgccagcgcactcttcatcctccctgatcaagacaagatggaggaagtggaagccatgctgctcccagagaccctgaagcggtggagagactctctggagttcagagagataggtgagctctacctgccaaagttttccatctcgagggactataacctgaacgacatacttctccagctgggcattgaggaagccttcaccagcaaggctgacctgtgcaccgagtggccatggcatgtgtggccctgtctgcttatccttggaaggtgacagcgattccctgtgtagctctcacatgcacaggggcccatggactcttcagtctggagggtcctgggcctcctgacagcaataaataatttcgttgga

SEQ ID NO: 343691 - DNA, 1329 bp, Homo sapiens
gcattcatggcaatccactactccagacagacggctttggaatccaccagctacatccagctccctgaggcagagttgagaatggagagaatgttacctctcctggctctggggctcttggcggctgggttctgccctgctgtcctctgccaccctaacagcccacttgacgaggagaatctgacccaggagaaccaagaccgagggacacacgtggacctcggattagcctccgccaacgtggacttcgctttcagcctgtacaagcagttagtcctgaaggcccctgataagaatgtcatcttctccccactgagcatctccaccgccttggccttcctgtctctgggggcccataataccaccctgacagagattctcaaaggcctcaagttcaacctcacggagacttctgaggcagaaattcaccagagcttccagcacctcctgcgcaccctcaatcagtccagcgatgagctgcagctgagtatgggaaatgccatgtttgtcaaagagcaactcagtctgctggacaggttcacggaggatgccaagaggctgtatggctccgaggcctttgccactgactttcaggactcagctgcagctaagaagctcatcaacgactacgtgaagaatggaactagggggaaaatcacagatctgatcaaggaccttgactcgcagacaatgatggtcctggtgaattacatcttctttaaagccaaatgggagatgccctttgacccccaagatactcatcagtcaaggttctacttgagcaagaaaaagtgggtaatggtgcccatgatgagtttgcatcacctgactataccttacttccgggacgaggagctgtcctgcaccgtggtggagctgaagtacacaggcaatgccagcgcactcttcatcctccctgatcaagacaagatggaggaagtggaagccatgctgctcccagagaccctgaagcggtggagagactctctggagttcaggtgattcttcctggcccccaaagaccccacatctctccacgtcaaggtctcaccaatgtccagggacaagggcatggtggtgggagaactcatacagggacaggtggaatttacacttactttgccctatgctgcctacatggctttgggcttgatttttctttttcttctttaagacaatgacatcagacaggacaaggggctgaggcttcctctgactccagcatgttctaagtcatgagaaatcttctgcacagtcccaaacactcatgcatggtttctcctggtctcaatctcttgaagggagagagaaacagaaggaattgtgatc

SEQ ID NO: 343692 - DNA, 1454 bp, Homo sapiens
gcattcatggcaatccactactccagacagacggctttggaatccaccagctacatccagctccctgaggcagagttgagaatggagagaatgttacctctcctggctctggggctcttggcggctgggttctgccctgctgtcctctgccaccctaacagcccacttgacgaggagaatctgacccaggagaaccaagaccgagggacacacgtggacctcggattagcctccgccaacgtggacttcgctttcagcctgtacaagcagttagtcctgaaggcccctgataagaatgtcatcttctccccactgagcatctccaccgccttggccttcctgtctctgggggcccataataccaccctgacagagattctcaaaggcctcaagttcaacctcacggagacttctgaggcagaaattcaccagagcttccagcacctcctgcgcaccctcaatcagtccactaagaagctcatcaacgactacgtgaagaatggaactagggggaaaatcacagatctgatcaaggaccttgactcgcagacaatgatggtcctggtgaattacatcttctttaaagccaaatgggagatgccctttgacccccaagatactcatcagtcaaggttctacttgagcaagaaaaagtgggtaatggtgcccatgatgagtttgcatcacctgactataccttacttccgggacgaggagctgtcctgcaccgtggtggagctgaagtacacaggcaatgccagcgcactcttcatcctccctgatcaagacaagatggaggaagtggaagccatgctgctcccagagaccctgaagcggtggagagactctctggagttcagagagataggtgagctctacctgccaaagttttccatctcgagggactataacctgaacgacatacttctccagctgggcattgaggaagccttcaccagcaaggctgacctgtcagggatcacaggggccaggaacctagcagtctcccaggtggtccataaggctgtgcttgatgtatttgaggagggcacagaagcatctgctgccacagcagtcaaaatcaccctcctttctgcattagtggagacaaggaccattgtgcgtttcaacaggcccttcctgatgatcattgtccctacagacacccagaacatcttcttcatgagcaaagtcaccaatcccaagcaagcctagagcttgccatcaagcagtggggctctcagtaaggaacttggaatgcaagctggatgcctgggtctctgggcacagcctggcccctgtgcaccgagtggccatggcatgtgtggccctgtctgcttatccttggaaggtgacagcgattccctgtgtagctctcacatgcacaggggcccatggactcttcagtctggagggtcctgggcctcctgacagcaataaataatttcgttgga

SEQ ID NO: 343693 - DNA, 1521 bp, Homo sapiens
gcattcatggcaatccactactccagacagacggctttggaatccaccagctacatccagctccctgaggcagagttgagaatggagagaatgttacctctcctggctctggggctcttggcggctgggttctgccctgctgtcctctgccaccctaacagcccacttgacgaggagaatctgacccaggagaaccaagaccgagggacacacgtggacctcggattagcctccgccaacgtggacttcgctttcagcctgtacaagcagttagtcctgaaggcccctgataagaatgtcatcttctccccactgagcatctccaccgccttggccttcctgtctctgggggcccataataccaccctgacagagattctcaaaggcctcaagttcaacctcacggagacttctgaggcagaaattcaccagagcttccagcacctcctgcgcaccctcaatcagtccagcgatgagctgcagctgagtatgggaaatgccatgtttgtcaaagagcaactcagtctgctggacaggttcacggaggatgccaagaggctgtatggctccgaggcctttgccactgactttcaggactcagctgcagctaagaagctcatcaacgactacgtgaagaatggaactagggggaaccaaatgggagatgccctttgacccccaagatactcatcagtcaaggttctacttgagcaagaaaaagtgggtaatggtgcccatgatgagtttgcatcacctgactataccttacttccgggacgaggagctgtcctgcaccgtggtggagctgaagtacacaggcaatgccagcgcactcttcatcctccctgatcaagacaagatggaggaagtggaagccatgctgctcccagagaccctgaagcggtggagagactctctggagttcagagagataggtgagctctacctgccaaagttttccatctcgagggactataacctgaacgacatacttctccagctgggcattgaggaagccttcaccagcaaggctgacctgtcagggatcacaggggccaggaacctagcagtctcccaggtggtccataaggctgtgcttgatgtatttgaggagggcacagaagcatctgctgccacagcagtcaaaatcaccctcctttctgcattagtggagacaaggaccattgtgcgtttcaacaggcccttcctgatgatcattgtccctacagacacccagaacatcttcttcatgagcaaagtcaccaatcccaagcaagcctagagcttgccatcaagcagtggggctctcagtaaggaacttggaatgcaagctggatgcctgggtctctgggcacagcctggcccctgtgcaccgagtggccatggcatgtgtggccctgtctgcttatccttggaaggtgacagcgattccctgtgtagctctcacatgcacaggggcccatggactcttcagtctggagggtcctgggcctcctgacagcaataaataatttcgttgga

SEQ ID NO: 343694 - DNA, 1318 bp, Homo sapiens
gcattcatggcaatccactactccagacagacggctttggaatccaccagctacatccagctccctgaggcagagttgagaatggagagaatgttacctctcctggctctggggctcttggcggctgggttctgccctgctgtcctctgccaccctaacagcccacttgacgaggagaatctgacccaggagaaccaagaccgagggacacacgtggacctcggattagcctccgccaacgtggacttcgctttcagcctgtacaagcagttagtcctgaaggcccctgataagaatgtcatcttctccccactgagcatctccaccgccttggccttcctgtctctgggggcccataataccaccctgacagagattctcaaaggcctcaagttcaacctcacggagacttctgaggcagaaattcaccagagcttccagcacctcctgcgcaccctcaatcagtccagcgatgagctgcagctgagtatgggaaatgccatgtttgtcaaagagcaactcagtctgctggacaggttcacggaggatgccaagaggctgtatggctccgaggcctttgccactgactttcaggactcagctgcagctaagaagctcatcaacgactacgtgaagaatggaactagggggaaaatcacagatctgatcaaggaccttgactcgcagacaatgatggtcctggtgaattacatcttctttaaagagagataggtgagctctacctgccaaagttttccatctcgagggactataacctgaacgacatacttctccagctgggcattgaggaagccttcaccagcaaggctgacctgtcagggatcacaggggccaggaacctagcagtctcccaggtggtccataaggctgtgcttgatgtatttgaggagggcacagaagcatctgctgccacagcagtcaaaatcaccctcctttctgcattagtggagacaaggaccattgtgcgtttcaacaggcccttcctgatgatcattgtccctacagacacccagaacatcttcttcatgagcaaagtcaccaatcccaagcaagcctagagcttgccatcaagcagtggggctctcagtaaggaacttggaatgcaagctggatgcctgggtctctgggcacagcctggcccctgtgcaccgagtggccatggcatgtgtggccctgtctgcttatccttggaaggtgacagcgattccctgtgtagctctcacatgcacaggggcccatggactcttcagtctggagggtcctgggcctcctgacagcaataaataatttcgttgga

SEQ ID NO: 343695 - DNA, 769 bp, Homo sapiens
ccgggctgcaggaattggcacgaggcaaggagctgtcctgcaccgtggtggagctgaagtacacaggcaatgccagcgcactcttcatcctccctgatcaagacaagatggaggaagtggaagccatgctgctcccagagaccctgaagcggtggagagactctctggagttcagagagataggtgagctctacctgccaaagttttccatctcgagggactataacctgaacgacatacttctccagctgggcattgaggaagccttcaccagcaaggctgacctgtcagggatcacaggggccaggaacctagcagtctcccaggtggtccataaggctgtgcttgatgtatttgaggagggcacagaagcatctgctgccacagcagtcaaaatcaccctcctttctgcattagtggagacaaggaccattgtgcgtttcaacaggcccttcctgatgatcattgtccctacagacacccagaacatcttcttcatgagcaaagtcaccaatcccaagcaagcctagagcttgccatcaagcagtggggctctcagtaaggaacttggaatgcaagctggatgcctgggtctctgggcacagcctggcccctgtgcaccgagtggccatggcatgtgtggccctgtctgcttatccttggaaggtgacagcgattccctgtgtagctctcacatgcacaggggcccatggactcttcagtctggagggtcctgggcctcctgacagcaataaataatttcgttgga

SEQ ID NO: 343696 - DNA, 771 bp, Homo sapiens
  misc_feature (22)..(22): n is a, c, g, or t
caggcgttctagaggatccgangtagcccaagagctgtcctgcaccgtggtggagctgaagtacacaggcaatgccagcgcactcttcatcctccctgatcaagacaagatggaggaagtggaagccatgctgctcccagagaccctgaagcggtggagagactctctggagttcagagagataggtgagctctacctgccaaagttttccatctcgagggactataacctgaacgacatacttctccagctgggcattgaggaagccttcaccagcaaggctgacctgtcagggatcacaggggccaggaacctagcagtctcccaggtggtccataaggctgtgcttgatgtatttgaggagggcacagaagcatctgctgccacagcagtcaaaatcaccctcctttctgcattagtggagacaaggaccattgtgcgtttcaacaggcccttcctgatgatcattgtccctacagacacccagaacatcttcttcatgagcaaagtcaccaatcccaagcaagcctagagcttgccatcaagcagtggggctctcagtaaggaacttggaatgcaagctggatgcctgggtctctgggcacagcctggcccctgtgcaccgagtggccatggcatgtgtggccctgtctgcttatccttggaaggtgacagcgattccctgtgtagctctcacatgcacaggggcccatggactcttcagtctggagggtcctgggcctcctgacagcaataaataatttcgttgga

SEQ ID NO: 343697 - DNA, 792 bp, Homo sapiens
gcattcatggcaatccactactccagacagacggctttggaatccaccagctacatccagctccctgaggcagagttgagaatggagagaatgttacctctcctggctctggggctcttggcggctgggttctgccctgctgtcctctgccaccctaacagcccacttgacgaggagaatctgacccaggagaaccaagaccgagggacacacgtggacctcggattagcctccgccaacgtggacttcgctttcagcctgtacaagcagttagtcctgaaggcccctgataagaatgtcatcttctccccactgagcatctccaccgccttggccttcctgtctctgggggcccataataccaccctgacagagattctcaaaggcctcaagttcaacctcacggagacttctgaggcagaaattcaccagagcttccagcacctcctgcgcaccctcaatcagtccagcgatgagctgcagctgagtatgggaaatgccatgtttgtcaaagagcaactcagtctgctggacaggttcacggaggatgccaagaggctgtatggctccgaggcctttgccactgactttcaggactcagctgcagctaagaagctcatcaacgactacgtgaagaatggaactagggggaaaatcacagatctgatcaaggaccttgactcgcagacaatgatggtcctggtgaattacatcttctttaaagccaaatgggagatgcccattcagccctccattcagcctctgtccatcaccactgtccattcacctctg

SEQ ID NO: 343698 - DNA, 1017 bp, Homo sapiens
gcattcatggcaatccactactccagacagacggctttggaatccaccagctacatccagctccctgaggcagagttgagaatggagagaatgttacctctcctggctctggggctcttggcggctgggttctgccctgctgtcctctgccaccctaacagcccacttgacgaggagaatctgacccaggagaaccaagaccgagggacacacgtggacctcggattagcctccgccaacgtggacttcgctttcagcctgtacaagcagttagtcctgaaggcccctgataagaatgtcatcttctccccactgagcatctccaccgccttggccttcctgtctctgggggcccataataccaccctgacagagattctcaaaggcctcaagttcaacctcacggagacttctgaggcagaaattcaccagagcttccagcacctcctgcgcaccctcaatcagtccagcgatgagctgcagctgagtatgggaaatgccatgtttgtcaaagagcaactcagtctgctggacaggttcacggaggatgccaagaggctgtatggctccgaggcctttgccactgactttcaggactcagctgcagctaagaagctcatcaacgactacgtgaagaatggaactagggggaacctgaagcggtggagagactctctggagttcaggtgattcttcctggcccccaaagaccccacatctctccacgtcaaggtctcaccaatgtccagggacaagggcatggtggtgggagaactcatacagggacaggtggaatttacacttactttgccctatgctgcctacatggctttgggcttgatttttctttttcttctttaagacaatgacatcagacaggacaaggggctgaggcttcctctgactccagcatgttctaagtcatgagaaatcttctgcacagtcccaaacactcatgcatggtttctcctggtctcaatctcttgaagggagagagaaacagaaggaattgtgatc

SEQ ID NO: 343699 - DNA, 628 bp, Homo sapiens
ttccaacgaaattatttattgctgtcaggaggcccaggaccctccagactgaagagtccatgggcccctgtgcatgtgagagctacacagggaatcgctgtcaccttccaaggataagcagacagggccacacactgccattggtgcactcggtgcacagagtgccaggaacctagcagtctcccgtggtccataaggctgtgcttgatgtatttgaggagggcacagaagcatctgctgccacagcagtcaaaatcaccctcctttctgcattagtggagacaaggaccattgtgcgtttcaacaggcccttcctgatgatcattgtccctacagacacccagaacatcttcttcatgagcaaagtcaccaatcccaagcaagcctagagcttgccatcaagcagtggggctctcagtaaggaacttggaatgcaagctggatgcctgggtctctgggcacagcctggcccctgtgcaccgagtggccatggcatgtgtggccctgtctgcttatccttggaaggtgacagcgattccctgtgtagctctcacatgcacaggggcccatggactcttcagtctggagggtcctgggcctcctgacagcaataaataatttcgttgga

SEQ ID NO: 343700 - DNA, 777 bp, Homo sapiens
ccgggctgcaggaattggcacgaggcaagagtgggtaatggtgcccatgatgagtttgcatcacctgactataccttacttccgggacgaggagctgtcctgcaccgtggtggagctgaagtacacaggcaatgccagcgcactcttcatcctccctgatcaagacaagatggaggaagtggaagccatgctgctcccagagaccctgaagcggtggagagactctctggagttcagagagataggtgagctctacctgccaaagttttccatctcgagggactataacctgaacgacatacttctccagctgggcattgaggaagccttcaccagcaaggctgacctgtcagggatcacaggggccaggaacctagcagtctcccaggtggtccataaggctgtgcttgatgtatttgaggagggcacagaagcatctgctgccacagcagtcaggcccttcctgatgatcattgtccctacagacacccagaacatcttcttcatgagcaaagtcaccaatcccaagcaagcctagagcttgccatcaagcagtggggctctcagtaaggaacttggaatgcaagctggatgcctgggtctctgggcacagcctggcccctgtgcaccgagtggccatggcatgtgtggccctgtctgcttatccttggaaggtgacagcgattccctgtgtagctctcacatgcacaggggcccatggactcttcagtctggagggtcctgggcctcctgacagcaataaataatttcgttgga

SEQ ID NO: 343701 - DNA, 611 bp, Homo sapiens
ggcaaatcatactcagcatctgggtctccatttgcacatctaggcatcaggactgtgcaaaactagttggcaggggagttgggaggagcaaacattcaacagcacaaagacaggccagcactaggtgctcaatgcacattagaccccttagtggcacacaggcaggtcgctgaactcctgcgcatctgtgtttcccgtgtgtaatgttctgctgtccccacagtggtccataaggctgtgcttgatgtatttgaggagggcacagaagcatctgctgccacagcagtcaggcccttcctgatgatcattgtccctacagacacccagaacatcttcttcatgagcaaagtcaccaatcccaagcaagcctagagcttgccatcaagcagtggggctctcagtaaggaacttggaatgcaagctggatgcctgggtctctgggcacagcctggcccctgtgcaccgagtggccatggcatgtgtggccctgtctgcttatccttggaaggtgacagcgattccctgtgtagctctcacatgcacaggggcccatggactcttcagtctggagggtcctgggcctcctgacagcaataaataatttcgttgga

SEQ ID NO: 343702 - DNA, 525 bp, Homo sapiens
ttccaacgaaattatttattgctgtcaggaggcccaggaccctccagactgaagagtccatgggcccctgtgcatgtgagagctacacagggaatcgctgtcaccttccaaggataagcagacagggccacacatgccatggccactcggtgcacaggggccaggctgtgcccagacacccagaacatcttcttcatgagcaaagtcaccaatcccaagcaagcctagagcttgccatcaagcagtggggctctcagtaaggaacttggaatgcaagctggatgcctgggtctctgggcacagcctggcccctgtgcaccgagtggccatggcatgtgtggccctgtctgcttatccttggaaggtgacagcgattccctgtgtagctctcacatgcacaggggcccatggactcttcagtctggagggtcctgggcctcctgacagcaataaataatttcgttggaaaaaaaaaagagaagttggcctataggagtcgattacagtgagcgcggaatttagatt

SEQ ID NO: 343703 - DNA, 339 bp, Homo sapiens
gcattcatggcaatccactactccagacagacggctttggaatccaccagctacatccagctccctgaggcagagttgagaatggagagaatgttacctctcctggctctggggctcttggcggctgggttctgccctgctgtcctctgccaccctaacagcccacttgacgaggagaatctgacccaggagaaccaagaccgagggacacacgtggacctcggattagcctccgccaacgtggacttcgctttcagcctgtacaagcagttagtcctgaaggcccctgataagaatgtcatcttctccctatcctagagtagacaaggtagagccgag

SEQ ID NO: 343704 - DNA, 817 bp, Homo sapiens
  misc_feature (716)..(716): n is a, c, g, or t
  misc_feature (725)..(725): n is a, c, g, or t
  misc_feature (727)..(727): n is a, c, g, or t
  misc_feature (733)..(733): n is a, c, g, or t
  misc_feature (746)..(746): n is a, c, g, or t
  misc_feature (751)..(752): n is a, c, g, or t
  misc_feature (772)..(772): n is a, c, g, or t
  misc_feature (775)..(775): n is a, c, g, or t
  misc_feature (786)..(786): n is a, c, g, or t
  misc_feature (790)..(791): n is a, c, g, or t
  misc_feature (805)..(805): n is a, c, g, or t
ccgggctgcaggaattggcacgaggcaagaatcacagatctgatcaaggaccttgactcgcagacaatgatggtcctggtgaattacatcttctttaaagccaaatgggagatgccctttgacccccaagatactcatcagtcaaggttctacttgagcaagaaaaagtgggtaatggtgcccatgatgagtttgcatcacctgactataccttacttccgggacgaggagctgtcctgcaccgtggtggagctgaagtacacaggcaatgccagcgcactcttcatcctccctgatcaagacaagatggaggaagtggaagccatgctgctcccagagaccctgaagcggtggagagactctctggagttcagagagataggtgagctctacctgccaaagttttccatctcgagggactataacctgaacgacatacttctccagctgggcattgaggaagccttcaccagcaaggctgacctgtcagggatcacaggggccaggaacctagcagtctcccaggtggtccataaggctgtgcttgatgtatttgaggagggcacagaagcatctgctgccacagcagtcaaaatcaccctcctttctgcattagtggagacaaggaccattgtgcgtttcaacaggcccttcctgatgatcattgtccctacagacacccagaacatcttcttcatgagcaaagtcaccaatcnagcagctanantgcatnagcatgggcttanagganntgatgagctgatgctggctntgncagctgccctngccnntgcatgatggtgcntgtgtatcttga

SEQ ID NO: 343705 - DNA, 789 bp, Homo sapiens
gactagttctagatcgcgatctagacactagtcggctttggaatccaccagctacatccagctccctgagagttgagaatggagagaatgttacctctcctggctctggggctcttggcggctgggttctgccctgctgtcctctgccaccctaacagcccacttgacgaggagaatctgacccaggagaaccaagaccgagggacacacgtggacctcggattagcctccgccaacgtggacttcgctttcagcctgtacaagcagttagtcctgaaggcccctgataagaatgtcatcttctccccactgagcatctccaccgccttggccttcctgtctctgggggcccataataccaccctgacagagattctcaaaggcctcaagttcaacctcacggagacttctgaggcagaaattcaccagagcttccagcacctcctgcgcaccctcaatcagtccagcgatgagctgcagctgagtatgggaaatgccatgtttgtcaaagagcaactcagtctgctggacaggttcacggaggatgccaagaggctgtatggctccgaggcctttgccactgactttcaggactcagctgcagctaagaagctcatcaacgactacgtgaagaatggaactagggggaaaatcacagatctgatcaaggaccttgactcgcagacaatgatggtcctggtgaattacatcttctttaaagccaaatgggagatgcccattcagccctccattcagcctctgtccatcaccactgtccattcacctctg

SEQ ID NO: 343706 - DNA, 249 bp, Homo sapiens
ttgtaggctggtggggtcgtcagtctcacaactgtcgtgtctggggagagagcctggtggcaccctaacagcccacttgacgaggagaatctgacccaggagaaccaagaccgagggacacacgtggacctcggattagcctccgccaacgtggacttcgctttcagcctgtacaagcagttagtcctgaaggcccctgataagaatgtcatcttctccctatcctagagtagacaaggtagagccgag

SEQ ID NO: 343707 - DNA, 1624 bp, Homo sapiens
gcattcatggcaatccactactccagacagacggctttggaatccaccagctacatccagctccctgaggcagagttgagaatggagagaatgttacctctcctggctctggggctcttggcggctgggttctgccctgctgtcctctgccaccctaacagcccacttgacgaggagaatctgacccaggagaaccaagaccgagggacacacgtggacctcggattagcctccgccaacgtggacttcgctttcagcctgtacaagcagttagtcctgaaggcccctgataagaatgtcatcttctccccactgagcatctccaccgccttggccttcctgtctctgggggcccataataccaccctgacagagattctcaaaggcctcaagttcaacctcacggagacttctgaggcagaaattcaccagagcttccagcacctcctgcgcaccctcaatcagtccagcgatgagctgcagctgagtatgggaaatgccatgtttgtcaaagagcaactcagtctgctggacaggttcacggaggatgccaagaggctgtatggctccgaggcctttgccactgactttcaggactcagctgcagctaagaagctcatcaacgactacgtgaagaatggaactagggggaaaatcacagatctgatcaaggaccttgactcgcagacaatgatggtcctggtgaattacatcttctttaaagccaaatgggagatgccctttgacccccaagatactcatcagtcaaggttctacttgagcaagaaaaagtgggtaatggtgcccatgatgagtttgcatcacctgactataccttacttccgggacgaggagctgtcctgcaccgtggtggagctgaagtacacaggcaatgccagcgcactcttcatcctccctgatcaagacaagatggaggaagtggaagccatgctgctcccagagaccctgaagcggtggagagactctctggagttcagagagataggtgagctctacctgccaaagttttccatctcgagggactataacctgaacgacatacttctccagctgggcattgaggaagccttcaccagcaaggctgacctgtcagggatcacaggggccaggaacctagcagtctcccaggtggtccataaggctgtgcttgatgtatttgaggagggcacagaagcatctgctgccacagcagtcaaaatcaccctcctttctgcattagtggagacaaggaccattgtgcgtttcaacaggcccttcctgatgatcattgtccctacagacacccagaacatcttcttcatgagcaaagtcaccaatcccaagcaagcctagagcttgccatcaagcagtggggctctcagtaaggaacttggaatgcaagctggatgcctgggtctctgggcacagcctggcccctgtgcaccgagtggccatggcatgtgtggccctgtctgcttatccttggaaggtgacagcgattccctgtgtagctctcacatgcacaggggcccatggactcttcagtctggagggtcctgggcctcctgacagcaataaataatttcgttggaaaacaaaacaatcaaagaaaaatcacaccacg

SEQ ID NO: 343708 - DNA, 1805 bp, Homo sapiens
gcattcatggcaatccactactccagacagacggctttggaatccaccagctacatccagctccctgaggcagagttgagaatggagagaatgttacctctcctggctctggggctcttggcggctgggttctgccctgctgtcctctgccaccctaacagcccacttgacgaggagaatctgacccaggagaaccaagaccgagggacacacgtggacctcggattagcctccgccaacgtggacttcgctttcagcctgtacaagcagttagtcctgaaggcccctgataagaatgtcatcttctccccactgagcatctccaccgccttggccttcctgtctctgggggcccataataccaccctgacagagattctcaaaggcctcaagttcaacctcacggagacttctgaggcagaaattcaccagagcttccagcacctcctgcgcaccctcaatcagtccagcgatgagctgcagctgagtatgggaaatgccatgtttgtcaaagagcaactcagtctgctggacaggttcacggaggatgccaagaggctgtatggctccgaggcctttgccactgactttcaggactcagctgcagctaagaagctcatcaacgactacgtgaagaatggaactagggggaaaatcacagatctgatcaaggaccttgactcgcagacaatgatggtcctggtgaattacatcttctttaaagccaaatgggagatgccctttgacccccaagatactcatcagtcaaggttctacttgagcaagaaaaagtgggtaatggtgcccatgatgagtttgcatcacctgactataccttacttccgggacgaggagctgtcctgcaccgtggtggagctgaagtacacaggcaatgccagcgcactcttcatcctccctgatcaagacaagatggaggaagtggaagccatgctgctcccagagaccctgaagcggtggagagactctctggagttcagagagataggtgagctctacctgccaaagttttccatctcgagggactataacctgaacgacatacttctccagctgggcattgaggaagccttcaccagcaaggctgacctgtcagggatcacaggggccaggaacctagcagtctcccaggtggtccataaggctgtgcttgatgtatttgaggagggcacagaagcatctgctgccacagcagtcaaaatcaccctcctttctgcattagtggagacaaggaccattgtgcgtttcaacaggcccttcctgatgatcattgtccctacagacacccagaacatcttcttcatgagcaaagtcaccaatcccaagcaagcctagagcttgccatcaagcagtggggctctcagtaaggaacttggaatgcaagctggatgcctgggtctctgggcacagcctggcccctgtgcaccgagtggccatggcatgtgtggccctgtctgcttatccttggaaggtgacagcgattccctgtgtagctctcacatgcacaggggcccatggactcttcagtctggagggtcctgggcctcctgacagcaataaataatttcgttggaaaaaaaaaaaaaaaaaaaaaaaaaaaaaaaaaaaaaaaaaaaaaaaaaaaaaaaaataaaaaaatattaaaaaataaaaaaaattataataaatttaaaattaaaattaatatattattatttatattatatattttttatattaaattataaattattttataatttaatataattttaatttaaatattttaatataattaatattaatcc

SEQ ID NO: 343709 - DNA, 1589 bp, Homo sapiens
gactagttctagatcgcgatctagacactagtcggctttggaatccaccagctacatccagctccctgagagttgagaatggagagaatgttacctctcctggctctggggctcttggcggctgggttctgccctgctgtcctctgccaccctaacagcccacttgacgaggagaatctgacccaggagaaccaagaccgagggacacacgtggacctcggattagcctccgccaacgtggacttcgctttcagcctgtacaagcagttagtcctgaaggcccctgataagaatgtcatcttctccccactgagcatctccaccgccttggccttcctgtctctgggggcccataataccaccctgacagagattctcaaaggcctcaagttcaacctcacggagacttctgaggcagaaattcaccagagcttccagcacctcctgcgcaccctcaatcagtccagcgatgagctgcagctgagtatgggaaatgccatgtttgtcaaagagcaactcagtctgctggacaggttcacggaggatgccaagaggctgtatggctccgaggcctttgccactgactttcaggactcagctgcagctaagaagctcatcaacgactacgtgaagaatggaactagggggaaaatcacagatctgatcaaggaccttgactcgcagacaatgatggtcctggtgaattacatcttctttaaagccaaatgggagatgccctttgacccccaagatactcatcagtcaaggttctacttgagcaagaaaaagtgggtaatggtgcccatgatgagtttgcatcacctgactataccttacttccgggacgaggagctgtcctgcaccgtggtggagctgaagtacacaggcaatgccagcgcactcttcatcctccctgatcaagacaagatggaggaagtggaagccatgctgctcccagagaccctgaagcggtggagagactctctggagttcagagagataggtgagctctacctgccaaagttttccatctcgagggactataacctgaacgacatacttctccagctgggcattgaggaagccttcaccagcaaggctgacctgtcagggatcacaggggccaggaacctagcagtctcccaggtggtccataaggctgtgcttgatgtatttgaggagggcacagaagcatctgctgccacagcagtcaaaatcaccctcctttctgcattagtggagacaaggaccattgtgcgtttcaacaggcccttcctgatgatcattgtccctacagacacccagaacatcttcttcatgagcaaagtcaccaatcccaagcaagcctagagcttgccatcaagcagtggggctctcagtaaggaacttggaatgcaagctggatgcctgggtctctgggcacagcctggcccctgtgcaccgagtggccatggcatgtgtggccctgtctgcttatccttggaaggtgacagcgattccctgtgtagctctcacatgcacaggggcccatggactcttcagtctggagggtcctgggcctcctgacagcaataaataatttcgttgga

SEQ ID NO: 343710 - DNA, 1542 bp, Homo sapiens
gcattcatggcaatccactactccagacagacggctttggaatccaccagctacatccagctccctgaggcagagttgagaatggagagaatgttacctctcctggctctggggctcttggcggctgggttctgccctgctgtcctctgccaccctaacagcccacttgacgaggagaatctgacccaggagaaccaagaccgagggacacacgtggacctcggattagcctccgccaacgtggacttcgctttcagcctgtacaagcagttagtcctgaaggcccctgataagaatgtcatcttctccccactgagcatctccaccgccttggccttcctgtctctgggggcccataataccaccctgacagagattctcaaaggcctcaagttcaacctcacggagacttctgaggcagaaattcaccagagcttccagcacctcctgcgcaccctcaatcagtccagcgatgagctgcagctgagtatgggaaatgccatgtttgtcaaagagcaactcagtctgctggacaggttcacggaggatgccaagaggctgtatggctccgaggcctttgccactgactttcaggactcagctgcagctaagaagctcatcaacgactacgtgaagaatggaactagggggaaaatcacagatctgatcaaggaccttgactcgcagacaatgatggtcctggtgaattacatcttctttaaagccaaatgggagatgccctttgacccccaagatactcatcagtcaaggttctacttgagcaagaaaaagtgggtaatggtgcccatgatgagtttgcatcacctgactataccttacttccgggacgaggagctgtcctgcaccgtggtggagctgaagtacacaggcaatgccagcgcactcttcatcctccctgatcaagacaagatggaggaagtggaagccatgctgctcccagagaccctgaagcggtggagagactctctggagttcagagagataggtgagctctacctgccaaagttttccatctcgagggactataacctgaacgacatacttctccagctgggcattgaggaagccttcaccagcaaggctgacctgtcagggatcacaggggccaggaacctagcagtctcccaggtggtccataaggctgtgcttgatgtatttgaggagggcacagaagcatctgctgccacagcagtcaaaatcaccctcctttctgcattagtggagacaaggaccattgtgcgtttcaacaggcccttcctgatgatcattgtccctacagacacccagaacatcaagcagtggggctctcagtaaggaacttggaatgcaagctggatgcctgggtctctgggcacagcctggcccctgtgcaccgagtggccatggcatgtgtggccctgtctgcttatccttggaaggtgacagcgattccctgtgtagctctcacatgcacaggggcccatggactcttcagtctggagggtcctgggcctcctgacagcaataaataatttcgttgga

SEQ ID NO: 343711 - DNA, 1492 bp, Homo sapiens
gcattcatggcaatccactactccagacagacggctttggaatccaccagcaccctaacagcccacttgacgaggagaatctgacccaggagaaccaagaccgagggacacacgtggacctcggattagcctccgccaacgtggacttcgctttcagcctgtacaagcagttagtcctgaaggcccctgataagaatgtcatcttctccccactgagcatctccaccgccttggccttcctgtctctgggggcccataataccaccctgacagagattctcaaaggcctcaagttcaacctcacggagacttctgaggcagaaattcaccagagcttccagcacctcctgcgcaccctcaatcagtccagcgatgagctgcagctgagtatgggaaatgccatgtttgtcaaagagcaactcagtctgctggacaggttcacggaggatgccaagaggctgtatggctccgaggcctttgccactgactttcaggactcagctgcagctaagaagctcatcaacgactacgtgaagaatggaactagggggaaaatcacagatctgatcaaggaccttgactcgcagacaatgatggtcctggtgaattacatcttctttaaagccaaatgggagatgccctttgacccccaagatactcatcagtcaaggttctacttgagcaagaaaaagtgggtaatggtgcccatgatgagtttgcatcacctgactataccttacttccgggacgaggagctgtcctgcaccgtggtggagctgaagtacacaggcaatgccagcgcactcttcatcctccctgatcaagacaagatggaggaagtggaagccatgctgctcccagagaccctgaagcggtggagagactctctggagttcagagagataggtgagctctacctgccaaagttttccatctcgagggactataacctgaacgacatacttctccagctgggcattgaggaagccttcaccagcaaggctgacctgtcagggatcacaggggccaggaacctagcagtctcccaggtggtccataaggctgtgcttgatgtatttgaggagggcacagaagcatctgctgccacagcagtcaaaatcaccctcctttctgcattagtggagacaaggaccattgtgcgtttcaacaggcccttcctgatgatcattgtccctacagacacccagaacatcttcttcatgagcaaagtcaccaatcccaagcaagcctagagcttgccatcaagcagtggggctctcagtaaggaacttggaatgcaagctggatgcctgggtctctgggcacagcctggcccctgtgcaccgagtggccatggcatgtgtggccctgtctgcttatccttggaaggtgacagcgattccctgtgtagctctcacatgcacaggggcccatggactcttcagtctggagggtcctgggcctcctgacagcaataaataatttcgttgga

SEQ ID NO: 343712 - DNA, 1530 bp, Homo sapiens
gcattcatggcaatccactactccagacagacggctttggaatccaccagctacatccagctccctgaggcagagttgagaatggagagaatgttacctctcctggctctggggctcttggcggctgggttctgccctgctgtcctctgccaccctaacagcccacttgacgaggagaatctgacccaggagaaccaagaccgagggacacacgtggacctcggattagcctccgccaacgtggacttcgctttcagcctgtacaagcagttagtcctgaaggcccctgataagaatgtcatcttctccccactgagcatctccaccgccttggccttcctgtctctgggggcccataataccaccctgacagagattctcaaaggcctcaagttcaacctcacggagacttctgaggcagaaattcaccagagcttccagcacctcctgcgcaccctcaatcagtccagcgatgagctgcagctgagtatgggaaatgccatgtttgtcaaagagcaactcagtctgctggacaggttcacggaggatgccaagaggctgtatggctccgaggcctttgccactgactttcaggactcagctgcagctaagaagctcatcaacgactacgtgaagaatggaactagggggaaaatcacagatctgatcaaggaccttgactcgcagacaatgatggtcctggtgaattacatcttctttaaagccaaatgggagatgccctttgacccccaagatactcatcagtcaaggttctacttgagcaagaaaagagctgtcctgcaccgtggtggagctgaagtacacaggcaatgccagcgcactcttcatcctccctgatcaagacaagatggaggaagtggaagccatgctgctcccagagaccctgaagcggtggagagactctctggagttcagagagataggtgagctctacctgccaaagttttccatctcgagggactataacctgaacgacatacttctccagctgggcattgaggaagccttcaccagcaaggctgacctgtcagggatcacaggggccaggaacctagcagtctcccaggtggtccataaggctgtgcttgatgtatttgaggagggcacagaagcatctgctgccacagcagtcaaaatcaccctcctttctgcattagtggagacaaggaccattgtgcgtttcaacaggcccttcctgatgatcattgtccctacagacacccagaacatcttcttcatgagcaaagtcaccaatcccaagcaagcctagagcttgccatcaagcagtggggctctcagtaaggaacttggaatgcaagctggatgcctgggtctctgggcacagcctggcccctgtgcaccgagtggccatggcatgtgtggccctgtctgcttatccttggaaggtgacagcgattccctgtgtagctctcacatgcacaggggcccatggactcttcagtctggagggtcctgggcctcctgacagcaataaataatttcgttgga

SEQ ID NO: 343713 - DNA, 1476 bp, Homo sapiens
cccatcagtgaatcatcaaggacatggtgcttaaacacaagtgtattcctttcacgtcttactactctccaaatcggagtccatcacttcacttcagattattcatcattcatcattccttttgattctttgaatgcattaaggggttcctctacagctttcctaggaggttgtatagtcttctgatgggccagcactgagcatctccaccgccttggccttcctgtctctgggggcccataataccaccctgacagagattctcaaaggcctcaagttcaacctcacggagacttctgaggcagaaattcaccagagcttccagcacctcctgcgcaccctcaatcagtccagcgatgagctgcagctgagtatgggaaatgccatgtttgtcaaagagcaactcagtctgctggacaggttcacggaggatgccaagaggctgtatggctccgaggcctttgccactgactttcaggactcagctgcagctaagaagctcatcaacgactacgtgaagaatggaactagggggaaaatcacagatctgatcaaggaccttgactcgcagacaatgatggtcctggtgaattacatcttctttaaagccaaatgggagatgccctttgacccccaagatactcatcagtcaaggttctacttgagcaagaaaaagtgggtaatggtgcccatgatgagtttgcatcacctgactataccttacttccgggacgaggagctgtcctgcaccgtggtggagctgaagtacacaggcaatgccagcgcactcttcatcctccctgatcaagacaagatggaggaagtggaagccatgctgctcccagagaccctgaagcggtggagagactctctggagttcagagagataggtgagctctacctgccaaagttttccatctcgagggactataacctgaacgacatacttctccagctgggcattgaggaagccttcaccagcaaggctgacctgtcagggatcacaggggccaggaacctagcagtctcccaggtggtccataaggctgtgcttgatgtatttgaggagggcacagaagcatctgctgccacagcagtcaaaatcaccctcctttctgcattagtggagacaaggaccattgtgcgtttcaacaggcccttcctgatgatcattgtccctacagacacccagaacatcttcttcatgagcaaagtcaccaatcccaagcaagcctagagcttgccatcaagcagtggggctctcagtaaggaacttggaatgcaagctggatgcctgggtctctgggcacagcctggcccctgtgcaccgagtggccatggcatgtgtggccctgtctgcttatccttggaaggtgacagcgattccctgtgtagctctcacatgcacaggggcccatggactcttcagtctggagggtcctgggcctcctgacagcaataaataatttcgttgga

SEQ ID NO: 343714 - DNA, 1260 bp, Homo sapiens
ctcggctctaccttgtcttgatcagcgcactcttcatcctccctgatcaagacaagatggaggaagtggaagccatgctgctcccagagaccctgaagcggtggagagactctctggagttcagagagataggtgagctctacctgccaaagttttccatctcgagggactataacctgaacgacatacttctctgctggacaggttcacggaggatgccaagaggctgtatggctccgaggcctttgccactgactttcaggactcagctgcagctaagaagctcatcaacgactacgtgaagaatggaactagggggaaaatcacagatctgatcaaggaccttgactcgcagacaatgatggtcctggtgaattacatcttctttaaagccaaatgggagatgccctttgacccccaagatactcatcagtcaaggttctacttgagcaagaaaaagtgggtaatggtgcccatgatgagtttgcatcacctgactataccttacttccgggacgaggagctgtcctgcaccgtggtggagctgaagtacacaggcaatgccagcgcactcttcatcctccctgatcaagacaagatggaggaagtggaagccatgctgctcccagagaccctgaagcggtggagagactctctggagttcagagagataggtgagctctacctgccaaagttttccatctcgagggactataacctgaacgacatacttctccagctgggcattgaggaagccttcaccagcaaggctgacctgtcagggatcacaggggccaggaacctagcagtctcccaggtggtccataaggctgtgcttgatgtatttgaggagggcacagaagcatctgctgccacagcagtcaaaatcaccctcctttctgcattagtggagacaaggaccattgtgcgtttcaacaggcccttcctgatgatcattgtccctacagacacccagaacatcttcttcatgagcaaagtcaccaatcccaagcaagcctagagcttgccatcaagcagtggggctctcagtaaggaacttggaatgcaagctggatgcctgggtctctgggcacagcctggcccctgtgcaccgagtggccatggcatgtgtggccctgtctgcttatccttggaaggtgacagcgattccctgtgtagctctcacatgcacaggggcccatggactcttcagtctggagggtcctgggcctcctgacagcaataaataatttcgttgga

SEQ ID NO: 343715 - DNA, 1084 bp, Homo sapiens
gcattcatggcaatccactactccagacagacggctttggaatccaccagctacatccagctccctgaggcagagttgagaatggagagaatgttacctctcctggctctggggctcttggcggctgggttctgccctgctgtcctctgccaccctaacagcccacttgacgaggagaatctgacccaggagaaccaagaccgagggacacacgtggacctcggattagcctccgccaacgtggacttcgctttcagcctgtacaagcagttagtcctgaaggcccctgataagaatgtcatcttctccccactgagcatctccaccgccttggccttcctgtctctgggggcccataataccaccctgacagagattctcaaaggcctcaagttcaacctcacggagacttctgaggcagaaattcaccagagcttccagcacctcctgcgcaccctcaatcagtccagcgatgagctgcagctgagtatgggaaatgccatgtttgtcaaagagcaactcagtctgctggacaggttcacggaggatgccaagaggctgtatggctccgaggcctttgccactgactttcaggactcagctgcagctaagaagctcatcaacgactacgtgaagaatggaactagggggaaaatcacagatctgatcaaggaccttgactcgcagacaatgatggtcctggtgaattacatcttctttaaagccaaatgggagatgccctttgacccccaagatactcatcagtcaaggttctacttgagcaagaaaaagtgggtaatggtgcccatgatgagtttgcatcacctgactataccttacttccgggacgagctgggcacagcctggcccctgtgcaccgagtggccatggcatgtgtggccctgtctgcttatccttggaaggtgacagcgattccctgtgtagctctcacatgcacaggggcccatggactcttcagtctggagggtcctgggcctcctgacagcaataaataatttcgttggaaaaaaaaaagagaagttggcctataggagtcgattacagtgagcgcggaatttagatt

SEQ ID NO: 343716 - DNA, 891 bp, Homo sapiens
tccaactgcttgctccaccttcaccaaatgggagatgccctttgacccccaagatactcatcagtcaaggttctacttgagcaagaaaaagtgggtaatggtgcccatgatgagtttgcatcacctgactataccttacttccgggacgaggagctgtcctgcaccgtggtggagctgaagtacacaggcaatgccagcgcactcttcatcctccctgatcaagacaagatggaggaagtggaagccatgctgctcccagagaccctgaagcggtggagagactctctggagttcagagagataggtgagctctacctgccaaagttttccatctcgagggactataacctgaacgacatacttctccagctgggcattgaggaagccttcaccagcaaggctgacctgtcagggatcacaggggccaggaacctagcagtctcccaggtggtccataaggctgtgcttgatgtatttgaggagggcacagaagcatctgctgccacagcagtcaaaatcaccctcctttctgcattagtggagacaaggaccattgtgcgtttcaacaggcccttcctgatgatcattgtccctacagacacccagaacatcttcttcatgagcaaagtcaccaatcccaagcaagcctagagcttgccatcaagcagtggggctctcagtaaggaacttggaatgcaagctggatgcctgggtctctgggcacagcctggcccctgtgcaccgagtggccatggcatgtgtggccctgtctgcttatccttggaaggtgacagcgattccctgtgtagctctcacatgcacaggggcccatggactcttcagtctggagggtcctgggcctcctgacagcaataaataatttcgttgga

SEQ ID NO: 343717 - DNA, 869 bp, Homo sapiens
ttccaacgaaattatttattgctgtcaggaggcccaggaccctccagactgaagagtccatgggcccctgtgcatgtgagagctacacagggaatcgctgtcaccttccaaggataagcagacagggccgagctgtcctgcaccgtggtggagctgaagtacacaggcaatgccagcgcactcttcatcctccctgatcaagacaagatggaggaagtggaagccatgctgctcccagagaccctgaagcggtggagagactctctggagttcagagagataggtgagctctacctgccaaagttttccatctcgagggactataacctgaacgacatacttctccagctgggcattgaggaagccttcaccagcaaggctgacctgtcagggatcacaggggccaggaacctagcagtctcccaggtggtccataaggctgtgcttgatgtatttgaggagggcacagaagcatctgctgccacagcagtcaaaatcaccctcctttctgcattagtggagacaaggaccattgtgcgtttcaacaggcccttcctgatgatcattgtccctacagacacccagaacatcttcttcatgagcaaagtcaccaatcccaagcaagcctagagcttgccatcaagcagtggggctctcagtaaggaacttggaatgcaagctggatgcctgggtctctgggcacagcctggcccctgtgcaccgagtggccatggcatgtgtggccctgtctgcttatccttggaaggtgacagcgattccctgtgtagctctcacatgcacaggggcccatggactcttcagtctggagggtcctgggcctcctgacagcaataaataatttcgttgga

SEQ ID NO: 343718 - DNA, 884 bp, Homo sapiens
gcattcatggcaatccactactccagacagacggctttggaatccaccagctacatccagctccctgaggcagagttgagaatggagagaatgttacctctcctggctctggggctcttggcggctgggttctgccctgctgtcctctgccaccctaacagcccacttgacgaggagaatctgacccaggagaaccaagaccgagggacacacgtggacctcggattagcctccgccaacgtggacttcgctttcagcctgtacaagcagttagtcctgaaggcccctgataagaatgtcatcttctccccactgagcatctccaccgccttggccttcctgtctctgggggcccataataccaccctgacagagattctcaaaggcctcaagttcaacctcacggagacttctgaggcagaaattcaccagagcttccaggtggtccataaggctgtgcttgatgtatttgaggagggcacagaagcatctgctgccacagcagtcaaaatcaccctcctttctgcattagtggagacaaggaccattgtgcgtttcaacaggcccttcctgatgatcattgtccctacagacacccagaacatcttcttcatgagcaaagtcaccaatcccaagcaagcctagagcttgccatcaagcagtggggctctcagtaaggaacttggaatgcaagctggatgcctgggtctctgggcacagcctggcccctgtgcaccgagtggccatggcatgtgtggccctgtctgcttatccttggaaggtgacagcgattccctgtgtagctctcacatgcacaggggcccatggactcttcagtctggagggtcctgggcctcctgacagcaataaataatttcgttgga

SEQ ID NO: 343719 - DNA, 541 bp, Homo sapiens
caagctagagcttgccatcagcagtggggctctcagtaaggaacttggaatgcaagctggatgcctgggtctctgggccaggaacctagcagtctcccgtggtccataaggctgtgcttgatgtatttgaggagggcacagaagcatctgctgccacagcagtcaaaatcaccctcctttctgcattagtggagacaaggaccattgtgcgtttcaacaggcccttcctgatgatcattgtccctacagacacccagaacatcttcttcatgagcaaagtcaccaatcccaagcaagcctagagcttgccatcaagcagtggggctctcagtaaggaacttggaatgcaagctggatgcctgggtctctgggcacagcctggcccctgtgcaccgagtggccatggcatgtgtggccctgtctgcttatccttggaaggtgacagcgattccctgtgtagctctcacatgcacaggggcccatggactcttcagtctggagggtcctgggcctcctgacagcaataaataatttcgttgga

SEQ ID NO: 343720 - DNA, 510 bp, Homo sapiens
gcattcatggcaatccactactccagacagacggctttggaatccaccagctacatccagctccctgaggcagagttgagaatggagagaatgttacctctcctggctctggggctcttggcggctgggttctgccctgctgtcctctgccaccctaacagcccacttgacgaggagaatctgacccaggagaaccaagaccgagggacacacgtggacctcggattagcctccgccaacgtggacttcgctttcagcctgtacaagcagttagtcctgaaggcccctgataagaatgtcatcttctccccactgagcatctccaccgccttggccttcctgtctctgggggcccataataccaccctgacagagattctcaaaggcctcaagttcaacctcacggagacttctgaggcagaaattcaccagagcttccaggggacctggcccagcttcgctgcgagatggagcagcacaacctggacggagccaacgcagcacaaccta

SEQ ID NO: 343721 - DNA, 370 bp, Homo sapiens
gcattcatggcaatccactactccagacagacggctttggaatccaccagctacatccagctccctgaggcagagttgagaatggagagaatgttacctctcctggctctggggctcttggcggctgggttctgccctgctgtcctctgccaccctaacagcccacttgacgaggagaatctgacccaggagaaccaagaccgagggagcaggcggcgaaggcagagaggaggaagcagcagctggcggaggaggaggcgcggcggcctcggggagaggacgggaagcctgtcaggaaggggcccgggaagcaggaggaggtgtgtgtcatcgatgccctgctggctgacatacaggtttctggtgacac

SEQ ID NO: 343722 - DNA, 501 bp, Homo sapiens
tccaaggagaaggaacagagtaagtaaaagcaagggaaaacacagcacatctaaacaagcttgaggacactcagagtatcttggaataatgttgctgccttaagaaagatggttcctgctggaggagagggaccttgtggagcagcttgcactgacctgtgagctgcgctcagaccaaggagcatacccagtcaatactgcagagtctgttccagatcagaagacccaagcagctgatcccatagactcataggaaataataaagttactgtttttagccactgagttttggggtggtttgttacagaacaatagccagttggttaaaaaacaccttactcaaccttagctcatgaaaaatacctgaagaatcaagtgaaataaatttctgactctctctctctctctctctctccagctattccaaggagaaggaacagagtaagtaaaagcaagggaaaacacagcacatctaaacaagcttgaggacactcagagtat

SEQ ID NO: 343723 - DNA, 233 bp, Homo sapiens
tccgatgactaccggaatcaggaaggagtgctagagttgggataaaccacagtgcctcattcctgtttattagtatcagacatcagacatatattttttattagttattcaaatgagttaaaatttaatacgactatattagcttttttccaaagtgctggctttttcattaaaatagctatttagtgaaaattctttataatacaatgatattccagagcagactaattttg

SEQ ID NO: 343724 - DNA, 106 bp, Homo sapiens
ttggtttcctatcatgtgagaccatagccagagtagttagatttccatgagaacaacattacgacaaaaatatgaccggtaagtatatagactatctacctattta

SEQ ID NO: 343725 - DNA, 923 bp, Homo sapiens
tcccacctgtagtcctggctactcaggagactgaggagggaggctcgcttgagccaggagttggaaaccagcctgggcagtataacaagacctcatctcggggaagaacggaaaggaaagaaaaagtttgagtctcatcaatatctaccatattaaaaattaaaactgggaaattcatttcatttaaaatatcaattgtaaacccattatatggtaacatatgtaacatctttgtgaaaagtaatttttaaaaaaatagacattgaacatcttagtaatgtttgacttaatagaaaaagacacttagaatttcataatttcgtatctgcttctgcattcaatctgttatgatacatccagtgttttgttgagcctctgggtaaacttcactgtatgcttgtggtaaaatgaggaagaaaaaaataatcatgttagtattattatgaaaatagttctggtcttgtgaaaggctgttggggttccccaaggtttcctggataacacttggagagctgctttagagcatatattggcaaccatcccaggccaaatctagaaaactttaaatgtttgcaggcctttcgtttaagtcctcaatattagttactctttttgtaaagttaagaaatttgacacctgctattgcacatcggcattgtaaaaattatcccataatttgaagggtttctttttccttaactccttgaggatggcagtggggtggagaaaataaagttattggtatgtgattgtatgctctaccctggaattctgttaagtgtaaggtatcagcttggactaatctagaatttgataggcaaaatcaatgtagtgtggtagaccggtgctcgggtttgtgaactttctgtcctggaggttgtgccagaatgttaatcacttaaatagaatgtttagttcagctg

SEQ ID NO: 343726 - DNA, 475 bp, Homo sapiens
agccctggacaactttcaggaagacagttctggtctgtagcaattaacacatggtcatcctcagaaaaaggtcctctcaattatttcccagagatacccataacttaaaatgcaggaaccaagagatttgagcctagacatttggatgaaaagcgatttccacctggagaaagtcactgcccttctgtgcagagtaccattgtgtcttgaatccagcttggccataaggaaatggggcgagactttgtcatgtatgtcgctgaagttcagctatgcaaaaatgttcacctatccttgatcaaccagtccaggaaccatcaaagaagaaaatgagattcgacttagaagacctgttctttataaacccctgcacagccctaatgatcaacaccacttccagtgctcataaattactgcttcaataattgttctgcaattctgcctattctcattgaatgcttcgtataatcccttt

SEQ ID NO: 343727 - DNA, 96 bp, Homo sapiens
ggaatgccagatgctggggatgctggtacaagttgtgggactgcatgctactgtctagagcttgtctcaatggatctagaacttcatcgccctctg

SEQ ID NO: 343728 - DNA, 315 bp, Homo sapiens
tcaggtaatgagggactgggagggacagtcagaccaggcctggggagaagaacaccaggaaggaagaacaggtgggaatggagaagcagctgggagtggtgggggggttgggggccatcatgtgcccagatccccatgagaaactggtcccagccacctgtttctccctgcccctccctctgccgccagctatgggttttgcctccaaatatgtccaagccacccccttcctctcctgtgcctagaccgggttcatgcctactccccacatctggtcctgacaccttccatccctccctcctgggacgaccagcc

SEQ ID NO: 343729 - DNA, 640 bp, Homo sapiens
aatgagctagccctgcacactagcttgattggtttatagcttaaattaaaaagccaaatggtaccaagtgttgatatggatcaggaacaacttgaattttcagatattgctgatagtttagctttttcttataaggttaaacatatacttaacatatttgcccactatatcactcgtgaatattgacccaagagaaacgaaagcatatgccatacaaatacttatttgtgaatgttcaaagcaacttaatttttaagagtcaaaaactagaaacagctcaacattcaagaggtgaaatgataaatttttgttatatccataaaattggaatgctactcagaaattcaaacaatgactatttgatttatgcaactacatggatacacccagtgttctgctggcaaatgtttaaaaactggctctccaaatgctcctgccatgactgatttcaagttaccaatataaggtcaatgaatgtggagttaggaagagatgcctagtagcaaactattttatagtatttcttctatccatgtcttctatccggtatttcttctgtcttatatccaatagacataatcttgaacacagatttcttgttttgttttgtagagacagggtctcactctgtcacctaggc

SEQ ID NO: 343730 - DNA, 285 bp, Homo sapiens
ttaagtatagagcttatcatgcttttactttgtagtaatgggaacatgaaaaatgattttaggcttttccggccatttcttgatgaggtatgtggatctcatcagatatattcatcctggctgaatctagtagaagagagggtccaagatcagacctagcagttcctgaggagcatggaactctctatgtatgcccttgtttttctctgggagttgttactctcaaaaatatacttcattttggaattcagttttgagctacctaaagccatatatggtagcgtg

SEQ ID NO: 343731 - DNA, 821 bp, Homo sapiens
agaaagcaacgacgaaacaagaataggatgagttctcagttacctactttattcttcaaatagcccttattcagcacatctttcttgtttgttgtagaatggagagcagtttattacatttgataatccttgaaagcattaatttgcttggagggtacccagggagtagagttcaagcagtatgaagagtgaagaatattcattctggtagagtttagtgacagactaagcttatattaataacggttctatattatagaagaatactactgctggagtatggcagtatattaggtttctccagagaagcaaggccaatagggtgtgtgtgtgtagagattgactggttgattgatgtttgaggaattggctcatgctattgtgaaggcttgcaagttcaaaatctgtagggtaggctgacaggccggggacctggggaagaggtgatgttgcatctcaagtccaaacgcagtcttttggcagaattctatcttacttgggaaatcagtcttttctttttctcttaaggtcttcaactgatagaataaggcccgcccacattataaagataattgactttactctgagtctgctgacttaaatgttaattgtatctgaagaaatatcttcacagcaacatctaaactattgtttgatcaaatatactgggcctagccaagttggaatgtaaaattaaccatcacaagactgtaatagaaaccatctcataatgtacatttgggacttatggtgaaaggcaaagggcgtgagccaccgcgcccagcctgaaactttctctttttagaggggcagtgaagaag

SEQ ID NO: 343732 - DNA, 895 bp, Homo sapiens
agaaagcaacgacgaaacaagaataggatgagttctcagttacctactttattcttcaaatagcccttattcagcacatctttcttgtttgttgtagaatggagagcagtttattacatttgataatccttgaaagcattaatttgcttggagggtacccagggagtagagttcaagcagtatgaagagtgaagaatattcattctggtagagtttagtgacagactaagcttatattaataacggttctatattatagaagaatactactgctggagtatggcagtatattaggtttctccagagaagcaaggccaatagggtgtgtgtgtgtagagattgactggttgattgatgtttgaggaattggctcatgctattgtgaaggcttgcaagttcaaaatctgtagggtaggctgacaggccggggacctggggaagaggtgatgttgcatctcaagtccaaacgcagtcttttggcagaattctatcttacttgggaaatcagtcttttctttttctcttaaggtcttcaactgatagaataaggcccgcccacattataaagataattgactttactctgagtctgctgacttaaatgttaattgtatctgaagaaatatcttcacagcaacatctaaactattgtttgatcaaatatactgggcctagccaagttggaatgtaaaattaaccatcacaagactgtaatagaaaccatctcataatgtacatttgggacttatggtgaaaggcaaagggcagaccgggtgcagtggctcacgcctgtaatcccagcactttgggaggccgaggcgaacagatcacgaggtcaagagatcgagaccatcctggctaacacggtgaaaccccgtctctactaaaaatacca

SEQ ID NO: 343733 - DNA, 391 bp, Homo sapiens
tcagtaactggatgaattttgtaatcatcatctcaatgataatacaaaggtttcctttccctaagtgataacaaagaaaacctctctttgtaattctttttgcaaggatccataagcctgaattctaaaaggagaggccaataaaaaggaaatgaagaatgttttaaaggtaaggggtttttttggtttgtttgtttgagacggagttacagtggtgtgatctcagctcactgcaacctccgcctccatgttcaagtgattctcctacctcagcctcctgagtagctggggttacaggtgcccgccaccacgcctgggtaatttttgtatttttggtagagatgggatttcaccatgtttgccaggctggtctcgaactcctgacctcaga

SEQ ID NO: 343734 - DNA, 960 bp, Homo sapiens
aaaacaaaacaaaaagaatccacactgcttccccgcttcactttacccagaaaaggaatgttctaggccacttcctcttcagcacacatccccagggaactaaaataggttcacagtcacccccatcttcctcattcccatcacctcttacccacagaggcatctctggtcctacagatccagccctgccttcaagaggcacaggtccaacccatccagtgtccctgctagtcacacacagcactcagggtacaatggagggcttctgtgctttggatgggaacaaaccccacctcacattcccacacctgagaagccaccagggtcctctctgtcctgtcctcacactcaatgtctgtcctgggtcacccttgtcatctctcctggaaataggcatggctcctgacaggtaggattgaggctttgtcttttcaggagtccctcccactctgagcacatgaaactgctcagctccatgcaaccctctctcaccaggggccttgttctctgggtccctgaatacctgggtccatgccatgtacattttaagaaaaatgacagtgactctcaccctgacatcctcacccaaggcacgtgtctgacaagaatcaccaggtgagatacctgtggctccacacacctgaggcttcactgcgcaggggtgtcctcatccctctcctcccacccctagggacagtaagcaccacaggctgccttggaccaccagctccccctcccagacacagcctcagatctatactgacatgctacatggagaggctctgatgaacagcaggtattaggaaatcccaccgaaccaggtgccacttgcggccccactcctcctcatatctgtgactgggacagacacacataacacacctctgttcaccgcccagcccccaaggtcaatcacagtctgcttctcccctagatccactgctccccatgtcttccgtc

SEQ ID NO: 343735 - DNA, 492 bp, Homo sapiens
tgtactccagcttgggcaacagactgagaccccatatcaaaaacaaacgaagagtgatcatccagttactcactgctgggtctgagggaagcccaaaggcagtgggagccagagaaaatagttgagagtcagatttcacagtggaggtgacattgaaacagggtattgaagggccaataagagttcaccaagtcaggagagagggaggaaaggacattccagcagagagcaggatctattctttccacaagcctttactgaggttcacctttgcacaggctagctactgggttctggaaatgcagagctcaagtaaacaacccttctcccacttttcccaaatgccgaaaacattaggagaactaggactctcatccctaggggcattgggaagaactcaaaagcctgctgcttgcaaagtattcaagatgatgtaaagcatttaacacactgtctgggagatagtacatttttaataaatactagctgtca

SEQ ID NO: 343736 - DNA, 124 bp, Homo sapiens
ggttatcacatgtagaatctggaggttctggtccatccatgaacagtccaaatgccacaacagcagtcacacagctgcagtcatggatcagccccaggaacaaaccttcctctattgagtggct

SEQ ID NO: 343737 - DNA, 350 bp, Homo sapiens
tggctgagtaatattctgtggtgtcgctataaacacattttctttatccactcattagtcgatgtgcacttaggttgcttccatgtttttgcagttgtgaattgtgctgctctaaacaaaacgtgtgcaagtgtctttttcgtataatgtgaaattgtctctagttttaatttttgtctttaaaaaatgtttttgcccttatttacctttataatttccattttcaaaaaaaaaagtaaagggaagaaatgttgctattttttagcatagtcattaaaaatagtagttattatgatcaagccccaatgtgtgaaaagactaataaatgctaaatttcttcattttattta

SEQ ID NO: 343738 - DNA, 575 bp, Homo sapiens
cttatttaaaaaggtcactcttatgacatttacttatgtatgcctccaaaactgtattataaggcagtgctttttcaaatctaggcagttttatttgcataactagtttatttgtaagtgaataaccaattctaattggtcgttagcctgaaaatctttggaagaaaagttcctattttccagtctcctttgtgtaaggtgtagcatttgttggatgtataaaaatatcacccaaatgctcagcttccggacaggcctggcagagactgttttcatttgctttttacagcctatttgcatagtagaatataggagtgaattaatcattactgatttccttggcactggcagcagttgggggtgagggcagaggagggatccgcagaaggcagagaaagagggccttttccagtggactcagttgacttccatgtttaccatacacacctgtggcagacagtgccatctggaaaggcgcttacgctatggagagagaggagcctggtcttacagcatccttctgtggtgtcatcctccttgcccctaacttttctccttcacccaagtgttcttga

SEQ ID NO: 343739 - DNA, 354 bp, Homo sapiens
gctttttcttttctttctcttttaaaacacatctagacaaggaaaaaacaagcctcggatctgatttttcactcctcgttcttgtgcttggttcttactgtgtttgtgtattttaaaggcgagaagacgaggggaacaaaaccagctggatccatccatcaccgtgggtggttttaatttttcgttttttctcgttatttttttttaaacaaccactcttcacaatgaacaaactgtatatcggaaacctcagcgagaacgccgccccctcggacctagaaagtatcttcaaggacgccaagatcccggtgtcgggacccttcctggtgaagactggctacgcgttcgtggact

SEQ ID NO: 343740 - DNA, 481 bp, Homo sapiens
ccccccccccccccccacccaccccccccccaacaccccaccccccaccccacccatcaccgaccgggaggcatatatagatgccgaacttagtgcggacacccgatcggcatagcgcactacagcccagaactcctgggctcaagcgatcctcctgccttagcctctcaaagtgctgggattataggcatgagccacagtgcctgtcccaatctttccttttaagttcgttcttctcacagtcttctcaatctcaataaatggccattctgttctttccttcttttgctcaaatcaaaaaccttggagttatccttgattcctttctgtccctcatagaagccatcagcaaatgctcttgattctaccttcaaaaagatatccaaagtctgaccaattctgtcaatctccattgctaccaccctggtccaggctagctctcttgggttattgtagatgccgcctatattgcctccctgct

SEQ ID NO: 343741 - DNA, 306 bp, Homo sapiens
tgctgggattacaggtgtaagccactgtgcccagccagagccaggattctaactcaggttggctccaaactgtgcttttagttactacattatcctgcctctggcatctttataatgtttgtaaagagaggtagagtgaccaggagaatctgttgtataattcagaagtatgctgtttatctcttggcaaaatacttaagagttgcgagaattacagatattctctatttttcttctacaaagcgacaatgtttgaaaatttattaactttctgtgtgaacaaaggggattatctaacaactatta

SEQ ID NO: 343742 - DNA, 243 bp, Homo sapiens
agtcaaagggtgttgttctctggcaggctggggtgggggtcacaaggtgctcagtgggggaggttctgagccaggagaaggaatttcacaaggttaatcgctcagttaaggtggggcaggaacaaatcacaatggtggaatgtcatcagttaaggcaggaacaggccattttcacttcttttgtgaatcttcagttacttcaggccatctggatgaatacgtgcagacttgggctcagaggcc

SEQ ID NO: 343743 - DNA, 223 bp, Homo sapiens
cccatctttaaaaataagtcagaaagttattaatattaaataacatttacttcttacaggaaatgttggaagtgcctagttaaagtaatttagtaaattaaaaacaaatttcttgaattttctttcacatttcttcttccttacaatatacgttttcccccatacaaattgaattatatgattgtgatatgtgattacatatgcaaggtaagataatatgatg

SEQ ID NO: 343744 - DNA, 307 bp, Homo sapiens
cactgatgtattcatttgtttcttaatgtgctcatcttgcccattaagaataattagcagctttactaacagattttctggcttctggcaatgtttctccccctttttttgttgacatccacttttacttcttagaaagtaatttttgaataatatcctacaactgctatataatttagacttcctaaaattttaaaggaaagatgtaaacagtaatttttaaataagtttgtttcaatctatatgcatcaatagtatgtgattcagtgaattagttattcttacagaaagtgggcatgcaaataga

SEQ ID NO: 343745 - DNA, 261 bp, Homo sapiens
agcgtgggggactccgcgcagaggtcgacagaggttgaggcagggccaggagccatgatggacacagaggggcagtagaggctgcaggcgtctccacaaccccagcgcagaggggcccgggccagggccacagggagccatggagagcttcatggagtcgctgaacaggctgaaggagatccacgagaaggaagtcctgggcctgcagaacaagcttctggaactgaactcagagaggtgccggtgagtcaggccaagcag

SEQ ID NO: 343746 - DNA, 354 bp, Homo sapiens
aggggacatgacatacatatacattactgataacccactttcacaggttagggaagctgattatttctgaatggccccaaataactttaagcacttaaaagcagcacctatcatgctgtaatgggtataactaggtaaattaagatgtgcctaccagcaaatggatagatttccaaacatgagatgaccagcacatatataccagatcttgtttcccaaggttttgttctaaaatatcactgcctaaaatggcataatgaataatgctaagctgggcttaatgcaaagtatttgctcattaaaagaaagaaatattcgcttattaaaagaaagaaatatttgctcattaaaaga

SEQ ID NO: 343747 - DNA, 291 bp, Homo sapiens
gaaactgtgctatgaatcatacagcagtcctcccttatcttcaagggatacgttctgaaattccccagtgggtgcctgaaactgcaggtagtaccagatctaaatacattgctttttcctatacacacatacctatggtaaagtttaaattataaattaggcacagtaaaagatgaataacaatgtaaaaggaaaataaacttggggaccccaaacccactaagtcaaagagaaaagtcaaggtaggaacggcatcatgcaaacctacctccctcacaatctgcccaatag

SEQ ID NO: 343748 - DNA, 4242 bp, Homo sapiens
gaagctcccgaccccgcctccgcagggtccaggcttcgcccctggtgacaggtggtgctggtgtagtcaaggaggagggctcgctttttttggttcaggttgtcatggtggcgcccaagcccgccttgccggccttgtcttttccggtctcagtccggcgtggcagcggaggcaggcaccgttaggtcttccagtccctctctgtcatggcgacgcccagcctcttcttccggccacagcctgtcatggcggcacccgaagtagtccctgccggggccagcctgttctgttgccctggctcttcctagtccaggctgccatggcggcgctcagggcttaccggaagtaaaacttcggaagtgaggcgttcctctgcccggaagtgagcgcggcgctaggaaagatggcggcagcggcggcggtgggcaacgcggtgccctgcggggcccggccttgcggggtccggcctgacgggcagcccaagcccgggccgcagccgcgcgcgctccttgccgccgggccggcgctcatagcgaacggtgacgagctggtggctgccgtgtggccgtaccggcggttggcgctgttgcggcgcctcacggtgctgccattcgccgggctgctttacccggcctggttgggtgccgcagccgctggctgctggggctggggcagcagttgggtgcagatccccgaagctgcgctgctcgtgcttgccaccatctgcctcgcgcacgcgctcactgtcctctcggggcattggtctgtgcacgcgcattgcgcgctcacctgcaccccggagtacgaccccagcaaagcgacctttgtgaaggtggtgccaacccccaacaatggctccacggagctcgtggccctgcaccgcaatgagggcgaagacgggcttgaggtgctgtccttcgaattccagaagatcaagtattcctacgatgccctggagaagaagcagtttctccccgtggcctttcctgtgggaaacgccttctcatactatcagagcaacagaggcttccaggaagactcagagatccgagcagctgagaagaaatttgggagcaacaaggccgagatggtggtgcctgacttctcggagcttttcaaggagagagccacagcccccttctttgtatttcaggtgttctgtgtggggctctggtgcctggatgagtactggtactacagcgtctttacgctatccatgctggtggcgttcgaggcctcgctggtgcagcagcagatgcggaacatgtcggagatccggaagatgggcaacaagccccacatgatccaggtctaccgaagccgcaagtggaggcccattgccagtgatgagatcgtaccaggggacatcgtctccatcggccgctccccacaggagaacctggtgccatgtgacgtgcttctgctgcgaggccgctgcatcgtagacgaggccatgctcacgggggagtccgtgccacagatgaaggagcccatcgaagacctcagcccagaccgggtgctggacctccaggctgattcccggctgcacgtcatcttcgggggcaccaaggtggtgcagcacatccccccacagaaagccaccacgggcctgaagccggttgacagcgggtgcgtggcctacgtcctgcggaccggattcaacacatcccagggcaagctgctgcgcaccatcctcttcggggtcaagagggtgactgcgaacaacctggagaccttcatcttcatcctcttcctcctggtgtttgccatcgctgcagctgcctatgtatggattgaaggtaccaaggaccccagccggaaccgctacaagctgtttctggagtgcaccctgatcctcacctcggtcgtgcctcctgagctgcccatcgagctgtccctggccgtcaacacctccctcatcgccctggccaagctctacatgtactgcacagagcccttccggatcccctttgctggcaaggtcgaggtgtgctgctttgacaagacggggacgttgaccagtgacagcctggtggtgcgcggtgtggccgggctgagagacgggaaggaggtgaccccagtgtccagcatccctgtagaaacacaccgggccctggcctcgtgccactcgctcatgcagctggacgacggcaccctcgtgggtgaccctctagagaaggccatgctgacggccgtggactggacgctgaccaaagatgagaaagtattcccccgaagtattaaaactcaggggctgaaaattcaccagcgctttcattttgccagtgccctgaagcgaatgtccgtgcttgcctcgtatgagaagctgggctccaccgacctctgctacatcgcggccgtgaagggggcccccgaaactctgcactccatgttctcccagtgcccgcccgactaccaccacatccacaccgagatctcccgggaaggagcccgcgtcctggcgctggggtacaaggagctgggacacctcactcaccagcaggcccgggaggtcaagcgggaggccctggagtgcagcctcaagttcgtcggcttcattgtggtctcctgcccgctcaaggctgactccaaggccgtgatccgggagatccagaatgcgtcccaccgggtggtcatgatcacgggagacaacccgctcactgcatgccacgtggcccaggagctgcacttcattgaaaaggcccacacgctgatcctgcagcctccctccgagaaaggccggcagtgcgagtggcgctccattgacggcagcatcgtgctgcccctggcccggggctccccaaaggcactggccctggagtacgcactgtgcctcacaggcgacggcttggcccacctgcaggccaccgacccccagcagctgctccgcctcatcccccatgtgcaggtgttcgcccgtgtggctcccaagcagaaggagtttgtcatcaccagcctgaaggagctgggctacgtgaccctcatgtgtggggatggcaccaacgacgtgggcgccctgaagcatgctgacgtgggtgtggcgctcttggccaatgcccctgagcgggttgtcgagcggcgacggcggccccgggacagcccaaccctgagcaacagtggcatcagagccacctccaggacagccaagcagcggtcggggctccctccctccgaggagcagccaacctcccagagggaccgcctgagccaggtgctgcgagacctcgaggacgagagtacgcccattgtgaaactgggggatgccagcatcgcagcacccttcacctccaagctctcatccatccagtgcatctgccacgtgatcaagcagggccgctgcacgctggtgaccacgctacagatgttcaagatcctggcgctcaatgccctcatcctggcctacagccagagcgtcctctacctggagggagtcaagttcagtgacttccaggccaccctacaggggctgctgctggccggctgcttcctcttcatctcccgttccaagcccctcaagaccctctcccgagaacggcccctgcccaacatcttcaacctgtacaccatcctcaccgtcatgctccagttctttgtgcacttcctgagccttgtctacctgtaccgtgaggcccaggcccggagccccgagaagcaggagcagttcgtggacttgtacaaggagtttgagccaagcctggtcaacagcaccgtctacatcatggccatggccatgcagatggccaccttcgccatcaattacaaaggcccgcccttcatggagagcctgcccgagaacaagcccctggtgtggagtctggcagtttcactcctggccatcattggcctgctcctcggctcctcgcccgacttcaacagccagtttggcctcgtggacatccctgtggagttcaagctggtcattgcccaggtcctgctcctggacttctgcctggcgctcctggccgaccgcgtcctgcagttcttcctggggaccccgaagctgaaagtgccttcctgagatggcagtgctggtacccactgcccaccctggctgccgctgggcgggaaccccaacagggccccgggagggaaccctgcccccaaccccccacagcaaggctgtacagtctcgcccttggaagactgagctgggacccccacagccatccgctggcttggccagcagaaccagccccaagccagcacctttggtaaataaagcagcatctgagattttaaaaa

SEQ ID NO: 343749 - DNA, 2016 bp, Homo sapiens
gaagctcccgaccccgcctccgcagggtccaggcttcgcccctggtgacaggtggtgctggtgtagtcaaggaggagggctcgctttttttggttcaggttgtcatggtggcgcccaagcccgccttgccggccttgtcttttccggtctcagtccggcgtggcagcggaggcaggcaccgttaggtcttccagtccctctctgtcatggcgacgcccagcctcttcttccggccacagcctgtcatggcggcacccgaagtagtccctgccggggccagcctgttctgttgccctggctcttcctagtccaggctgccatggcggcgctcagggcttaccggaagtaaaacttcggaagtgaggcgttcctctgcccggaagtgagcgcggcgctaggaaagatggcggcagcggcggcggtgggcaacgcggtgccctgcggggcccggccttgcggggtccggcctgacgggcagcccaagcccgggccgcagccgcgcgcgctccttgccgccgggccggcgctcatagcgaacggtgacgagctggtggtgcccctggcccggggctccccaaaggcactggccctggagtacgcactgtgcctcacaggcgacggcttggcccacctgcaggccaccgacccccagcagctgctccgcctcatcccccatgtgcaggtgttcgcccgtgtggctcccaagcagaaggagtttgtcatcaccagcctgaaggagctgggctacgtgaccctcatgtgtggggatggcaccaacgacgtgggcgccctgaagcatgctgacgtgggtgtggcgctcttggccaatgcccctgagcgggttgtcgagcggcgacggcggccccgggacagcccaaccctgagcaacagtggcatcagagccacctccaggacagccaagcagcggtcggggctccctccctccgaggagcagccaacctcccagagggaccgcctgagccaggtgctgcgagacctcgaggacgagagtacgcccattgtgaaactgggggatgccagcatcgcagcacccttcacctccaagctctcatccatccagtgcatctgccacgtgatcaagcagggccgctgcacgctggtgaccacgctacagatgttcaagatcctggcgctcaatgccctcatcctggcctacagccagagcgtcctctacctggagggagtcaagttcagtgacttccaggccaccctacaggggctgctgctggccggctgcttcctcttcatctcccgttccaagcccctcaagaccctctcccgagaacggcccctgcccaacatcttcaacctgtacaccatcctcaccgtcatgctccagttctttgtgcacttcctgagccttgtctacctgtaccgtgaggcccaggcccggagccccgagaagcaggagcagttcgtggacttgtacaaggagtttgagccaagcctggtcaacagcaccgtctacatcatggccatggccatgcagatggccaccttcgccatcaattacaaaggcccgcccttcatggagagcctgcccgagaacaagcccctggtgtggagtctggcagtttcactcctggccatcattggcctgctcctcggctcctcgcccgacttcaacagccagtttggcctcgtggacatccctgtggagttcaagctggtcattgcccaggtcctgctcctggacttctgcctggcgctcctggccgaccgcgtcctgcagttcttcctggggaccccgaagctgaaagtgccttcctgagatggcagtgctggtacccactgcccaccctggctgccgctgggcgggaaccccaacagggccccgggagggaaccctgcccccaaccccccacagcaaggctgtacagtctcgcccttggaagactgagctgggacccccacagccatccgctggcttggccagcagaaccagccccaagccagcacctttggtaaataaagcagcatctgagattttaaaaa

SEQ ID NO: 343750 - DNA, 334 bp, Homo sapiens
ctcggacctctgttggcgcttgtttcccagtgctccgccgtgcatctggagagccctgccatatggttctccctagtctgagagctcgccaggctttacttcgtcctcatgttcttcttggttccttgtttgaagcggcctgccatgctcaggttggaggggtcagggtggagactccataccccagaggccttgccctgggaacaggatggggcctggtctcttgcagggccgagatggtggtgcctgacttctcggagcttttcaaggagagagccacagcccccttctttgtatttcaggtaaagcagcagctctggcccatctccccatt

SEQ ID NO: 343751 - DNA, 4312 bp, Homo sapiens
gaagctcccgaccccgcctccgcagggtccaggcttcgcccctggtgacaggtggtgctggtgtagtcaaggaggagggctcgctttttttggttcaggttgtcatggtggcgcccaagcccgccttgccggccttgtcttttccggtctcagtccggcgtggcagcggaggcaggcaccgttaggtcttccagtccctctctgtcatggcgacgcccagcctcttcttccggccacagcctgtcatggcggcacccgaagtagtccctgccggggccagcctgttctgttgccctggctcttcctagtccaggctgccatggcggcgctcagggcttaccggaagtaaaacttcggaagtgaggcgttcctctgcccggaagtgagcgcggcgctaggaaagatggcggcagcggcggcggtgggcaacgcggtgccctgcggggcccggccttgcggggtccggcctgacgggcagcccaagcccgggccgcagccgcgcgcgctccttgccgccgggccggcgctcatagcgaacggtgacgagctggtggctgccgtgtggccgtaccggcggttggcgctgttgcggcgcctcacggtgctgccattcgccgggctgctttacccggcctggttgggtgccgcagccgctggctgctggggctggggcagcagttgggtgcagatccccgaagctgcgctgctcgtgcttgccaccatctgcctcgcgcacgcgctcactgtcctctcggggcattggtctgtgcacgcgcattgcgcgctcacctgcaccccggagtacgaccccagcaaagcgacctttgtgaaggtggtgccaacccccaacaatggctccacggagctcgtggccctgcaccgcaatgagggcgaagacgggcttgaggtgctgtccttcgaattccagaagatcaagtattcctacgatgccctggagaagaagcagtttctccccgtggcctttcctgtgggaaacgccttctcatactatcagagcaacagaggcttccaggaagactcagagatccgagcagctgagaagaaatttgggagcaacaaggccgagatggtggtgcctgacttctcggagcttttcaaggagagagccacagcccccttctttgtatttcaggtgttctgtgtggggctctggtgcctggatgagtactggtactacagcgtctttacgctatccatgctggtggcgttcgaggcctcgctggtgcagcagcagatgcggaacatgtcggagatccggaagatgggcaacaagccccacatgatccaggtctaccgaagccgcaagtggaggcccattgccagtgatgagatcgtaccaggggacatcgtctccatcggccgctccccacaggagaacctggtgccatgtgacgtgcttctgctgcgaggccgctgcatcgtagacgaggccatgctcacgggggagtccgtgccacagatgaaggagcccatcgaagacctcagcccagaccgggtgctggacctccaggctgattcccggctgcacgtcatcttcgggggcaccaaggtggtgcagcacatccccccacagaaagccaccacgggcctgaagccggttgacagcgggtgcgtggcctacgtcctgcggaccggattcaacacatcccagggcaagctgctgcgcaccatcctcttcggggtcaagagggtgactgcgaacaacctggagaccttcatcttcatcctcttcctcctggtgtttgccatcgctgcagctgcctatgtatggattgaaggtaccaaggaccccagccggaaccgctacaagctgtttctggagtgcaccctgatcctcacctcggtcgtgcctcctgagctgcccatcgagctgtccctggccgtcaacacctccctcatcgccctggccaagctctacatgtactgcacagagcccttccggatcccctttgctggcaaggtcgaggtgtgctgctttgacaagacggggacgttgaccagtgacagcctggtggtgcgcggtgtggccgggctgagagacgggaaggaggtgaccccagtgtccagcatccctgtagaaacacaccgggccctggcctcgtgccactcgctcatgcagctggacgacggcaccctcgtgggtgaccctctagagaaggccatgctgacggccgtggactggacgctgaccaaagatgagaaagtattcccccgaagtattaaaactcaggggctgaaaattcaccagcgctttcattttgccagtgccctgaagcgaatgtccgtgcttgcctcgtatgagaagctgggctccaccgacctctgctacatcgcggccgtgaagggggcccccgaaactctgcactccatgttctcccagtgcccgcccgactaccaccacatccacaccgagatctcccgggaaggagcccgcgtcctggcgctggggtacaaggagctgggacacctcactcaccagcaggcccgggaggtcaagcgggaggccctggagtgcagcctcaagttcgtcggcttcattgtggtctcctgcccgctcaaggctgactccaaggccgtgatccgggagatccagaatgcgtcccaccgggtggtcatgatcacgggagacaacccgctcactgcatgccacgtggcccaggagctgcacttcattgaaaaggcccacacgctgatcctgcagcctccctccgagaaaggccggcagtgcgagtggcgctccattgacggcagcatcgtgctgcccctggcccggggctccccaaaggcactggccctggagtacgcactgtgcctcacaggcgacggcttggcccacctgcaggccaccgacccccagcagctgctccgcctcatcccccatgtgcaggtgttcgcccgtgtggctcccaagcagaaggagtttgtcatcaccagcctgaaggagctgggctacgtgaccctcatgtgtggggatggcaccaacgacgtgggcgccctgaagcatgctgacgtgggtgtggcgctcttggccaatgcccctgagcgggttgtcgagcggcgacggcggccccgggacagcccaaccctgagcaacagtggcatcagagccacctccaggacagccaagcagcggtcggggctccctccctccgaggagcagccaacctcccagagggtgagtcccaagaggggaggtgctgcaccccatcctggccagggctgacagcctgctgtctaccctgcaggaccgcctgagccaggtgctgcgagacctcgaggacgagagtacgcccattgtgaaactgggggatgccagcatcgcagcacccttcacctccaagctctcatccatccagtgcatctgccacgtgatcaagcagggccgctgcacgctggtgaccacgctacagatgttcaagatcctggcgctcaatgccctcatcctggcctacagccagagcgtcctctacctggagggagtcaagttcagtgacttccaggccaccctacaggggctgctgctggccggctgcttcctcttcatctcccgttccaagcccctcaagaccctctcccgagaacggcccctgcccaacatcttcaacctgtacaccatcctcaccgtcatgctccagttctttgtgcacttcctgagccttgtctacctgtaccgtgaggcccaggcccggagccccgagaagcaggagcagttcgtggacttgtacaaggagtttgagccaagcctggtcaacagcaccgtctacatcatggccatggccatgcagatggccaccttcgccatcaattacaaaggcccgcccttcatggagagcctgcccgagaacaagcccctggtgtggagtctggcagtttcactcctggccatcattggcctgctcctcggctcctcgcccgacttcaacagccagtttggcctcgtggacatccctgtggagttcaagctggtcattgcccaggtcctgctcctggacttctgcctggcgctcctggccgaccgcgtcctgcagttcttcctggggaccccgaagctgaaagtgccttcctgagatggcagtgctggtacccactgcccaccctggctgccgctgggcgggaaccccaacagggccccgggagggaaccctgcccccaaccccccacagcaaggctgtacagtctcgcccttggaagactgagctgggacccccacagccatccgctggcttggccagcagaaccagccccaagccagcacctttggtaaataaagcagcatctgagattttaaaaa

SEQ ID NO: 343752 - DNA, 4845 bp, Homo sapiens
  misc_feature (4248)..(4249): n is a, c, g, or t
gaagctcccgaccccgcctccgcagggtccaggcttcgcccctggtgacaggtggtgctggtgtagtcaaggaggagggctcgctttttttggttcaggttgtcatggtggcgcccaagcccgccttgccggccttgtcttttccggtctcagtccggcgtggcagcggaggcaggcaccgttaggtcttccagtccctctctgtcatggcgacgcccagcctcttcttccggccacagcctgtcatggcggcacccgaagtagtccctgccggggccagcctgttctgttgccctggctcttcctagtccaggctgccatggcggcgctcagggcttaccggaagtaaaacttcggaagtgaggcgttcctctgcccggaagtgagcgcggcgctaggaaagatggcggcagcggcggcggtgggcaacgcggtgccctgcggggcccggccttgcggggtccggcctgacgggcagcccaagcccgggccgcagccgcgcgcgctccttgccgccgggccggcgctcatagcgaacggtgacgagctggtggctgccgtgtggccgtaccggcggttggcgctgttgcggcgcctcacggtgctgccattcgccgggctgctttacccggcctggttgggtgccgcagccgctggctgctggggctggggcagcagttgggtgcagatccccgaagctgcgctgctcgtgcttgccaccatctgcctcgcgcacgcgctcactgtcctctcggggcattggtctgtgcacgcgcattgcgcgctcacctgcaccccggagtacgaccccagcaaagcgacctttgtgaaggtggtgccaacccccaacaatggctccacggagctcgtggccctgcaccgcaatgagggcgaagacgggcttgaggtgctgtccttcgaattccagaagatcaagtattcctacgatgccctggagaagaagcagtttctccccgtggcctttcctgtgggaaacgccttctcatactatcagagcaacagaggcttccaggaagactcagagatccgagcagctgagaagaaatttgggagcaacaaggccgagatggtggtgcctgacttctcggagcttttcaaggagagagccacagcccccttctttgtatttcaggtgttctgtgtggggctctggtgcctggatgagtactggtactacagcgtctttacgctatccatgctggtggcgttcgaggcctcgctggtgcagcagcagatgcggaacatgtcggagatccggaagatgggcaacaagccccacatgatccaggtctaccgaagccgcaagtggaggcccattgccagtgatgagatcgtaccaggggacatcgtctccatcggccgctccccacaggagaacctggtgccatgtgacgtgcttctgctgcgaggccgctgcatcgtagacgaggccatgctcacgggggagtccgtgccacagatgaaggagcccatcgaagacctcagcccagaccgggtgctggacctccaggctgattcccggctgcacgtcatcttcgggggcaccaaggtggtgcagcacatccccccacagaaagccaccacgggcctgaagccggttgacagcgggtgcgtggcctacgtcctgcggaccggattcaacacatcccagggcaagctgctgcgcaccatcctcttcggggtcaagagggtgactgcgaacaacctggagaccttcatcttcatcctcttcctcctggtgtttgccatcgctgcagctgcctatgtatggattgaaggtaccaaggaccccagccggaaccgctacaagctgtttctggagtgcaccctgatcctcacctcggtcgtgcctcctgagctgcccatcgagctgtccctggccgtcaacacctccctcatcgccctggccaagctctacatgtactgcacagagcccttccggatcccctttgctggcaaggtcgaggtgtgctgctttgacaagacggggacgttgaccagtgacagcctggtggtgcgcggtgtggccgggctgagagacgggaaggaggtgaccccagtgtccagcatccctgtagaaacacaccgggccctggcctcgtgccactcgctcatgcagctggacgacggcaccctcgtgggtgaccctctagagaaggccatgctgacggccgtggactggacgctgaccaaagatgagaaagtattcccccgaagtattaaaactcaggggctgaaaattcaccagcgctttcattttgccagtgccctgaagcgaatgtccgtgcttgcctcgtatgagaagctgggctccaccgacctctgctacatcgcggccgtgaagggggcccccgaaactctgcactccatgttctcccagtgcccgcccgactaccaccacatccacaccgagatctcccgggaaggagcccgcgtcctggcgctggggtacaaggagctgggacacctcactcaccagcaggcccgggaggtcaagcgggaggccctggagtgcagcctcaagttcgtcggcttcattgtggtctcctgcccgctcaaggctgactccaaggccgtgatccgggagatccagaatgcgtcccaccgggtggtcatgatcacgggagacaacccgctcactgcatgccacgtggcccaggagctgcacttcattgaaaaggcccacacgctgatcctgcagcctccctccgagaaaggccggcagtgcgagtggcgctccattgacggcagcatcgtgctgcccctggcccggggctccccaaaggcactggccctggagtacgcactgtgcctcacaggcgacggcttggcccacctgcaggccaccgacccccagcagctgctccgcctcatcccccatgtgcaggtgttcgcccgtgtggctcccaagcagaaggagtttgtcatcaccagcctgaaggagctgggctacgtgaccctcatgtgtggggatggcaccaacgacgtgggcgccctgaagcatgctgacgtgggtgtggcgctcttggccaatgcccctgagcgggttgtcgagcggcgacggcggccccgggacagcccaaccctgagcaacagtggcatcagagccacctccaggacagccaagcagcggtcggggctccctccctccgaggagcagccaacctcccagagggaccgcctgagccaggtgctgcgagacctcgaggacgagagtacgcccattgtgaaactgggggatgccagcatcgcagcacccttcacctccaagctctcatccatccagtgcatctgccacgtgatcaagcagggccgctgcacgctggtgaccacgctacagatgttcaagatcctggcgctcaatgccctcatcctggcctacagccagagcgtcctctacctggagggagtcaagttcagtgacttccaggccaccctacaggggctgctgctggccggctgcttcctcttcatctcccgttccaagcccctcaagaccctctcccgagaacggcccctgcccaacatcttcaacctgtacaccatcctcaccgtcatgctccagttctttgtgcacttcctgagccttgtctacctgtaccgtgaggcccaggcccggagccccgagaagcaggagcagttcgtggacttgtacaaggagtttgagccaagcctggtcaacagcaccgtctacatcatggccatggccatgcagatggccaccttcgccatcaattacaaaggcccgcccttcatggagagcctgcccgagaacaagcccctggtgtggagtctggcagtttcactcctggccatcattggcctgctcctcggctcctcgcccgacttcaacagccagtttggcctcgtggacatccctgtggagttcaagctggtcattgcccaggtcctgctcctggacttctgcctggcgctcctggccgaccgcgtcctgcagttcttcctggggaccccgaagctgaaagtgccttcctgagatggcagtgctggtacccactgcccaccctggctgccgctgggcgggaaccccaacagggccccgggagggaaccctgcccccaaccccccacagcaaggctgtacagtctcgcccttggaagactgagctgggacccccacagccatccgctggcttggccagcagaaccagccccaagccagcacctttggtaaataaagcagcatctgagattttaaaaaaaaaannaaaaaaaaaaaaaaaaaaaaaaaaaaaaaaaaaaaaaacaaaaatatagcaaccaccatacgaacataaccaaaggggggggggcgcgctaaataataaatatcctcccctgggagggggcgccagaagcatatattactcgagacaacccccagccatgtttgtattcaacaagaggggcgcgctcccataattttaaggagcggcggattaataaaagaagcagacgacgagcagcgcgccatattaacaaacaacagctggtgtctgatgagagaaaaaccgtggccatcacggggaactacgtttttggtgagaagaaacccaccacccaacttatttggtgggggggcgacacgaacaacacattggggggcagacccaacgctctgccagacaaaagagttattaccctccctcggccggaggcattataacaacctgttgatggatggtatataatggtgtgtaaagcacccacgaccatgcaatatatgcgtccgctccagagcaaaaaagtttggaacgcacgaggcgttagtataacacagacgaattatatatcacagggcgggtatagtagaaaatagagggtg

SEQ ID NO: 343753 - DNA, 1243 bp, Homo sapiens
gggctgctcttgtgccaatgccctctgacgcgggattgtcgcagctgtgctgacgtgctggcccctggtgacatgcccaacccatgagcaacacgtgtgcatcatgatgcctacctccatgtgacatgccaatgcagctgtgtctggggctctcctccactcccgatgtgatgcatgccacaccttcccacgatgtggaccgcctgagccaggtgctgcgagacctcgaggacgagagtacgcccattgtgaaactgggggatgccagcatcgcagcacccttcacctccaagctctcatccatccagtgcatctgccacgtgatcaagcagggccgctgcacgctggtgaccacgctacagatgttcaagatcctggcgctcaatgccctcatcctggcctacagccagagcgtcctctacctggagggagtcaagttcagtgacttccaggccaccctacaggggctgctgctggccggctgcttcctcttcatctcccgttccaagcccctcaagaccctctcccgagaacggcccctgcccaacatcttcaacctgtacaccatcctcaccgtcatgctccagttctttgtgcacttcctgagccttgtctacctgtaccgtgaggcccaggcccggagccccgagaagcaggagcagttcgtggacttgtacaaggagtttgagccaagcctggtcaacagcaccgtctacatcatggccatggccatgcagatggccaccttcgccatcaattacaaaggcccgcccttcatggagagcctgcccgagaacaagcccctggtgtggagtctggcagtttcactcctggccatcattggcctgctcctcggctcctcgcccgacttcaacagccagtttggcctcgtggacatccctgtggagttcaagctggtcattgcccaggtcctgctcctggacttctgcctggcgctcctggccgaccgcgtcctgcagttcttcctggggaccccgaagctgaaagtgccttcctgagatggcagtgctggtacccactgcccaccctggctgccgctgggcgggaaccccaacagggccccgggagggaaccctgcccccaaccccccacagcaaggctgtacagtctcgcccttggaagactgagctgggacccccacagccatccgctggcttggccagcagaaccagccccaagccagcacctttggtaaataaagcagcatctgagattttaaaaa

SEQ ID NO: 343754 - DNA, 4167 bp, Homo sapiens
gaagctcccgaccccgcctccgcagggtccaggcttcgcccctggtgacaggtggtgctggtgtagtcaaggaggagggctcgctttttttggttcaggttgtcatggtggcgcccaagcccgccttgccggccttgtcttttccggtctcagtccggcgtggcagcggaggcaggcaccgttaggtcttccagtccctctctgtcatggcgacgcccagcctcttcttccggccacagcctgtcatggcggcacccgaagtagtccctgccggggccagcctgttctgttgccctggctcttcctagtccaggctgccatggcggcgctcagggcttaccggaagtaaaacttcggaagtgaggcgttcctctgcccggaagtgagcgcggcgctaggaaagatggcggcagcggcggcggtgggcaacgcggtgccctgcggggcccggccttgcggggtccggcctgacgggcagcccaagcccgggccgcagccgcgcgcgctccttgccgccgggccggcgctcatagcgaacggtgacgagctggtggctgccgtgtggccgtaccggcggttggcgctgttgcggcgcctcacggtgctgccattcgccgggctgctttacccggcctggttgggtgccgcagccgctggctgctggggctggggcagcagttgggtgcagatccccgaagctgcgctgctcgtgcttgccaccatctgcctcgcgcacgcgctcactgtcctctcggggcattggtctgtgcacgcgcattgcgcgctcacctgcaccccggagtacgaccccagcaaagcgacctttgtgaaggtggtgccaacccccaacaatggctccacggagctcgtggccctgcaccgcaatgagggcgaagacgggcttgaggtgctgtccttcgaattccagaagatcaagtattcctacgatgccctggagaagaagcagtttctccccgtggcctttcctgtgggaaacgccttctcatactatcagagcaacagaggcttccaggaagactcagagatccgagcagctgagaagaaatttgggagcaacaaggccgagatggtggtgcctgacttctcggagcttttcaaggagagagccacagcccccttctttgtatttcaggtgttctgtgtggggctctggtgcctggatgagtactggtactacagcgtctttacgctatccatgctggtggcgttcgaggcctcgctggtgcagcagcagatgcggaacatgtcggagatccggaagatgggcaacaagccccacatgatccaggtctaccgaagccgcaagtggaggcccattgccagtgatgagatcgtaccaggggacatcgtctccatcggccgctccccacaggagaacctggtgccatgtgacgtgcttctgctgcgaggccgctgcatcgtagacgaggccatgctcacgggggagtccgtgccacagatgaaggagcccatcgaagacctcagcccagaccgggtgctggacctccaggctgattcccggctgcacgtcatcttcgggggcaccaaggtggtgcagcacatccccccacagaaagccaccacgggcctgaagccggttgacagcgggtgcgtggcctacgtcctgcggaccggattcaacacatcccagggcaagctgctgcgcaccatcctcttcggggtcaagagggtgactgcgaacaacctggagaccttcatcttcatcctcttcctcctggtgtttgccatcgctgcagctgcctatgtatggattgaaggtaccaaggaccccagccggaaccgctacaagctgtttctggagtgcaccctgatcctcacctcggtcgtgcctcctgagctgcccatcgagctgtccctggccgtcaacacctccctcatcgccctggccaagctctacatgtactgcacagagcccttccggatcccctttgctggcaaggtcgaggtgtgctgctttgacaagacggggacgttgaccagtgacagcctggtggtgcgcggtgtggccgggctgagagacgggaaggaggtgaccccagtgtccagcatccctgtagaaacacaccgggccctggcctcgtgccactcgctcatgcagctggacgacggcaccctcgtgggtgaccctctagagaaggccatgctgacggccgtggactggacgctgaccaaagatgagaaagtattcccccgaagtattaaaactcaggggctgaaaattcaccagcgctttcattttgccagtgccctgaagcgaatgtccgtgcttgcctcgtatgagaagctgggctccaccgacctctgctacatcgcggccgtgaagggggcccccgaaactctgcactccatgttctcccagtgcccgcccgactaccaccacatccacaccgagatctcccgggaaggagcccgcgtcctggcgctggggtacaaggagctgggacacctcactcaccagcaggcccgggaggtcaagcgggaggccctggagtgcagcctcaagttcgtcggcttcattgtggtctcctgcccgctcaaggctgactccaaggccgtgatccgggagatccagaatgcgtcccaccgggtggtcatgatcacgggagacaacccgctcactgcatgccacgtggcccaggagctgcacttcattgaaaaggcccacacgctgatcctgcagcctccctccgagaaaggccggcagtgcgagtggcgctccattgacggcagcatcgtgctgcccctggcccggggctccccaaaggcactggccctggagtacgcactgtgcctcacaggcgacggcttggcccacctgcaggccaccgacccccagcagctgctccgcctcatcccccatgtgcaggtgttcgcccgtgtggctcccaagcagaaggagtttgtcatcaccagcctgaaggagctgggctacgtgaccctcatgtgtggggatggcaccaacgacgtgggcgccctgaagcatgctgacgtgggtgtggcgctcttggccaatgcccctgagcgggttgtcgagcggcgacggcggccccgggacagcccaaccctgagcaacagtggcatcagagccacctccaggacagccaagcagcggtcggggctccctccctccgaggagcagccaacctcccagagggaccgcctgagccaggtgctgcgagacctcgaggacgagagtacgcccattgtgaaactgggggatgccagcatcgcagcacccttcacctccaagctctcatccatccagtgcatctgccacgtgatcaagcagggccgctgcacgctggtgaccacgctacagatgttcaagatcctggcgctcaatgccctcatcctggcctacagccagagcgtcctctacctggagggagtcaagttcagtgacttccaggccaccctacaggggctgctgctggccggctgcttcctcttcatctcccgttccaagcccctcaagaccctctcccgagaacggcccctgcccaacatcttcaacctgtacaccatcctcaccgtcatgctccagttctttgtgcacttcctgagccttgtctacctgtaccgtgaggcccaggcccggagccccgagaagcaggagcagttcgtggacttgtacaaggagtttgagccaagcctggtcaacagcaccgtctacatcatggccatggccatgcagatggccaccttcgccatcaattacaaaggcccgcccttcatggagagcctgcccgagaacaagcccctggtgtggagtctggcagtttcactcctggccatcattggcctgctcctcggctcctcgcccgacttcaacagccagtttggcctcgtggacatccctgtggagttcaagctggtcattgcccaggtcctgctcctggacttctgcctggcgctcctggccgaccgcgtcctgcagttcttcctggggaccccgaagctgaaagtgccttcctgagatggcagtgctggtacccagcaaggctgtacagtctcgcccttggaagactgagctgggacccccacagccatccgctggcttggccagcagaaccagccccaagccagcacctttggtaaataaagcagcatctgagattttaaaaa

SEQ ID NO: 343755 - DNA, 4013 bp, Homo sapiens
gaagctcccgaccccgcctccgcagggtccaggcttcgcccctggtgacaggtggtgctggtgtagtcaaggaggagggctcgctttttttggttcaggttgtcatggtggcgcccaagcccgccttgccggccttgtcttttccggtctcagtccggcgtggcagcggaggcaggcaccgttaggtcttccagtccctctctgtcatggcgacgcccagcctcttcttccggccacagcctgtcatggcggcacccgaagtagtccctgccggggccagcctgttctgttgccctggctcttcctagtccaggctgccatggcggcgctcagggcttaccggaagtaaaacttcggaagtgaggcgttcctctgcccggaagtgagcgcggcgctaggaaagatggcggcagcggcggcggtgggcaacgcggtgccctgcggggcccggccttgcggggtccggcctgacgggcagcccaagcccgggccgcagccgcgcgcgctccttgccgccgggccggcgctcatagcgaacggtgacgagctggtggctgccgtgtggccgtaccggcggttggcgctgttgcggcgcctcacggtgctgccattcgccgggctgctttacccggcctggttgggtgccgcagccgctggctgctggggctggggcagcagttgggtgcagatccccgaagctgcgctgctcgtgcttgccaccatctgcctcgcgcacgcgctcactgtcctctcggggcattggtctgtgcacgcgcattgcgcgctcacctgcaccccggagtacgaccccagcaaagcgacctttgtgaaggtggtgccaacccccaacaatggctccacggagctcgtggccctgcaccgcaatgagggcgaagacgggcttgaggtgctgtccttcgaattccagaagatcaagtattcctacgatgccctggagaagaagcagtttctccccgtggcctttcctgtgggaaacgccttctcatactatcagagcaacagaggcttccaggaagactcagagatccgagcagctgagaagaaatttgggagcaacaaggccgagatggtggtgcctgacttctcggagcttttcaaggagagagccacagcccccttctttgtatttcaggtgttctgtgtggggctctggtgcctggatgagtactggtactacagcgtctttacgctatccatgctggtggcgttcgaggcctcgctggtgcagcagcagatgcggaacatgtcggagatccggaagatgggcaacaagccccacatgatccaggtctaccgaagccgcaagtggaggcccattgccagtgatgagatcgtaccaggggacatcgtctccatcggccgctccccacaggagaacctggtgccatgtgacgtgcttctgctgcgaggccgctgcatcgtagacgaggccatgctcacgggggagtccgtgccacagatgaaggagcccatcgaagacctcagcccagaccgggtgctggacctccaggctgattcccggctgcacgtcatcttcgggggcaccaaggtggtgcagcacatccccccacagaaagccaccacgggcctgaagccggttgacagcgggtgcgtggcctacgtcctgcggaccggattcaacacatcccagggcaagctgctgcgcaccatcctcttcggggtcaagagggtgactgcgaacaacctggagaccttcatcttcatcctcttcctcctggtgtttgccatcgctgcagctgcctatgtatggattgaaggtaccaaggaccccagccggaaccgctacaagctgtttctggagtgcaccctgatcctcacctcggtcgtgcctcctgagctgcccatcgagctgtccctggccgtcaacacctccctcatcgccctggccaagctctacatgtactgcacagagcccttccggatcccctttgctggcaaggtcgaggtgtgctgctttgacaagacggggacgttgaccagtgacagcctggtggtgcgcggtgtggccgggctgagagacgggaaggaggtgaccccagtgtccagcatccctgtagaaacacaccgggccctggcctcgtgccactcgctcatgcagctggacgacggcaccctcgtgggtgaccctctagagaaggccatgctgacggccgtggactggacgctgaccaaagatgagaaagtattcccccgaagtattaaaactcaggggctgaaaattcaccagcgctttcattttgccagtgccctgaagcgaatgtccgtgcttgcctcgtatgagaagctgggctccaccgacctctgctacatcgcggccgtgaagggggcccccgaaactctgcactccatgttctcccagtgcccgcccgactaccaccacatccacaccgagatctcccgggaaggagcccgcgtcctggcgctggggtacaaggagctgggacacctcactcaccagcaggcccgggaggtcaagcgggaggccctggagtgcagcctcaagttcgtcggcttcattgtggtctcctgcccgctcaaggctgactccaaggccgtgatccgggagatccagaatgcgtcccaccgggtggtcatgatcacgggagacaacccgctcactgcatgccacgtggcccaggagctgcacttcattgaaaaggcccacacgctgatcctgcagcctccctccgagaaaggccggcagtgcgagtggcgctccattgacggcagcatcgtgctgcccctggcccggggctccccaaaggcactggccctggagtacgcactgtgcctcacaggcgacggcttggcccacctgcaggccaccgacccccagcagctgctccgcctcatcccccatgtgcaggtgttcgcccgtgtggctcccaagcagaaggagtttgtcatcaccagcctgaaggagctgggctacgtgaccctcatgtgtggggatggcaccaacgacgtgggcgccctgaagcatgctgacgtgggtgtggcgctcttggccaatgcccctgagcgggttgtcgagcggcgacggcggccccgggacagcccaaccctgagcaacagtggcatcagagccacctccaggacagccaagcagcggtcggggctccctccctccgaggagcagccaacctcccagagggaccgcctgagccaggtgctgcgagacctcgaggacgagagtacgcccattgtgaaactgggggatgccagcatcgcagcacccttcacctccaagctctcatccatccagtgcatctgccacgtgatcaagcagggccgctgcacgctggtgaccacgctacagatgttcaagatcctggcgctcaatgccctcatcctggcctacagccagagcgtcctctacctggagggagtcaagttcagtgacttccaggccaccctacaggggctgctgctggccggctgcttcctcttcatctcccgttccaagcccctcaagaccctctcccgagaacggcccctgcccaacatcttcaacctgtacaccatcctcaccgtcatgctccagttctttgtgcacttcctgagccttgtctacctgtaccgtgaggcccaggcccggagccccgagaagcaggagcagttcgtggacttgtacaaggagtttgagccaagcctggtcaacagcaccgtctacatcatggccatggccatgcagatggccaccttcgccatcaattacaaagtaaggcctgggccctgcccaaacattcactgtctgcccacccagccccaccccgaagctgaaagtgccttcctgagatggcagtgctggtacccactgcccaccctggctgccgctgggcgggaaccccaacagggccccgggagggaaccctgcccccaaccccccacaccatccgctggcttggccagcagaaccagccccaagccagcacctttggtaaataaagcagcatctgagattttaaaaa

SEQ ID NO: 343756 - DNA, 2907 bp, Homo sapiens
gaagctcccgaccccgcctccgcagggtccaggcttcgcccctggtgacaggtggtgctggtgtagtcaaggaggagggctcgctttttttggttcaggttgtcatggtggcgcccaagcccgccttgccggccttgtcttttccggtctcagtccggcgtggcagcggaggcaggcaccgttaggtcttccagtccctctctgtcatggcgacgcccagcctcttcttccggccacagcctgtcatggcggcacccgaagtagtccctgccggggccagcctgttctgttgccctggctcttcctagtccaggctgccatggcggcgctcagggcttaccggaagtaaaacttcggaagtgaggcgttcctctgcccggaagtgagcgcggcgctaggaaagatggcggcagcggcggcggtgggcaacgcggtgccctgcggggcccggccttgcggggtccggcctgacgggcagcccaagcccgggccgcagccgcgcgcgctccttgccgccgggccggcgctcatagcgaacggtgacgagctggtggctgccgtgtggccgtaccggcggttggcgctgttgcggcgcctcacggtgctgccattcgccgggctgctttacccggcctggttgggtgccgcagccgctggctgctggggctggggcagcagttgggtgcagatccccgaagctgcgctgctcgtgcttgccaccatctgcctcgcgcacgcgctcactgtcctctcggggcattggtctgtgcacgcgcattgcgcgctcacctgcaccccggagtacgaccccagcaaagcgacctttgtgaaggtggtgccaacccccaacaatggctccacggagctcgtggccctgcaccgcaatgagggcgaagacgggcttgaggtgctgtccttcgaattccagaagatcaagtattcctacgatgccctggagaagaagcagtttctccccgtggcctttcctgtgggaaacgccttctcatactatcagagcaacagaggcttccaggaagactcagagatccgagcagctgagaagaaatttgggagcaacaaggccgagatggtggtgcctgacttctcggagcttttcaaggagagagccacagcccccttctttgtatttcaggtgttctgtgtggggctctggtgcctggatgagtactggtactacagcgtctttacgctatccatgctggtggcgttcgaggcctcgctggtgcagcagcagatgcggaacatgtcggagatccggaagatgggcaacaagccccacatgatccaggtctaccgaagccgcaagtggaggcccattgccagtgatgagatcgtaccaggggacatcgtctccatcggccgctccccacaggagaacctggtgccatgtgacgtgcttctgctgcgaggccgctgcatcgtagacgaggccatgctcacgggggagtccgtgccacagatgaaggagcccatcgaagacctcagcccagaccgggtgctggacctccaggctgattcccggctgcacgtcatcttcgggggcaccaaggtggtgcagcacatccccccacagaaagccaccacgggcctgaagccggttgacagcgggtgcgtggcctacgtcctgcggaccggattcaacacatcccagggcaagctgctgcgcaccatcctcttcggggtcaagagggtgactgcgaacaacctggagaccttcatcttcatcctcttcctcctggtgtttgccatcgctgcagctgcctatgtatggattgaaggtaccaaggaccccagccggaaccgctacaagctgtttctggagtgcaccctgatcctcacctcggtcgtgcctcctgagctgcccatcgagctgtccctggccgtcaacacctccctcatcgccctggccaagctctacatgtactgcacagagcccttccggatcccctttgctggcaaggtcgaggtgtgctgctttgacaagacggggacgttgaccagtgacagcctggtggtgcgcggtgtggccgggctgagagacgggaaggaggtgaccccagtgtccagcatccctgtagaaacacaccgggccctggcctcgtgccactcgctcatgcagctggacgacggcaccctcgtgggtgaccctctagagaaggccatgctgacggccgtggactggacgctgaccaaagatgagaaagtattcccccgaagtattaaaactcaggggctgaaaattcaccagcgctttcattttgccagtgccctgaagcgaatgtccgtgcttgcctcgtatgagaagctgggctccaccgacctctgctacatcgcggccgtgaagggggcccccgaaactctgcactccatgttctcccagtgcccgcccgactaccaccacatccacaccgagatctcccgggaaggagcccgcgtcctggcgctggggtacaaggagctgggacacctcactcaccagcaggtacgggcccaggctccccctgccttcaccatgtgcctggcccgtcagctcctccctgagtcacctcctgtgtcccacagtgccaggttgaatggttgtgattttgtcctccttgccccgcctccagcttctacctttggagactccaaatggcactcagtctgtccactgctgtggggacccacccagtcctggctcacgcagagcacacgcagggcttacctgccccagtcctggtgtgtccctagctctactcttttgccctggtcttgggcagggctaggtggcatcctcagccctctcacccatccatcctccacaaagcccaccctccgcctccaccaccggcacatctgccgcttggcttcttcctgggctctcgttctttctgcttgcaccctaca

SEQ ID NO: 343757 - DNA, 3485 bp, Homo sapiens
atggagaagtgggaggagctgaacagccatcagccaggagaggagtacgaccccagcaaagcgacctttgtgaaggtggtgccaacccccaacaatggctccacggagctcgtggccctgcaccgcaatgagggcgaagacgggcttgaggtgctgtccttcgaattccagaagatcaagtattcctacgatgccctggagaagaagcagtttctccccgtggcctttcctgtgggaaacgccttctcatactatcagagcaacagaggcttccaggaagactcagagatccgagcagctgagaagaaatttgggagcaacaaggccgagatggtggtgcctgacttctcggagcttttcaaggagagagccacagcccccttctttgtatttcaggtgttctgtgtggggctctggtgcctggatgagtactggtactacagcgtctttacgctatccatgctggtggcgttcgaggcctcgctggtgcagcagcagatgcggaacatgtcggagatccggaagatgggcaacaagccccacatgatccaggtctaccgaagccgcaagtggaggcccattgccagtgatgagatcgtaccaggggacatcgtctccatcggccgctccccacaggagaacctggtgccatgtgacgtgcttctgctgcgaggccgctgcatcgtagacgaggccatgctcacgggggagtccgtgccacagatgaaggagcccatcgaagacctcagcccagaccgggtgctggacctccaggctgattcccggctgcacgtcatcttcgggggcaccaaggtggtgcagcacatccccccacagaaagccaccacgggcctgaagccggttgacagcgggtgcgtggcctacgtcctgcggaccggattcaacacatcccagggcaagctgctgcgcaccatcctcttcggggtcaagagggtgactgcgaacaacctggagaccttcatcttcatcctcttcctcctggtgtttgccatcgctgcagctgcctatgtatggattgaaggtaccaaggaccccagccggaaccgctacaagctgtttctggagtgcaccctgatcctcacctcggtcgtgcctcctgagctgcccatcgagctgtccctggccgtcaacacctccctcatcgccctggccaagctctacatgtactgcacagagcccttccggatcccctttgctggcaaggtcgaggtgtgctgctttgacaagacggggacgttgaccagtgacagcctggtggtgcgcggtgtggccgggctgagagacgggaaggaggtgaccccagtgtccagcatccctgtagaaacacaccgggccctggcctcgtgccactcgctcatgcagctggacgacggcaccctcgtgggtgaccctctagagaaggccatgctgacggccgtggactggacgctgaccaaagatgagaaagtattcccccgaagtattaaaactcaggggctgaaaattcaccagcgctttcattttgccagtgccctgaagcgaatgtccgtgcttgcctcgtatgagaagctgggctccaccgacctctgctacatcgcggccgtgaagggggcccccgaaactctgcactccatgttctcccagtgcccgcccgactaccaccacatccacaccgagatctcccgggaaggagcccgcgtcctggcgctggggtacaaggagctgggacacctcactcaccagcaggcccgggaggtcaagcgggaggccctggagtgcagcctcaagttcgtcggcttcattgtggtctcctgcccgctcaaggctgactccaaggccgtgatccgggagatccagaatgcgtcccaccgggtggtcatgatcacgggagacaacccgctcactgcatgccacgtggcccaggagctgcacttcattgaaaaggcccacacgctgatcctgcagcctccctccgagaaaggccggcagtgcgagtggcgctccattgacggcagcatcgtgctgcccctggcccggggctccccaaaggcactggccctggagtacgcactgtgcctcacaggcgacggcttggcccacctgcaggccaccgacccccagcagctgctccgcctcatcccccatgtgcaggtgttcgcccgtgtggctcccaagcagaaggagtttgtcatcaccagcctgaaggagctgggctacgtgaccctcatgtgtggggatggcaccaacgacgtgggcgccctgaagcatgctgacgtgggtgtggcgctcttggccaatgcccctgagcgggttgtcgagcggcgacggcggccccgggacagcccaaccctgagcaacagtggcatcagagccacctccaggacagccaagcagcggtcggggctccctccctccgaggagcagccaacctcccagagggaccgcctgagccaggtgctgcgagacctcgaggacgagagtacgcccattgtgaaactgggggatgccagcatcgcagcacccttcacctccaagctctcatccatccagtgcatctgccacgtgatcaagcagggccgctgcacgctggtgaccacgctacagatgttcaagatcctggcgctcaatgccctcatcctggcctacagccagagcgtcctctacctggagggagtcaagttcagtgacttccaggccaccctacaggggctgctgctggccggctgcttcctcttcatctcccgttccaagcccctcaagaccctctcccgagaacggcccctgcccaacatcttcaacctgtacaccatcctcaccgtcatgctccagttctttgtgcacttcctgagccttgtctacctgtaccgtgaggcccaggcccggagccccgagaagcaggagcagttcgtggacttgtacaaggagtttgagccaagcctggtcaacagcaccgtctacatcatggccatggccatgcagatggccaccttcgccatcaattacaaaggcccgcccttcatggagagcctgcccgagaacaagcccctggtgtggagtctggcagtttcactcctggccatcattggcctgctcctcggctcctcgcccgacttcaacagccagtttggcctcgtggacatccctgtggagttcaagctggtcattgcccaggtcctgctcctggacttctgcctggcgctcctggccgaccgcgtcctgcagttcttcctggggaccccgaagctgaaagtgccttcctgagatggcagtgctggtacccactgcccaccctggctgccgctgggcgggaaccccaacagggccccgggagggaaccctgcccccaaccccccacagcaaggctgtacagtctcgcccttggaagactgagctgggacccccacagccatccgctggcttggccagcagaaccagccccaagccagcacctttggtaaataaagcagcatctgagattttaaaaa

SEQ ID NO: 343758 - DNA, 771 bp, Homo sapiens
ctcccgggggggtcttggaactgtaggttgagaagagctaagccacaatgctttctttgtctctgtcaggagtacgaccccagcaaagcgacctttgtgaaggtggtgccaacccccaacaatggctccacggagctcgtggccctgcaccgcaatgagggcgaagacgggcttgaggtgctgtccttcgaattccagaagatcaagtattcctacgatgccctggagaagaagcagtttctccccgtggcctttcctgtgggaaacgccttctcatactatcagagcaacagaggcttccaggaagactcagagatccgagcagctgagaagaaatttgggagcaacaagtgagtccttgatttgcctgtagcacctttgcctttctgtcctgctcccctcctgattcagggtgcctaggaagcgggacagaggcatctgcccttttatttatttatttactattattttatttttattttattttttatttttgagactgagtctcgctctgtcacccaggctggagtgcagtgacgcgatctcagctcaccccaacctccgcctccccggttcaagtgattctcctgcctcaacctgccaagcagctgggaatacaggctccccccaccacgcctggctaatttttgtatttttagtagagatgggggtttcaccatgttggccaggctggtcttgaactcctgacctcaggtgatcctcccatgttggcctcccaaagtgctgggattacaggcgtgagccactgca

SEQ ID NO: 343759 - DNA, 4172 bp, Homo sapiens
gaagctcccgaccccgcctccgcagggtccaggcttcgcccctggtgacaggtggtgctggtgtagtcaaggaggagggctcgctttttttggttcaggttgtcatggtggcgcccaagcccgccttgccggccttgtcttttccggtctcagtccggcgtggcagcggaggcaggcaccgttaggtcttccagtccctctctgtcatggcgacgcccagcctcttcttccggccacagcctgtcatggcggcacccgaagtagtccctgccggggccagcctgttctgttgccctggctcttcctagtccaggctgccatggcggcgctcagggcttaccggaagtaaaacttcggaagtgaggcgttcctctgcccggaagtgagcgcggcgctaggaaagatggcggcagcggcggcggtgggcaacgcggtgccctgcggggcccggccttgcggggtccggcctgacgggcagcccaagcccgggccgcagccgcgcgcgctccttgccgccgggccggcgctcatagcgaacggtgacgagctggtggctgccgtgtggccgtaccggcggttggcgctgttgcggcgcctcacggtgctgccattcgccgggctgctttacccggcctggttgggtgccgcagccgctggctgctggggctggggcagcagttgggtgcagatccccgaagctgcgctgctcgtgcttgccaccatctgcctcgcgcacgcgctcactgtcctctcggggcattggtctgtgcacgcgcattgcgcgctcacctgcaccccggagtacgaccccagcaaagcgacctttgtgaaggtggtgccaacccccaacaatggctccacggagctcgtggccctgcaccgcaatgagggcgaagacgggcttgaggtgctgtccttcgaattccagaagatcaagtattcctacgatgccctggagaagaagcagtttctccccgtggcctttcctgtgggaaacgccttctcatactatcagagcaacagaggcttccaggaagactcagagatccgagcagctgagaagaaatttgggagcaacaaggccgagatggtggtgcctgacttctcggagcttttcaaggagagagccacagcccccttctttgtatttcaggtgttctgtgtggggctctggtgcctggatgagtactggtactacagcgtctttacgctatccatgctggtggcgttcgaggcctcgctggtgcagcagcagatgcggaacatgtcggagatccggaagatgggcaacaagccccacatgatccaggtctaccgaagccgcaagtggaggcccattgccagtgatgagatcgtaccaggggacatcgtctccatcggccgctccccacaggagaacctggtgccatgtgacgtgcttctgctgcgaggccgctgcatcgtagacgaggccatgctcacgggggagtccgtgccacagatgaaggagcccatcgaagacctcagcccagaccgggtgctggacctccaggctgattcccggctgcacgtcatcttcgggggcaccaaggtggtgcagcacatccccccacagaaagccaccacgggcctgaagccggttgacagcgggtgcgtggcctacgtcctgcggaccggattcaacacatcccagggcaagctgctgcgcaccatcctcttcggggtcaagagggtgactgcgaacaacctggagaccttcatcttcatcctcttcctcctggtgtttgccatcgctgcagctgcctatgtatggattgaaggtaccaaggaccccagccggaaccgctacaagctgtttctggagtgcaccctgatcctcacctcggtcgtgcctcctgagctgcccatcgagctgtccctggccgtcaacacctccctcatcgccctggccaagctctacatgtactgcacagagcccttccggatcccctttgctggcaaggtcgaggtgtgctgctttgacaagacggggacgttgaccagtgacagcctggtggtgcgcggtgtggccgggctgagagacgggaaggaggtgaccccagtgtccagcatccctgtagaaacacaccgggccctggcctcgtgccactcgctcatgcagctggacgacggcaccctcgtgggtgaccctctagagaaggccatgctgacggccgtggactggacgctgaccaaagtgccctgaagcgaatgtccgtgcttgcctcgtatgagaagctgggctccaccgacctctgctacatcgcggccgtgaagggggcccccgaaactctgcactccatgttctcccagtgcccgcccgactaccaccacatccacaccgagatctcccgggaaggagcccgcgtcctggcgctggggtacaaggagctgggacacctcactcaccagcaggcccgggaggtcaagcgggaggccctggagtgcagcctcaagttcgtcggcttcattgtggtctcctgcccgctcaaggctgactccaaggccgtgatccgggagatccagaatgcgtcccaccgggtggtcatgatcacgggagacaacccgctcactgcatgccacgtggcccaggagctgcacttcattgaaaaggcccacacgctgatcctgcagcctccctccgagaaaggccggcagtgcgagtggcgctccattgacggcagcatcgtgctgcccctggcccggggctccccaaaggcactggccctggagtacgcactgtgcctcacaggcgacggcttggcccacctgcaggccaccgacccccagcagctgctccgcctcatcccccatgtgcaggtgttcgcccgtgtggctcccaagcagaaggagtttgtcatcaccagcctgaaggagctgggctacgtgaccctcatgtgtggggatggcaccaacgacgtgggcgccctgaagcatgctgacgtgggtgtggcgctcttggccaatgcccctgagcgggttgtcgagcggcgacggcggccccgggacagcccaaccctgagcaacagtggcatcagagccacctccaggacagccaagcagcggtcggggctccctccctccgaggagcagccaacctcccagagggaccgcctgagccaggtgctgcgagacctcgaggacgagagtacgcccattgtgaaactgggggatgccagcatcgcagcacccttcacctccaagctctcatccatccagtgcatctgccacgtgatcaagcagggccgctgcacgctggtgaccacgctacagatgttcaagatcctggcgctcaatgccctcatcctggcctacagccagagcgtcctctacctggagggagtcaagttcagtgacttccaggccaccctacaggggctgctgctggccggctgcttcctcttcatctcccgttccaagcccctcaagaccctctcccgagaacggcccctgcccaacatcttcaacctgtacaccatcctcaccgtcatgctccagttctttgtgcacttcctgagccttgtctacctgtaccgtgaggcccaggcccggagccccgagaagcaggagcagttcgtggacttgtacaaggagtttgagccaagcctggtcaacagcaccgtctacatcatggccatggccatgcagatggccaccttcgccatcaattacaaaggcccgcccttcatggagagcctgcccgagaacaagcccctggtgtggagtctggcagtttcactcctggccatcattggcctgctcctcggctcctcgcccgacttcaacagccagtttggcctcgtggacatccctgtggagttcaagctggtcattgcccaggtcctgctcctggacttctgcctggcgctcctggccgaccgcgtcctgcagttcttcctggggaccccgaagctgaaagtgccttcctgagatggcagtgctggtacccactgcccaccctggctgccgctgggcgggaaccccaacagggccccgggagggaaccctgcccccaaccccccacagcaaggctgtacagtctcgcccttggaagactgagctgggacccccacagccatccgctggcttggccagcagaaccagccccaagccagcacctttggtaaataaagcagcatctgagattttaaaaa

SEQ ID NO: 343760 - DNA, 4325 bp, Homo sapiens
gaagctcccgaccccgcctccgcagggtccaggcttcgcccctggtgacaggtggtgctggtgtagtcaaggaggagggctcgctttttttggttcaggttgtcatggtggcgcccaagcccgccttgccggccttgtcttttccggtctcagtccggcgtggcagcggaggcaggcaccgttaggtcttccagtccctctctgtcatggcgacgcccagcctcttcttccggccacagcctgtcatggcggcacccgaagtagtccctgccggggccagcctgttctgttgccctggctcttcctagtccaggctgccatggcggcgctcagggcttaccggaagtaaaacttcggaagtgaggcgttcctctgcccggaagtgagcgcggcgctaggaaagatggcggcagcggcggcggtgggcaacgcggtgccctgcggggcccggccttgcggggtccggcctgacgggcagcccaagcccgggccgcagccgcgcgcgctccttgccgccgggccggcgctcatagcgaacggtgacgagctggtggctgccgtgtggccgtaccggcggttggcgctgttgcggcgcctcacggtgctgccattcgccgggctgctttacccggcctggttgggtgccgcagccgctggctgctggggctggggcagcagttgggtgcagatccccgaagctgcgctgctcgtgcttgccaccatctgcctcgcgcacgcgctcactgtcctctcggggcattggtctgtgcacgcgcattgcgcgctcacctgcaccccggagtacgaccccagcaaagcgacctttgtgaaggtggtgccaacccccaacaatggctccacggagctcgtggccctgcaccgcaatgagggcgaagacgggcttgaggtgctgtccttcgaattccagaagatcaagtattcctacgatgccctggagaagaagcagtttctccccgtggcctttcctgtgggaaacgccttctcatactatcagagcaacagaggcttccaggaagactcagagatccgagcagctgagaagaaatttgggagcaacaaggccgagatggtggtgcctgacttctcggagcttttcaaggagagagccacagcccccttctttgtatttcaggtgttctgtgtggggctctggtgcctggatgagtactggtactacagcgtctttacgctatccatgctggtggcgttcgaggcctcgctggtgcagcagcagatgcggaacatgtcggagatccggaagatgggcaacaagccccacatgatccaggtctaccgaagccgcaagtggaggcccattgccagtgatgagatcgtaccaggggacatcgtctccatcggccgctccccacaggagaacctggtgccatgtgacgtgcttctgctgcgaggccgctgcatcgtagacgaggccatgctcacgggggagtccgtgccacagatgaaggagcccatcgaagacctcagcccagaccgggtgctggacctccaggctgattcccggctgcacgtcatcttcgggggcaccaaggtggtgcagcacatccccccacagaaagccaccacgggcctgaagccggttgacagcgggtgcgtggcctacgtcctgcggaccggattcaacacatcccagggcaagctgctgcgcaccatcctcttcggggtcaagagggtgactgcgaacaacctggagaccttcatcttcatcctcttcctcctggtgtttgccatcgctgcagctgcctatgtatggattgaaggtaccaaggaccccagccggaaccgctacaagctgtttctggagtgcaccctgatcctcacctcggtcgtgcctcctgagctgcccatcgagctgtccctggccgtcaacacctccctcatcgccctggccaagctctacatgtactgcacagagcccttccggatcccctttgctggcaaggtcgaggtgtgctgctttgacaagacggggacgttgaccagtgacagcctggtggtgcgcggtgtggccgggctgagagacgggaaggaggtgaccccagtgtccagcatccctgtagaaacacaccgggccctggcctcgtgccactcgctcatgcagctggacgacggcaccctcgtgggtgaccctctagagaaggccatgctgacggccgtggactggacgctgaccaaagatgagaaagtattcccccgaagtattaaaactcaggggctgaaaattcaccagcgctttcattttgccagtgccctgaagcgaatgtccgtgcttgcctcgtatgagaagctgggctccaccgacctctgctacatcgcggccgtgaagggggcccccgaaactctgcactccatgttctcccagtgcccgcccgactaccaccacatccacaccgagatctcccgggaaggagcccgcgtcctggcgctggggtacaaggagctgggacacctcactcaccagcaggcccgggaggtcaagcgggaggccctggagtgcagcctcaagttcgtcggcttcattgtggtctcctgcccgctcaaggctgactccaaggccgtgatccgggagatccagaatgcgtcccaccgggtggtcatgatcacgggagacaacccgctcactgcatgccacgtggcccaggagctgcacttcattgaaaaggcccacacgctgatcctgcagcctccctccgagaaaggccggcagtgcgagtggcgctccattgacggcagcatcgtgctgcccctggcccggggctccccaaaggcactggccctggagtacgcactgtgcctcacaggcgacggcttggcccacctgcaggccaccgacccccagcagctgctccgcctcatcccccatgtgcaggtgttcgcccgtgtggctcccaagcagaaggagtttgtcatcaccagcctgaaggagctgggctacgtgaccctcatgtgtggggatggcaccaacgacgtgggcgccctgaagcatgctgacgtgggtgtggcgctcttggccaatgcccctgagcgggttgtcgagcggcgacggcggccccgggacagcccaaccctgagcaacagtggcatcagagccacctccaggacagccaagcagcggtcggggctccctccctccgaggagcagccaacctcccagagggaccgcctgagccaggtgctgcgagacctcgaggacgagagtacgcccattgtgaaactgggggatgccagcatcgcagcacccttcacctccaagctctcatccatccagtgcatctgccacgtgatcaagcagggccgctgcacgctggtgaccacgctacagatgttcaagatcctggcgctcaatgccctcatcctggcctacagccagagcgtcctctacctggagggagtcaagttcagtgacttccaggccaccctacaggggctgctgctggccggctgcttcctcttcatctcccgttccaagcccctcaagaccctctcccgagaacggcccctgcccaacatcttcaacctgtacaccatcctcaccgtcatgctccagttctttgtgcacttcctgagccttgtctacctgtaccgtgaggcccaggcccggagccccgagaagcaggagcagttcgtggacttgtacaaggagtttgagccaagcctggtcaacagcaccgtctacatcatggccatggccatgcagatggccaccttcgccatcaattacaaagtaaggcctgggccctgcccaaacattcactgtctgcccacccagccccaccccatgaagccatctgtccctcatccccacagggcccgcccttcatggagagcctgcccgagaacaagcccctggtgtggagtctggcagtttcactcctggccatcattggcctgctcctcggctcctcgcccgacttcaacagccagtttggcctcgtggacatccctgtggagttcaagctggtcattgcccaggtcctgctcctggacttctgcctggcgctcctggccgaccgcgtcctgcagttcttcctggggaccccgaagctgaaagtgccttcctgagatggcagtgctggtacccactgcccaccctggctgccgctgggcgggaaccccaacagggccccgggagggaaccctgcccccaaccccccacagcaaggctgtacagtctcgcccttggaagactgagctgggacccccacagccatccgctggcttggccagcagaaccagccccaagccagcacctttggtaaataaagcagcatctgagattttaaaaa

SEQ ID NO: 343761 - DNA, 4221 bp, Homo sapiens
gaagctcccgaccccgcctccgcagggtccaggcttcgcccctggtgacaggtggtgctggtgtagtcaaggaggagggctcgctttttttggttcaggttgtcatggtggcgcccaagcccgccttgccggccttgtcttttccggtctcagtccggcgtggcagcggaggcaggcaccgttaggtcttccagtccctctctgtcatggcgacgcccagcctcttcttccggccacagcctgtcatggcggcacccgaagtagtccctgccggggccagcctgttctgttgccctggctcttcctagtccaggctgccatggcggcgctcagggcttaccggaagtaaaacttcggaagtgaggcgttcctctgcccggaagtgagcgcggcgctaggaaagatggcggcagcggcggcggtgggcaacgcggtgccctgcggggcccggccttgcggggtccggcctgacgggcagcccaagcccgggccgcagccgcgcgcgctccttgccgccgggccggcgctcatagcgaacggtgacgagctggtggctgccgtgtggccgtaccggcggttggcgctgttgcggcgcctcacggtgctgccattcgccgggctgctttacccggcctggttgggtgccgcagccgctggctgctggggctggggcagcagttgggtgcagatccccgaagctgcgctgctcgtgcttgccaccatctgcctcgcgcacgcgctcactgtcctctcggggcattggtctgtgcacgcgcattgcgcgctcacctgcaccccggagtacgaccccagcaaagcgacctttgtgaaggtggtgccaacccccaacaatggctccacggagctcgtggccctgcaccgcaatgagggcgaagacgggcttgaggtgctgtccttcgaattccagaagatcaagtattcctacgatgccctggagaagaagcagtttctccccgtggcctttcctgtgggaaacgccttctcatactatcagagcaacagaggcttccaggaagactcagagatccgagcagctgagaagaaatttgggagcaacaaggccgagatggtggtgcctgacttctcggagcttttcaaggagagagccacagcccccttctttgtatttcaggtgttctgtgtggggctctggtgcctggatgagtactggtactacagcgtctttacgctatccatgctggtggcgttcgaggcctcgctggtgcagcagcagatgcggaacatgtcggagatccggaagatgggcaacaagccccacatgatccaggtctaccgaagccgcaagtggaggcccattgccagtgatgagatcgtaccaggggacatcgtctccatcggccgctccccacaggagaacctggtgccatgtgacgtgcttctgctgcgaggccgctgcatcgtagacgaggccatgctcacgggggagtccgtgccacagatgaaggagcccatcgaagacctcagcccagaccgggtgctggacctccaggctgattcccggctgcacgtcatcttcgggggcaccaaggtggtgcagcacatccccccacagaaagccaccacgggcctgaagccggttgacagcgggtgcgtggcctacgtcctgcggaccggattcaacacatcccagggcaagctgctgcgcaccatcctcttcggggtcaagagggtgactgcgaacaacctggagaccttcatcttcatcctcttcctcctggtgtttgccatcgctgcagctgcctatgtatggattgaaggtaccaaggaccccagccggaaccgctacaagctgtttctggagtgcaccctgatcctcacctcggtcgtgcctcctgagctgcccatcgagctgtccctggccgtcaacacctccctcatcgccctggccaagctctacatgtactgcacagagcccttccggatcccctttgctggcaaggtcgaggtgtgctgctttgacaagacggggacgttgaccagtgacagcctggtggtgcgcggtgtggccgggctgagagacgggaaggaggtgaccccagtgtccagcatccctgtagaaacacaccgggccctggcctcgtgccactcgctcatgcagctggacgacggcaccctcgtgggtgaccctctagagaaggccatgctgacggccgtggactggacgctgaccaaagatgagaaagtattcccccgaagtattaaaactcaggggctgaaaattcaccagcgctttcattttgccagtgccctgaagcgaatgtccgtgcttgcctcgtatgagaagctgggctccaccgacctctgctacatcgcggccgtgaagggggcccccgaaactctgcactccatgttctcccagtgcccgcccgactaccaccacatccacaccgagatctcccgggaaggagcccgcgtcctggcgctggggtacaaggagctgggacacctcactcaccagcaggcccgggaggtcaagcgggaggccctggagtgcagcctcaagttcgtcggcttcattgtggtctcctgcccgctcaaggctgactccaaggccgtgatccgggagatccagaatgcgtcccaccgggtggtcatgatcacgggagacaacccgctcactgcatgccacgtggcccaggagctgcacttcattgaaaaggcccacacgctgatcctgcagcctccctccgagaaaggccggcagtgcgagtggcgctccattgacggcagcatcgtgctgcccctggcccggggctccccaaaggcactggccctggagtacgcactgtgcctcacaggcgacggcttggcccacctgcaggccaccgacccccagcagctgctccgcctcatcccccatgtgcaggtgttcgcccgtgtggctcccaagcagaaggagtttgtcatcaccagcctgaaggagctgggctacgtgaccctcatgtgtggggatggcaccaacgacgtgggcgccctgaagcatgctgacgtgggtgtggcgctcttggccaatgcccctgagcgggttgtcgagcggcgacggcggccccgggacagcccaaccctgagcaacagtggcatcagagccacctccaggacagccaagcagcggtcggggctccctccctccgaggagcagccaacctcccagagggaccgcctgagccaggtgctgcgagacctcgaggacgagagtacgcccattgtgaaactgggggatgccagcatcgcagcacccttcacctccaagctctcatccatccagtgcatctgccacgtgatcaagcagggccgctgcacgctggtgaccacgctacagatgttcaagatcctggcgctcaatgccctcatcctggcctacagccagagcgtcctctacctggagggagtcaagttcagtgacttccaggccaccctacaggggctgctgctggccggctgcttcctcttcatctcccgttccaagcccctcaagaccctctcccgagaacggcccctgcccaacatcttcaacctgtacaccatcctcaccgtcatgctccagttctttgtgcacttcctgagccttgtctacctgtaccgtgaggcccaggcccggagccccgagaagcaggagcagttcgtggacttgtacaaggagtttgagccaagcctggtcaacagcaccgtctacatcatggccatggccatgcagatggccaccttcgccatcaattacaaaggcccgcccttcatggagagcctgcccgagaacaagcccctggtgtggagtctggcagtttcactcctggccatcattggcctgctcctcggctcctcgcccgacttcaacagccagtttggcctcgtggacatccctgtggaggtcctgctcctggacttctgcctggcgctcctggccgaccgcgtcctgcagttcttcctggggaccccgaagctgaaagtgccttcctgagatggcagtgctggtacccactgcccaccctggctgccgctgggcgggaaccccaacagggccccgggagggaaccctgcccccaaccccccacagcaaggctgtacagtctcgcccttggaagactgagctgggacccccacagccatccgctggcttggccagcagaaccagccccaagccagcacctttggtaaataaagcagcatctgagattttaaaaa

SEQ ID NO: 343762 - DNA, 789 bp, Homo sapiens
agggtggccccaagtgagccagatcctgactcccccacccgccttgctgctgcagcccctcaagaccctctcccgagaacggcccctgcccaacatcttcaacctgtacaccatcctcaccgtcatgctccagttctttgtgcacttcctgagccttgtctacctgtaccgtgaggcccaggcccggagccccgagaagcaggagcagttcgtggacttgtacaaggagtttgagccaagcctggtcaacagcaccgtctacatcatggccatggccatgcagatggccaccttcgccatcaattacaaaggcccgcccttcatggagagcctgcccgagaacaagcccctggtgtggagtctggcagtttcactcctggccatcattggcctgctcctcggctcctcgcccgacttcaacagccagtttggcctcgtggacatccctgtggagttcaagctggtcattgcccaggtcctgctcctggacttctgcctggcgctcctggccgaccgcgtcctgcagttcttcctggggaccccgaagctgaaagtgccttcctgagatggcagtgctggtacccactgcccaccctggctgccgctgggcgggaaccccaacagggccccgggagggaaccctgcccccaaccccccacagcaaggctgtacagtctcgcccttggaagactgagctgggacccccacagccatccgctggcttggccagcagaaccagccccaagccagcacctttggtaaataaagcagcatctgagattttaaaaa

SEQ ID NO: 343763 - DNA, 2955 bp, Homo sapiens
gaagctcccgaccccgcctccgcagggtccaggcttcgcccctggtgacaggtggtgctggtgtagtcaaggaggagggctcgctttttttggttcaggttgtcatggtggcgcccaagcccgccttgccggccttgtcttttccggtctcagtccggcgtggcagcggaggcaggcaccgttaggtcttccagtccctctctgtcatggcgacgcccagcctcttcttccggccacagcctgtcatggcggcacccgaagtagtccctgccggggccagcctgttctgttgccctggctcttcctagtccaggctgccatggcggcgctcagggcttaccggaagtaaaacttcggaagtgaggcgttcctctgcccggaagtgagcgcggcgctaggaaagatggcggcagcggcggcggtgggcaacgcggtgccctgcggggcccggccttgcggggtccggcctgacgggcagcccaagcccgggccgcagccgcgcgcgctccttgccgccgggccggcgctcatagcgaacggtgacgagctggtggctgccgtgtggccgtaccggcggttggcgctgttgcggcgcctcacggtgctgccattcgccgggctgctttacccggcctggttgggtgccgcagccgctggctgctggggctggggcagcagttgggtgcagatccccgaagctgcgctgctcgtgcttgccaccatctgcctcgcgcacgcgctcactgtcctctcggggcattggtctgtgcacgcgcattgcgcgctcacctgcaccccggagtacgaccccagcaaagcgacctttgtgaaggtggtgccaacccccaacaatggctccacggagctcgtggccctgcaccgcaatgagggcgaagacgggcttgaggtgctgtccttcgaattccagaagatcaagtattcctacgatgccctggagaagaagcagtttctccccgtggcctttcctgtgggaaacgccttctcatactatcagagcaacagaggcttccaggaagactcagagatccgagcagctgagaagaaatttgggagcaacaaggccgagatggtggtgcctgacttctcggagcttttcaaggagagagccacagcccccttctttgtatttcaggtgttctgtgtggggctctggtgcctggatgagtactggtactacagcgtctttacgctatccatgctggtggcgttcgaggcctcgctggtgcagcagcagatgcggaacatgtcggagatccggaagatgggcaacaagccccacatgatccaggtctaccgaagccgcaagtggaggcccattgccagtgatgagatcgtaccaggggacatcgtctccatcggccgctccccacaggagaacctggtgccatgtgacgtgcttctgctgcgaggccgctgcatcgtagacgaggccatgctcacgggggagtccgtgccacagatgaaggagcccatcgaagacctcagcccagaccgggtgctggacctccaggctgattcccggctgcacgtcatcttcgggggcaccaaggtggtgcagcacatccccccacagaaagccaccacgggcctgaagccggttgacagcgggtgcgtggcctacgtcctgcggaccggattcaacacatcccagggcaagctgctgcgcaccatcctcttcggggtcaagagggtgactgcgaacaacctggagaccttcatcttcatcctcttcctcctggtgtttgccatcgctgcagctgcctatgtatggattgaaggtaccaaggaccccagccggaaccgctacaagctgtttctggagtgcaccctgatcctcacctcggtcgtgcctcctgagctgcccatcgagctgtccctggccgtcaacacctccctcatcgccctggccaagctctacatgtactgcacagagcccttccggatcccctttgctggcaaggtcgaggtgtgctgctttgacaagacggggacgttgaccagtgacagcctggtggtgcgcggtgtggccgggctgagagacgggaaggaggtgaccccagtgtccagcatccctgtagaaacacaccgggccctggcctcgtgccactcgctcatgcagctggacgacggcaccctcgtgggtgaccctctagagaaggccatgctgacggccgtggactggacgctgaccaaagatgagaaagtattcccccgaagtattaaaactcaggggctgaaaattcaccagcgctttcattttgccagtgccctgaagcgaatgtccgtgcttgcctcgtatgagaagctgggctccaccgacctctgctacatcgcggccgtgaagggggcccccgaaactctgcactccatgttctcccagtgcccgcccgactaccaccacatccacaccgagatctcccgggaaggagcccgcgtcctggcgctggggtacaaggagctgggacacctcactcaccagcaggcccgggaggtcaagcgggaggccctggagtgcagcctcaagttcgtcggcttcattgtggtctcctgcccgctcaaggctgactccaaggccgtgatccgggagatccagaatgcgtcccaccgggtggtcatgatcacgggagacaacccgctcactgcatgccacgtggccgaccgcgtcctgcagttcttcctggggaccccgaagctgaaagtgccttcctgagatggcagtgctggtacccactgcccaccctggctgccgctgggcgggaaccccaacagggccccgggagggaaccctgcccccaaccccccacagcaaggctgtacagtctcgcccttggaagactgagctgggacccccacagccatccgctggcttggccagcagaaccagccccaagccagcacctttggtaaataaagcagcatctgagattttaaaaa

SEQ ID NO: 343764 - DNA, 234 bp, Homo sapiens
ctctcataaatttcatggcaacaggaactgagtggctttgaaactccagctgctggtgggctcgatatgaggtctgttccaaaacctggaacatttgcttttcctatcgtcagccccaagtgctactcagacttggtgtctggaggagatgggccagagtcctgggggccagtgccagtccttctctgccctcagctggcacatcttggggagactttctttggatattccctg

SEQ ID NO: 343765 - DNA, 321 bp, Homo sapiens
gaacactaatttgttgtagtcaaattatttgaaaatgtactattattataaaacaaatagtttaattaaaagaatggttaattcaaatacttcatttcctgaccatgtcgtatgtctgaacttaatatacacaaaaatgtgaagaaaaagatttagggagcaacagagtaaatcaaaaggattgcacagaggtttttaagatttactttcaaaagctagttccctcaagtgttagtttataaaccattaactatttgacaggttggagacaatcacacctggaacccgaatctagacatataaagaacagatacattctat

SEQ ID NO: 343766 - DNA, 206 bp, Homo sapiens
gggaactaaggcgtggaacttaggtttttgatcagtgtaggatttaatgtctttcactaaaaaggacaaaagtacaacccctgttggctccgagtctcccaagcagcagccctgtttctcactccttctcgaaagtgcagtgtgcactcccccgccatccccgcctctgccccttctgctctcgccctggcctctgtgcccactgt

SEQ ID NO: 343767 - DNA, 601 bp, Homo sapiens
aaaaaaaaaaaacactgggctcaagcagtctgcctgcctcagcttcccaaggagctgggattataggtgtgagccaccacacccagccaattttttttaaattaaaaaataaatctagcatagctctggaaatgatcaaatgtgtagggaagaaaatgcacatgtgtaaatgtgtccatttattttaattctaatgctaggctaaatgctttattatgcatgttatgatttaatccttatgacaactcttcaatattatttctctcatttttttgaggaaacaggagtgtcaactttatgcattctcatggctagtacatggcagctgaaattcaaaaccaagtctgtttcactcatttattcattgagtaaatttttaactgaaattcctctgctctttcaaccataatgcgttatcaatttggaggaattttttttttcatgtttatgcaaagcttcgtaacaacaataagagacttggggcacacaaagacaaaggtacatccacaaaagtagaacattggatacttagcatattaggtgtagcttaatgtagtctggatatgattaggcttaatctgtgtacatctttacttaccag

SEQ ID NO: 343768 - DNA, 359 bp, Homo sapiens
ccctctggcattgtgcacacccactggaagtgggctgttcttgcatttcacacaaaggcagcatatgggctagtgaagatactcggaaattcagtgatagcatccccagtttacagttgaagaaattgaactttgaacctaagagagtttgccaacttgcccagcccagatagtaaagtgatgaaagtggggtggaagccaagacctgccagaagtccaaaatctgtgttctttctgctgcctattttcctctctgaagtggaattttcccctacttaacctcaatgtgaaagcactgggtatccacctccaataccatactctaacttggagtaaattatttgtttatatctctacta

SEQ ID NO: 343769 - DNA, 484 bp, Homo sapiens
caggttatatatttctaggaatttattcatttcttctaggttatccaattttttggcatataatttttcattatggtctcatgatcctttatatttctgtggttatcagttgtaatgccttctctttcatttctagttttacttcagtcttgtctattttaatcttaagtagtctggctaaaggtttttgttggtttatcttttcatacaaccaacattcagtttcatcgatcttttctattgtcttcctagtctctcatttatttctgctgcgatctttattattatttccttccttgtactgactttgggcttagtttctttttccttctactgactttgggcttagctgctgctttttctagtaacttgaggtgtaacattaagctggtataagatctttcctactcacccttgctctctttggtttccatttacgtggaatgtcttttcccatctttttactttcgggctacatgcattc

SEQ ID NO: 343770 - DNA, 605 bp, Homo sapiens
tggggaccacagaagtaggcgagaccgggagaccctggtgggctgggccatcaccagagtcacagggttgaaagggaatgactgagctatgattcagcatttcccaaactactgttagacgttcaggggaaaagggaaacacagagtgaatctctctaatccctggctagtactgagaaggaattccctgttgtcctgaggctgaagctttgagggtgacgtgctgctctcatatccactctttcttggagggccaagatgcatcaggctgagatggtttcttcccactccactgctccatgggcatccccattaaaacaatgggttggtccaagagggagacacttgttcaccaacctatttggtcaagaatgtgaggccaggcacggtggctcacacctgtaaccctagcactttgggaggccaaggcgggtggatcacctgaagtcaggagttcgagaccagcctggccaacatggtgaaacccggtactgatctataggagtggtgcaccactcctatagatcagtattactatttccctccttcacagatgaggaaactgaagcagggaaaagttaaacaatttgcccaaagttacacaa

SEQ ID NO: 343771 - DNA, 586 bp, Homo sapiens
caggcatttatcagctacccctacaataattttaaatgattttaaattatgtcaacaagttggtaacataatttaataaattcttgagcatttcaagaaacttaatattactgatgaatagaaagatgacctttgctcccataacaaacagaaagcaggttattcatatttagaagcaatttatttggacatttaatatcatatgtataacaacacaatttaacttttccttagatgttaaaataagaagtatacatttgaaaattttagatttaataaggtttctcctacactgccagtttaaaaactgcaacccagatatatttatgagaattctttcatgatttcacactgttatttttctgatacttcaaattttcagttctcacaagttccttgggaagccaaacaactcatcataaatttagctcatattttagctcacaatgcagtcagcaaattctataaattttttaatctaaattactattaagttttatttactttgtacactgatagaattgagttaaatttgttttattatgttaaaatctattcttaaacccatcaattcaagtgatagata

SEQ ID NO: 343772 - DNA, 457 bp, Homo sapiens
tcctggctgcatgggtctctcaacttcgctcaccactatgagagccgctccaccccttctccagttccaggtctgggaaggagagagcagacaagcttgctcatgatggagtccttttacctggtttctctctctgttcacagataccacctctgttgatctgggaactaagaccatgttgcttgtccttagtcacatatgacttaatttgcacccatggtgggccactggtgtcagacaggaagcctaagcgcaggtatcactgaggaggatacacatgctaactacacgatcttcaccagacctgtgagcttccagccaccagatccaaagtcacagagcacagggacttacaaacccagtgctggaaaacatagcaaaggctatatccaatttaggtttctctttattggaaataaagatggcccatacttcaaatatgttatttagagaatgc
